United States Patent 11,931,406 (FLAVIVIRUS VACCINE) - sequence listing, part 67

SEQ ID NO: 23371 - RNA, 9873 nt, Artificial Sequence
  derived and/or modified CDS sequence (opt6) from DENV-3__FJ478456__SS-prME
acaaguuuaugucugaugaugauacuaccagcagcucuagcauuucauuuaacaucgcgagauggggaaccaagaaugauagucggcaaaaacgaaagagguaaaagucuuuuauucaaaacagcaucggggauaaacaugugcacgcugauugcaauggauuugggagaaaugugugaugauacgguuacauacaaauguccacacauugcagaaguagaaccagaagauauugacugcugguguaacuuaacaucuacguggguaaccuaugggacuugcaaccaagccggugaacaccgaagagacaaaagaucaguggcacuagcuccccauguugggaugggauuagacacucgaacacaaacuuggaugagcgcagagggugcauggagacaaguugaaaaaguugagacgugggcucuacgucauccaggauucaccauauuagcauuguuccuugcucacuauauaggaacaagccuaacacaaaaaguugugauuuucauacuauuaauguugguuacuccgaguaugacgaugagaugcgugggagucggaaacagagacuucgucgaaggauuauccggagccaccuggguagaugucguacuagagcauggaggauguguaacuacaauggccaaaaauaaaccaacauuagauauagaacuacagaaaacugaagcuacucaacuugcaacuuugagaaaacuaugcauagaaggaaaaauaacgaauauaaccaccgauucuagaugccccacgcaaggggaagcaguucuaccagaagaacaagaucaaaacuauguuuguaaacacacguauguugaucggggauggggaaacggaugcgguuuauuuggaaaaggaucuuuaguuacaugcgcgaaauuucagugucuagaaccaauagaaggcaaaguaguucaauaugagaaucuaaaauauacggucaucauaacugugcauaccggugaucagcaucaagugggaaacgaaacgcagggcguaacagcggagauuacaccucaggcuuccacuacagaagcuauucuaccagaguacggcacuuuaggauuagaauguucgccucggacgggccuggauuuuaacgaaaugaucuuacuaacuaugaaaaacaaggcuuggaugguacauagacagugguucuuugaccuaccauuaccuuggacuuccggcgcaacgacagaaacaccaacauggaaucgaaaagaauugcuaguuaccuuuaaaaaugcucaugcgaagaaacaggaagugguugugcuaggaucucaagaaggagcgaugcacacggcauuaacaggagcuacugagauacaaaacucuggaggaacauccauauuugcuggucauuuaaaaugccgauugaaaauggauaaauuagaguuaaaagguaugucuuacgcaaugugcacaaauacauucguccuuaagaaagagguuucagaaacucaacauggaacaauacugauaaaaguagaguauaaaggugaagacguaccaugcaaaauaccuuuuaguacugaagauggccaggguaaagcccacaacggcaggcuaauaacagcaaauccugugguuacuaagaaagaagaaccagucaauauugaagcugaaccuccauucggugaaucaaauauagugauaggaauaggugauaaugcacuuaaaaucaauugguauaagaaaggcaguaguauagggaaaauguucgaagcuacagccagaggagcucgaagaauggcaauacugggagauacugcaugggacuuugggucaguagguggugugcucaauagccugggaaaaaugguacaccaaaucuucgggagcgcauacacugcacuguuuaguggaguuuccuggguaaugaaaauagguauagguguauuauuaacauggauuggcuuaaacagcaaaaauaccaguauguccuuuucaugcauugcaauagguauaaucaccuuguacuuaggagcuguuguacaggcggauacgggauguguaauaaauuggaaaggaaaagaauuaaaauguggauccggaauauucguuacgaaugaaguucauacuuggacagaacaauacaaauuucaagcagauucuccaaaaagauuagcuacggccaucgcuggcgcuugggaaaacgggguuugugggauuagaagcacuacccgcauggagaaccuacuuuggaaacaaaucgccaaugaacugaauuacauccucugggaaaacaauauuaaauuaacaguaguugugggugauauuauaggagucuuagagcaggggaaaagaacauuaacuccucaacccauggaacucaaauauucauggaaaacguggggaaaagcuaaaauuguuacagcugagacacaaaauaguagcuuuauuauugacggcccuaauacaccagaaugcccaucagcauccagagcauggaaugugugggagguagaagacuauggguucgguguauuuacaaccaauauuugguuaaaacuuagagagguuuacacacaacucugugaucauagauuaaugucggcagcaguaaaagacgaacgcgcaguucaugcagacaugggguacuggauugagucucagaaaaacggcucauggaaacuagagaaagcgucgcuuauagagguaaaaaccugcacauggccaaagagucauacacuauggaguaauggaguucuugaauccgauaugauuaucccaaaaagucuagcaggaccaaucucgcaacauaauuauagaccaggguaucacacacaaacagcuggaccguggcauuuaggcaaacuagaauuagauuuuaacuacugugaaggaacgacaguggucauuacggaaaauugugggacgagaggaccgagccuaagaacgacaacagugucaggcaaguuaauacacgaaugguguuguagaagcuguacauuacccccucuaagauacaugggagaagaugggugcugguauggaauggagauccgcccaauaucagaaaaagaagaaaacaugguuaagagucugguaucggccgguagcggaaaaguugauaauuucacgauggguguccugugucuugcuaucuuauucgaggaagucaugagaggcaaauucggcaagaaacauaugauagcugguguauucuuuacauucguauuacucuuaucaggccaaauaacuuggagagauauggcacauacccuaauuaugauugguagcaaugcuucggacagaaugggaauggguguaacuuauuuggcauugauugcaacauucaaaauucaaccguuccuagcacuagguuucuuucugaggaaauuaacuucaagggaaaauuuacuacuuggagucggauuagcaauggcaacaacacuucaauugccagaggacauagaacaaauggcuaauggaauugcuuuggggcuaauggcauugaaacugauuacacaauuugaaacuuaucaacuauggacugcgcuaaucucauuaacauguaguaauaccauauuuacacuuacuguagcuuggagaaccgcaacuuugauucuugccgggguuagcauucugccagugugccaaaguucgucuaugcgaaaaucagacuggcuaccuaugacgguagcagcuauggguguaccaccacuuccccuauuuauauuuagccuuaaagauacacucaaaagaagaucauggccacugaaugaaggugugauggccguaggucucguuaguaucuuggccucuagucugcuacgaaaugacguuccuauggcaggaccccuugucgcaggagguuuacuuauagcaugcuacguuaucacaggcacaucagcugaucuaacuguagagaaggcagcugacguaaccugggaggaagaagcggaacaaacgggggucucacauaauuuaaugauuacaguugacgaugacggcacgaugcggauuaaagaugaugaaaccgagaacauucuaacaguacuguuaaagacagccuuacuaauaguaaguggcauuuuccccuacucaauaccggcuacucuauuaguguggcacacauggcagaaacaaacaaggcgaucuggcguccucugggauguaccaaguccacccgaaacacagaaagcagagcuugaagaagguguuuaucggauuaaacagcaagguauuuuuggaaaaacccaagugggagucggcguucaaaaggaaggaguauuccauacgauguggcacguuacaagaggugcagucuugacauacaaugguaagaggcuugaaccgaauugggccagugucaagaaagaucucauuucguacgggggcggcuggagacuuucggcccaguggcaaaaaggagaggaaguccaagucauugcugucgagccaggcaaaaaccccaaaaacuuccaaacaaugcccggaacguuucagacuacaacuggugaaauuggggcgauagcguuagacuucaagccuggaaccagcgggaguccgauaaucaaccgagaagguaaaguggugggucuauaugggaacgguguaguaacgaagaacggaggauauguaucggggauagcucagacuaacgcagagccugauggaccgaccccugaacuagaggaagaaauguucaagaaaagaaaccuuacaauaauggauuuacauccgggaucaggaaaaacucggaaauacuuaccggcaauagucagagaagcaauuaagcgacgucuuagaacgcugauuuuagccccaacuagaguaguugccgcugagauggaagaggcauuaaagggacuuccgauaagguaucaaacgacagccacaaaaucggaacauacaggaagggaaaucguagauuuaaugugccacgcgaccuucacaaugcgccugcuaucuccaguucgaguaccuaacuauaacuuaauaaucauggaugaagcacacuuuacagauccagccaguaucgcagcaagaggauauauaucuacccgaguaggaaugggagaagcugccgcaauauucaugaccgcaacuccuccaggcacggccgaugcguuuccacagucuaacgccccgauccaggaugaagagagagauauaccggaacgaaguuggaacucugguaacgaguggauaacagacuuugcaggaaaaacaguaugguucguaccauccaucaaagcuggaaacgauauagcgaauugucucaggaaaaacgguaagaaaguaauacaguugucaagaaaaacauucgauacggaguaucagaaaacaaaacucaacgauugggauuucgugguaacaacagauauauccgaaaugggagcuaacuucaaagccgauagaguaauugacccaagaagauguuuaaaaccggugauacucacagacgggccugaaagagugauauuagcugguccaaugccaguaacagcagcaucagcggcacagagacguggccggguuggcagaaauccucaaaaagagaacgaucaauauauuuuuacuggacagccacuaaauaaugaugaagaucaugcacacuggaccgaagcuaaaauguuguuagauaauauuaacacgccagaaggaauaaucccugcuuuguuugaaccugaaagggagaaaagcgcggcaauugauggugaauauagguuaaaaggggaaucuagaaaaacauuugucgaguuaaugagaaggggagaucuaccuguaugguuagcccacaaaguagcaagcgagggaaucaaauauacugaccgaaaauggugcuuugacggccagagaaauaaccagauacuggaagaaaacauggacguugagaucuggaccaaagaaggagagaaaaagaaauuacgaccacguuggcuugacgcccguacguacucugauccccuggcauuaaaagaauuuaaagacuucgcugcuggacgaaaaagcaucgcacuagaccuggugacagaaauagggcgaguaccuucacacuuagcacaucggaccaggaaugcccucgauaacuuagugauguuacauacaagugaacacggcggaaaagccuaucgucacgcgguagaagaauugccagagacaauggaaacucuccuacuauugggcuugaugauucuucucaccggaggggcuaugcuauuccuaauaagugggaaaggaauagggaagacuagcauuggauuaauuugcguaauugcuaguucugggauguuguggauggcggaaauaccccuccaguggauagcgucugcaauuguucucgaguucuuuaugaugguacuuuuaauuccggaaccagaaaaacagagaacaccucaggauaaucaacuagccuacgucgugauagguauucuuacgcuggcugcaauuaucgcugcaaacgaaaugggucuuuuagaaacuacaaaaagggacuuaggcaugagcaaagagcccggaguaguaucacccaccagcuaccuagacguagaucuucauccggcgagcgcauggacccuauaugcuguagcaacgacaguaauaaccccuauguuacggcauacaauagaaaauagcacggcgaaugugagccuggcagcuauagcuaaccaagcggugguccuaaugggccuagauaaaggauggccgauuuccaaaauggauuuagggguaccacuauuggcccuuggguguuauagccaaguaaauccccuaacacuuacugcugcggucuuacuguuaauaacacauuacgccauaauaggaccugggcuccaagcaaaagcaacaagagaagcacaaaaacgcacagcggcugguauuaugaaaaacccaaccgucgacgggauaaugacgauugauuuagacccggugauuuaugacagcaaauuugaaaagcaauuaggacagguuaugcuucuaguucugugcgcggugcaacuucuacuaaugagaacuucaugggcauugugugaagcacuuacuuuggcaacagguccaauaaccacacuaugggaagguucaccaggcaaauuuuggaauacaaccauugcagugucgauggcuaauauauucagaggaucauaucuggccggagcagguuuagccuucuccaucaugaagaguguaggaacaggaaaaaggggaacagguucucagggggaaacauugggagagaaauggaagaagaaacugaaucaacuaucaagaaaggaauuugacuuauauaagaaaucagggauuacggaaguggaucguacagaagcaaaagaagggcuuaagaggggugaaaucacacaucacgcuguaucacgagguucagccaaacuacaaugguuuguggaacgaaacaugguuauuccggaaggaagagucauugaccucggauguggccgagguggauggaguuauuacugcgcaggacugaagaaagucacugagguucgagguuauacgaaagggggcccgggacaugaggaaccuguacccaugucaacuuauggauggaauaucgugaaacuuaugagcggaaaagauguauucuaccuaccuccugaaaaaugugauacguuguuaugcgauauaggagagucaucaccuucgccaacaguagaagaaagcagaacaauaagaguacugaaaaugguggaaccauggcucaaaaacaaucaauucuguauaaagguucuaaacccauauaugccuacggugauugaacaucuugagcgccuccaaaggaaacauggcggcauguuaguuagaaacccacuaucuagaaauucgacgcacgaaauguacuggauauccaaugguacugguaauauaguagcgucaguuaauaugguguccagacuccuccucaaccgauuuaccaugacgcauaggagaccuacuauagaaaaagauguugauuuaggagcagggacgaggcauguuaaugcugaaccagaaacaccaaacauggauguaauuggugagcggauuaaacggauuaaagaagaacacaauuccacauggcacuaugaugacgaaaauccguauaaaaccugggccuaucauggaagcuacgaaguaaaagcaacggggucagccaguucaaugauaaacggaguugugaaacuacugacaaagccaugggacguuguuccgaugguaacacagauggccaugacagauaccacuccauuuggucaacagagaguuuucaaagaaaagguagauacaaggacgccgagaaguaugccaggaacaaggagaguuaugggcauaacugcagaauggcuauggagaaccuuaggaagaaacaaaaagccacgucuguguacaagagaagaauuuaccaagaaagucaggacaaaugcagccaugggugcaguuuuuacugaggaaaaucaaugggacucugccaaggcagccguugaagaugaagacuuuuggaaauuaguagaucgggaaagggagcugcacaaguuaggcaaaugugggucguguguuuacaacaugauggguaaaagggagaagaaacuaggugaauuuggaaaagcuaaaggcucuagggcuauuugguacauguggcuaggagcacgguaccuagaauuugaagcauuaggauuucugaaugaagaucacugguucucucgggaaaauagcuauuccgguguagaaggggaagguuugcauaaacugggauacauacucagagauauaucuaaaauucccggaggagcuauguacgcagaugauaccgcuggaugggacacccguaucacagaggaugaccuccacaacgaagagaaaauaacucaacagauggacccggaacaucgucaacuagcgaacgccauuuuuaaacuaacuuaucaaaauaaaguugucaaggugcagagaccaacacccaccgggacaguaauggauauuauaucacgaaaagaccagagaggaagcgggcaagucgguacuuauggccucaauaccuuuaccaacauggaagcacagcuaaucagacagauggagggggaaggaguauuaagcaaggcggaucucgaaaauccacacuuaagugagaagaaaauuacccaauggcuagaaacgaaagguguagaacgacugaaacguauggcgaucaguggagaugacuguguaguaaaaccaaucgacgaccgauucgcuaaugcacuauuagcuuuaaacgauauggguaagguacguaaagauauuccucaguggcagccuaguaaaggauggcacgacuggcagcaagucccauuuuguucccaccacuuucaugagcuaauuaugaaggauggucgcaaguugguggucccaugcagaccccaagaugaacuaauagguagagcuagaauaucucaaggcgcaggguggagucucagagaaacggccugucucgggaaagcauacgcgcaaauguggucgcugauguauuuccaccgacgagacuuaagacucgcaucaaaugcaauaugcucggcuguuccggugcacugggugccgacaucuagaacaaccugguccauacaugcucaccaccaauggaugacaacagaagacaugcuaacuguguggaauaggguguggaucgaagauaacccguggauggaggauaaaacccccgugacuacaugggaaaacguuccauacuuagggaaaagagaagaccaguggugcgggucuuugauaggauuaacaucgagagcuacaugggcucaaaauauaccgacugccauucagcaagucagaucguugauaggaaaugaagaauuuuuagauuauaugccaucaaugaaaagauuccgaaaagaagaagaaagugaaggugcgauaugguag

SEQ ID NO: 23372 - RNA, 9873 nt, Artificial Sequence
  derived and/or modified CDS sequence (opt6) from DENV-3__FJ547085__SS-prME
acuucacuaugcuugaugaugauacuaccugcagcacuggccuuucaucuaacaucuagagacggggaaccgcguaugauaguagguaaaaacgaaagaggaaaaucacuauuauuuaaaacugcuagcgguaucaauauguguacauuaauugccauggacuuaggugaaaugugugaugauacuguaacauacaaauguccgcacaucacagaaguagaaccugaagauauagacuguugguguaaucugaccuccacauggguaacuuaugguacuugcaaucaggcaggcgaacauagaagagacaaacguucaguugcacuggccccucacgugggaaugggucuagacacaagaacgcaaacauggaugucugcagaaggagcauggcgccaaguagaaaaaguggaaacuugggcacugaggcacccaggauuuacuauccucgcguuguucuuagcacacuacauaggaacgagucugacccagaaaguaguuauuuuuauauuacuuaugcuuguaacaccaucgaugacaaugcgaugcguaggaguggguaaucgcgacuucguugaaggguuaagcggcgcgacauggguagauguuguacuagaacacgggggcuguguaacuacgauggccaaaaauaaaccuacguuagauaucgaacuucagaaaacggaagcgacucaacuggcuacacuacgcaaacuaugcauagaagguaaaaucacuaauauuacuacagacucgagguguccuacacaaggggaagcaguccuuccugaagaacaagaucaaaacuauguaugcaaacauacguauguagauagagguuggggcaacggguguggguuauuuggcaaagguucgcuaguaacuugcgccaaauuccaaugucuugaaccaauugaaggaaaagucguucaguaugagaaucuaaaauacacaguuauuauaaccguacauacuggagaucaacaucaagucggaaaugaaacucaaggaguaacagccgaaauaaccccucaagcuaguaccacugaggcgauucuaccggaauacggcacacuggggcuagaguguaguccacgaacaggucuugauuuuaaugaaaugauucuucuaacuaugaaaaauaaagcauggaugguacacagacagugguuuuucgaucuacccuuaccauggacgaguggagccacaacagaaacuccaacuuggaauagaaaagagcuauuaguaacauuuaaaaacgcccacgccaagaaacaagagguaguggucuugggcagucaagaaggagccaugcauacggcgcucacuggagcuacugaaauacaaaacucagguggcacaaguauauuugcaggacaccuaaaaugcagacugaaaauggacaaauuagaguuaaaaggaaugucuuacgcuaugugcacuaauaccuucguacuaaagaaagaggugucagaaacgcagcacgguaccauccuaauaaaaguagaauauaaaggagaggacgugccaugcaaaauaccguuuucaacagaagaugggcaaggaaaagcacauaacggucgacuaauaacagcaaaccccguugugacgaagaaagaagaaccagugaacauagaagcagaaccacccuucggugaaucaaauaucguaauuggaauaggggacaaugcccugaaaaucaauugguauaagaaagggagcuccaucgggaaaauguucgaagcaacagcaaggggagcaaggagaauggcaauacucggcgacaccgcuugggauuucgguagcguaggugguguucucaauucccuaggaaaaaugguccaucaaauauuugguagcgcauauacagcacuuuucagcgguguaagcuggguuaugaaaauagggaucggaguacuacuuacuuggaucggacuuaacucuaaaaacacaucuaugucguucucguguaucgcaaucggaaucauaaccuuauacuugggagcgguaguucaagcagacacaggaugcguaauaaacuggaaagggaaagaauuaaaaugcgggaguggaaucuuugucacgaacgagguacacacauggaccgaacaguauaaauuccaagcagauucuccaaaaagacuugcuacggcgauagcuggagcuugggagaauggaguaugcggaauccgauccacgacuaggauggaaaaucuucuuuggaaacaaauagcgaacgaguuaaauuacauacuaugggagaauaauauaaaacuaacagucguugugggagacauuauagggguacuugaacagggcaagagaacacugacuccacaaccgauggaauugaaauauucauggaagacauggggcaaagcaagaauagucaccgcagaaacccaaaauucgagcuuuaucauagacgguccuaacaccccugaaugcccaaauacaagucgcgcauggaauguaugggaagucgaagacuauggauuugggguguuuacuacaaauauuuggcuuaaauugagagagguauacacucaacugugcgaucauagguuaaugucagccgcuguaaaggaugaacgagcaguacacgcagauaugggauauuggaucgaaucgcaaaagaacgguaguuggaagcuggaaaaggcaucccuaauugagguuaaaacuuguacauggccaaaaagucauacacuauggucuaacgguguuuuagagagcgauaugauuauacccaaaucauuagcaggaccaauaagccagcauaacuaucgcccuggguaccauacgcaaacugcuggcccauggcacuuaggcaagcucgaacuugacuucaauuacugcgaaggaacuaccguuguaauaacagagaauugcgguaccagaggaccuucacugaggacgacuacagucucaggcaaacugauucacgaauggugcuguagaucauguacgcugccgcccuuacgguauaugggugaagauggaugcugguacggaauggaaauacggcccaucucugaaaaagaagaaaacauggugaaaucauugguuucagcagguaguggagaggucgacaauuuuacgauggguguauuaugccuagcuauucuguuugaagaagucaugagaggaaaauuugggaagaaacauaugauagcagggguguucuuuaccuucguguuguuacuaagugggcaaauuacguggcgugacauggcucacacuuuaauuaugaucggcucgaacgcgacagaucgaauggggaugggcgugacguaucucgcauuaauagcgaccuuuaaaauucaaccauucuuagcauuaggcuucuuuuuaaggaaacuuaccagcagggaaaaccuacuacugggcguuggauuagccauggcaaccacccuacaacugccagaagauaucgaacaaauggcgaauggcauugccuuaggacuuauggcacuaaaacuuauaacgcaauucgaaaccuaucaacuauggacagcuuuaauuucuuuaacguguucuaauaccauuuucacacucacgguagcuuggagaacagcaacuuuaauacuggcuggugucaguuuauuaccagugugccaaucaucuucaaugagaaagacagacugguuaccgaugacaguagcagcaaugggcguuccaccgcuuccuuuauucauuuuuagucucaaagacacgcuaaaaaggagauccuggccacucaaugaggguguuauggcuguuggccucguuucgauacuagcgucgagucuuuuaagaaacgaugucccaauggcuggaccccuaguagcaggcgggcuccuuaucgcuuguuacguaauuacuggaacaucggcagacuuaacgguugagaaggcggcagaugugacuugggaagaggaagcugagcaaacaggcguuagccauaaucuaaugauaacaguggaugacgacggaaccaugagaauuaaagacgaugaaacagaaaauauauuaaccguauuauuaaaaacugccuuacuaaucguaaguggaaucuuuccauauaguauaccagcaacauuauuggucuggcauaccuggcagaagcaaacgcaaagaagcggcgugcucugggauguuccaucuccgccagagacgcagaaagcagaauuagaagagggggucuauagaauaaaacaacaaggcauuuuugguaaaacccaaguagggguaggaguccaaaaagaaggaguauuucauacaauguggcacguaacacgaggcgccguauuaacguauaauggaaagcggcuagagcccaauugggcaagcgugaaaaaggaccuuauaucguauggcggaggauggcgucuaucagcacaguggcaaaagggagaggagguucagguaauugccguggagccagguaaaaaccccaaaaacuuucagacuaugccuggaacauuucaaacuacaacaggugagauaggcgcaauagcacuggacuucaaaccugggacauccgguagucccaucauaaacagagagggaaaaguugugggccucuauggcaaugggguagugacuaaaaacggaggcuauguaucaggcauugcacaaacaaaugcagagccagacggaccaacaccagaacuagaagaagaaauguucaagaaacggaacuuaaccauuauggauuuacacccaggaucuggaaaaacuaggaaguaucuucccgcgauaguacgcgaagccauaaaaagacgacuacgaacgcuuauuuuagcacccacaaggguuguggcagcggaaauggaagaagcucuaaaagguuugccuauacguuaucaaacaacagcuacgaagucugaacauacaggaagagaaauagucgaucugaugugucaugcgacuuucaccaugaggcucuuaucgccuguaagagucccgaauuauaacuuaauaauaauggaugaagcccauuucacugacccugcgaguauugccgcucguggcuauauuaguacaagaguagguaugggugaagcggcagccaucuuuaugacagccacgccaccaggaacggcugaugcguucccucagagcaaugccccuauacaagaugaagaaagagacauaccggaaaggagcuggaauaguggaaaugaguggauaacggacuuugccggcaaaacaguuugguuuguuccuucaauuaaggccgggaaugauaucgcaaauuguuuaaggaaaaauggcaagaaaguaauacaguuaucuagaaagaccuuugacaccgaauaccagaaaacgaaguugaacgacugggauuucguagugacaacugauaucagugaaaugggagcaaacuucaaagcagauaggguaauagauccccggaggugccuuaagccuguuauucucacagacggaccggaaagaguuauucuugcagguccaaugccgguaacugccgcaucagcagcucaaagacgaggaagggugggacgaaauccucagaaagagaacgaucaauauauuuuuacuggacaaccguuaaauaaugaugaggaucaugcucacuggaccgaggcgaaaauguuacucgauaauauaaauacaccagaggguauaauaccugcacuauuugaaccagaaagggagaaaucggccgcaauagacggugaguauagguugaagggagaaaguagaaaaacauucguagagcugaugaggagaggggaucuuccaguaugguuagcgcacaaaguagccagugaagguauuaaguacacggacagaaaauggugcuucgacgggcaaagaaauaaccaaauacuagaagaaaacauggacguugagauuuggacgaaagaaggagagaagaagaaauuacgcccaaggugguuagaugcaagaacguauagugauccacuugcccuaaaggaguuuaaagauuuugcagcggggagaaaaucgaucgcacuagauuuaguaacagaaauaggacggguuccaacacauuuagcgcaccggaccagaaaugcucuagauaacuuggucaugcuacauacguccgaacacggcggcaaagccuacagacaugcuguagaagaguugccugaaacuauggaaacacuacugcuacuuggcuuaaugauuuuguugacaggaggagcaauguuauuuuuaaucaguggcaagggaauagguaaaacgucaaucggucuaauaugcguaauagcaagcagugggauguuauggauggcagaaauaccacuacaauggaucgccucggcuaucguauuggaauuuuucaugauggucuuacuaaucccggaaccugagaagcaaagaacaccucaggauaaucaauuagcauacgugguaauuggcauauuaacauuagcugcgauaauugcagcaaacgagauggggcuacuagagacaacaaaaagagauuuggggaugaguaaagaacccggugugguuucaccaacaaguuacuuggacgucgauuuacaccccgcaucggcauggacauuauacgcaguagcaacuacuguaauaacaccgauguuaagacauacaauugaaaauucuacagccaacguuuccuuagccgcaauagcgaaccaagcaguaguccugaugggucucgauaaaggauggcccaucagcaaaauggaccuagggguuccauuguuggcacuuggaugcuacucacaagugaacccauuaacgcugacagcugcuguguugcuacucauaacacacuacgcaauaaucggaccuggcuugcaggcaaaggcaacacgcgaggcacaaaaacguaccgcugcgggcaucaugaagaauccuacgguagauggaauuaugacaaucgauuuagaccccgucauauacgauucaaaauucgaaaaacaguugggccaaguaaugcucuuaguauuaugcgcagugcaauuauuguuaaugaggacaaguugggcacuuugcgaagcucucacuuuagcuacgggaccgauuaccacguuaugggaagguaguccagguaaauucuggaauacuacaauagcaguaucaauggcaaacauuuuccguggaucauaucuagccggugcgggcuuagcuuuuagcauuaugaaauccgucggcaccggaaaaagagguacuggaucgcagggagaaacauuaggggaaaaauggaaaaagaaacucaaucaauuauccagaaaagaguucgauuuauacaagaaaucaggaauaacugaaguagauagaacagaagcuaaagagggauuaaaaagaggggaaauuacucaucaugcgguaagccgaggaacugcuaaauuacagugguuuguugaacgaaacauggucauuccagaaggcagaguaauagaucuuggauguggucgaggaggauggucauauuauugugcagguuugaagaaagucacugaaguacgaggauacacaaaagggggaccgggucacgaagaaccagugccaaugucaacguauggauggaauaucguaaaacucaugucggggaaagacgucuuuuaccucccaccagaaaaaugcgacacucuguuaugugauauaggagaaaguucgccuuccccaacuguagaagaaucacggaccaucagaguacuuaaaaugguugaaccaugguuaaagaauaaccaauuuuguauaaagguacuuaacccuuauaugccagcaguuauagaacaucucgaacguuuacaaagaaaacauggagguauguuaguacgaaauccauugucgcgaaacagcacccaugaaauguauuggauuaguaacggaacugguaacauaguagcaucagugaacaugguaucaagauuauuacuaaacagauuuacgaugacccaucgcaggccuacuauagaaaaagauguugaucuaggugcggguacccgccacgucaacgccgagccugaaacaccaaacauggauguaaucggggagagaauuaaacgaauaaaggaagaacacaacucgacauggcauuaugaugaugaaaacccuuauaaaacuugggcauaucauggcucuuaugaagugaaagcaacuggaucggcgagcucaaugauuaacggagugguaaaauuauuaacaaaaccaugggaugucguaccuaugguuacgcaaauggccaugacagacacuacaccguucggacaacagcgcguguuuaaggagaaaguugacacgagaacgccgcguuccaugccgggcacaagacgaguaauggagauaaccgcggaauggcuauggagaacucuugguaggaauaagaaaccuagacuguguacgcgggaagaauuuaccaagaaagucagaacaaaugcagcaaugggcgcggucuucaccgaggagaaucaaugggauucggcgaaggcagcggucgaagacgaagacuuuuggaaauuaguggaccgagaacgugaguugcacaaacuuggcaaaugcggaaguuguguuuacaauaugaugggaaaacgagagaagaaacuaggugaauuuggaaaagcaaaaggcaguagggccauuugguacaugugguugggcgcaagauauuuagaauuugaagcauuagguuuucuuaaugaagaucacugguucuccagggaaaacaguuauaguggaguugagggagaagguuugcauaaauuggguuauauuuuaagagacauaagcaaaauucccggaggugcuauguaugcagaugauacugcuggaugggacacucgaauaacggaagaugacuuacacaaugaagagaaaauuacgcaacaaauggauccagagcauagacaauuagccaaugcaaucuuuaaacuuacauaucaaaacaaaguggugaaaguacaacgaccuacaccuacuggaacaguaauggauauuauaucucgaaaggaccaacgggguagcggacaagucggaacguauggucuaaauacuuuuacgaacauggaagcucaguuaauucgucaaauggagggagaagguguauuaucaaaagcugaccucgaaaauccccauuuacccgagaagaaaauaacgcaaugguuagaaacaaaaggagucgaaagacuaaagcgaauggcuauaaguggagacgauugcguuguaaagccaauagacgaccguuucgcaaaugcauuauuagcucuuaaugauaugggcaaaguucgaaaagacauaccucaauggcaaccuagcaagggauggcaugacuggcagcaaguaccauuuuguagccaccacuuccaugagcuaauaaugaaagaugggaggaaacuuguaguuccgugcagaccacaagaugaauuaauaggacgagcucgcauuagucaaggcgcaggcugguccuuaagggaaacagcuugucuuggaaaagcguaugcucaaauguggaguuuaauguacuuccauagacgagaucugcgacuugccaguaaugcuaucugcucggcgguaccaguucacuggguaccaaccagcagaacaacuuggucgauacaugcgcaccaccaauggaugacaacugaagacaugcucacagucuggaaccggguauggauugaagacaauccauggauggaagauaaaacuccaguuacuacgugggaaaauguaccauauuuaggcaagagagaagaucaauggugugguucccuaauuggacuuacaagccgggcuacaugggcccagaacauaccgacugccauacaacaaguuaggagucuuauuggcaaugaagaguuuuuggauuacaugccguccaugaaacguuuccgaaaagaagaagagagcgagggugcuaucugguaa

SEQ ID NO: 23373 - RNA, 9873 nt, Artificial Sequence
  derived and/or modified CDS sequence (opt6) from DENV-3__EU482595__SS-prME
acaucauuaugucugaugaugaugcuuccugcugcacuagcuuuucacuuaacaagucgggauggggaaccaaggaugauagucgggaaaaaugaacgaggaaaaaguuugcuuuuuaaaacggcaucaggaauaaauaugugcacgcugauagcuauggaccugggggaaaugugugaugacacuguuacauacaaaugcccacacaucacggaaguagaaccagaagauauugauuguuggugcaauuuaacgaguacauggguuacguaugguacaugcaaccaagcuggggaacacaggagagacaaaagaaguguagcgcuagcuccacauguaggaaugggccuggauacacgaacgcaaaccuggaugucggcagaaggggcauggaggcaaguugaaaaaguagaaacuugggcgcuucggcaucccggauuuacuauuuuagcacuauuuuuagcacauuaugucggaacaaguuuaacucaaaaagucgucauauuuauucuccugaugcuaguaacaccaaguaugacaaugagaugcguuggaguggguaaccgagacuuuguagaagguuugaguggagcuaccuggguugacgugguacuagaacacggcggaugugucaccaccauggccaaaaauaaaccuacgcuagacauagaguuacagaaaacugaggcaacacaauuagcaacucuacgcaaacuuuguauagaaggcaaaauuacaaauauuacuacagacagucgcuguccuacacaaggcgaagccguguuacccgaagaacaagaucaaaauuaugugugcaaacauacguacguugaucgaggguggggaaacgggugugggcucuuugguaaaggcagucuagugacaugugccaaauuucaaugccuagaaccaauugaaggaaaaguaguacaauaugaaaaucuaaaauauacaguaaucaucacuguacauacgggggaucaacaucagguagguaacgagacacaaggagugacggcugaaaucacaccacaggcuucuacaacagaagcgauacucccugaauaugguacauugggacucgaauguucaccaagaacuggucuugacuucaacgaaaugauauuauuaaccaugaaaaauaaagcauggaugguacaucgccagugguucuuugauuugccauuacccuggaccucuggggcaacuaccgaaacuccuaccuggaacaggaaagaacugcuagugacauuuaaaaaugcucacgcaaagaaacaggaaguuguaguucuagguagucaagagggagcuaugcacacagcacuaacgggagccacagaaauacaaaauagcggcggcacaucuauauucgcuggucauuugaaaugccgauuaaaaauggacaaauuagaacuuaaaggaaugucauaugcaaugugcacaaacacauuuguccucaagaaagaaguuuccgaaacacaacacgguaccauauuaauaaagguggaauauaaaggcgaagaugugccauguaaggugccauuuucaaccgaagauggacagggaaaagcgcauaacggacgauuaauaacggcaaauccaguugugaccaagaaagaggagccuguaaauauagaagcggaaccacccuucggugaaucaaacauuguaaucggaauuggagacaacgcacuaaagauuaauugguacaagaagggaucuuccauagggaaaauguuugaagcaacagcacgaggggcucgccguauggcuauucucggagacacagcuugggacuuugggagugucggcggugugcuaaauuccuuagggaaaaugguacaucaaauauuuggaagugccuauacugcuuuguuuuccgguguaucauggguuaugaaaauaggaauagguguauugcuaacguggauaggcuugaauaguaaaaacacuuccaugagcuucuccuguauuguuauaggcauuauuacuuuguaucuaggagcgguugugcaagcugauaugggaugugucauaaauuggaaaggaaaggagcucaaaugcggaucagguauauucguuacaaacgaagugcauacauggacugaacaauauaaguuucaagcugauucacccaaacgacuggcaaccgcaauagcuggagcaugggaaaacggagucuguggaauuaggaguacuacacguauggagaaccucuuguggaaacaaauugcaaaugaacuaaacuauauucuaugggagaauaacaucaaauugacuguagugguaggugacauuauagguguauuggaacaagguaagagaauccucacaccgcaaccaauggagcugaaauauagcuggaagacuugggguaaagcuaagaucguaacagcagaaacucagaacucaucauuuauuauugauggaccgaauacacccgaaugcccgagcgccagucgagcuuggaauguuugggaaguugaggauuacggcuuugguguauucuccacuaacauaugguuaaaauuaagagaaguauauacccaauuaugugaucaucgauuaauguccgccgccgucaaggaugaaagagcgguccacgcagauaugggguauuggauagagagccaaaagaacggaagcuggaaacucgaaaaagcaaguuuaauugagguaaagaccugcacuuggccaaaaagccacacacuauggaguaacggaguacuugagagcgauaugauuauaccaaagagcuuggcaggccccauaagccaacauaauuauaggccagguuaccauacccaaacagccgguccuuggcaccugggcaaauuagaacuagacuuuaauuacugcgaaggaacuacuguaguuauaacugagaauuguggcacuagagggcccucucugcgaacaacaacggugagcggaaaauuaauacacgaauggugcugucgguccuguacuuuaccaccacugagauauaugggagaagauggaugcugguauggcauggaaaucagaccaauuuccgaaaaggaagaaaauauggucaaaaguuuaguaucagcaggaucugguaaaguugauaacuucacaaugggaguguuaugucuggccauucuauucgaggaaguaaugcgaggaaaauuuggcaagaaacacaugauugccggaguauuuuucacauucguacuacuauugagcgggcagauuacauggcgcgauauggcucacacauugauuaugauagggucaaacgcuucugaccggauggguauggggguaacuuacuuagcucugaucgcaacauucaaaauucaacccuuucuagcuuuaggguucuuuuugagaaaacuaacuucucgagaaaaucuguuauuaggaguaggccuugcaauggcgacaacuuuacaacuaccugaggacaucgaacagauggcuaauggaauagccuugggacuaauggcuuuaaaacuuauuacacaauucgagacguaucaauuauggacggcauuaauaucauuaacaugcucaaacaccaucuuuaccuuaaccguagcauggagaacagcgacauuaauccuggcaggcguuagucuucuuccaguuugucaaaguuccucaaugagaaaaacugacugguuaccuaugacaguagcagcgaugggagugccaccacuuccucuauuuauauucucucucaaagauacgcuaaaacggaggucguggcccuuaaaugagggagugauggcagugggucuggucucuauucuugcaucuagccuucuaagaaaugauguaccaauggcagguccccuaguugcaggagggcuguugauugcuuguuacguaauuacuggcacaucagcggaccuuacaguagagaaagcagcugauguuacaugggaagaggaggcugaacaaacgggcguaagccauaaucucaugauaacgguggaugaugacggcacaaugagaauaaaagaugacgaaacggaaaacauucugacaguccuacuaaaaacagcacuucuaauugugucaggcauauuuccuuacagcauaccagccacacuauuaguguggcacacuuggcagaaacaaacacaaagaagugguguacuaugggauguaccuagucccccagagacucaaaaagcugaacuagaagaaggagucuacaggaucaaacaacaggguauuuuuggcaaaacacagguaggaguaggaguacaaaaagaaggaguauuucacacaauguggcauguuacuagaggugcgguuuuaaccuacaacgguaaaagacuugaaccaaauugggcuucaguaaagaaagacuugauuaguuaugggggaggguggcgauuaagcgcucaauggcaaaagggcgaagaagugcaaguaauugcuguugagcccgggaaaaaccccaaaaauuuucagaccaugccugguacauuccagacaacaacuggcgaaauaggcgcuauagcccuugauuucaaaccgggaaccaguggcagcccaaucauaaaccgcgaaggcaaaguuguaggauuauauggaaacgguguuguaacuaaaaaugggggauacguaagugguauagcacaaacaaacgcugaaccugacgguccugccccugaacuggaagaagaaauguuuaagaaaagaaauuugacuauaauggacuugcauccagguagcgggaaaacaagaaaauaccuuccagccaucguucgagaagcuauaaaacgaaggcuaagaacuuuaauccuagcucccacaagaguaguugccgccgaaauggaagaagcucuaaaaggucuuccgaucagauaucaaacaaccgcaacgaaaucugaacauacagggcgcgaaauugucgacuugaugugucacgcaacauucacaaugagauuauuaaguccaguuaggguaccaaauuacaauuugauaauaauggacgaagcgcauuuuacggauccagccuccaucgccgcgcgggguuauauaucaacacgaguagggaugggagaagccgcagcuauuuuuaugacagcaacaccgccuggcacagcagaugcauuuccucaaucgaacgcacccauacaagaugaagaaagggauauacccgaacguagcuggaacucuggcaaugaguggauaacggauuuugccggaaaaacugucugguucguuccaaguauuaaagcagggaacgauauagcgaauugccuuagaaagaaugguaagaaaguaauucaacuguccagaaaaacuuucgauacagaauaucagaaaacgaaacucaaugauugggauuucguaguaacaacagauaucucagagaugggagcgaauuuuaaagcagaucgagugauugacccaaggcgcugucuuaaaccuguaauauuaacagauggccccgaaagaguuauauuagcaggaccaaugccugucacggcggcuucugcggcacaaagaagaggucgcguggguagaaauccgcagaaagagaacgaccaauauaucuuuaccgggcaaccccuuaauaaugaugaagaccaugcucauuggaccgaagcaaaaaugcuuuuagauaacaucaacacuccugaagguauaauuccagcacucuuugaacccgaaagagaaaagucggccgcgauugauggagaauaccggcuaaaaggugaaagucguaaaacauuuguagaauugaugcggagaggagaccucccggugugguuggcacauaaaguagcgucagaagguauaaaguauaccgacagaaaaugguguuuugauggccagagaaacaaccaaauauuagaggaaaauauggacgucgaaauauggacgaaagagggugagaagaagaaacuaagaccucguugguuggaugcaaggacuuacagugauccucuugcacuuaaagaauuuaaagacuuugcagcagguaggaagaguaucgcccuggaccuggugacugaaauagggagagugccaucacauuuagcacauagaacucgaaacgcguuagauaacuugguuaugcuucacacaagugaacacgggggaaaagcauaucgucacgccgucgaagaacuuccugaaacaauggaaacuuugcuacuucucggccugaugauucugcucaccgguggagcgauguuauuccuaauuucugguaagggaauagguaaaaccucaauaggucuaauuugcguuaucgcaaguagcggaauguuauggauggcggaaauacccuuacaauggauagcuagcgcaauuguucucgaauuuuucaugaugguucuuuuaauccccgaaccugaaaaacaacguacgccucaagauaaccaauuagccuaugucguaauugguaucuuaacccucgcugcaauaauagccgcgaacgaaaugggacuucuagaaacaacaaagagagauuuaggaaugaguaaggagcccggugucguaaguccuacuucauaucuagacguugauuugcauccagcaucugcauggacauuauaugcuguggcaacgaccguaauaacccccauguuaagacauacgauagaaaacucaacggcaaauguuucacuggcugcaauugcaaaccaagcagugguacuaaugggcuuagacaaagguuggccgauuucgaaaauggaucuagggguaccacuacuagcauuaggguguuacucacaaguuaacccccuaacauuaacggcagcaguacuucuacuuauuacccacuaugccaucauagguccagggcugcaggcuaaagccacucgagaggcgcagaaaagaacagccgcagggauaaugaaaaaucccaccguugacggaaucaugacuauagacuuagauccggucauauaugauucaaaauuugagaaacagcucggacaagugaugcuauuggucuuaugcgccguccaauugcuacuaaugagaacaagcugggcccuuugcgaagcacuaacauuagcgacagggcccaucaccacuuugugggaagguucaccugguaaauuuuggaacacaacuauagcggugucgauggcaaacauauuccguggguccuaccucgccggcgcaggucuugcauuuucaauuaugaaaucuguuggaaccgguaaaagaggaacuggaagccagggagaaacauuaggugagaaauggaagaagaaacucaaucagcugucucguaaagaauuugaccucuacaaaaagagcggaauuacagaagucgaccgaaccgaagcaaaagaaggucuaaagaggggcgagauuacccaucacgccguuucacguggcagcgcuaaguuacaaugguuuguagaaaggaacauggucaucccugaaggcagaguaauugacuuaggaugugguagaggaggguggucuuauuacugcgccggauugaagaagguaacugagguacgaggcuauacaaaagggggcccugggcaugaggaaccagugccgaugucuacauacggauggaauaucgugaaacuuaugagcgggaaagauguauuuuacuuaccaccagaaaagugugauacuuuguugugugacaucggagagaguaguccaucaccuacagucgaagagagcagaacuauuagaguguuaaagaugguagagccuugguuaaagaacaaucaauucugcauuaaaguucuuaacccauauaugccgacugucauagaacacuuggaaagguuacaacggaaacaugggggaauguuaguuagaaacccgcuaaguagaaacagcacccaugaaauguacuggaucaguaacggaacaggaaacaucguagccucaguaaauaugguuucacgauuauuacuaaauagauucacaaugacccaucggcgaccaacaauugaaaaagacguagaucugggcgccgggacucgucaugugaacgcugagccagaaacgccuaauauggaugugauuggagagcgaauaaaaaggauuaaagaggaacauaauaguacauggcauuaugaugacgaaaauccuuacaagaccugggcguaucaugguaguuaugaaguaaaagcaacaggauccgcuaguagcaugaucaauggcguaguaaaacuucuuacaaaaccaugggacgucgugccgaugguaacucaaauggccaugacagauaccacccccuuuggacaacaaagggucuuuaaggaaaaaguugauacaagaacaccgaggaguaugccaggaacgagaagagucaugggcauaacagcugaaugguuauggagaacccuaggacguaauaagaaaccgcgguuaugcacuagagaagaguucacgaagaaaguaagaacaaacgcagcuaugggagccguauucaccgaggaaaaucaaugggauucagcaaaagcugcaguugaagaugaagauuuuuggauccuagucgauagagagagagaauugcauaaacuugggaaaugcggcucaugcguauauaacaugauggggaaaagagagaagaaacugggagaauuugguaaagcaaaaggcucucgagcuaucugguacauguggcuuggcgcaagguaccuagaguucgaggcacuuggauucuuaaaugaggaccauugguucucccgagaaaacucauauuccggaguagaaggagaaggucuccauaaauugggauauauccugagggacauuuccaaaauuccaggcggugcaauguacgcagaugacacggcuggcugggacacaaggaucaccgaagacgaccuacauaacgaggagaaaauaacacagcaaauggauccugagcauagacagcuggcuaaugccauuuucaaauuaacuuaucagaauaaagucguuaaaguacaacggcccacuccuacugguacaguaauggauauaauuucgagaaaggaccaacgcggaucgggccaaguggggacauacggauugaacacauuuacuaacauggaagcacaacuaauacgacaaauggaaggagaaggaguuuuaagcaaagccgaccucgaaaauccacauuuaccagagaagaaaauaacucaaugguuagagacaaaggguguggagcgauuaaaacggauggcuauuaguggagaugauuguguugucaaaccaaucgaugaucgauuugcgaaugcacugcuagcuuuaaacgacaugggaaaagugagaaaagacauaccgcaguggcaaccauccaaaggguggcacgacuggcaacaggugcccuuuuguagucaccacuuucaugagcugaucaugaaagaugggcgaaaauuaguaguaccuuguagaccacaagacgaauugauugggcgagcuagaauaagucaaggcgcgggauggucucugcgcgaaacugcguguuuaggaaaagcauacgcacaaauguggaguuuaauguauuuucauagaagagauuugcggcucgcuucgaacgcaauaugcagugcugucccaguacacugggucccaacgucaagaacaacauggucaauccaugcucaucaccaauggaugacgacugaagauaugcuaaccguauggaaccgaguauggauagaagacaaucccuggauggaagacaagacgccggugacaaccugggaaaaugucccuuaccuagguaaaagggaagaccaauggugcggaucuuuaauaggauugacuucccgagcaacaugggcacaaaacauaccuacggcaauacagcaaguacgaagucuaaucggaaaugaagaguuuuuagauuauaugccuuccaugaaacgcuucagaaaggaagaagagagcgaaggugccauuugguga

SEQ ID NO: 23374 - RNA, 9873 nt, Artificial Sequence
  derived and/or modified CDS sequence (opt6) from DENV-3__EU482596__SS-prME
acuucguugugucuaaugaugauauuaccugcagcucuagcauuucaucuaacaucuagagacggagaaccccgaaugaucguagguaaaaacgaaagaggaaaaucacuauuguuuaaaacggcaagcgggauuaauauguguacuuugauugcaauggauuugggagaaaugugugaugauacaguuacauauaaauguccucacauaaccgaaguugaaccugaagauauagauuguugguguaaucuuacuucaacguggguaacauaugggacguguaaucaagcaggggaacauaggcgagauaaaagaucaguugcacuagcaccucauguggggauggguuuagauacaagaacacagaccuggaugagugcggaaggagcuuggaggcaaguagaaaaaguggaaacaugggcacuaaggcauccuggcuucacaauacuugcgcuauuucuagcacauuauauugggacaucacucacacagaaagucguaauauucauauuacuaaugcuugugacuccgucgaugacgaugagguguguugguguaggaaacagagauuuugucgaaggguuaucgggggccaccugggucgaugugguauuagaacaugguggcuguguaaccacuauggcuaaaaacaaaccaacuuuagacaucgaauugcagaaaacugaagcaacgcaauuggcuacacuccgaaaacuauguaucgaagggaaaauuacaaacaucacuacugacaguaggugcccaacacaaggcgaagccguccuaccugaggaacaagaucaaaacuauguauguaaacauacguaugucgauagggguuggggaaacgguugugguuuguucggcaaaggaucccuaguuacgugcgcuaaauuucaaugcuuggaaccuaucgaagggaaagucguucaauacgaaaauuuaaaauacaccgucaucauaacaguccauacgggagaccaacaucaagucggaaaugaaacccagggaguaacagcagagauaacuccgcaggcguccacuaccgaagcaauucuaccagaauacggaacucugggacucgaauguucgccaaggacuggacuggacuuuaacgaaaugauauuauugacaaugaaaaacaaagcauggauggugcacagacaaugguucuuugaccuuccucugccuuggacgaguggagcaacaacugaaacuccuacuuggaaucguaaagagcucuuagugacauuuaaaaacgcgcacgcgaagaaacaagaagucgucguccuaggaucacaagaaggugcuaugcauacagcauuaacaggagcaacagaaauacaaaauucaggaggcacaucgauuuucgccggacaccuaaaaugcagacugaaaauggauaaauuagaacuaaagggaaugucuuaugcaaugugcacgaauacauucguccuaaagaaagagguuucagaaacacaacaugggacgauuuuaauaaaagucgaauacaaaggugaagacguaccaugcaagauaccuuuuucuacagaagaugggcaaggaaaagcucauaauggaagacuaauuacagcaaacccuguggucacuaagaaagaagaaccuguaaauaucgaagcagaaccaccuuuuggagaaaguaauauuguaaucggaauuggagacaaugcccuaaagauaaacugguauaagaaaggaucgaguauaggaaaaauguuugaggcuacagcacgaggagccagacgcauggcaauauuaggagauaccgccugggacuucgguagugugggagguguucuaaauucacuuggaaaaaugguacaucaaaucuuuggaagugcauacacagcauuguucucaggcgucaguuggguuaugaaaaucggcauugggguuuugcuaacauggauaggauuaaauucuaagaauaccucaaugucuuucaguugcauugcuauugggaucaucacuuuauaucuuggagcaguuguccaagcagauauggguugugugauuaauuggaaagggaaagaacuuaaauguggcuccgguauauuuguuacuaacgagguccacacauggacagaacaauauaaauuucaagcagacaguccaaaacgacuagcgacugcuauugcaggagcaugggagaacgguguauguggcauaaggucaacaacgcgaauggaaaacuuacuuuggaaacaaauagcaaaugaacuaaauuacauacuaugggaaaacaauauaaaauuaacgguagugguaggagauauuauuggaguucuagagcaagguaaacgcaccuugacaccgcaaccuauggagcucaaauacucuuggaaaaccuggggaaaagcaaaaauaguaacggcagagacccaaaacucaaguuuuauaauugacgguccaaauacgccugaguguccaagugcaagucgagcguggaacgugugggaaguugaagauuauggauuuggagucuuuacuacaaauaucuggcuaaaacuaagagaagucuauacucaguugugugaccaucgucucaugucagcagcaguaaaagaugaacgggccguucacgcugacaugggauauuggauagagucucagaaaaaugguaguuggaaauuggaaaaagccucguuaauagagguaaagaccuguacauggcccaaaagccauacguuauggucaaaugguguucuggaaucggacaugauuauuccaaagagcuuagcagguccaaucagccaacacaauuaccguccgggcuaucauacacaaaccgcaggucccuggcaucuaggcaaacucgaacuagacuuuaauuacugcgaaggaacaacuguuguaauaacagaaaacugugguacuaggggaccgucacuaagaacuacgacaguaucugguaaacuaauacacgaguggugcuguagaucuuguacguuaccaccacuuagauauaugggggaggacgguuguugguaugguauggaaauaagaccuauuucagaaaaagaagagaauaugguaaaaucccugguuucggcugggucugguaaaguagauaauuuuacaauggguguucucugccucgcaauucuuuuugaggaaguaaugagaggaaaguucgguaagaaacauaugauugccgguguauuuuucacauucguguugcuccuuuccggacaaauuacuuggagagauauggcccacacacuuaucaugauaggaucaaacgcauccgaucgaaugggaaugggggucacuuacuuagcccugauagcuacuuuuaagauucaaccauuccuugcuuuaggcuucuuuuugcggaaacucacuucacgggaaaaucuauuacucggagucggauuagcaauggcgaccacacuacaacuuccugaagauauugagcagauggccaaugggauagcguugggucuuauggcacuaaagcucauuacacaauuugaaacguaccaacuauggacagcgcuaauuucgcuaacauguucuaacacgauauuuacccuaacaguugcauggagaacggcaaccuuaauauuagccgguguaucacuucucccaguuugucagaguaguaguaugagaaagacagauugguuaccaaugacgguagcagcaauggguguaccuccccuuccacucuuuaucuucagucuaaaagacacucuaaagcggagaucuuggccacuaaaugaagggguaauggcaguuggacuuguaaguauacucgccucgagucucuuaagaaaugauguaccaauggccggaccgcugguugcuggaggucuacuaaucgccuguuauguaauuacaggaacaagugcggauuugacaguagagaaagcugcagauguaacuugggaagaagaagccgaacaaacagggguuagccacaaccucaugauaacugucgacgacgaugguacuaugcguauuaaagaugacgaaaccgaaaauauacuuacaguauuacuaaaaacugcguuguuaauuguauccggcauauuccccuauuccauccccgcgacucuguuaguauggcauacuuggcaaaaacaaacucaacguaguggcgugcucugggauguccccucaccgcccgaaacacagaaggccgaauuagaagaaggaguuuauagaaucaaacaacaaggaaucuuuggaaaaacgcaaguuggagucgguguacaaaaagaggggguuuuucacaccauguggcacguaacucguggugcgguuuugacuuacaacgggaagcgcuuagaacccaacugggcuagcguaaagaaagaccuaauuucauauggagguggauggcgguugagugcacaauggcaaaaaggggaagaagugcaagugauugcgguugaaccgggcaaaaacccuaaaaauuuucaaacaaugccuggaacauuccaaacaacaacaggggaaauaggagccauagcacuagacuucaagccugggacaaguggcucaccaauaauaaacagagaaggcaaaguaguagguuuauaugggaaugguguuguaaccaaaaauggcggauacguuucuggcauagcacaaacuaaugcggaaccugaugguccaacaccagaacucgaggaggagauguuuaagaaacggaaucuaacaaucauggaucuacauccuggaagcggaaaaacaagaaaauacuuacccgcaauaguucgagaagccauuaagcgcagacuaagaacguugauauuggcaccaacacgagucguugcagcggaaauggaagaagcacugaaaggauugcccauaagguaucagaccacagcaaccaagagcgaacauaccggacgcgagauuguagacuugaugugccaugccacguuuacaaugcguuuauuaucaccggugagggucccuaauuacaaucuuauaauuauggacgaagcccauuucaccgauccagcgucuauagcggcgcgggguuauaucucaacccgugucggaaugggugaggcggcugccauuuuuaugacugcuacgccacccgggacagcugaugcguucccucaaucaaacgcaccaauccaagaugaagaaagggacauaccugaaaggucguggaacucgggaaaugaauggauuacugauuuugcugggaaaacaguaugguuuguacccucuauuaaagcggggaaugacauugcgaauuguuuacgcaagaaugguaagaaaguaauucaguuaucgagaaaaaccuuugacacagaguaucagaaaacuaagcugaacgauugggauuuugugguuaccacugauaucucugagaugggggcgaauuuuaaagcugauagaguuauagauccuagaagaugucugaaacccgucauacuaacagauggaccugaaagggucauacuagcugggccuaugccuguaaccgcugcaagugcugcucaacgacgcgggagaguaggaagaaacccgcaaaaagaaaaugaucaauauauuuuuaccggacagccacuaaauaaugaugaagaccaugcacauuggacugaagccaaaauguuauuggacaauauaaauaccccggaaggcauaauuccggcgcuguuugagcccgaacgggaaaaaucagcagcaaucgauggagaauauagacugaaaggagaaucaaggaaaacauuuguagagcuaaugcgcagaggcgacuugccuguauggcuugcacacaaaguggcaucugaagggauaaaauauacugaucgcaaaugguguuuugauggucaaagaaauaaucaaauauuagaggagaacauggaugucgaaaucuggaccaaggaaggugagaagaagaaauuacguccucgauggcuagacgccagaacauauagugauccuuuagcucucaaagaguucaaagacuucgcggcuggacguaaaucuauagcgcucgaccuuguaacggagaucggacgaguaccaucucaucuagcacacagaacgcgaaaugcacuagauaaucucguaauguuacauacaagugaacaugggggcaaagcauaucgacaugccguagaggaauuaccagaaacuauggaaacccuccuauuacuuggucucaugauacugcuaacagggggugccaugcucuuucuaauaagcgguaaagguauagguaaaacuucuaucgggcuaaucuguguaauugcuucgucaggaauguuguggauggcggaaauaccacuacaauggauagccagcgcuauagucuuagaauuuuucaugaugguccuucuaauccccgaaccggaaaaacaacgaaccccucaagacaaucagcuugcuuacguuguaauugggauauugacguuagcugcaauuauagcagcgaaugaaaugggacuguuagaaacgacaaaacgggacuuaggaaugucaaaagaaccgggaguuguaucucccacaagcuauuuagacguagaucugcauccugcuucugccuggacucuuuaugcugucgcgacuacagugaucacucccauguuacgacacacaauagaaaauucuaccgcuaauguaucauuggcugcaaucgcuaaccaagccguaguacugauggguuuagacaaagguuggccgauuaguaaaauggaccuuggagucccgcuauuagccuugggaugcuauucccaaguaaacccauugacccuuaccgccgcaguauuguuauugauaacacauuaugcuaucauaggaccuggacugcaagcuaaagcaacacgugaggcucagaaaagaacagcagcugguauaaugaaaaaucccaccguagacgggauaaugacgauagauuuagauccaguaauuuaugacagcaaguuugaaaagcaguuagggcaaguuaugcuuuuaguguugugcgcaguccagcuccuucuaaugagaacuucaugggcauuaugugaagcucugacuuuagcaaccgggcccauaacuacacugugggaggguucaccaggaaaauuuuggaauacaacgaucgcgguaucuauggcaaauauuuuuagagguucguaucuggcaggagcaggguuagcauuuuccauuaugaaaagcguugguaccgguaaaagagguacagggagccaaggugaaacacuaggagaaaaauggaagaagaaacuaaaucaacuauccaggaaggaauuugaucuguauaagaaaucuggaaucacggaaguagaccgaacagaagcaaaagaaggguuaaagagaggagagauaacccaucaugccguaagucgagguucagccaagcugcaaugguucguugaaagaaauaugguuauuccugaaggaagaguaauugacuuagguuguggacgagggggcuggagcuacuacugugcaggcuugaagaaaguaacggaagucaggggauauacaaagggugguccaggucacgaggaaccaguucccauguccacauaugguuggaauauuguaaaauuaaugagcggaaaagaugucuucuacuuaccgccggagaagugugauacuuuacugugugauauaggagaaaguucaccuaguccaacggucgaagagaguagaaccaucagaguauuaaagaugguagaaccguggcuuaaaaauaaucaauuuuguauaaaaguucugaaucccuauaugccaacaguuaucgaacaucuugaaagguuacaaagaaaacauggggguauguuagugagaaauccuuuaucgagaaacuccacacacgagauguacuggauuucuaacggaacuggaaauauuguugcauccguuaacaugguaagucgauuauugcuaaaucgcuucaccaugacacaucgacguccuacaauagaaaaagacguggauuuaggagcugguacaagacauguaaacgcugagccugaaacacccaacauggacgucauaggagagagaaucaaaagaaucaaagaagaacacaacagcacauggcauuaugaugaugaaaacccuuauaaaacaugggcauaccaugggucauacgaagugaaagcuacuggcagcgcaucuuccaugauaaauggaguggucaaacuucugaccaaaccgugggaugugguuccuaugguaacacagauggcaaugacagacacaacacccuuuggacagcaacgaguauuuaaagaaaagguagauacgaggaccccgcgaaguaugccggggacccgcagaguuauggggauaaccgcugaauggcuauggcgaacacuuggucguaacaagaaaccacguuuauguacuagagaggaguucacuaagaaaguaagaacaaacgcugccaugggugcuguauucacagaggaaaaucaaugggauucagcaaaggcagcagucgaggaugaagauuuuuggaagcugguugaccgagaaagggaauuacacaaacuagguaaauguggaaguugcguauacaacaugaugggaaaaagagagaagaaacugggcgaguucggaaaagcgaagggauccagggccaucugguacauguggcuuggugcaagguaccuggaguucgaagcucuuggauuucuaaaugaggaucacugguuuucucgggagaacucuuauucaggaguagaaggugaaggguuacauaaacuuggguacauccuacgagacaucucgaaaauaccgggaggggcaauguacgcagacgauacggcggguugggacaccagaaucacugaagacgauuuacacaacgaggagaagauaacucagcaaauggauccagagcacagacaauuagcaaaugcaauuuucaaauuaacauaucagaacaaagucgucaaaguacaacgaccgacgccuaccggcacuguaauggauauaaucagucgcaaagaccaaagaggauccggacaaguagguacauaugggcuaaacacauuuacgaauauggaggcacaacuaauaagacagauggagggcgaaggaguauugaguaaggcugaucuagaaaacccccacuuaccggagaagaaaauuacgcaaugguuagaaaccaaagguguagaacgucuuaaacgaauggcuaucucaggggaugacugugugguaaaaccuauugacgaucgcuucgcaaacgcgcuguuagcacugaacgacaugggaaaagucagaaaggauauaccacaguggcagccuucgaaaggguggcaugacuggcagcagguacccuuuuguagccaccauuuccacgaacugauaaugaaagaugggagaaaauuggugguucccuguagaccacaagacgaacuaauagggcgugcgagaaucucccaaggagcugguuggucucuaagagaaacggcaugucuaggaaaggcuuaugcacagauguggucacuaauguauuuccacagaagagaucuaaggcuugcuucgaaugcgauuugcuccgcugucccaguacauuggguuccuaccagucgaacuacauggucaauacaugcucaccaucaauggaugacaaccgaagacauguuaacaguauggaauaggguuuggauagaagauaacccauggauggaggauaaaacucccguuacaaccugggagaacguuccguauuuaggaaaacgcgaagaucaguggugugggucgcucauuggacugacuagcagagcaacgugggcucaaaauauccccacugcuauucaacaaguuaggagucuuauaggaaacgaggaguucuuggauuacaugcccaguaugaagagauucaggaaagaggaggaaucagaaggcgccauaugguaa

SEQ ID NO: 23375 - RNA, 9873 nt, Artificial Sequence
  derived and/or modified CDS sequence (opt6) from DENV-3__JQ922554__SS-prME
acaucccugugucugaugaugaugcuaccugcuacuuuagcauuucauuugacaucaagagauggugaaccacgcaugauagucgguaaaaaugaacguggaaaaucacuccuauuuaaaacggcgucaggaauaaacaugugcacacuuauagcuauggaucuaggugaaaugugcgaugauacaguuacauauaaaugcccacacauaacagaauuagaaccagaagacauagauuguuggugcaaucuaacuagcacgugggugacauaugggacauguaaucaagcuggggaacaucgaagagauaaaagaaguguggcacuagcaccucauguagguaugggacucgacacaagaacgcaaacauggaugagugcugaaggugcuuggagacaaguggaaaaaguggaaacaugggcauuacgacauccagguuucacaauacuugcacucuuuuuagcacacuacauaggaaccagcuugacgcaaaaaguaguaauauuuauauuauuaauguuggugacuccgucgaugacgaugcguuguguaggaguggggaaccgcgacuuuguagagggccucagcggugcuacauggguggacguuguauuggaacauggcggcugcguaacuacuauggcuaaaaauaaaccaacucuugacauugaacuacagaaaacugaagcaacacaacuagcuacuuuaagaaagcuauguauagaaggaaaaaucacaaauauaacgacagacagucguuguccuacccaaggcgaagcgauccuacccgaagaacaagaucaaaauuacgugugcaaacacaccuauguagacagaggcuggggaaacggcugcggacucuuuggaaaaggaagucuaguaaccugugcaaaauuucaaugccuggaguccauugaaggcaaaguaguacaacaugaaaauuuaaaauauacagucaucauuacuguacacacaggagaucaacaucaagucgguaaugaaacccaaggaguuacagcggaaaucacaucacaggcaucaacagcagaagcuauacucccugaauacgggacccuaggguuagaauguuccccaagaacaggacuagauuuuaaugagaugauauugcugacaaugaaaaacaaagcguggaugguacaccgucaaugguucuuugauuuaccucuaccguggacgaguggagcgaccacaaaaacgccuacuuggaauaggaaagagcugcuugucacuuuuaaaaacgcucaugcgaagaaacaagaagugguaguucuaggaagucaagaaggugcaaugcauacggcucuaacaggcgcgacugaaauccagacuucuggaggaacuucaauuuucgcaggacauuuaaaaugcagguuaaaaauggacaaacuugaauugaaaggaaugucauaugccaugugucuaaauacuuuuguacuuaagaaagaagucagugaaacgcaacauggaacaauauugauuaaaguugaguauaaaggagaagacgcaccauguaaaauacccuuuucaacugaagacggacaagggaaggcacacaacggacgacugauuacggcaaaucccgugguuacgaaaaaggaggagcccgucaauauagaagcugagccacccuuuggugaaucaaacauaguaauagggauaggggacaaagcauuaaaaauaaauugguaccgcaaaggaaguucaaucggaaaaauguuugaagcgacagcaaggggcgcacguaggauggcaauucuaggggauacagcaugggauuuugggucggucggcgggguccuaaauucucuugggaaaaugguucaucaaauauuuggaagugcauauacggcacuauucaguggaguauccuggauuaugaaaauuggaauaggcgugcugcuuacguggaucggcuuaaauagcaaaaacacuucuauggcuuucaguuguauugcaauagguaucauuaccuuauacguagggguaguuguccaagcugacauggguugcguuauuaauuggaaagguaaagaacuaaaaugcggaagugguauuuucgugacaaaugaaguacacacauggacagaacaauacaaauuucaagccgacucaccaaaaagacuagcuacagcaauugcaggagcaugggagaacggcguaugcgguaucaggucuacaaccaggauggaaaaucuacuauggaaacaaaucgccaaugagcuaaauuauauucuaugggaaaacaacauuaaauuaacuguuguuguuggcgacauuaccgguguacuugagcagggagaaagaacacucacaccacaaccuauggaacuuaaguauucauggaaaacuuggggcaaggccaagauuguaacagcggaaacacaaaacucaucauuuauuauugacgguccaucaacaccugaaugcccaagugcuaguagagcauggaacguaugggaggucgaagacuauggauucggugucuucacuacuaacauuugguugaaauuaagagaaguguauacacaacuaugugaccacagauuaaugucugcugcgguaaaagaugagcgagccguccacgccgacaugggauauuggauugaaucacagaaaaauggcagcuggaaauuggaaaaagccagcuugauugagguuaaaacuugcacguggccgaagucucacacuuuauggucaaacggaguccucgaaagcgacaugaucauuccgaaaucccuugccgguccaauaucucaacauaaccauagaccgggcuaccacacacaaacagcaggacccuggcacuuagguaaacucgaguuggauuucaauuacugugaaggaacgacuguaguaauaucagaaaauugugguacuagaggaccuaguuuaagaaccaccaccguaucugguaaacuaauacaugagugguguuguagaagcuguacucugccaccauugagauacaugggcgaggacggauguugguauggaauggagauucgaccuaucaaugagaaagaggaaaacaugguuaagagucuggccagcgccggauccgguaaaguggauaauuucacuaugggaguucuaugccuagcuauucucuucgaagaaguaaugcgaggaaaguuccggaagaaacacaugauagcuggcguacuauucacauucguacugcuacuguccggacagauaaccuggcgugacauggcacacacgcuaauaaugauaggcuccaacgcaagcgaucgcauggguaugggaguaacuuauuuagcuuuaauagcgaccuuuaagauucaaccguuccucgcacucggguucuuuuuaagaaaauuaacuucacgagaaaaccuacuauuaggaguuggauuagcuauggcugcaacgcugagauugccagaagauauugaacaaauggccaaugggaucgcucuagggcucauggcuuuaaagcugauuacgcaauuugaaacuuaccagcucuggacagcccuuguuucacugacguguagcaauacuauauucacccucacaguagcguggagaacagccacccuaauauuggcggggaucagcuuauugccuguuugucaaaguucgaguaugcgaaaaacagauuggcuaccaaugacuguagcagcuauggggguuccaccccugccccuuuucauauuuagcuuaaaggacacucucaaacgcagaucauggccuuuaaacgaaggaguuauggcaguaggguuaguaagcauccuagcaucaucauuauuacguaaugauguaccaauggcuggaccgcuaguagccggugguuuauuaauagcgugcuacgucauuacgggaacuucagcugauuuaaccguagaaaaggccgcugacgugacaugggaggaagaagcugaacaaacuggaguaucacacaaucugaugauaacuguugacgaugauggaaccaugagaauuaaagaugacgaaacggaaaacaucuugacuguguugcuaaagacggcuuugcugaucguaaguggaauuuuuccauauucuauaccugcaacguuacugguauggcacacuuggcaaaaacaaacacaacgcucuggggugcuaugggacguaccgagcccaccagaaacucaaaaagcagagcuugaagaagguguauaccgaauaaaacaacagggaauuuucgggaagacgcagguagggguugguguccaaaaagaaggggucuuucauacuauguggcauguaacgaggggcgcugucuugacucauaacgggaaacgacuggaaccuaacugggccucugucaagaaagaccuuauuaguuaugggggagguuggagguuauccgcacaaugggccaaaggaggagaaacccaagugauagcuguagaaccuggcaaaaaucccaaaaacuuucaaaccaugccugguauuuuccaaacuaccacaggcgaaauaggcgcaauagcacuagauuucaagcccggaacaucuggcucccccauaauaaacagagaaggaaaaguaguaggucuauacggcaacggaguagucaccaaaaacgguggauauguaagugguauugcccaaacuaaugcggaauuggauggaccaacaccagaacuugaagaagaaauguuuaagaagcgaaauuugacuauuauggauuuacacccggguuccgguaaaacaaggaaauauuuaccugccaucguacgagaggcgauaaagcgacgauuaaggacacucauacuagcucccacucgagucgucgccgcagaaauggaggaagcacuaaaaggauuaccgauaagauaucaaacaacagcaacaaaauccgaacauaccggucgugaaauaguggauuugaugugucaugccacuuucaccaugagacuauugaguccuguaagaggcaguaacuauaaucuuaucauuauggaugaggcucauuucacggacccugcaucaaucgcagcaaucgguuacauaaguaccagagugggaaugggugaagcagcggcaauuuuuaugacagcuacaccaccaggaacaguagaugcguucccucaaucaauaccuccgauucaggacgaagaacgcgacaucccagaacgaaguuggaacucgggaaacgaguggauaacagacuucgugggaaaaacaguaugguucguuccuuccauuaaagcuggaaacgauaucgcaaacugucugcggaagaacggcaagaaaguuauacaauugagucgcaagacauucgacacugaauaucagaaaacuaaauuaaaugacugggauuuugugguaaccacugauaucucagaaaugggugcaaacuuuaaagccgaucggguaauauauuuaagaaggugcuuaaaaccaguuaucuugacuaauggaccagaacgggugaucuuagcaggaccuaugccaguuacagucgccagugccgcccaaaggcggggacgcgucggacguaauccccaaaaagagaacgaucaguauauauucaugggacaaccucuuaauaaugaugaagaccaugcacauuggacugaggcuaaaaugcuucuagauaacaucaacacaccagaagggauuauuccagcgcuuuuugaaccggaacgugaaaaauccgccgcaaucgauggagaguauagacuaaaaggugaaucaaggaagacguuuguugaguuaaugaggcgaggagaccuuccaguaugguuagcacauaaaguagcaucagaagguaucaaauacaccgauagaaaauggugcuuugacggugaaaggaauaaucaaauauuggaggaaaauauggauguagaaaucuggacuaaggagggagagaagaaaaauuggcgaccgagaugguuagaugccaggacauauagcgauccauuagcacugaaagaauuuaaagauuucgcggcagggcggaaauccauagcauuagauuuaguuaccgaaauaggaagaguaccgucacacuuagcacacaccguacgcaaugcauuggacaaccuugucauguuacauacuucagaacacgguggacgugcauauaggcacgccguugaggaacuuccagaaacaauggaaacuuuguugcuauugggacuuaugauacugcuaacaggaggugcaaugcuuuuucuaauuucagguaagggaauaggaaaaacuucaauuggauugauuugcguaauagcgucaucagguauguuauggauggcugacguaccguuacaguggauagcaagugcaauaguccuggaguucuuuaugaugguacuuuuaauuccagagccagagaaacaacgcacuccacaagauaaucaacucgccuauguaguaauuggcauauugacacuagcagccauuguugcagcuaacgaaauggggcuacucgaaacuacaaagcgcgauuuagguaugucaaaagaaccuggcgugguuagucccacaaguuacuuagacgucgacuugcaucccgcaagugcuuggacccuguaugcuguugcgacaccgguaauaacaccaaugcuuagacauacaaucgaaaauucaacagcaaauguuucacuagcugcgauugccaaucaagcuguagugcucaugggguuagauaaaggcuggccuauuucaaaaauggacuuaggcguaccuuuacuugcauuaggcugcuauucacaaguaaauccucugacauuagcggcagcuguacuucugcuagugacacauuaugcgauuauuggaccaggauugcaagcaaaggcuacucgugaggcacaaaaacggacagcagcuggaauaaugaaaaaccccacuguagaugggaucaugacaaucgaucuagauccuguaauauacgacucgaaguuugagaaacaauugggucaaguaauguuacuugugcuuugcgcgguucaauuacuacugaugcgaaccucauggccucucugcgaaguauuagcguuagcuacggguccaaucacaacauuaugggaaggauccccugggaaauucuggaauacaacgaucgcugucagcauggccaauauauuuagggguuccuauuuggcaggagcgggauuagcuuuuucaauuaugaaaagcguaggaacggguaaacgaggaacagguagccaaggagaaacacuuggggagaaguggaagaagaaauuaaaucaauugucucgcaaagaauuugauuuguauaagaaaagcgggauaacagaaguugaucguaccgaagcuaaagagggauugaaaagaggugaaauuacucaucacgcgguuagucguggaucggcaaaacugcaaugguucguagagagaaauaugguauuuccugagggaagagucauugaucugggaugcggaagagguggauggucguauuauugugccggacucaagaaaguuacagaagugcggggcuacacaaaaggcggcccuggacacgaagaacccgugccaaugaguacauauggauggaauauaguuaaacuaaugucgggaaaagauguuuucuauuuaccaccagaaaagugcgauacauuauuaugcgacauaggcgaaaguagcccgucaccgacuguggaagaaucucggacaauaagaguacuaaaaaugguagagcccugggugaaaaacaaccaguuuugcauaaaaguacuuaauccauauaugccauccgucauugagcaucuagaaaacuugcaaaggaaacauggaggaauccuaguaagaaauccacuuucccgaaauaguacucaugaaauguacuggauaagcaauggaacggguaacauuguaucuucaguuaauaugguaucuagacuccucuuaaacagauuuaccaugacacaucgaagaccaacgauugaaaaagacgucgacuuaggcgccggaacacgacaugugaaugccgaaccagagacuccaaacauggacguuauaggugaaagaauuaagagaauuaaagaagaacacucgucuaccuggcacuaugaugaugaaaaucccuacaaaacaugggcuuaucauggaaguuacgaaguuaaagcuaccgggucagcgucgucaaugauuaacggcgugguaaaauuacuaaccaaaccaugggacguaguccccaugguaacacaaauggcuaugacagacacaacuccauucggucaacaacgaguuuuuaaagagaaggucgauacacguacuccgcggcccaugccagguacgcgcaaaguaauggaaauuacagcagaaugguuauggagaacgcuaggacgaaacaaaagaccucgacuuugcacuagagaagaauuuacaaagaaaguacgaacaaacgcagcgaugggggcuguauuuacagaagaaaaucaaugggauucugccagagcagcgguggaagaugaagaauuuuggaaauugguagacagggaacgcgaacuacacaaauuaggaaaguguggaaguugcguauauaacaugaugggaaaacgggagaagaaacucggagaauuugguaaagcaaaagauucuagggcaauaugguacaugugguuaggcgcccguuaucuggaguucgaagcacuuggauucuuaaaugaagaccacugguucaguagagaaaacuccuacucaggaguggagggcgaaggccuacauaaacuaggauacauuuuacgagacauaucuaaaaucccugggggagcaauguaugcagaugauacagcggggugggauacacguauaaccgaagacgauuuacauaaugaggagaaaauuacucaacaaauggcgagagaacaucgccagcuagccaacgcuauuuucaaguugacauaucagaacaaggucguuaaaguacaaaggccaacuccaaaaggaacgguaauggauauuauuucacggaaagaccaaagagguagcggucagguuggcaccuacggacuuaacacauucacaaauauggaagcacaauuaauacgacaaauggagggggaaggaguguuaucaaaggcugauuuagagaauccacacccgcuugagaagaaaauaacgcaaugguuggaaaccaagggcgucgaaagauuaaagcguauggcgauaaguggcgaugacuguguggucaaaccaauagaugacagauucgccaaugcacuacuugcuuuaaacgacaugggaaaaguacgcaaagacauuccgcaauggcaaccauccaaaggauggcacgacuggcagcaaguuccuuuuugcucgcaucacuuucacgaacuaauaaugaaagacggacgaaaauugguuguaccgugcagaccacaagaugaguugcuaggaaaagcucggauaagccaaggagcggguuggagucuaagagaaacagccuguuuggguaaggcguacgcccaaauguggacuuugauguacuuucauagaagagaccuuagauuagcgaguaaugcaauaugcagugcaguaccaguacauuggguaccuacgucaaggacaacauggaguauacaugcccaccaccaauggaugacaacagaagauaugcuaacagucuggaauaggguguggauagaggauaaccccuggauggaagauaaaacacccguuaccaccugggaagacguccccuaccuggguaaaagggaggaccaauggugugguagccuaauuggauuaacaagcagagccacaugggcacaaaauauuuuaacggccauccaacaagugaggagccucauaggaaaugaagaguuucucgauuauaugccuucuaugaaacgguucagaaaagaagaagagucugaaggugcaauuugguaa

SEQ ID NO: 23376 - RNA, 9873 nt, Artificial Sequence
  derived and/or modified CDS sequence (opt6) from DENV-3__EU529683__SS-prME
acaucucucugucuuaugaugauccugcccgcugcuuuagcguuucacuuaacaucuagagacggggaaccgagaaugauagucggcaaaaacgaaagaggaaaaucuuuauuauuuaaaaccgcuucagguauaaauauguguacauugauugcaauggaccuaggcgaaaugugcgacgauacagucacauacaaauguccgcacauaacagaaguagaaccggaagacaucgauugcuggugcaaccuaacgucaacauggguuaccuaugggacaugcaaccaagccggugaacacagacgagauaaacgaaguguugcacuagcaccgcauguugggaugggacuagacacgaggacacaaacauggaugagcgccgaaggagcuuggaggcaaguagaaaaaguagaaacgugggcucuccgacacccaggguuuacaauccuugcauuauuuuuggcacauuauauagggacaagucuaacacaaaaagucguaaucuuuauccuguugauguuggugacaccuucaaugacaaugcgaugcguagggguagguaacagggauuuuguugaagggcuaucuggggcuacauggguugauguaguacuagaacaugggggcuguguaacaacgauggccaaaaauaaaccuacuuuagauauugaacuacagaaaacagaagcaacgcaacuagcaacguugcguaaauuauguauugaaggaaaaauaaccaacauaacgacagacucacgauguccuacccaaggcgaggcgguacuuccggaagaacaagaccaaaauuauguuugcaaacacaccuauguagaccggggaugggggaaugguugcggucuuuucggcaaagggucauuagugacaugcgcgaaauuccaaugccuagaacccauagaagggaaaguaguacaguaugagaaccuuaaauauacaguuauaauuacuguacacaccggagaccaacaccaagucggaaaugagacacaaggagucacggcugagauuacaccacaagcaucgacgaccgaagcuauuuugccagaauaugggacacucgguuuagaauguuccccuaggacuggcuuagacuuuaacgaaaugauucuguugacaaugaaaaacaaagcauggauggugcauagacagugguucuuugauuuaccacugccauggacauccggugccacgaccgaaaccccgacauggaauaggaaagaguuguuaguaaccuuuaaaaaugcgcaugcaaagaaacaagaagugguaguauuggguucccaagaaggagcuaugcacacggcccuuacaggugcuacagaaauccagaacucaggggguacuuccaucuucgcaggacaucugaaauguaggcuuaaaauggacaaacucgagcuaaaagggaugucuuacgcaaugugcaccaacacauuuguucuaaagaaggaaguaagcgaaacccagcaugguacaauacugauuaaaguagaauauaaaggggaagacgugccuuguaaaauuccauuuucaacggaagauggucaagguaaagcacauaacggcagauuaauaacagccaaccccguuguaacuaagaaggaagaacccgucaauauagaagcugaaccaccauuuggugaaagcaacaucguaaucggaauaggggacaaugcacuuaagauuaacugguauaaaaaggggaguaguaucgggaagauguuugaagcuacugcccguggugcaagacguauggcaauccuuggugauacagcaugggacuucgguaguguaggcgguguacugaacagucuugggaaaauggugcaucaaauuuucggguccgcuuauacagcacuauucaguggugucucuuggguaaugaaaauaggcauaggugugcuguuaacauggauuggauuaaauucuaaaaacaccucaaugaguuuuucaugcauagcaauaggaauuauuacgcuuuauuuaggcgcaguugugcaggcugauacaggaugcguuaucaauuggaaagggaaggagcuaaaauguggaucgggaauauucgucaccaaugaaguacauacauggacggaacaguauaaauuccaagccgauucaccuaaaagacuugccacugcaauagcaggagccugggaaaaugguguaugcggaauaagaucaacuacgagaauggaaaaccucuuauggaaacagaucgcaaaugaacuuaauuauauucugugggaaaacaacaucaaauuaacaguagucguaggagauauaauaggaguuuuagaacaagguaaaagaacgcuaacaccucaaccuauggaauuaaaauauucuuggaaaaccuggggaaaggcacgaauagucacagcggaaacccagaacaguagcuuuauaauagauggaccgaacacuccagaaugcccuaacacgucgagagccuggaaugucugggaagucgaagacuaugguuuuggaguauucacaaccaacauuuggcugaagcuaagagagguauacacgcaauugugcgaucacagacuaauguccgcugcgguuaaggaugaacgcgcaguacaugcggauaugggauacuggauagaaucgcagaaaaacgguucuuggaaguuagaaaaggcuucacuuaucgagguuaagacgugcaccuggccgaaaucucacacucuaugguccaauggagugcuugaaucagacaugaucauaccaaaaaguuuggcaggaccuaucucgcaacacaacuaccguccuggauaucauacacaaacagccggacccuggcauuugggaaaacuugaacuugauuuuaacuacugcgaaggaacuacgguagucauaacagagaauugcggaacuagagguccaaguuuaagaacuacuacuguaucuggcaaacuaauucacgaaugguguugucggagcuguacguuaccacccuuacgcuacaugggcgaagauggaugcugguaugggauggaaauacguccuauaucagagaaagaggaaaauauggugaaaucguuaguaagcgcggggucgggcgagguugacaauuucacaauggguguacuuugucuagcaauauuauuugaagaaguaaugcgugggaaguuugggaagaaacauaugauugccgguguuuucuuuaccuuuguguuacuucuaucgggucaaauuacauggcgcgauauggcacauacccuaauuaugauuggcuccaaugcuacagaccgaaugggaaugggaguaaccuauuuagcuuugauugcaacauucaaaauacaaccauuucuugccuugggauuuuucuuaagaaagcugacuucucgcgagaauuuguugcuugggguaggacuagcaauggcaacaacauuacaacuuccugaagacauagaacaaauggcuaacggaauagcccuuggacucauggcccuuaaauuaauaacgcaauucgaaacauaucaguuguggacugcccuuaucagcuuaacaugcucuaauacaauuuucacacugacuguggccuggcggacagcaacauugauuuuagcaggagucucauugcugccgguaugucagaguuccucuaugcgaaagacagauuggcuaccaaugacuguggccgcgaugggaguaccacccuugccacuuuucauauuuucauugaaagauacccuuaaaagaagaucguggccuuugaacgaaggaguaauggccguagggcuugugaguauacuggcgaguucacugcuacggaaugacguaccgauggcagguccauuaguagcaggaggguuauuaauugcuuguuauguuauaacugggacgucagcggauuuaacaguagaaaaagcagcggauguaacaugggaagaagaagcagaacaaacggggguaucgcauaaucuaaugauaacaguugaugaugauggaaccaugagaauaaaagaugaugagacugaaaauaucuuaacugugcuucuaaaaacggcgcuauuaauagucuccgguauauucccauauucgaucccagcaacucuuuuagucuggcacacuuggcagaaacaaacucaaagaucggguguguuaugggacgucccuagcccuccugaaacucaaaaggcggaacuggaagaaggaguauauaggaucaaacaacaagguauauuugggaagacacaaguaggcguagggguacagaaagagggcguuuuucauacuauguggcacguuacuagaggugcgguacuaacuuauaaugguaaaagacuagaaccuaacugggcuucuguuaagaaagauuuaauaucuuauggcggaggcuggagacuaagcgcucaauggcagaaaggugaagagguucaggugauagcuguugaaccugggaaaaauccgaaaaauuuccagacuaugccagguacuuuucaaacgacaacaggagaaauuggagcuauagcacuagacuucaagccuggaacaucaggcagucccauaauuaacagagaaggaaaaguaguaggacuuuacggaaauggcguaguuaccaagaauggcggauauguaucggguaucgcccaaaccaacgcggaaccugacggaccuaccccggaauuggaagaggaaauguuuaagaaacgcaaucucacaauaauggaucugcauccuggaagcgggaagacgagaaaauaccuaccugcaaucgugagagaagcuauaaaacgacgauugagaacccucauauuagcaccgacacgcgugguagcagcggagauggaagaagcacucaagggacugcccauaagauaucaaacaacggcaacaaaaagugaacauacuggccgagaaauugucgaucugaugugucaugcaacauucaccaugagacuccucucuccgguaagagucccaaacuauaaucuaauaauaauggaugaagcacauuucacagauccggccagcauagcagcacgcggguauauaucaacuaggguagguaugggugaagcggcugcuauauuuaugacugcaacgccacccggaacugcagaugcguuuccucaaagcaaugcaccaauucaggaugaagaaagagacaucccugaacgaaguuggaacagcgguaacgaauggaucacagauuuugcuggaaagacaguaugguuuguuccgagcauaaaagcaggaaacgauauagcuaauuguuuaaggaaaaaugguaagaaagucauacaacuaucacgaaagacauucgauacggaguaccagaaaaccaaacuaaaugauugggauuuuguaguuacaacggauauuagcgaaaugggagcuaauuuuaaggcugaccgaguaauagaucccagaaggugccuaaaaccugucauacuaacggacggaccagaacgaguaauacuugcuggcccaaugcccguaacugcagccuccgcagcacaacgacggggacggguaggaagaaauccacagaaggaaaaugaccaauacaucuuuacuggccagcccuuaaauaaugacgaggaucacgcacacuggacugaagcaaagauguuauuagauaacaucaacacuccagaaggaauaauaccagcgcuauuugaacccgagagagaaaaauccgccgccauagauggcgaauacagguuaaaaggggaaagcaggaaaacuuuuguagagcucaugagacgaggagaccuuccaguaugguuagcgcacaaagucgcuucugagggaauaaaauauaccgaucguaagugguguuuugauggacaacgaaauaaucaaauacuagaggagaauauggauguugaaauuuggacuaaggaaggagagaagaagaaacuuaggccuagaugguuagaugcuagaacauauucagaccccuuagcacucaaagaguucaaagauuuugcagcagggcgcaaaucaauagcauuagaccuuguuacagaaaucggacgaguacccacgcaucuagcacaucgaacccgaaaugcucuggacaacuuaguuaugcuccacacuucagagcacgguggaaaagcauaucggcacgcaguggaagaacuaccggagacgauggaaacauuacugcuacuggguuuaaugaucuugcuaacaggcggagccauguuguucuuaauaucaggaaaaggaauugguaaaacaaguauagguuuaauaugcgucauagcaagcucuggcaugcuguggauggcagaaaucccacuacaguggauugcuagugccauugucuuggaguuuuucaugaugguacuucucauccccgaaccagaaaagcaaaggaccccgcaagauaaucaauuagcauauguagugaucgguauauuaacccuggcggccaucauagcagccaacgaaaugggacuccucgaaacgacuaaaagggauuuagggaugucaaaggaaccaggagucguuucgccaacaucauauuuggacgucgaucuucacccggccucggcauggacacucuacgcaguagccacaacaguaauaacaccuauguuacgccauacuauugagaacuccacagccaacgugagucuagccgcaaucgccaaccaagcgguuguucuaaugggccuagacaagggcuggccaauuucaaagauggaucuugggguuccccuuuuagcucuaggcugcuauucccaaguaaaccccuuaacacugacagcggccguucuuuuacuaauuacgcauuacgcuauuauuggaccuggccuacaagcaaaggcgacccgagaggcacagaaaagaacagcggcgggaauaaugaaaaauccaacuguagacggaauaaugacgauagacuuggauccaguaaucuaugacaguaaauucgaaaaacaacuaggacagguaaugcuccuaguucucugugccguacaacugcuacugaugaggacgaguugggcuuuaugugaagccuugacacucgcaacuggaccuauaacaaccuugugggaagguucccccggcaaauuuuggaacacaaccauugcaguuuccauggcaaacauauucaggggaaguuaccuagccggggccggacucgcguucaguauaaugaaaucuguagguacuggaaaaagagggacaggaucacaaggugaaacccuuggggaaaaguggaagaagaaacuuaaccaacuuagccgcaaagaguuugaucuuuacaagaaaucaggaauaacagaaguagaccgaacugaagccaaagaagggcuaaaacguggagaaauuacacaucaugcgguaucuagagguucagcaaaacuacaaugguucguagagaggaacauggucauucccgaaggaagaguaaucgauuuaggcugugggagaggagguuggagcuacuauugcgcaggccugaagaaaguaacugaaguaagagguuacaccaaaggggguccaggacaugaggagccaguuccaaugucaacauauggauggaauaucguaaaauuaaugucgggcaaagacguuuucuaucuaccuccagaaaagugugauacacuccuuugugacauuggagaaagcaguccuagucccacgguggaagaaucgagaacaauaagaguucugaaaaugguagagccauggcucaaaaacaaccaauuuugcauuaaaguauugaacccauacaugccagcaguuauugaacacuuagagagacuucaacguaaacauggugguauguuaguucgcaauccacuguccagaaacagcacucacgaaauguacuggauuagcaacggaacuggaaauaucguggcuucuguaaauaugguuagccgacuucuucugaauagauuuaccaugacacaucgacgcccaacaauagaaaaagacguagacuuaggugccggaacaagacacgucaacgcggaaccugagacaccuaauauggacguaauaggagaacgcauuaaacguaucaaagaagaacauaauagcacuuggcauuaugacgacgaaaaccccuacaagaccugggcauaucacgggucuuaugaaguuaaagccacgggaucagcuaguucgaugauaaauggaguuguaaaacuacuaacaaagccaugggacgugguaccaaugguaacacaaauggcaaugacggauacuacaccuuuuggucaacaaagggucuucaaagaaaaagucgauacaagaacaccucguagcaugccgggaacgcgaagggucauggagauuacagcagaaugguuauggagaacccugggacgaaauaagaaaccuagacuauguacccgggaagaguucacuaagaaagugagaacuaacgccgccaugggggccguuuuuacggaagaaaaccaaugggauucugccaaagccgcaguagaagaugaagacuucuggaaacucguagacagagaaagggaacuacauaaacuuggaaaaugcggaucuugcguauacaauaugauggggaagcgggagaagaaacugggagaauuugguaaggccaagggcucuagagcaauaugguacaugugguuaggugcacgauauuuggaguuugaagcauuagguuuccugaaugaagaucauugguuuucgcgagaaaauagcuauucggggguagagggagaagguuuacacaaguugggcuacauucuaagagauaucucgaaaauuccagguggcgcgauguaugccgaugauacugccgggugggacacuagaauaacggaggaugaccuacauaacgaggagaaaauuacgcaacaaauggacccagaacacaggcagcuggcaaacgcuauauucaaguugacuuaucaaaauaaagucguuaagguucagaggccuaccccgacaggaacaguaauggacauuauuagucgaaaagaccagcguggaagcgggcagguugguacguacggacugaauacauuuacaaauauggaagcucaguuaauuaggcagauggaaggagaagguguauuguccaaggcagauuuagaaaacccacaucuaccggaaaagaaaauaacucaaugguuagagacuaaaggaguugagcgacucaaaagaauggccauuaguggagaugacugcguuguaaaacccaucgaugacagauucgcgaaugcgcuacuagcacuaaaugauauggguaaaguaagaaaagauauuccacaauggcaaccgucaaaaggauggcacgacuggcaacaaguuccuuuuuguucacaucauuuccaugaacuaauaaugaaagacggacgaaagcuagucgucccaugcagaccucaagacgaauugauuggucgugcuaggauaucacaaggggcaggcuggucauuacgagaaacagcgugccugggaaaggcuuaugcacaaauguggagccuaauguacuuucacagaagagaucuaaggcuagcgucgaaugcaauuuguucagcugugccaguacauuggguaccgacaagcaggacuacauggaguauucaugcucaucaucaauggaugacaacugaagacauguuaacaguauggaaucgcgucuggauagaggauaauccguggauggaagacaaaacgccagucacaacaugggaaaacguuccauauuuaggaaaacgugaagaucaauggugcgggagcuuaauaggauuaacaaguagagcuacuugggcacaaaacauaccuaccgcuauacaacaaguuaggucccucauagguaacgaagaauuuuuagauuacaugccaaguaugaaaagauucagaaaggaggaggagucugaaggcgcaauaugguga

SEQ ID NO: 23377 - RNA, 9873 nt, Artificial Sequence
  derived and/or modified CDS sequence (opt6) from DENV-3__EU529684__SS-prME
acuucacuaugucuaaugaugauuuugccagcagcauuggcauuucacuuaaccucaagggacggggaaccuagaaugauaguuggcaaaaaugaacgagggaaaucacuuuuguuuaaaacagcaucaggaauuaacauguguacacuaauagcaauggaucuaggugaaaugugugacgauacaguaacguauaaaugcccacauauaacugaaguggaaccagaagauauugauuguugguguaaucuuacuagcacauggguaacguacggaaccuguaaucaagcaggagaacauagacgagauaaacgauccguugcauuggcaccccacguagguauggggcuagauacucggacucaaacuuggaugagugcagaaggagcauggcggcaaguagaaaaaguggaaaccugggcacuuagacacccaggauucacuauauuagcgcuguuucuagcucacuacauuggaaccucucuaacacaaaaaguagugaucuucauccuauugaugcuaguuacaccgucaaugacaaugagaugugugggagucggaaacagagacuucguagaaggacuauccggagcaacguggguggacguaguacuagaacauggaggauguguaacuacgauggcuaaaaauaaaccaacuuuagacauugaauuacagaaaacggaggcaacacaacuugcaacacuaaggaaacuauguauagagggaaaaauuacgaacauaacaacugauaguagaugcccuacccaaggagaggcagugcuaccugaggaacaagaucaaaauuauguauguaaacauacguacguagacagagguugggguaacgguugcggacuauuuggaaaagguucuuuagugacgugugcaaaauuucaaugcuuggaaccgauagaagguaaagugguacaauacgagaaucuaaaauacacagucauuauaacgguacauacgggggaucaacaucaaguuggaaacgagacacaaggagucacagcagagauuaccccacaagcaucaacaacagaagcaaucuuaccggaguaugguacucuaggcuuggaauguagcccgcgaacaggcuuggauuuuaacgaaaugauucucuuaacuaugaaaaauaaagcauggauggugcauagacaaugguucuuugacuugccacuuccuuggacgaguggugcuaccacugagacuccaacauggaaucgaaaagagcuguuaguuacuuucaaaaaugcacaugcuaagaaacaagagguaguaguccuaggaucacaagagggugcaaugcacacagcacuaacaggcgcgaccgagauccaaaacaguggagggacguccauauuugccggccauuuaaaaugucgucucaaaauggauaaauuagaauugaaagggaugucguaugcaauguguacuaauacauucguacuaaagaaagagguuuccgaaacucaacaugggacaaucuuaauaaaaguagaauacaaaggugaggauguuccaugcaaaauuccuuucagcacagaggauggacaaggaaaagcgcacaaugggagacuaauaaccgcaaacccaguaguuaccaagaaagaagaacccguaaauauugaagcagaaccacccuuuggagagucgaauauaguaauuggaauaggugacaacgcguuaaaaauaaacugguacaagaaagguucuucgauugggaaaauguucgaagcgacugcccgaggugcuagacgaauggcaauccucggugacacugccugggacuuugguuccguaggaggaguuuugaauagucucgguaaaauggugcaucaaauuuucggaucagcuuacacagcacuuuuuagcgguguaaguuggguaaugaaaauagggaucgguguucuacuuacuuggauaggccuuaauagcaaaaauacuucaauguccuuuucauguauugcgauaggaaucauaacacuuuaucugggugcuguaguucaagcugacaugggguguguuauaaauuggaaaggaaaagagcugaaaugcggcuccggaauauucguaacgaacgaaguucacacuuggacugagcaguauaaauuccaagcagacucaccgaagaaacucgcaaccgcaauagccggugcuugggagaauggcguuuguggaauaagaaguacuacacggauggaaaauuugcuguggaaacagauagccaacgaauuaaacuacaucuugugggaaaauaauauaaaacuaacuguggucguuggagauauuauuggaguauuggaacaggggaaaagaacacugacgccccaaccaauggaacuaaaauauucauggaaaacaugggguaaagccaaaauuguaaccgcagagacacagaauaguaguuuuauaauagauggcccuaauacgccugaaugcccuucggcaucgagggcguggaacguuugggaaguugaagacuauggauucgguguauuuacgacaaauaucugguuaaaguuacgugaaguauauacucaauuaugugaccauagacuaaugucugcagcagugaaggaugagagagcagugcacgcugauaugggauacuggauagaaagucagaaaaauggaagcuggaaacuagaaaaagcuagucuaauagagguuaaaacauguacauggccuaaaagucauacauuauggaguaaugggguauuagaaucggauaugaucaucccgaagucauuagcaggaccaauaucucagcauaacuacagaccuggguaccauacccaaacagcaggaccauggcaccucggcaaacuagaauuagacuuuaacuacugcgagggcacaacagucguaaucacggaaaauuguggcacgaggggaccgucacuaagaacaaccacaguaucagggaaacucauccacgaaugguguugcagguccuguacucuaccgccguuacgguacaugggugaggacgguuguugguacgguauggaaauaagaccuauuuccgaaaaagaggagaauaugguaaaaucauuaguaagcgcuggcucaggagaaguugauaacuuuacgaugggcguauuauguuuagccauauuauucgaagaggugaugagaggaaaauucgguaagaaacauaugauagcuggcguguucuuuacuuuugucuuacuucuuagcggacaaauaacauggcgagacauggcccacacucuaauaaugauagguagcaaugcgagcgauaggauggggaugggagucacguaucuugcgcuuauugccacauucaagauucaaccauuuuuagccuuaggcuucuucuugcguaaauuaacaaguagagagaaucuguuauuaggggucggcuuagccauggcuacaaccuuacaguuaccggaggauauugaacagauggcuaauggaauagcacuaggacuaauggcuuugaaacuaauuacacaauuugaaacuuaucaacuauggacugccuuaauuucgcuaaccuguucgaauacaauuuuuacgcuuacgguugcauggagaaccgcaacacugauacuugccggagucaguuugcuaccugugugucaaucaucgucaaugcggaaaacagacuggcugccaaugacaguagcugcaaugggagugccaccucuaccucuguuuauauucagccugaaagacacucuaaaacgaaggucuuggccucuaaacgagggugugauggcaguggguuuagucuccauuuuagcaaguucauuacuuagaaaugauguaccuauggcgggaccguugguagcgggaggauuacugauugcauguuacguuauuacaggaacgucugcugaccuaacaguagaaaaggcggccgacgucacgugggaggaggaagcugaacaaaccgggguaagucacaaucuuaugauaacagucgacgaugauggaacgaugcguauuaaagaugacgaaacagagaauauucuaacgguacuuuugaaaacagcauuauugaucgugucaggaauuuuuccuuacaguauacccgcuacguuauugguauggcauacauggcagaaacaaacacaaagaucgggaguguugugggauguaccuagcccgccagaaacgcagaaagcagaguuagaagaaggcguauacagaauaaagcagcaagguauauuugguaaaacacaagugggcgucgguguccaaaaagaagguguauuucauacgauguggcaugucacucgaggggcaguguuaacauacaaugguaagcgguuagaaccaaacugggcaucgguuaaaaaggaccuaauuagcuacgggggaggauggcgccuuagcgcccaauggcaaaagggugaagaaguucaaguaaucgcagucgaacccggcaaaaaccccaaaaacuuccaaacuaugccagguaccuuccaaacaacaacuggagaaauuggugcaauagcguuggauuuuaagccgggcaccagcggaucaccuauaaucaacagagaaggaaagauuguaggcuuauaugggaaugguguaguuacuaaaaaugguggauaugucagcggcauugcgcagaccaacgcagaacccgacggucccaccccagaacuugaagaggaaauguucaagaaacgaaaucuaaccauaauggaccuccauccaggguccgguaaaacaagaaaauauuuaccggcaauaguuagagaagcaaucaaaagaagacucagaacucuaauauuagcuccgaccagagugguagcugcagagauggaagaagcucugaaagguuuaccuauaagauaccagacaacugccacaaaaucagaacauacaggucgggagauuguugacuuaaugugccacgcaacguuuacuaugcguuuauugucaccaguaagaguuccuaacuacaaucuuauaaucauggacgaggcucauuuuacggaccccgcaaguauugcugcgcguggcuauaucucuacgagagugggaaugggugaagcagcugcuauauuuaugacugcaaccccuccgggaacugcagaugccuucccacaaucuaacgcaccuauucaagaugaagaaagagacauuccagaaagaucuuggaacagcggaaacgaauggauuacugacuuugcgggaaagacgguaugguuugucccgaguauaaaagcugguaacgauauagcaaacugucuuaggaaaaacgggaagaaagucauucaauuaagucguaaaacuuuugauacagaauaccagaaaacuaaacuaaacgacugggacuuugucguaacaacagauauaagcgagaugggcgcuaauuuuaaagcagauagaguaauagacccccgacggugcuugaagccgguaauccuaacugaugguccugaaagaguuauauuagcugggccaaugccagugacugcugcuucagcggcacagcguagggguaggguugggagaaauccgcagaaagagaacgaucaauauauauucacaggacaaccucuaaauaaugaugaagaucacgcccauuggaccgaagcuaagauguuacuggacaauauuaauacgcccgaagguaucaucccugcccuauuugaaccagagcgagagaagucagcagcgauugacggagaauaucgguugaagggugaaagcaggaagacuuucguugaauugaugagaaggggcgauuuaccuguuugguuagcccauaaaguagcuagcgaggguauaaaauacacugaucgcaagugguguuuugacggacaaagaaacaaccagauauuagaagaaaauauggacguagagauuuggacuaaggaaggcgagaagaagaaauuaaggccaagaugguuagacgcacguacguauagugacccuuuagccuuaaaggaauuuaaggauuuugcggcgggacgcaaauccauugcgcuugaucuuguaacagaaauagguagagucccuacacaucuggcccacagaacgagaacagcuuuggauaacuuagugauguugcacaccuccgagcacgguggaaaggcuuauagacacgcgguugaggaacuaccggaaacuauggaaacguuauuacuauugggauugaugauauuauugacaggaggugcgauguuauuccuaauaucagggaagggaauuggaaaaacuuccauaggucuaauaugcgugauagccucgucaggcaugcuauggauggcugagauaccguuacaauggaucgcaagugcaauuguguuagaguucuuuaugauggugcugcucauuccagaaccagaaaaacagagaacaccacaagauaaucaauuagcauacguaguuauaggaauauuaacccuugccgcaauuauugcagcaaacgagaugggauuacuagagacaacuaaacgugauuugggaauguccaaggagcccgguguggugucgccgacaucauacuuggacgucgauuuacacccugcaagugcuuggacuuuauaugcgguagcuacaacaguuaucaccccuauguuaaggcacacaauugaaaauucaaccgcaaauguaucacuugcugcgauagcuaaucaagcaguaguacuaaugggacuagauaaaggcuggccuauuaguaaaauggaucucgguguacccuuguuagcacuaggguguuauagucaagucaacccuuuaacacugacugccgcugucuuguugcuaauaacacauuaugcgauaauagguccgggacuacaagccaaagccacaagggaggcccaaaagaggacagccgcgggcauaaugaagaauccgacuguugaugguauuaugacaauugacuuagaccccgucauuuaugacagcaaauucgaaaagcaauuaggucaaguuaugcucuuaguucuaugcgcgguacaauugcuauuaaugagaacaaguugggccuugugugaggcacucacucuggccacaggcccgaucacaacccuuugggaagggaguccggguaaauuuuggaauacaacaauagcgguaucgauggcuaauauuuuucguggaucauacuuagccggugcuggucuggcauuuuccauuaugaagucuguaggcaccgguaaacggggcaccggaagccagggggagaccuuaggggaaaaauggaagaagaagcuaaaucaauuaagucgaaaagaguucgauuuguacaagaaaagcggaaucacugaaguagaucgaacagaagcuaaggaaggucuaaagagaggugaaauuacucaucacgcaguuucaagaggauccgcaaaauuacaaugguuuguagaaaggaauaugguaauaccugaagguagggucauagauuuagguuguggucgaggcgguuggaguuauuacugugcagggcuaaagaaagugacagagguacgcggauacaccaaaggcggaccuggacaugaagaaccuguaccaaugucgacguacgguuggaauauuguaaaacugaugucggguaaagacguauuuuauuugccuccugaaaaaugugauaccuuacuaugugacauuggagaauccagcccuuccccaacuguagaggaaucgcgcacuauucgcguuuuaaaaaugguggaaccuuggcucaaaaauaaccaguuuugcaucaagguacuaaauccauacaugccaaccguuaucgaacacuuagaacgacuucaacgaaaacacggaggcaugcuaguuagaaauccgcugucaagaaauucaacucaugagauguauuggaucucaaaugggacuggaaauauuguagcaagcgucaacaugguuagcagacuacuguuaaaccgcuuuacaaugacccauagaaggccuacgaucgaaaaggaugucgacuuaggagcgggaacgagacauguaaacgccgagcccgaaacccccaacauggacgucauuggugaaagaauuaaaagaauaaaggaugaacacaauagcaccuggcauuaugaugacgaaaacccauauaaaacaugggcuuaccaugggaguuacgaagugaaagcaacgggaucagcuucgaguaugauuaauggcguaguaaaacuucuaacuaagccuugggacguugucccgauggucacacaaauggcaaugaccgauacaacacccuuuggucagcaaaggguauuuaaagaaaaagucgauacaagaacaccaagaaguaugccuggaacgcgacgaguaaugggaauaaccgcagaauggcuuuggagaacgcuuggacgcaacaagaaaccacguuuguguacuagagaagaguucacgaaaaagguacgaacaaacgcagcuaugggagcuguauuuacugaagaaaaccaaugggauucggcaaaggccgcuguggaagacgaagauuuuuggaagcuaguugaccgagaacgugaauugcauaaacuaggaaagugcggcucaugcguuuauaauaugauggguaaaagggaaaagaaacuuggggaauuuggcaaagcuaaagggagucgggcaauaugguauauguggcucggggccagauaucuugaguucgaagcccuagguuuucucaaugaagaucacugguuuucgcgugaaaauagcuauagcggagucgaaggugagggacuucacaaguuaggauauauuuuaagagauauaucgaagauuccgggaggagcaauguaugcggaugacacagcagggugggacacgagaaucacagaggaugaccuacacaaugaagagaagauaacgcaacagauggacccagaacauaggcagcuagcuaacgcuauuuuuaagcuaacuuaucaaaauaaaguuguaaaaguacagagaccgaccccgacugggaccguaauggauauuaucucuagaaaagaccaacgaggcucaggccaagugggaacauauggacuuaacacauuuacgaauauggaagcacaacugauacggcagauggaaggagagggaguacuaagcaaggcugaccuagaaaauccacaucuacccgagaagaaaaucacgcaaugguuggaaacaaaaggaguggaaagacuuaaaagaauggcuauauccggggaugacuguguaguuaaaccgaucgacgauagguuugcaaacgcgcuacuggcauugaaugacauggguaaaguacgcaaagacauaccgcaauggcaaccgucuaaaggcuggcaugacuggcaacagguaccauuuuguagccaucacuuucacgaacuaauuaugaaagaugguagaaaauuaguugugccauguagaccacaagacgaacuaauaggcagagcucggaucucacaaggagcgggauggagucugcgugagacggcaugucucgguaaagccuacgcucaaauguggucguuaauguauuuccacagaagagaccuacgucuagccagcaacgcgauuugcagcgcaguaccuguacacuggguuccgaccucgagaacuacuuggucuauacaugcucaucaucaguggaugacaacagaagacauguuaacaguauggaauagggucuggaucgaggacaauccauggauggaagacaagacaccaguuacaaccugggaaaacguaccauauuuaggaaaacgcgaagaccaguggugugggucacuaauuggucuaacgagccgagcuaccugggcucaaaacauaccuacagccauacaacaagugagaucucuaauaggaaaugaggaguuccuggauuacaugccaucgaugaaaagguuucguaaagaggaagaaagugaaggugcaauuugguaa

SEQ ID NO: 23378 - RNA, 9873 nt, Artificial Sequence
  derived and/or modified CDS sequence (opt6) from DENV-3__FJ182015__SS-prME
acuucauugugucugaugaugaucuugccugcagcacuugccuuucaucuaacuucccgugacggugaaccucgcaugaucguggguaaaaaugaacgaggaaaaucccuccuauuuaaaacggcgaguggaaucaauauguguacuuuaauugccauggaucuaggugaaaugugcgacgacacugugacauacaaaugcccccacauuacagaagucgaaccagaagauauugauuguugguguaaucuuacauccacguggguuacuuacgguacuuguaaucaagcuggggaacaucguagagauaaaaggucaguugcacuggcuccucacguagguaugggcuuggauacgcgcacacagacuuggaugucugccgagggugcauggcgacaggucgaaaaaguggaaacaugggccuugagacauccuggauuuacuauccuagcgcuguuucucgcucauuauauuggaacaagucuaacucaaaaaguagucauauuuauucuacugaugcuaguaacucccucgaugacaaugcgaugcguggggguagguaaucgagacuuuguugaaggguuaagcggagcaacgugggucgacgugguuuuagaacacggaggaugcguuacaacaauggccaaaaacaaaccaacccuugacauagaacuacagaaaacugaagcuacccaacuagcaacacuccguaaauuaugcauagaagguaaaaucacuaauaucacaacggacucucgauguccaacacaaggagaagccguauuaccugaagaacaagaucaaaauuaugucuguaaacauacauacguagaucgaggaugggguaauggguguggucuauuuggaaaaggaagccucguaacaugcgcaaaauuucagugucuggaaccaauagaaggaaaaguaguacaguaugaaaaccuuaaauacacaguaaucauaaccguucacaccggugaccaacaccaaguaggcaacgagacacaaggaguaacugccgaaauaacgccacaagcuaguacgacugaggcaauacuaccggaauauggaacauugggguuagaauguuccccaagaacaggucuggacuuuaacgaaaugauccuacucacaaugaaaaauaaagcguggaugguccaucgucaaugguucuucgaucugccucuuccauggacaaguggagcaacuacagaaacaccgacguggaacaggaaagaacuauuaguaacauuuaaaaaugcccacgccaagaaacaagaaguaguuguccuuggcagccaggaaggagcaaugcauacagcguuaacuggagcuaccgaaauccaaaauucaggugguacauccauuuuugcaggucaccuaaaaugccgccuuaaaauggacaaacucgaauuaaaagguaugaguuacgcgauguguacuaauacauucguccuuaagaaagaaguuuccgaaacucagcacgguacaauacugauuaaagucgaguacaaaggugaggaugucccauguaaaauaccguucaguacagaagauggucaaggaaaagcccacaauggcagauuaauaaccgcaaauccagugguuaccaagaaagaagaaccuguaaauauugaggcggaaccaccuuuuggugagucuaacaucgucaucgguauuggagacaacgcacuaaaaaucaauugguauaaaaaggggagcucaaucggaaaaauguucgaagccacagcaagaggagcucgaagaauggcuauuuuaggcgacacagcuugggauuuuggaucggucggcggcguacuaaauucacuuggcaaaaugguccaucaaauauuuggcagcgcuuauacagccuuauucaguggaguauccugggucaugaagauaggaauaggcgucuuauuaacauggaucgguuugaauagcaaaaacaccuccaugucauuuucgugcauagcgaucgguauaauuacauuguacuuaggagcuguagugcaagcggauauggggugcguaauaaacuggaaagguaaagaacuuaaauguggaucuggaauauuuguaacuaacgaagugcacaccuggacagaacaauacaaauuccaagccgauucuccaaaaagacuagcaacggccauagcaggagcaugggaaaacggaguguguggaaucagaucuacuacuaggauggaaaauuugcucuggaagcaaauagcuaaugaauuaaacuauauuuuaugggaaaauaacaucaaacuaacuguuguagucggggauauuaucggaguucuugagcagggaaagagaacauuaacgccucaacccauggaauugaaauacucauggaagacauggggaaaggcaaaaauaguuacagcugaaacgcaaaacaguuccuuuauuaucgauggucccaacacacccgagugccccucagcaagccgagccuggaauguaugggaaguagaggauuacggauuuggaguauuuaccacaaauaucuggcuaaaauuacgugaaguuuauacccaauuaugugaucaccgauuaaugagugccgcuguaaaagaugaaagggcagugcacgcggauaugggauauuggauagagucucagaaaaauggcagcuggaaacucgaaaaagcaagucuaauugaaguaaaaaccuguacguggccgaaaucucauacuuuauggagcaauggaguuuuggaaucggauaugaucauaccgaaaucauuagccggcccaauaagccagcauaauuauaggccaggauaucacacacaaacagccgggccuuggcauuuggguaaacuggaauuagacuuuaauuacugcgagggaacuacggugguaauaaccgaaaauugugguacaagaggaccaagucuacgaacgacaacuguaagugggaaacuuauccacgaauggugcugcagaucuugcacuuuaccuccucuccgauauaugggugaagauggauguugguacggcauggaaauuagaccaauaagcgaaaaagaggaaaauaugguaaaauccuuagucucugcuggaaguggcgaaguagauaauuucacuaugggaguauugugccuugcaauacuauucgaggagguaaugcgagggaaguuugguaaaaagcauaugauugcgggaguuuucuuuacuuucguucuccuguuaucggggcagauuacauggagagacauggcccacacccuaauaaugauagguucaaacgccagugaucguauggggaugggaguaacuuauuuagcacuuaucgcaacauucaagauacaacccuuucuugcacuuggauucuuucuaagaaaauuaaccaguagagaaaaccuacuauuagguguaggucucgcaauggcaacgacucugcaacugccugaagauauagagcagauggcaaauggcauagcauuggguuugauggcacucaagcucauaacgcaguuugagacauaccaauuauggacagcuuugauuaguuugacaugcaguaacacgaucuucaccuugacgguagcuuggaggaccgcuacauuaauauuagcgggagucagcuuacuuccugucugucaaucauccucaaugagaaaaacagauuggcucccuaugacaguugcagcuauggggguaccuccacuaccucuguuuauauuuucgcuaaaagauacacuaaaaagacgaagcuggccucuaaaugagggcguuauggcaguagguuuaguaaguaucuuggcaagcagccucuugagaaacgauguaccuauggccggaccucuagucgcaggaggucugcugaucgcaugcuauguaauuacgggaacaagugcugaucucacagucgaaaaggcugcugacguaacaugggaagaagaagccgaacaaaccggagucucgcauaaccuaaugauaaccguggaugaugacgggacuaugcgaaucaaggaugaugaaacagaaaacauccuuacaguccuccugaagaccgcucuauuaauagucucaggaauauuuccauauucaauucccgccacacuguuaguuuggcauacuuggcaaaagcaaacacaacgcucugguguucuuugggaugucccgaguccuccagaaacucagaaagcagaguuagaggaagggguuuauaggaucaaacaacaagggaucuuuggcaaaacacaggucgguguaggugugcagaaagaaggaguguuucacaccauguggcauguaacacgcggggcggucuuaaccuacaacgguaagagauuagaaccuaacugggcaucagugaagaaagauuuaauuucuuauggcgguggauggagacuuucagcacaauggcaaaaaggagaagagguacaaguaauugcuguugagccaggcaaaaacccuaaaaacuuccaaacuaugccuggaacauuccaaacuaccacaggcgaaauaggagcuauugcacucgacuuuaaaccuggaaccagcggaucgccaauuauuaaucgggaaggaaaaguuguaggucuuuacggcaaugguguaguuacuaaaaacgguggguauguaucaggcauugcucaaacaaaugcugaacccgaugguccaacaccagaacuggaggaagaaauguuuaagaaaagaaacuugacuauaauggauuugcauccuggaagcgggaaaacucgaaaauacuugccagcgaucguacgugaagcaaucaaaagacgauuacgaaccuugauacuugcaccaacuagagucguagccgcugaaauggaagaagcauuaaaaggacuaccaauuagauaucaaacaacagcaacaaaauccgagcauacuggucgcgaaaucguagauuuaaugugucacgccacauuuacaaugaggcuacucagucccgucagaguuccgaauuacaaucuaauaauuauggaugaagcucacuucacugauccagcaaguaucgcugcacgaggguauaucagcacccgcgucggaaugggagaggcagcugcgaucuucaugacggcuacuccaccuggaacugcagaugcuuuuccgcaaucaaaugcaccaauccaagaugaagaacgagacauaccagaaaggagcuggaacucgggaaaugaauggauaacugacuuugcgggaaaaaccgugugguucgugcccaguauaaaggcuggaaaugacaucgcuaauuguuuaaggaaaaaugguaagaaggucauccaauuaagucgcaaaaccuuugauacugaauaucagaaaacgaaacuuaacgauugggauuucguagucaccacugauaucagcgagaugggagccaauuuuaaagccgauagagucaucgacccuagaaggugccucaaaccaguaauuuuaacugaugguccugaaagagugauacuggcagguccgaugccggucaccgcggcaagugcggcucaaagacgaggaagaguaggcagaaacccccaaaaagaaaaugaucaguauaucuuuacgggucaaccacuaaauaaugaugaagaucacgcacauuggacagaagcaaagauguuauuggacaauauaaauaccccagaaggcauuauaccggccuuauucgaaccagagcgcgagaaaagugcagcgauagauggagaauauagacuaaaaggagagucaagaaaaacauuuguugaacuaaugcgucguggcgaucuaccagucugguuagcccauaaaguagcaagcgaggggauaaaauauacugaccgaaaaugguguuuugauggccaaaggaacaaccaaauuuuagaagagaauauggauguugagauauggacaaaagaaggagaaaagaagaaguugaggccacguuggcuggaugcgagaacguauucugauccguuagcgcuuaaggaauuuaaagacuuugcagcaggaagaaaaaguauagcucuugaucucgugacugagauaggacgaguaccuacucauuuagcacaucguacgaggaacgcacuugauaaucuaguaaugcugcacacaucagagcacgguggaaaagcauacagacaugcugucgaggaauugccugagacuauggaaacucuacuuuuguuagggcucaugauauuauuaacaggaggagccaugcuauuucugauuagcggaaaaggaauaggaaaaacgucaauaggucuaauuugugugauagcaaguucggggauguuauggauggcagaaauaccacuacaguggauugcuagugcuauaguuuuagaguucuucaugaugguguuacuaauaccugaacccgaaaagcaacggacaccacaagauaaccaguuagccuacguaguaauaggcauacuuacucuagcugcuauuauugccgcaaacgagaugggguuacuugaaacaaccaaacgagauuuagguaugucuaaggaaccaggaguagugucgcccacaagcuaccuagacguugacuuacauccggcaagcgcauggacacuauacgcaguagcuacuacagugaucacuccgaugcugagacauacaauugaaaacaguacugcaaacgugucauuagcagcaauugcaaaucaagcgguuguucuaauggguuuggacaaaggauggccaaucucgaagauggauuuaggaguucccuuacucgcuuuaggcugcuauagccaaguaaauccauugacucugaccgcagcuguccuuuuacuuauuacucauuacgcgauaauuggaccaggccuacaagcuaaagcgacccgagaggcacaaaagcgcacagccgccggaauuaugaagaauccaacaguggacggaauaaugacaauagaccucgaucccguuaucuacgauagcaaauucgagaaacaacugggccaaguuauguuacuuguguuaugcgcggugcaacuucuacuaaugcggacaucuugggcgcuuugugaagcauuaacauuggcaacgggaccuauaacaacguugugggaagguuccccaggaaaauucuggaauacaacgauagcaguaucgauggcaaauauauuccgugguagcuaucuagcuggugcgggauuagcauuuaguauaaugaaaucuguagggacuggcaagagaggaaccggaucacaaggagaaacccuaggcgaaaaguggaagaagaaacugaaccaacugagucggaaggaguucgauuuguauaaaaagucuggaaucaccgaaguagaucgaacagaagcaaaagagggccuaaaaagaggcgagauaacucaucaugcaguaucaagaggcucagcaaaauuacaaugguuuguagagcguaacaugguaauucccgaagguagaguaauugaucuaggcugugguagaggaggguggucuuauuacugugcuggacuuaagaaagucaccgagguaagaggcuacacgaagggugguccagggcaugaagaaccaguaccuaugaguaccuauggcuggaauauaguaaaguuaaugucugggaaagacguauucuaucuaccuccagaaaagugcgacacccuccuuugcgauauaggagagucgagcccaucaccaacagucgaggaaucaagaacaauaagaguauuaaaaaugguagagccuuggcuuaaaaacaaccaauuuugcauaaaaguacuaaaucccuauaugccaaccgugaucgaacaccucgagcgacuucagagaaaacauggaggaaugcuuguucgcaacccacuaucgaggaacucuacccacgaaauguacuggauuucaaauggcacaggcaauauaguagcgucugugaacaugguauccagguuacuauuaaauagauucaccaugacccacagaagaccaacuaucgagaaagauguagaucuaggagcgggaacaagacaugugaaugcagaaccugaaacaccaaacauggauguuaucggcgaaaggaucaagcgaaucaaggaggaacacaacucaacuuggcauuaugaugacgaaaauccauauaaaacaugggcguaucaugggucuuaugaagucaaagcaacugguucagcaucuaguaugauuaauggaguggucaaauugcuuacaaaacccugggacgucguuccgauggugacucaaauggcuaugacagauacaacuccauucgggcaacaaagaguauucaaagagaaggucgacacccgaacaccuagaucaaugccagguacaagacgaguuauggguauaaccgccgaaugguuguggagaacuuugggccgaaauaagaaaccucgauuauguacgcgagaagaauuuacaaagaaaguacguacuaaugcagcuaugggagcuguguuuacugaagaaaaucaaugggauagcgcaaaagcugcaguugaagaugaagacuucuggaaauuagucgauagagaaagggaacuacacaaauuagguaaauguggaaguugcguauacaacaugauggguaaacgagagaagaaauuaggcgaguucgggaaagcaaaggguucuagggccauaugguacaugugguuaggugcacgauaucucgaguucgaagcauuaggguucuugaaugaagaccauugguuuucacgcgaaaauuccuauucaggagucgaaggugaaggauuacauaaacuugguuacauacuuagagauauaucaaagauuccgggaggagccauguaugcugaugacacggcaggaugggacacucgcauaacagaagaugaccuacauaacgaagagaaaauaacacagcaaauggauccagaacacagacaacuugcaaaugcaauauuuaaacugacuuaucaaaauaaaguaguaaaaguucagaggccaacaccuacaggcaccguaauggauaucauaucuaggaaagaccaaagagguuccggacaaguggggaccuaugggcucaauacauucaccaauauggaagcucaauugauaaggcaaauggagggcgaaggcguacuaucuaaagcggauuuggaaaauccacaccuaccugaaaagaaaaucacucagugguuagaaacaaagggcguugagagacuuaaacgaauggcaauaucaggggacgacuguguggugaagccaauagacgacagauuugcaaaugcucugcuggcgcuaaacgauauggggaaaguucguaaggauauaccacaauggcaaccguccaaaggauggcaugacuggcaacaaguuccauuuuguucacaccauuuccacgaacuaauaaugaaagauggaagaaagcuaguaguuccauguagaccgcaagacgaguuaauagguagggcuaggauaucacaaggcgcgggcuggagccuuagggagaccgcgugucuagguaaagcauacgcacaaauguggagucuuauguauuuccaccgcagggaucugcgucuggcuaguaacgcgaucuguucagccguacccgugcacugggucccuacaagucguacgacauggaguauucacgcgcaccaucaauggaugacgacugaagauauguugacuguuuggaacagaguguggauagaagacaaucccuggauggaagacaaaaccccgguaacaacaugggaaaauguaccuuaucuagguaagcgggaagaucaguggugcgguucccugauuggacucacaagucgugcaaccugggcacaaaacauuccaacagcuauucagcaaguccggucacuuauuggaaaugaggaguucuuagauuauaugcccucuaugaaaagguuccguaaagaggaagaaagugaaggggcuauuugguaa

SEQ ID NO: 23379 - RNA, 9873 nt, Artificial Sequence
  derived and/or modified CDS sequence (opt6) from DENV-3__EU569688__SS-prME
accucgcuaugcuuaaugaugauccugccugcugcacuagcguuccacuuaacuagcagagauggagaaccucgaaugauugucgguaaaaaugaaaggggaaaauccuuguuguuuaaaacugcgucuggaauuaacaugugcacguuaauagcaauggaucuaggagaaaugugcgacgacacugugacauauaaauguccgcauauuacagaagcggaaccagaagauauugauuguugguguaaccuuacuucaacgugggugacuuaugggacauguaaucaagccggugaacaccgcagagacaaacgaucaguggcguuagcaccacaugugggaauggguuuggacacuaggacacaaacguggaugagugccgaaggggccuggcgucaaguugaaaaaguggaaacuugggcacucagacauccgggauuuacaauccucgcccucuuucuggcucauuauaucgguacgucucuuacacaaaaagucguuauuuuuaucuuacuaaugcuagucacacccucaaugaccaugagguguguuggaguaggaaaccgggauuuuguagaagggcuaucaggggcaacuuggguagacguuguuuuagaacaugggggauguguuacaacaauggcgaaaaauaaaccuaccuuagauaucgaacuacagaaaacugaagcgacgcaauuggcaaccuuaaggaaacuaugcauagaaggaaaaaucaccaauaucacaacagauaguagguguccaacgcaaggagaagccguacuaccagaagaacaagaucaaaacuacguauguaaacacacguauguugacagaggauggggcaauggauguggauuauuuggaaaagguagccugguuaccugugcaaaauuccaaugucuggagccaauugaaggaaaaguggugcaauacgaaaaccuaaaauauaccguaaucauaacaguccacacuggugaccaacaucagguaggaaaugagacgcagggugucacagcugaaauaacuccccaggcuucaacgacagaagcuauauuaccagaauaugggacauuaggauuagaauguucuccaaggacuggguuagacuucaaugaaaugaucuuacugacuaugaaaaauaaagcguggaugguacauagacagugguuuuucgaccuaccgcuuccauggaccucaggggcuacgacagaaacuccuaccuggaauagaaaagaacuuuugguuacauucaaaaacgcccaugcaaagaaacaagaagucgucguuuugggcagccaagagggagcaaugcauacagcacugaccggugcaacagagauacaaaauuccggaggcacaucaauuuucgcgggucaucuuaaaugcagauugaaaauggauaaauuagaacuaaaaggaaugucauaugcaauguguacaaauacauucguauuaaagaaagagguuuccgagacacaacaugggacaauacuuaucaaaguugaauauaaaggggaggauguaccuuguaaaauuccauucuccacagaagauggacaggguaaagcacauaacgguagacugaucacagcaaacccugucgucacuaagaaagaagaaccaguaaauaucgaagcagaaccuccuuuuggagaaucuaacauagugaucgggaucggugauaacgcacucaaaauaaauugguauaagaaaggaucgucaauagggaagauguuugaagccacugccagaggggcgcgacgaauggcgaucuugggcgacacggcgugggauuuugguucggucggagguguccuuaauucauuaggaaagauggugcaccaaauuuucgggucggccuauacggccuuauucagugguguaucuuggguaaugaagauaggaaucggaguuuuacugacauggaucgggcucaacaguaaaaacacaaguaugucauuuagcugcauugcaauuggaauaauaacauuauauuuaggugcuguuguucaagcagauaugggauguguuauaaacuggaaaggaaaagaguuaaaaugugggucaggaaucuuugugacaaaugaaguacauaccuggaccgaacaauacaaauuucaggcagauagucccaaaagacuagcaacugcgauagccggugcgugggagaacggcguaugcggaauacgaagcacuacaagaauggaaaaucuacuauggaagcaaauagcuaaugaacuuaauuacauuuuaugggaaaauaauaucaagcugacagugguugugggcgacacuauuggcguuuuagaacaagggaagagaacacuaacaccacaacccauggaguuaaaauauaguuggaaaacauggggcaaagcaaaaaucgugaccgcggaaacacagaacucauccuuuauaaucgauggaccuaacacgcccgaaugcccaucagccagcagggccuggaaugucugggaaguggaagauuauggauuuggaguuuuuacuacaaauaucugguuaaaacugagagaaguauauacccaacuaugcgaucaucgacucaugucagcugcaguaaaagaugaacgagcagugcacgccgauaugggcuauuggauagaaucccaaaagaaugguuccuggaaauuggaaaaagcaucauuaauugagguaaaaacuuguacuuggccaaagagucacacuuuauggucuaacggcguucuggaaagugauaugauaaucccaaaaagucuggcgggcccuauaucacaacacaauuacagaccaggauaucauacacaaacugcagguccauggcauuugggaaaauuagaacuagacuucaauuauugugaaggcacgacggucgugauaacagaaaacugugguacaagaggaccuaguuuacgaacgacaaccguuagcggaaaacugauacaugaaugguguugucguaguuguacauuaccaccacugcgcuacaugggcgaggaugguugcugguacgguauggagauucgcccaauaucugagaaagaagagaauauggucaagagccuaguauccgcaggaagcggcgagguagacaacuucacgaugggaguacucugcuuagcgauauuauuugaggaaguaaugagaggcaaguuuggcaagaaacauaugauagcagggguauucuuuacguucguacuuuuauuaagcggacaaaucacguggcgagauauggcucacacucuaauuaugauuggcaguaaugcaagugaucguaugggaaugggcguaacauaccuagcucucauugcaacguuuaaaauccaaccuuucuuggcgcuuggauucuuuuuaagaaaacucacuucaagagaaaaccugcuccuugggguaggucuugccauggcgacuacucuacaacuaccagaagauauugaacaaauggcgaacgguauugcuuuaggccuaauggcauuaaaacuuauaacucaauucgaaacauaucaguuguggacagcucuaauaucguugaccugcucuaauacgaucuuuacuuuaaccguagcuuggagaaccgcgacguugauauuagcaggcgucucauugcugccagugugccaaucaucgucuaugagaaaaacagacugguuacccaugaccguugcagcuaugggaguaccacccuugccucuguuuauauuuucucuuaaagacaccuuaaaacgacgaaguuggccacuaaaugaggguguaauggcaguaggccuaguaagcauacuggcaaguucuuuacuaagaaaugaugucccaauggcuggaccccuaguggcaggagggcuccuuauagcuugcuaugugauaacuggaacgagugcugauuuaaccguagagaaagcagcugacgucacgugggaagaagaagccgaacaaacaggaguaagccauaauuuaaugauuacaguggacgaugaugguaccaugcguauuaaagaugaugagacagagaacauacuuacggugcuucucaagacugcacuauuaauuguuagcggcauauucccguacucgauucccgcaacucuacuggucuggcauacuuggcaaaaacaaacacaacgaagcggaguguuaugggaugugccgucgccaccagaaacacagaaagcggaacuagaagaagguguauaccgaauaaagcaacaagguauauuuggaaaaacgcaaguaggagugggaguacaaaaagaagguguauuucacacuauguggcauguaacgcgaggagccguacuaacauauaacggaaagaggcuagaaccaaacugggcgucgguuaagaaagaucuaauaucuuacgguggagguuggagacugagugcccaauggcaaaaaggugaagaaguccaaguaauugcagucgaaccggggaaaaacccuaaaaauuuccaaacuaugcccgggacauuucaaacaaccacaggagaaauaggggcuauagccuuggacuuuaaacccggaaccucaggaucuccgauaauuaacagagaggguaagguaguaggacucuacggaaauggaguaguuaccaaaaacgguggcuaugucucugggauugcucagacuaaugcagagccggauggaccuacuccagaauuagaagaagaaauguucaaaaagagaaacuugacaauuauggaucuacauccuggcucugguaaaacgcguaaauauuuaccagccauuguucgagaagcgauaaagagacgacuccguacuuuaauucuagcuccaacucggguaguagccgcagagauggaggaagcacuuaaaggcuuaccuauacguuaucaaacaacagcgacaaaaucugaacacacagggagggaaauaguagaucuuaugugucaugcaacauuuacaaugagacuccugagccccgugcguguaccaaacuacaauuuaauaauuauggaugaggcccauuuuacagauccagccucuauugccgcucgggguuauauaucuacaagagugggaaugggagaagcugcagcaauuuuuaugacggcaacgccaccgggcacugcagacgcuuucccacagaguaacgcaccaauucaggaugaggaacgcgacauuccagaaaggaguuggaacucugguaaugaauggauuacagauuuugccggcaagacaguaugguuugucccaaguauaaaagcgggaaacgauaucgccaacugucuacguaaaaacggcaaaaagguaauacaacuuucacgaaaaacauuugauacagaauaccaaaagacgaaacucaaugauugggauuuugugguuacuaccgauauuucagaaaugggcgcaaauuucaaggcugacaggguaaucgauccuaggagaugucucaagccgguaauuuuaacugauggcccagagagaguaauccuagccggucccaugcccgugacugcugcaagcgcggcacaacgaagaggacgaguugggagaaacccgcaaaaggaaaacgaucaauauauuuuuacaggacagccacuuaauaaugacgaagaccacgcacauuggacugaggccaagaugcugcuggauaacauuaauacuccugaggggauuauuccggcucuguuugaaccagaaagagaaaagagugccgcuaucgauggcgaauauaggcuaaaaggagaaagucguaaaacauucguagaacuaaugagaaggggagacuuaccgguauggcucgcacauaaagucgcuucugagggaauuaaauauaccgaccgaaaaugguguuucgauggccaacgcaauaaucagauauuggaagaaaacauggauguggaaaucuggacuaaagagggagagaaaaagaaauugagaccacgauggcuggacgcuagaacuuauucugauccccuggcgcuaaaagaguucaaagauuuugcggcaggaagaaaaucuauagcucucgauuuaguaacugaaauuggaagagucccaacacaucuugcgcauagaacacgaaaugcgcuugacaaccuugugauguugcauacauccgagcacggaggcaaggcuuaccggcacgcuguugaagaauuaccugagacuauggagacacuauuacuacuaggauugaugauacuuuuaacuggaggggcgaugcuauuucuaauauccgguaaagguauaggaaaaaccaguauaggauuaauuuguguaauagcuagcagcgggaugcuuuggauggcagaaauuccuuuacaauggauugcuucugcaauagugcuagaguuuuucaugaugguccuucuuaucccagaaccggaaaaacaacgcacgccucaagacaaucaacuagcguauguagucauaggcauauuaacauuagcagcaauuaucgcggcgaacgagaugggauugcuugaaacuacuaaaagagacuuaggaaugucaaaagaaccaggaguaguguccccuacgucuuacuuggaugucgaccuccaccccgcuagcgcuuggacuuuauaugcgguggcuacaacaguaauaacccccaugcugaggcacacuauagagaauagcacagcuaauguaucucuagcugccauugccaaccaggcuguaguauuaaugggacuagauaagggcuggccuauaucaaagauggacuuaggaguaccauugcuagcuuugggaugcuauagccagguuaauccauuaacacuaacagcugcaguuuuacuacuaauaacacacuacgcuaucaucgguccaggguugcaagcaaaggcaacuagggaagcacagaaaagaacagccgccgguaucaugaaaaauccaaccguggauggaauuaugacuauagacuuagacccagucauuuacgauaguaaauuugaaaagcagcugggacaagugaugcuuuuagugcuaugugcaguacaauuauuauuaaugcgaacaaguugggccuuaugcgaggcgcucacgcuagcaaccggaccaauaacgacacuuugggaagguuccccagguaaauucuggaacacaacaauugcuguuuccauggcaaacauuuuccguggcaguuacuuggcgggagccggucuagccuuuucgauuaugaaaucuguaggaacaggaaaaagaggaacuggaucucagggagaaacgcuuggugaaaaauggaagaagaaauuaaaccaguuaucccgaaaggaguucgauuuauauaaaaagucagguauuacggaggucgauagaaccgaagcaaaagaaggacuaaaaagaggagagauuacacaucaugccguuucccgcggcucugcaaaguuacaaugguucguggagagaaauaugguuauuccagaaggaagaguaauugacuuaggauguggacgugguggauggaguuauuauugugcaggacucaagaaagucaccgagguaagaggguauacgaaaggaggaccuggacaugaagaaccaguucccaugucaacauacgguuggaacauugugaagcuaaugagcggcaaagacguauucuauuugccaccggaaagaugcgauacacuucuaugcgauaucggugaaagcaguccuaguccaacuguagaagaaucaagaacaauucgaguauugaagauggucgaaccaugguugaaaaacaaucaauuuuguaucaaaguccuuaacccauauaugccuacugugauagaacaucuagagcgccuucagcgaaaacacggaggaaugcuagugagaaacccccuuucucgaaauaguacgcaugaaauguauuggauuucuaauggcacggguaauauagucgcgaguguuaauauggucuccagacuucugcuuaaccgauuuacgaugacacacagaagacccaccauagaaaaagauguagaccugggagcaggaacacgccauguuaaugcagagcccgaaacaccaaacauggauguaauaggcgagagaauaaaaaggauaaaggaggaacacaauuccaccuggcauuacgacgacgaaaauccguacaaaacaugggcauaccauggcucauaugaagucaaagcaacggggagugcguccagcaugauaaauggagugguaaaauuauuaacaaaaccaugggacguaguaccgauggucacacaaauggcuaugacagacacgacaccuuucggccaacaacgagucuuuaaagaaaaaguggacacucgaaccccacgaucuaugccagguaccagacguguaaugggaauuacggcggaauggcuuuggagaacauuagguagaaauaagaaaccuagacuuugcaccagagaagaguucaccaagaaagugagaaccaacgcugcgaugggagcgguguuuacagaagaaaaccaaugggacucagccaaagcagcgguugaagaugaagacuuuuggaaacucguugauagagagcgagaguuacacaaauuaggaaagugugguaguugcguuuacaauaugauggguaagagagagaagaaauugggagaauuugggaaagcaaaaggaagcagggccauaugguacauguggcucggagcaagauaccucgaauuugaggcuuugggcuuuuugaacgaagaucauugguucaguagagaaaauucauacagcggcguugaaggugagggacuucauaaauugggcuauauucuuagggauauaagcaaaauaccagguggggcaauguacgcggacgacacugcaggaugggauacacgaauuacagaagacgaucugcauaacgaagagaaaaucacacaacaaauggauccggagcaucgacaacuggcgaaugcgauauuuaagcugacauaucaaaacaaagucguuaaagugcaaagacccacuccaacaggaacugucauggauauaauuagcagaaaagaccaaaggggaucgggacaaguagggacauacgguuuaaacacuuuuacgaauauggaggcgcaacucauuagacagauggaaggcgaaggcguucuuagcaaagccgaccuggaaaauccgcacuuacccgaaaagaaaaucacacaaugguuggaaacgaaaggcguagaaaggcuuaaacgcauggcgauaucaggugaugacuguguuguaaaacccaucgaugacagauuugcuaaugcgcucuuagcacuuaaugauauggguaagguucgcaaagacauaccacaauggcaaccuaguaagggauggcaugacuggcaacaagucccauuuuguagucaucauuuccaugaauuaauuaugaaagauggacgcaaacuuguuguuccuugcagaccacaagaugaauuaauagggagagcgagaaucucacaaggugcgggcuggucucuacgagagaccgcuugccuagguaaagccuaugcgcaaauguggucucuaauguauuuccaucguagagaucuacgauuggcuucaaaugcaaucuguagcgcaguucccguacauuggguccccacaagucguacuacauggucaauacacgcgcaucaucaauggaugacuacugaggacaugcuaacaguauggaauaggguguggauagaggauaacccauggauggaagacaaaacaccaguuacuacgugggaaaaugugcccuaccuuggaaaacgggaagaucaguggugcggaagccuaauaggacugacaucgcgagcaacaugggcacagaacauaccuaccgcuauucaacaaguacgaucuuuaauaggaaaugaagaguucuuggauuacaugccgucaaugaaaagguuuagaaaagaagaagaaagcgaaggcgcgauaugguag

SEQ ID NO: 23380 - RNA, 9873 nt, Artificial Sequence
  derived and/or modified CDS sequence (opt6) from DENV-3__EU529686__SS-prME
acuagcuuaugcuugaugaugauuuuacccgcugcauuagcauuccaucugacaucuagggacggagaaccgagaaugauagucggcaaaaacgaaagagguaaaucauuguuauuuaaaacagcauccggaauuaauaugugcacacuuaucgcaauggauuuaggggaaaugugcgacgacacaguuacuuacaaauguccccauauuacagaaguggagccugaagauaucgauuguugguguaauuugacuucaaccuggguuacauaugguacaugcaaucaagcuggugagcacagaagagauaaacgaucuguugcacuggcuccacacguaggaauggguuuggacacaaggacacagacauggaugagcgcugaaggcgccuggcgacaaguggaaaaaguugaaacuugggcguuacgccacccaggauuuacaauauuagcucuauuccuugcccauuacaucgggacaaguuuaacgcaaaaaguuguaauauucauacuauugauguuaguaacaccguccaugacgaugaggugcguuggagucggaaaccgggauuucguggaaggauuaucuggugcaaccuggguagacguaguucuugaacaugguggcuguguuacaacuauggcuaaaaauaaaccuacacuagauaucgaacuucagaaaacagaagcaacacaauuagcaacauuacgaaaacuauguauugaaggaaaaauuacaaacaucaccacagauaguagguguccaacacaaggggaagcuguucuaccagaagaacaagaucaaaacuauguuuguaaacauaccuacguagauagagguugggggaacggaugugguuuauucggcaaagggucauuggugaccugugccaaauuucaaugccuugaaccaauagaggggaaaguaguucaauacgagaauuuaaaauauacaguaauuauaacaguacacaccggagaccaacaccaaguaggaaacgaaacacagggcgugacagcagaaauuacuccgcaggcuuccacaacugaagcgauucuaccugaauauggaacgcuaggccuugaaugcaguccacgaacggguuuggauuuuaaugaaaugauacuccuaacaaugaaaaauaaggcuuggaugguccaccgccaaugguucuuugauuuaccauuaccguggacuagcggagcaacgaccgaaacucccacauggaacagaaaagaacuguuaguaacauucaaaaaugcgcaugcaaagaaacaagagguagucguacuaggcucgcaagagggugcaaugcauacggcgcucacaggagcuacugagauacaaaacucgggagguacguccauuuucgcggggcauuugaaauguagacuuaaaauggacaaacuagaauugaaaggaaugucauacgcaaugugcacaaauaccuucguucuuaagaaagaagugucagaaacccagcauggcacgauucuaauuaaaguagaauauaaaggagaagauguacccuguaaaauaccauuuucaacagaagauggacagggaaaagcucauaauggccguuuaauuacagcuaacccgguggugaccaagaaagaagaaccuguaaacauagaagcagaaccaccuuuuggcgaguccaauauaguuauugguauaggggauaaugcucugaaaauaaauugguacaagaaagggucaagcauaggaaaaauguuugaagcaaccgcgaggggagcccgaagaauggcaauacuaggcgauacugcuugggacuucggcagcguagggggaguuuuaaauucacugggaaaaaugguacaccaaauuuuugguucagcauauacagcauuauuuagugguguaaguuggguuaugaaaaucggcaucggcguacuccugacauggaucggucuaaauucgaaaaauaccucuaugagcuucagcuguauagcaaucggaauaaucacauuauaucuaggagcgguuguucaagcagacaugggauguguuauuaauuggaaagggaaagaacuaaaaugcgguaguggcauauuugucacaaacgaaguacauacguggaccgaacaguacaaauuucaagccgauucuccaaaaagauuagcuacggcaaucgcuggagccugggaaaauggaguuugugguauuagaaguacaacacgaauggagaaucuacuguggaaacaaauugcgaaugaguuaaauuauauucucugggaaaauaacauaaaauugaccguuguaguaggggauauaauaggaguucuagaacaaggaaaacgaacacuaacgccgcagccaauggaauugaaauacucuuggaaaacuugggguaaagcaaaaauugugacagcagagacacaaaauagcucauuuauaauagauggaccaaauacacccgaguguccaagugcaucacgggccuggaauguaugggagguagaagauuacggauuuggaguuuucacuaccaacaucuggcuuaaacuucgagaaguguacacacaacugugcgaucaccggcuaauguccgcagcaguaaaagaugaaagagcaguacacgcugauaugggauauuggauagaaagucagaaaaacggaucuuggaaacuugagaaagcaucucuuaucgaagucaaaacaugcacuuggcccaaaagccauacgcucuggaguaacggaguauuagaauccgacaugauuauaccuaagucuuuggcggggccuauaucacaacauaacuacaggccggguuaucacacacaaacagcugguccauggcauuuggguaaguuagaacuggacuuuaacuacugcgaaggaacuacuguuguaauaacagaaaacugugguacaagaggaccaucucucagaacuacuaccgugucagguaaauuaauucaugaauggugcugcagaagcugcacauuaccuccccuaagguacaugggcgaagauggcuguugguacgguauggaaauuagaccaauuucagaaaaagaagaaaacauggucaagagcuuaguauccgcuggaagcggugaaguugauaacuuuaccaugggaguauuaugucucgcgauauuguucgaagagguaaugagaggcaaauucggcaagaagcauaugauugcaggggucuucuucacauuugugcuacuuuuaagcggacaaauuacguggcgagauauggcacauacgcuaauaaugauagguucgaaugcuagcgacagaaugggaaugggagugacauaccucgcccuuauugcuacauucaagauucagccguuuuuggcccuaggauucuucuuaagaaaauuaacaagccgagaaaacuugcuauuagggguaggacuugcuauggccacaacauugcaacuaccggaggauauugaacaaauggcaaacggaaucgcucuagggcugauggcauuaaaguugauaacacaauuugaaacguaccaauuauggacugcauuaauaucccuaacauguucaaacacgauauuuacuuuaacggucgcauggcguaccgcaacguuaauauuagccggugucucgcuacuaccaguaugucaaaguaguucaaugagaaaaacagacuggcuaccaaugaccguagccgcaaugggcguaccgccguuaccacuauuuauauucucauugaaagacacuuuaaagcgacgauccuggccacuuaacgaaggagugauggcgguaggauuaguaucaauccuagcaaguucguuacuaaggaacgauguuccaauggcaggcccgcuaguagcaggcggacuuuugaucgcuuguuauguuauuaccgguaccagcgcagaucuuacugucgaaaaagcggcagauguaaccugggaagaagaagcugaacaaacaggcgugucacauaaucucaugauaacugucgaugaugacgggacgaugcguauuaaagacgaugaaacggaaaacauucuaaccgucuugcuuaaaacagcccuuuuaaucgucagcgguauauucccuuauucaauaccugcaacccugcuaguguggcauacuuggcaaaagcaaacucaacggaguggcgucuuaugggauguaccaagcccucccgagacgcaaaaagccgaacuugaagaaggcgucuauagaauaaagcaacaagguauuuuuggaaaaacacaagucggagugggcguucaaaaagaaggaguauuucauaccauguggcacgucacaagaggggcugugcuuacauacaauggaaaaagacuugagccaaauugggcgucgguaaagaaggaucuaauuaguuacggaggaggguggcgguuaagugcacaauggcaaaaaggcgaagaaguacaagucauagcuguagaaccuggcaaaaaccccaagaacuuucaaacuaugccagguacguuucaaacaacuacaggcgaaauaggagcaauagcuuuggauuucaaaccugggacaucaggaagcccaauaauuaauagagaaggcaaggugguuggcuuauauggcaauggggucguuacuaagaaugguggguauguaucugggauugcacaaacaaacgccgaaccugacggaccuacaccagagcuggaagaagaaauguuuaagaaacgaaauuuaaccauuauggaucuacaucccgggucagggaaaacuagaaaguauuuacccgcgauuguuagagaggccauaaaaagaaggcuuagaacacugauucuagcacccaccaggguaguagccgcagaaauggaagaagcacuaaaaggacuaccgauaagauaucaaaccacugcaacaaaaucagaacauacgggcagggaaauaguggaccuaaugugccaugccacauuuacgaugcgcuuacugagcccaguucgugucccaaacuauaaucuaauaauaauggaugaggcucauuucacugauccagcaaguaucgccgcgagaggguauaucaguacuagaguugguaugggagaagcugcagccauauuuaugacugcaacgccaccgggaacagcugacgcauuuccacagagcaaugcgccaauucaagacgaagagagggacaucccagaacgcaguuggaacucaggcaaugaguggauaacagacuuugcggguaaaacggugugguucguuccgaguauaaaggcagguaaugauauagcaaauugucuucggaagaacggcaagaaaguuauucagcuaaguagaaaaacauuugauaccgaguaucaaaagacaaaacuaaaugauugggacuucguggugacaaccgauauaucggagaugggugcaaauuuuaaggcagauagaguuauagauccccguagaugucugaagccuguuauuuuaacagacggacccgaacgaguuauacucgcagguccuaugccuguaacugcugccucagccgcgcagagacgaggacggguugggcguaacccucaaaaagaaaacgaucaguauauuuuuacgggccagccuuuaaauaacgaugaagaucaugcacauuggacugaggcaaaaauguuacuagauaauauuaauacacccgaaggaauaauaccagcacucuucgagcccgagcgugaaaaaucagcagcaauagacggagaguauagauuaaaaggagaaaguaggaagacauucguggaacucaugcguagaggugaucugccgguaugguuagcccacaagguugcaagugaagguauaaaauauacagaucguaagugguguuuugauggacagagaaacaaucagauacuugaagagaauauggauguggaaauauggacaaaggaaggugaaaagaagaaacuuaggccccgaugguuggacgcccgaaccuauagcgauccacuugcccucaaagaauuuaaggauuuugcugcagggagaaaaagcaucgcauuagaucuggugacagaaauagguaggguuccgacacauuuagcucauaggacuagaaaugcccuagauaacuuaguaauguugcauaccagugaacaugggggaaaggcauauaggcaugcaguagaagaacuucccgaaacuauggaaaccuuacuucuuuugggauugaugauauuauuaacgggaggggcaauguuauuuuugaucucagguaagggaauagggaagaccuccauagguuuaauauguguaauugcuucuucaggcauguuauggauggcugaaauaccauuacaauggaucgcuuccgccauaguacuagaguucuuuaugaugguucuucuaauaccagaaccagaaaaacaaaggacgccucaggacaaucaacuggcguacguagucaucggcauuuuaacgcucgcggcaauaauugcagccaacgaaaugggccuacuggagacaacaaagcgugauuuagguaugucaaaggaaccgggaguaguuucuccuacaucauaucuugauguggauuuacauccugcaucggcauggacuuuguacgcaguagcaacaaccguaauaacaccgaugcuucgacauacaauagaaaacucgacagcuaauguaucuuuagcagcaauugcaaaucaagcagucguacucauggggcuagacaaagguuggccaauuucaaaaauggauuugggaguuccuuugcuugcucucggcuguuauucucagguaaacccguugacuuuaaccgcggcagugcuuuuauuaauuacucacuacgcgaucauagguccuggucuccaggcaaaggcuacaagagaggcucaaaaacgaacggcagcuggcauaaugaaaaacccaacaguagacgguaucaugacaauugacuuggacccgguuauuuacgauaguaaguuugaaaaacaauuaggacaagucauguuacuugugcuaugugcaguccaauuauuauugaugagaacaucaugggcauugugugaggcuuugacucuggcaacaggcccaauaacuacacuuugggaagggucgccgggcaaauucuggaacacuacaauagcuguaucaauggcuaacauauucagggguagcuauuuggcaggagcaggguuagcguucaguauaaugaagaguguugggacggggaaaagaggaacggguagucagggagaaacccugggugaaaaauggaagaagaaauuaaaccaacucucgagaaaagaauuugacuuauacaagaaaagugggaucacggaaguagauagaacugaagcuaaagaaggucugaaaagaggcgaaauuacucaccaugcaguaaguagggguucagccaaacuacaaugguucguggaacggaacaugguuauacccgaagggcgggugauagacuugggauguggccgggguggaugguccuauuauugugcgggacuaaagaaaguaacagagguaagaggcuauacuaagggaggcccaggccacgaagaacccguuccaaugucaacauaugguuggaauauagugaaacuuaugucuggaaaggauguauuuuaucuaccaccagaaaaaugugacacauuacucugugacauaggugaaucuagcccuaguccaaccguugaagaaucacguacaauucgaguguuaaaaaugguagaaccuuggcuaaagaauaaccaauucuguauuaaaguuuuaaauccguauaugccaacuguuauagaacaucuugaaagacuacagaggaaacacggaggcauguuagucagaaauccccucucaagaaauucaacacaugaaauguacuggauaucaaaugggacaggaaacauuguugccagcguuaauaugguaagccgucuccugcuaaaucgauuuaccaugacucauaggaggccaacgauugaaaaagacguagaccugggagcaggcacaagacaugugaaugcugaaccagaaacaccgaacauggauguaauaggggaacgaauuaaaaggauuaaagaagaacauaauagcacauggcacuacgacgacgaaaauccauacaaaacuugggcauaucaugggaguuacgagguuaaagcaacuggcucagcaucaaguaugaucaacggaguaguaaaacuucuaacaaaaccaugggauguaguccccaugguaacacagauggcgaugacugauacgacuccauucggacaacaacgaguauuuaaagagaaaguugauacuagaacuccaaggucaaugccgggaacucgacggguuauggggauuacagccgaaugguuauggcgaacacuggggaggaacaagaaaccccgucuauguacacgugaagaguucaccaagaagguccgcacuaacgcugccaugggagccgucuuuacagaagaaaaccagugggauucugccaaagccgccgucgaagaugaaaacuucuggaagcuaguugaccgggaacgugaacuacauaaacucggaaaaugugggucauguguauacaacaugaugggaaaaagagagaagaaauugggagaauuuggaaaagcaaaagguucacgugcuaucugguauauguggcugggugcgagauaccuagaguuugaagcacuuggauuccugaacgaagaucauugguuuucacgagaaaauaguuauaguggagucgaaggagaagguuuacauaaauuaggauacauucucagagauauaaguaagauacccgguggcgcaauguacgcggaugauacagcggguugggacacaagaauaacagaagaugaccuacacaacgaagagaaaaucacucaacagauggauccggagcacagacaacuggcaaaugcaauuuuuaaacuaacuuaccaaaauaaaguagugaaaguacaacguccaaccccaacaggaacaguaauggacauuauaucaagaaaagaccaaagaggaaguggacaaguagguaccuauggacugaacacauuuacgaacauggaggcacaauugauacgacaaauggagggugagggcguauuaaguaaggcagaucuagaaaauagccacuuaccugagaagaaaauuacacaauggcuagaaacaaaaggcguagaaagacugaaacguauggcuaucucuggggaugacuguguagugaaaccuauagacgaucgauuugcgaacgcauuguuagcgcugaaugacaugggcaagguuaggaaagauauaccucaauggcaacccaguaaagguuggcaugauuggcagcaagugccauuuugcucucaccauuuucaugagcuaaucaugaaagaugguaggaaauugguagucccauguaggccacaggacgaguuaauagguagagcuagaauuucacaaggagcuggauggagucuaagagaaacagccugccuaggaaaagcguaugcacaaauguggaguuuaauguauuuucacaggcgugaucuuagacuagcgagcaacgcgauaugcuccgcagugccaguacauuggguucccacuucaagaacaacauggucaauacaugcucaccaccaauggaugacgacugaggauauguuaaccgucuggaacaggguauggaucgaggacaauccauggauggaagauaagacgccgguaacgacaugggaaaaugugccauaucuugguaagagagaagaccaguggugcggaucgcucauaggauuaacaucacgugcuacgugggcucagaauauaccaacagccauacagcaagugcgaucccuaaucgguaacgaggaauuucuugauuacaugcccucaaugaagcgauuucgaaaggaggaagaaucugaaggagcaauaugguaa

SEQ ID NO: 23381 - RNA, 9873 nt, Artificial Sequence
  derived and/or modified CDS sequence (opt6) from DENV-3__EU529687__SS-prME
accucauuaugccuuaugaugauacugccggcggcccucgcauuucauuuaaccucucgcgacggggaaccgaggaugauuguggguaaaaaugaaagagggaaaaguuuacuguucaaaaccgcaagcgguauuaauauguguacucucauugccauggauuuaggugaaaugugcgaugacacuguuacuuauaaauguccucauauaacugaagucgaaccggaagacauagacugcugguguaauuuaacaagcacauggguuacguacggaacauguaaucaggcuggagaacaccggagagauaaaaggucaguugcguuagcgccacacgucggaaugggccuugauacucggacgcaaacauggaugagcgccgaaggggcuuggcgucaaguggaaaaaguggaaacaugggcacuucgccaccccggauucacgaucuuagcauuauuucuggcacauuacauagggacgagucuaacacaaaaaguaguaauuuuuauacuccuaauguuagucacuccauccaugaccaugcgaugcguuggcguggguaauagagacuuuguagaaggauuaucuggagcaacauggguagacguuguauuagaacauggaggaugcguaaccaccauggcaaagaauaaaccgacccuagauauagaacuacagaaaacggaagcgacacagcuugcaacguuaagaaaacuuugcauagaaggaaaaauuacaaacauaacgacagauagucgaugcccaacgcagggugaagcuguacuaccagaagaacaagaccagaacuacguauguaaacauacuuacguugauaggggaugggguaacgguuguggcuuauucggaaaagggucacuuguaacaugugcuaaguuccagugccuggaaccaauagaaggaaaaguaguacaauacgaaaaucuaaaguauacaguaauuauuacgguacauacgggcgaucaacaucaagugggcaaugagacucaggguguaacagcagaaauaacaccacaggccagcaccacugaagccaucuuaccugaauauggaacacugggcuuagagugcucgcccagaacgggucuagacuuuaacgaaaugauauuguuaacuaugaaaaacaaagcauggaugguucaccgacaaugguucuuugaucucccauuaccauggacaaguggagccacaacugagacuccaacauggaacagaaaggaacuauuaguuacauucaaaaaugcccaugcuaaaaagcaagaagugguagugcuagguagucaagaaggcgcgaugcacacagcacuuaccggugcuacugagauccaaaauucaggcgggacaucgauauuugccggccauuuaaagugucgcuugaagauggauaaacuugaguuaaagggaaugagcuaugccauguguacaaauacguucguacuaaagaaagagguaucugagacacaacauggaaccauacugauaaagguggaauacaaaggagaagauguacccuguaaaauucccuuuagcacagaagacggacaagggaaggcacauaacggcagacuaauuaccgcuaauccuguaguuacuaagaaagaagaacccguaaacauagaagcggaaccaccauuuggugaaagcaauauuguaauugguaucggagauaaugcauuaaagauaaauugguauaagaaaggaucuucuauagggaagauguucgaggcaacugcccgaggugcacgacgcauggcgauacuaggcgacacagccugggauuuugggagugucggaggcguacuaaauucccuagguaaaaugguucaccagauauuugguagugcauauaccgcacuguuuucagggguuucuugggucaugaaaauagggauugguguauuauuaacuuggauaggacugaacagcaagaauacguccaugaguuucaguuguauugcaauagguauaauaacccuauaucugggagcuguaguacaagcagauaugggaugcgucauuaauuggaaggguaaagagcucaaguguggaaguggcauuuuugucacaaaugaaguacacacuuggaccgaacaauauaaauuucaagcggacaguccaaaaagacuugcaaccgcgauugcgggcgcgugggaaaacgggguuugcgggauacguucaacaacccggauggagaacuugcuuuggaaacaaauagcaaacgaacuaaauuauauucuaugggaaaauaauaucaaauuaacagugguaguuggagacauaauugggguauuagaacaaggaaagcgaacgcuaacaccacaaccuauggaacuuaaauacucuuggaaaacuugggggaaagcuaaaauaguuacugcagaaacacaaaauaguucauuuauuaucgauggaccaaauacgccagagugcccuucggcgucuagggcauggaacguuugggaaguagaggauuaugguuuugggguauucacaacaaacauauggcugaaacuacgagaaguuuauacacaauuaugcgaccacagauuaaugucagcagcagucaaagaugaaagggcgguacacgcagacaugggcuacuggaucgaaucucagaaaaacggaucauggaaacucgaaaaggcaucguuaauagaaguaaaaacaugcacauggcccaaaucacacacucuauggucaaauggaguguuagagucggacaugauuauuccaaaaucacuagcggguccgauaucacaacacaauuacaggccaggauaucauacucaaacagcugguccauggcaucuuggaaaacuugaacuggacuucaacuauugcgaaggcacaacagugguaauuacggaaaauuguggaacuagaggacccaguuugaggacgacuacaguaucggguaaacuaauacaugagugguguuguaggucauguacacuaccuccacugagguauaugggcgaggaugguuguugguaugggauggaaauaagacccauaagugaaaaagaagaaaacauggucaaaaguuuagucagugcagguucaggagagguagauaacuuuacaaugggugucuuaugccuagcaauacuuuucgaagaggugaugagagguaaauucggaaagaaacacaugauugccgggguguucuuuaccuuuguacuauuguuaaguggacaaaucacauggcgagauauggcacauacccucauaaugauuggaucuaaugcuucugacaggauggggaugggaguuacauaucucgcuuugauugccacguuuaaaauacaaccguuuuuggcacuuggguucuuucuaaggaaacuaacaaguagagaaaauuuauuauuaggcgucggcuuggcaauggccacaacucuacaacucccagaagacaucgaacaaauggcuaauggaauugcucuuggacuaauggcccuaaaauugauaacucaauucgaaacuuaucaacuauggacggcauuaauauccuuaacaugcaguaacacgauuuuuaccuugaccguagcuuggcgaacugcuacuuugauacuagcaggaguuucucucuuaccuguaugucaaaguaguucaaugcguaaaaccgacuggcuucccaugacagucgccgccaugggaguuccuccacuaccgcuguucaucuucagccuuaaagauacuuuaaaacgucguucuuggccuuuaaaugaaggcgucauggcaguaggauuaguaucaauacuagccuccucacuuuuaagaaaugacgucccuauggccggaccacuggucgcaggaggauuauugauagcauguuaugugauaacggguacaagugcagaccucacgguagagaaagcagcagauguaacaugggaagaagaagcugagcaaacuggaguaucacauaaucuuaugauaacggucgacgaugacggaacuaugagaauaaaggaugaugaaacagagaacaucuugacgguacuacuaaaaacagcacucuugauagucagugguauauuuccauacagcaucccugcaacacuauuaguguggcauacguggcaaaaacaaacccaaagaucaggaguuuugugggauguuccgagcccuccggaaacccagaaagcagaacuagaggaaggagucuaccgaauaaaacaacaggguauauucgguaaaacacaaguugguguaggcguacaaaaggaggguguuuuucacacuauguggcauguuacaaggggcgccguacucacuuacaaugggaaaagauuggaacccaauugggcaucaguuaagaaagauuuaauaagcuaugggggagguuggaggcucagugcucaauggcagaaaggcgaagagguacagguuaucgcggucgaaccuggcaaaaaucccaaaaauuuucaaacaaugcccggaacauuucaaacuacaacuggugaaaucggagcgaucgcauuagauuuuaaaccagguacaucgggaucuccaauuauaaacagggaaggaaaaguaguaggucuauacggaaaugguguggugacuaagaacggagguuacgugucaggcauugcccagacuaaugcagaaccggacggaccuacaccagaacuugaggaagagauguuuaagaaacgaaaucuaaccauaauggauuuacauccgggauccgggaaaacaaggaaauaccuaccagccauaguacgggaagcgauuaagcgccgacuccgaacccuuauccuugcaccgacacgcguuguagcugcagaaauggaggaagcucugaagggucuccccauaagauaccagacuacagcaacaaagucggaacacacuggucgugagauuguagauuuaaugugccaugcaaccuuuacaaugcgacuauuaucaccuguuagaguaccuaauuacaauuugauaauaauggacgaagcucauuuuacugacccagcaucgauagcugcaagaggauacaucucuacaagaguagggaugggagaagcugccgcaauuuuuaugaccgcaacaccaccagguaccgccgacgcauucccccaaucgaaugcucccauacaagacgaagaaaaggauauacccgaaaggagcuggaacucugguaacgaguggaucacagacuucgcagguaagacgguaugguucguaccuaguauaaaagcggguaaugacauagcaaacugcuuaaggaaaaauggaaagaaagugauacaauuaucccguaagaccuucgacacagaauaccagaaaacgaaacuuaaugauugggauuuugugguaacgacggauauaucggaaaugggagcaaacuuuaaagcugaccgaguaauagacccacgcagaugcuuaaagccaguaauccuaacagacggcccugaaagggugauucucgcugggccaaugccgguuacagcugccagugcagcgcaaaggagaggucguguaggucgcaauccgcagaaagaaaacgaucaguauauauuuaccggacagccuuuaaacaaugacgaagaccacgcccauuggacugaagcaaaaaugcugcucgauaauauuaacacaccagaggggaucauaccagcacuauuugaaccagaaagagaaaagucugcagcuauagacggggaauacagauuaaaaggugaaucgaggaaaacuuuuguagaacuaaugcgaagaggggauuuaccgguguggcucgcgcauaaaguagcaucugaaggaaucaaauauaccgauagaaaaugguguuucgauggucaacgcaauaaucaaauacucgaggaaaauauggauguggaaaucuggacaaaagaaggcgagaaaaagaaacuacgaccacgauggcuagaugcuagaacauauagugauccucucgcguugaaagaauuuaaagauuuugcagcugguaggaaaucaauugcguuggaucuagugacggaaaucggaagaguacccucccaucucgcacauagaacaaggaaugcuuuagacaaucuaguaaugcuacacacaagugaacauggcggaaaagcauaucgucaugcaguugaagaauuaccugagacaauggaaacuuuacuacuccuugguuugaugauccuguuaacgggaggggcaaugcuauuuuuaauuagugggaagggcauaggcaagaccucgauuggacugauuuguguaaucgcuucuuccgggaugcuauggauggcagaaauaccauuacaauggauugcgucggcaaucguauuggaauuuuucaugaugguucuucuaauacccgagccagaaaagcaaaggacgccacaagauaaccaguuagccuacguuguuauuggaauacuaacuuuagcagcaauaauagcggcaaaugaaaugggauuauuagagacgacuaaaagagauuuagguaugagcaaagaaccugggguaguaucaccaacgucguaccuagauguagauuuacauccggccucagcauggacucuauaugcuguugcuaccaccguaauaacgccaaugcuaagacauaccauugaaaacucaacugcaaacguaaguuuggcagccauagcuaaccaagcgguugucuuaauggguuuagacaaaggauggccgauaaguaaaauggaucuaggaguuccacuacuagcacugggauguuauucucaaguuaauccauuaaccuuaacagccgcaguucuucucuuaaucacccacuaugccauaauuggcccgggguuacaagcuaaagcaacaagggaagcccaaaagaggacagcagcugggauuaugaaaaaccccacaguagacgguauaaugacgauugacuuggacccuguuauuuaugauuccaaauuugaaaaacaacucggacaggucaugcuguuaguucugugugcagugcaauuauuacugaugagaaccuccugggcacucugugaggcauugacauuagcuacuggaccgauuaccacgcugugggaagguagcccagguaaauuuuggaauacgacuauagcuguaagcauggcaaacauuuuuagaggaagcuacuuagcaggcgcaggacuagccuuuucuauaaugaaaucaguuggaacaggaaagcgaggaaccggaagucaaggagaaacacucggcgaaaaauggaaaaagaagcuaaaccagcucucucggaaagaauuugauuuauauaaaaagucagggauuacagagguagaucgcacugaagcaaaagaaggauuaaaaagaggggaaauuacacaucacgcggugaguagagguucagcuaaauugcaaugguuugucgaaagaaauauggucauacccgaaggacgagugauugauuuggguugcggucgggguggcuggagcuauuauugugcuggucuaaagaaaguaacagaaguaagaggguauacaaaaggcgggccaggucaugaggaaccaguaccaaugucaaccuauggauggaacauuguuaagcuaaugucgggcaaagauguauuuuacuuaccaccagaaaaaugcgacacacuacuaugugauauaggugagucaaguccgucaccaacgguagaagaaagcagaacgauuaggguccuaaaaaugguagagccguggcuuaagaauaaucaguuuuguaucaagguacuaaauccauauaugcccaccguaaucgaacaccuagaaagauuacaacgaaaacauggagguauguugguaagaaacccauuaaguagaaauagcacucaugaaauguacuggauuucaaacgguacagguaacauaguggcgucaguuaauauggugucaagauuacuauugaaccguuucaccaugacacauagaagacccacaauagaaaaagauguagauuuaggcgcuggaacucgccacgucaacgcagaaccagaaacaccaaacauggaugugaucggugaaaggaucaaaagaauaaaggaagaacauaauucaaccuggcacuacgaugacgaaaauccuuauaaaacgugggcauaccauggcaguuacgagguaaaggcuacagggagugcuuccaguaugaucaauggugugguaaaauuguuaacaaagccaugggauguaguaccgauggugacacaaauggcuaugacugauacuacuccauucggucaacagagggucuucaaagaaaaaguagauacuaggacgcccagaagcaugccggggacucguagaguuaugggaaucacggccgaauggcuauggcgaacguugggacgaaauaagaaaccccgucucuguacuagggaagaauuuacgaagaaaguuagaacgaacgcagcaaugggugcaguauucacugaagaaaaucagugggacagugcuaaggccgcuguagaagacgaggauuuuuggaaauuaguggaccgugaaagagaacuacauaaacuugggaaguguggaucaugcguuuauaauaugauggguaaaagagagaagaaauuaggcgaauuuggaaaagcaaaaggaucacgcgcgauaugguacaugugguugggagcucgguauuuagaauuugaagcguuaggcuuucuuaaugaggaccauugguuuaguagagaaaacaguuauucggguguugaaggagaggggcuacacaaacuaggguauauauuacgagauauuucaaagauacccggaggggccauguaugccgaugacacggccggcugggauacccggauaacugaagacgaucugcauaaugaagagaaaauaacucaacaaauggacccagaacauagacagcuugcaaaugccauuuucaaacucacguaccagaacaagguuguaaaaguacaacgcccaacaccuaccggaacaguaauggauauuauaagccguaaagaccagagagguucaggacaaguuggaacauauggcuuaaacaccuuuaccaauauggaagcgcaauuaauacggcaaauggaaggagagggaguauuaaguaaagccgacuuagagaauccucaucuuccugagaagaaaauaacucaaugguuagagacaaaggguguagaacgucuuaaaagaauggccauaaguggugaugacugcgucguaaaaccgauagaugaucguuuugcuaacgcucuccucgcacuuaaugauaugggaaaaguuagaaaggacauuccacaguggcaaccgaguaaaggauggcacgacuggcaacagguacccuuuuguagucaucacuuccaugaacugauaaugaaggacggccguaaacuugucgucccuuguaggccacaggacgaacuaauuggaagggcaagaauaagucaaggggcuggauggucguuaagagaaacugcgugucuaggaaaagccuaugcucagauguggucacucauguauuuucaucgaagagaccuuagguuagcaucaaaugcuauauguucagcuguucccguccauuggguaccaacaaguagaacaacaugguccauacaugcucaucaucaauggaugacgacugaagauauguuaaccguauggaacagaguauggauagaagauaacccguggauggaggauaaaacucccguaacaacaugggagaaugugccauaccuaggaaaaagggaagaucaaugguguggcucucuaaucggacuaacaagucgggcaaccugggcucaaaacauaccaaccgcuauucaacagguacgcagucucauagguaacgaggaauuuuuggacuacaugcccucaaugaaacgcuuccgaaaagaggaagagucagaaggugcuaucugguag

SEQ ID NO: 23382 - RNA, 9873 nt, Artificial Sequence
  derived and/or modified CDS sequence (opt6) from DENV-3__KF955449__SS-prME
acaagccuaugccuaaugaugauacucccagcagcacuagcuuuucaucuaacaucgcgugauggggaaccuaggaugauuguaggcaaaaaugaacgcggaaaaucauuauuauucaaaacagcaucuggaauaaacaugugcacacuuauagcaauggauuuaggagaaaugugugacgauacagugacauacaaauguccgcauauuacggaaguggaaccagaagauauugacugcugguguaaucuaaccucuacuugggugacauaugguacuuguaaucaagcgggggaacaccggagagacaaaagaaguguggcacuugcaccacauguuggaaugggauuagauacucgaacacaaacguggaugucggcagaaggugcguggcgacaaguugaaaaaguagagaccugggcacuuagacauccugguuuuaccauucucgcgcuauuucuagcgcauuauauuggcacgucacugacgcaaaaaguaguuauuuuuguauuauuaaugcuagucacgccgucuaugacgaugaggugcguaggaguugggaaucgggauuuugucgaagguuuaaguggggcaacauggguagacgugguguuagagcacggcggaugcguaacaacaauggccaaaaacaaacccacuuuggauauugagcugcagaaaacugaggcaacgcaauuagcuacacuaagaaaacucuguauagaaggaaaaaucacaaauauuaccacagauucccguuguccuacacaaggcgaggcaguucuaccagaggaacaagaucaaaacuacguuuguaaacacacauauguugaccgaggcuggggaaauggguguggauuguuugggaaaggaagucuuguuacaugugcuaaauuucaaugucuggaaccuauagaaggaaaagucgugcaguaugagaauuuaaaauauaccguaauaauaacagugcauacaggugaucaacaucaaguagguaacgaaacgcaggguguuacugcagaaauuacaccacaagcaucaaccacagaagccauacuuccagaauauggaacucuaggauuagaaugcaguccacgaacuggauuggacuuuaaugagaugauauuauuaacgaugaaaaacaaagcauggauggugcauaggcaaugguucuuugaucugccauugcccuggacaaguggcgcuacaacagaaacaccuacauggaauaggaaagaauuguuagucacuuuuaagaacgcucacgccaagaaacaggaaguuguuguguuagguucgcaggaaggugcaaugcacacagcguuaacgggggcaacagaaauacagaauaguggugguaccaguauauucgccggucaccuuaaaugccgcuuaaaaauggauaaacuugaauuaaaagguaugucuuaugcaauguguacuaauacuuucguacuaaagaaagagguaagugagacccagcauggaacgauacugauaaaaguugaauauaaaggagaggaugugcccuguaaaauuccauuuaguaccgaagauggacaaggaaaagcgcauaaugggcgacucaucacugcuaauccaguaguaaccaagaaagaagaaccaguaaauauagaagccgaacccccauucggggaguccaauaucguuaucggaaucggagacaaugcauugaagaucaauugguauaagaaaggaucaagcauuggaaaaauguucgaagcgaccgcgcggggagcacgaaggauggcaauacuaggagacaccgcaugggauuuugggucaguaggaggugugcuuaauucacugggaaaaaugguucaccaaauuuucggaagugccuauaccgcacuauuuucaggagucagcuggguuaugaagauaggcauuggcguguugcucacauggauuggccuuaauagcaaaaauaccucuaugucguuuuccugcauugccaucgguauaauuaccuuguaccuaggcgcgguaguacaggcggauaugggcuguguuauaaauuggaaagguaaagaguuaaagugugguagcgguauauucguuacgaaugaggugcauacuuggacagaacaauauaaauuccaggccgacucgccuaagagacucgcuacagcaaucgcuggcgcgugggaaaauggggugugcggaaucaggagcacgacacguauggagaacuugcuauggaaacaaaucgcaaaugaauuaaacuauauacugugggaaaauaauaucaaacuaacaguuguugugggagacaucaucggcgugcuagagcaagguaaacgaacgcucacgccucagccaauggaauuaaaauauucauggaagacauggggaaaggcaaaaauaguaacggccgagacucaaaacagcagcuucauaauagauggacccaacaccccagaauguccuucugcaaguagagcauggaacguuugggaaguagaagacuaugguuucggaguauuuacgacaaacaucuggcuaaaacuucgugagguguauacgcaacuuugugaccauagauuaaugagugcagcagugaaagacgaacgggcgguacaugcagacaugggauauuggauugaaucucagaaaaacggaagcuggaagcuagaaaaagcgagucuuaucgaggucaagacauguaccuggccuaagagucacacacuguggucaaaugguguucuugaaucagacaugauaauaccaaaaagucuugcggggccuauuucacaacacaauuauagacccggauaucauacucaaacggcugggccuuggcaucuaggaaaacuagaauuagauuucaacuacugugaggggacuacaguugugauaaccgaaaacugcggcacaaggggcccuaguuuaagaacaacuacagugucggguaagcuaauacaugaaugguguuguagaaguugcacccuuccuccguugcguuauaugggcgaagauggauguugguauggcauggaaauuagacccauauccgaaaaagaagaaaacauggucaagucacuuguaagcgcaggaucuggugaaguagacaauuucacaaugggaguauugugucuagcaauccuauucgaagaagucaugaggggcaaauuuggcaagaaacacaugauugccgguguauucuucacuuuuguauuauuauuaaguggucagauuacauggagagacauggcacauacccuaauaaugaucggaucaaaugcuuccgaucgcaugggaaugggugugacuuauuuagcauuaauagcaacauuuaaaauacaaccauuucuagcucuuggauuuuuccucagaaaacuuaccucaagagagaaucuauugcuuggaguugggcuagcaauggcaacuacauuacaacuaccugaagacauugagcaaauggcuaacggaauugcuuuaggcuugauggcauugaaacugaucacccaauuugaaacauaccagcuauggacagcucugaucagccuaaccuguucgaauacaauauucacguugaccgucgcauggaggaccgcaacauuaauucuagccggagucucucuauuaccuguaugccaaucgaguucuaugagaaaaacagacugguugccgaugacagucgcagcuauggggguuccuccguugccacuauucauuuucagcuugaaagauacacuuaaacgaagaucuuggccucuuaaugaaggaguuauggccgugggauuaguaucuauccuugcgaguucacuacugagaaaugacguaccgauggcaggucccuuaguggcggguggacuauuaauugcaugcuaugucaucaccggcacaagcgcagacuuaaccguagaaaaagcugcagauguaaccugggaagaagaagccgaacagaccggggugagccauaaccuuaugauuacaguagaugaugacggaacgaugcggauuaaggaugacgaaacggagaauauacuaacuguauuacuuaaaacggcauuacuaauaguaagugggauauucccauacucaaucccagcuacuuuacucguguggcauacguggcaaaaacagacucaacgaucgggagucuuaugggacguuccgagucccccugaaacgcagaaagcagaauuagaagaagguguguacagaaucaaacagcagggaauauucgguaaaacucagguugggguggggguacaaaaagaaggaguguuccacaccauguggcacgugacaaggggugcgguauuaaccuauaacggcaaaaggcuugaacccaauugggcaagugucaagaaagaccuaauuucauacgguggcggauggagauuaagugcgcaauggcaaaaaggugaagaagugcaaguaauugcuguagaaccaggcaaaaaucccaaaaauuuucaaaccaugccggguacauuccaaacaacuacaggcgaaauuggggcuauagcauuagauuucaaaccugggacaaguggcucgccaauuaucaaucgagaagguaagguuguagguuuauacggaaauggagugguaacgaagaauggaggcuacguaucagguauugcacaaacuaaugcagagccugacggccccacgccugaacuagaagaagaaauguucaagaaaagaaauuuaacaauaauggaccuacauccuggaucagggaaaacuagaaaauacuugccugcaauaguuagagaagccaucaaacgacgguuacggacgcuaaucuuggcgcccacgcgcguuguggcugccgaaauggaagaagcguugaaaggcuugccuauuagguaucagacuacagcaacaaaaagcgagcauacggggagagaaauaguagaucuaaugugucaugcaacuuuuacgaugcgauuacuaaguccgguccguguaccaaacuauaaucuuauuauaauggaugaagcccauuuuacugauccagcaucuauugccgcgcgaggcuauauauccacuaggguuggaaugggugaagcggcagccauuuuuaugacggcaaccccgccagguacggccgacgcauucccccaaaguaaugcaccaauucaagaugaagaaagggauauuccugaacgaucauggaauagcggaaaugaauggauaacggacuuugcgggcaaaacaguuugguuugucccauccaucaaggccgguaacgacauagcaaauugccuaaggaaaaauggcaagaaagucauacaacugagccgaaaaacauuugacacagaauaccagaaaacgaaauuaaacgacugggacuucguagugacaacagacauuucugaaaugggcgcuaauuuuaaagcagauagaguuauagauccaagaaggugucuaaaaccuguuauuuugacggauggaccggaacguguaauacuugcaggacccaugccuguaacagcagcaucugcagcacagcgcagaggcagaguaggacgaaacccacagaaggagaaugaucaauauauauuuacaggacaaccccuuaacaaugacgaggaccacgcacauuggacugaggccaaaauguuacuggacaacauaaauacacccgaaggaauaauuccagcucucuucgagccagaaagagaaaagagugcugccauugacggcgaauaucgacuaaaaggagagucacgaaaaacuuuuguagaauugaugcguagaggagaucuacccgucuggcuagcacauaaaguugcgagugaaggaauaaaauauaccgacagaaaauggugcuuugauggucaacgaaauaaucaaauacuggaagaaaacauggauguugaaauauggacaaaggaaggagagaagaagaaacuuaggccaaggugguuggacgccagaacauacucagauccauuggcgcuaaaagaauuuaaagauuuugcagccggacguaaaucuauagcacuagaccuagucacugaaauaggaagagucccaucucaucuagcucauagaacacguaaugcucuugauaauuugguaauguuacacaccagcgagcauggugguaaagcauaucgucaugcgguagaagaacuucccgaaacgauggaaacccuacuauuacucggauuaaugauacuccucacaggaggagccauguuauucuuaaucagcggcaaagguauaggaaagacuucaauaggucuaauaugcgucauugcaucaucuggaauguuauggauggcagaaaucccacuacaauggauugcgagugcaauagucuuagaauuuuucaugaugguauuauuaauacccgaaccagaaaaacaaagaacuccacaagacaaucaauuggcauaugucgucauaggaauuuuaacucuagcagccaucauagcagccaaugagaugggguuauuagaaacaacaaaaagagacuugggaaugagcaaggaaccggguguuguuucucccacuucuuacuuggauguagaucugcauccggcaucagcuuggacuuuauaugccgucgcaaccacaguuauuaccccgauguuacgacauacaauugaaaauucgacugcuaacguaagucuagcagcuauagccaaccaagcggugguacugaugggacuagauaaaggauggccaaucucgaaaauggaucugggaguaccacuuuuagcacucggauguuauucccaaguuaauccauuaacacuuaccgccgccguucuacuucuuauuacacauuacgcgaucauagguccaggucuccaagcgaaagcgaccagggaagcacaaaaacgaacggcagcagguaucaugaaaaacccgacgguugacggaauuaugacaaucgaucucgacccugucauauacgacagcaaauuugagaaacaacuuggucagguaaugcuguuaguuuuaugcgcaguucaauuacucuuaaugcggaccucgugggcucuaugcgaagcccuaaccuuagcuacaggaccaauaacaacucuaugggaaggaucaccaggcaaguuuuggaacacuacaauagcagucucgauggcuaauauauuucgaggaucauaccuugcuggagcgggacuagcauucucaauaaugaaauccguggguacagggaagcgagguacaggaagccaaggggaaacuuuaggagaaaaauggaagaagaaacucaaucaauuaagccgaaaagaguucgaccuuuauaagaaaucgggaaucacagagguagaucgaacugaagcgaaagaaggcuuaaaaagaggagaaaucacacaccaugcaguaucaagggguucagcuaaacuacaaugguuugucgaacgcaacaugguaaucccagaaggaaggguaauugauuugggcugugggcgaggaggauggucuuauuacugugcugguuugaagaaaguuacugaaguuagaggguacacuaaaggcggccccggucaugaggaaccaguuccaaugucaacuuacgguuggaauauaguaaaacuaaugagcgguaaagauguguucuaccuaccucccgagaaaugugauacauuauuaugcgauauaggagaaaguucaccaaguccaacaguugaagaaucuaggacgauacgcguauuaaaaaugguagaaccauggcugaaaaauaaucaauuuuguauaaagguacucaacccuuauaugcccaccguaauagagcaccuugaaagauuacaaagaaaacacggaggaaugcuagugaggaauccauuaagcagaaauucuacucaugaaauguacuggauaaguaauggaacugguaauaucguagccagugucaauaugguaucuagacuucuauugaauagguucacaaugacucaucgucgaccuacuauagaaaaagauguugacuuaggagcaggaacgagacacgugaacgcugaaccagaaacgccgaacauggauguaaucggugaacguaucaaaagaaucaaagaagaacacaacucgaccuggcacuaugaugaugagaaucccuauaaaacaugggcguaccacgguucguaugagguuaaggcuacuggaucagcaucaucaaugaucaauggcgugguaaaacuauuaacaaaaccgugggacguugucccaaugguuacgcaaauggcaaugacagacacuacgccguucggacaacaacguguguuuaaggaaaaggucgacacgaggacgccacgaucaaugccaggaacgagacgcgugauggggaucacggccgagugguuguggagaacguuaggaagaaauaagaaaccacgacugugcacuagagaagaguuuacuaaaaagguaagaaccaacgcggcgaugggagcgguguucacggaagaaaaccaaugggacucggcgaaagcggccgucgaagaugaagauuuuuggaaguuaguagaccgggaaagagaacuucauaaguugggcaaaugcggaucuugcguuuauaacaugaugggaaagagggagaagaaauuaggggaguucggcaaagcuaagggaagccgagcgaucugguacauguggcuuggagccagguaucuggaauuugaagcgcuugguuuccuaaaugaagaccauugguucuccagggaaaacucauacucgggaguugaaggcgaaggccuacauaaacuagguuauauacuuagggacaucucuaaaauucccgguggugccauguaugcagaugauacagcgggaugggacacucgaaucacugaagacgaccugcauaaugaggagaaaauaacucagcaaauggauccugaacaucgucaguuagcaaacgcaauuuuuaaacuaacuuaccaaaauaaaguaguaaaaguacaaagaccgacuccuacgggaacaguaauggacauaaucucccggaaagaccaacgcggaucuggucaaguaggaacguacggauuaaauacauucacuaacauggaagcacaacucauuagacaaauggagggagaagggguucuaucaaaggcagacuuggagaauccacaccuaccggagaagaaaauaacacagugguuagaaaccaaaggaguagaacgacugaaacguauggcgauuucaggcgacgacuguguuguuaaaccaauugaugaccgauucgcuaacgcacuuuuagcucugaacgauauggggaagguuaggaaggauauaccgcaauggcagccgucaaaaggguggcaugacuggcaacaaguuccauuuugcucccaucauuuccacgaauuaauaaugaaggacggaaggaaauuaguagucccuugcagaccccaggaugaauuaauugguagagcaaggaucucgcaaggagccggauggucuuuaagggaaacggcaugcuuaggaaaggcguaugcucaaauguggucacuuauguacuuucauagaagagaucuaagacuagcaucuaaugcuauuugcucagcggugccggugcauuggguaccaacgucacguacaacguggagcauacaugcacaucaccaauggaugacgacagaggacauguuaacaguauggaaucguguguggauugaagacaauccuuggauggaagauaaaaccccaguuaccacaugggaaaacgucccuuauuuggguaaacgagaagaccaauggugcgguagccuaaucggacuaacaagccgagcuacgugggcccagaauauuccaaccgcuauacagcaaguuagaagucuuauaggaaaugaagaauuucuagacuauaugccuucaaugaaacgauuuagaaaggaagaggaaagcgaaggagcuaucugguag

SEQ ID NO: 23383 - RNA, 9873 nt, Artificial Sequence
  derived and/or modified CDS sequence (opt6) from DENV-3__FJ373303__SS-prME
accagcuuaugccuaaugaugauacuuccugcagcgcuagcauuucaccuaacuucacgagacggggaacccagaaugaucguagggaaaaaugaaagagguaaaucccuacucuuuaaaacugcuagugguauaaauauguguacgcuaauugcgauggaucuaggcgaaaugugugacgauacaguuacguacaaaugcccccacauuaccgaaguugaaccagaagauaucgauuguuggugcaaccuaaccucuacauggguuacuuaugggacaugcaaucaagcuggugaacaccgaagagauaaaagaagcguagcgcuagcuccgcauguuggcauggguuuggauacaagaacucaaacauggaugagugcugaaggagcuuggcgucagguugaaaaaguagaaacuugggcauuacgacacccugguuucaccauccuagcacuauuuuuggcacauuauauuggaacgucccuaacccaaaaagucguaauauuuauccuucuuaugcucgucacccccucuaugacaaugaggugcgucggaguuggaaauagagacuucgucgaaggacuguccggugcuacguggguugacgugguauuggaacauggcggcugcguuacaacgauggccaaaaauaaaccuacucuagauauagaacuacagaaaacagaagcuacgcaacuugcuacgcuaagaaaacuauguauagaaggcaaaaucacaaauauaacaacugauaguagguguccaacacaaggagaagcaguccuaccagaagaacaagaucaaaauuacguauguaagcauacauacguugauagagguuggggcaacgggugcgggcucuuuggaaaagguaguuuaguuacaugugcaaaauuucaauguuuagaaccaauugaagguaaggucguacaguaugagaaccuaaaauacacugucauaauuaccgugcacacaggggaucaacaucagguggguaacgaaacacaaggcguaaccgcagaaauaacgccacaagcaucuacaacagaagcuauuuuaccagaguacgguacuuuaggauuagaauguaguccacguacuggcuuagauuuuaacgaaaugauucuguugacuaugaaaaacaaagcauggaugguucacagacaaugguuuuucgauuuaccuuuaccguggacuucaggagcaacaacagagacuccaacauggaacagaaaggaguugcuagugacauuuaagaacgcacaugccaagaaacaagaagucguugucuuagggagccaagagggcgcaaugcacacagcacugacaggcgcuacugaaauacaaaacaguggugguaccucaauauucgcgggacauuuaaaguguagauuaaaaauggacaaacucgaacuuaaagguaugucguacgcaaugugcacuaauacauucguauuaaagaaagaggucucugagacucaacacgggacaauccuaauuaaagucgaguauaaaggugaagacguuccuuguaaaauaccauuuaguacugaggauggacaagggaaggcacauaacggcagacugaucacugcaaauccgguugucacuaaaaaggaagaaccaguaaauauugaggcagaaccgccguuuggugaaucuaacaucguaauagguauuggagauaaugcgcucaagauaaacugguauaagaaaggcagcucaauugggaaaauguucgaagccacugcgagaggcgcuagacgaauggcgauauuaggugauacagcaugggacuuuggaagcguagggggagugcuuaauucacucggaaaaaugguacaucaaauuuucggaucagccuauacagccuuauucagugggguuuccuggguuaugaaaaucggcauagggguacuauuaaccuggaucggauugaacucaaagaauaccucaaugagcuucuccuguaucgcaauugguaucauaacucuuuacuugggugcugucgugcaagcagauaugggauguguuaucaauuggaaggggaaagaauugaaaugcgggaguggcauuuucguaacaaacgagguucauacauggacagaacaauauaaguuucaagcggauucucccaagcgauuggcaacagcgauugccggagcgugggaaaauggaguuugugggauacgaaguacuacucggauggaaaacuuacuauggaaacaaauugcuaaugagcuaaauuacauauugugggaaaauaaugucaaacucacagugguuguuggagauauuauuggcgucuuggaacaagguaagagaacuuuaacuccacaaccuauggaacuaaaauauaguuggaaaaccugggggaaagccaaaauaguaacagcugaaacacaaaauucaucuuuuauuauagauggaccgaacacaccugaaugcccaagugcgagucgagcauggaaugugugggaggucgaagacuauggcuuuggagucuucacuacaaauauaugguuaaaauuaagagaaguuuacacacaauuaugcgaucaucgcuuaaugucugcugcagugaaagaugaaagagcaguacacgcagauaugggcuauuggauugagagucaaaagaauggaagcuggaagcucgaaaaagcaaguuugauugaggugaaaacuugcacauggccaaagagucauacgcucuggagcaaugguguauuagaaucugauaugauaauaccuaaaagucuggcgggaccaauuagucaacauaauuauagaccuggauaucauacucaaacagcaggcccuuggcauuuaggcaagcuagagcuagauuuuaacuacugugaagguacaacggugguuauuacagagaacuguggaacucguggaccuagccuacgaaccacgacaguuaguggaaaauugauucaugaauggugcugcagaagcugcacacuaccuccauuacguuauaugggugaggauggcugcugguacgguauggaaaucagacccauuuccgagaaggaagaaaacauggucaaaagccugguuucagcuggcagcggagagguugauaauuucacaaugggagugcuaugucuagcaauauuauucgaagaggugaugcggggaaaguuugguaaaaagcauaugauagcagggguuuucuucacguucguauuacuacugagcgggcaaauuaccuggagagauauggcgcauacucuaauaaugauagggucgaaugcaagugauagaaugggaaugggggucacuuaucucgcacuaauugcaacauucaaaauccagcccuucuuggcccuuggauucuuuuugaggaaauuaacgagcagagaaaaucuuuuauuagguguggggcuugcgauggcuacaaccuuacaauugccggaggacauugaacaaauggcgaauggcauugcgcuaggucuaauggcauugaaacucauaacucaauucgagacguaccaacuauggaccgcacuuauuucauuaacaugcagcaauacuauauuuacucuaacaguagcguggcguacugcaacauuaauccuggccgguguuagucuuuuaccagugugucaaucuaguaguaugagaaaaacagacuggcuaccuaugacagucgcggcaaugggaguuccaccacuaccuuuauucauuuucucacucaaagauacacugaaacggagguccuggccucucaaugagggaguaauggcggucggauuaguauccauucuagcuucaucauuacuucgcaaugacguuccuauggcggguccauugguagcuggaggauuacucaucgcauguuacguaauaaccgguacgucagcugaccuaaccguagaaaaagcggcagaugucacaugggaggaagaggccgaacaaacagguguaagccacaaucugaugauuaccguagacgaugauggaacaaugcggauuaaggaugaugaaacagaaaauauacuuacggucuuacucaagacggcccuacuaauaguaagcggcauuuucccguacaguauaccagccacauuauugguauggcauacuuggcagaagcaaacacaaagaagcggcgugcuaugggauguaccuagucccccagaaacucagaaagccgaauuagaggaaggcguauaccgaauuaagcaacaaggaauauucgguaaaacacaaguaggagucggaguucagaaagaagggguauuccauacuauguggcacgugacgagaggugcaguccuaaccuacaacggaaagaggcuagaaccgaacugggcaagcguuaagaaagaccugauaaguuacgguggaggguggcgccuaucugcacaauggcaaaaaggagaggaagugcaagugaucgcaguagaacccgggaagaaccccaaaaauuuccaaaccaugccagguacuuuccagacuacuacuggcgagauuggagccaucgcccuggacuuuaaaccaggaacaucggguaguccuauaaucaacagagaaggcaagguuguggguuuauacggaaauggaguuguuaccaaaaauggagguuauguaaguggaauagcacaaacuaacgcagaaccagaugguccaacccccgaguuagaagaggaaauguuuaaaaagcguaauuuaacaauuauggaucuacauccaggcucuggcaaaacacggaaauaccuuccagcuauagugagggaggcuauaaaacgacgacuacguacguugauacuugcacccacaagggucguugcugcagagauggaagaggcauuaaaaggacuaccaauuagguaccaaacgacggcuaccaaaagugaacacacuggaagagaaauaguggauuuaaugugucaugcaaccuucacaaugcguuuguuaucuccagugcgaguucccaacuacaaucuaauaauaauggacgaggcgcauuucacugaucccgcguccauugcggcuaggggauauauaucuacaagaguggguaugggagaagcagccgcgauuuuuaugacugcaacaccaccggggacagcagaugcauuuccccaaucaaaugcuccaauucaggacgaagaaagggauauaccagaacguagcuggaacucaggaaaugaauggaucacggauuucgcaggaaaaaccguuugguucguuccaaguauuaaagcuggaaacgauauugcaaauugccuuaggaaaaaugguaagaaagucauacaguuaucaagaaaaacauuugauaccgaauaucagaaaacgaaacuuaaugauugggacuucguugucacuacagauauuagugaaaugggugcuaauuucaaagcugaccgggucauugauccgcgaagaugccuaaaacccguuauuuugacugacggaccugagaggguuauauuggcuggaccuaugccuguaacagcggcgucggcagcccaacgacgaggacggguaggucgaaacccucaaaaagaaaacgaucaguacaucuuuacugggcaaccccuuaacaaugaugaagaucaugcgcauuggacagaagccaaaauguuauuagauaacaucaauacgccagaggggauuauacccgccuuauuugaaccagaaagagagaaaagcgccgcuaucgauggagaauauagauuaaagggagagucucgaaaaaccuucguagaauugaugagaagaggcgacuuaccagucugguuagcacauaaaguugcaucugaaggaaucaaguauacagaucgaaagugguguuuugacggucaacguaauaaucaaauuuuggaagaaaacauggacguugagaucuggaccaaagaaggcgagaagaagaaacuacggccaagauggcuugaugcucgaacauauagcgauccgcuagcacuuaaggaauuuaaagauuuugcagcugggaggaaaaguauagcacuagaucuagugaccgagauuggaagaguuccgucacaucuggcccauagaacacgcaaugcacuagauaacuuagucaugcuucauacaucagaacaugggggcaaagcauauagacaugcuguggaagaacuaccggagacuauggaaacacuauuacuauuaggguugaugauacuauuaacagguggggcgaugcuauuccuuauuucaggaaagggaaucggaaaaacaucaauugguuuaaucugcguaauugcuaguucugguauguuauggauggcagaaauaccauuacaauggauagcaucugccauaguucuagaguuuuucaugaugguauuacuaauaccggaaccugaaaaacaaaggaccccucaagauaaccaacuagcauauguagugauuggcauuuuaacccuagcggccauuauugccgcgaaugagaugggucuuuuagagaccacgaaacgcgaccucgguaugaguaaggaacccgguguagugucuccuacaucauaucucgauguagauuuacauccagccucagcauggacccuuuacgcagucgcgaccacuguaaucacucccauguugcgacauacaauugaaaauaguacagccaauguaucucuugcagcuauugcuaaucaagcaguuguccuuaugggauuagauaaagguuggccgauaucaaagauggauuuagguguaccucuacuugcacuaggcuguuauucgcaagucaacccuuuaacguuaaccgcagcaguucugcuuuugauaacacacuaugcaauuauaggaccuggucugcaagccaaagcaacaagagaggcacagaaaagaacggccgcggguaucaugaaaaaucccacggucgacggaauaaugacaauagacuuagauccagucauauaugacaguaaauucgaaaaacagcuuggacaagugauguuauuaguguugugugcuguacaacuacuccuaaugcgaacaucuugggcacuaugugaggcuuugacacuagcuacaggaccgauuacgacacuaugggaagguucaccaggaaaauuuuggaauacaacaauagcagugucgauggcgaauauauucagaggguccuacuuagcuggagcagguuuagcuuuuucaauaaugaagucuguaggaacagggaaaagagguacaggcagccagggagagacacuaggagagaaauggaagaagaaacugaaucaacucaguagaaaagaauuugauuuauauaagaaaucuggaauaacagaaguugaucggacagaagcuaaagaagguuuaaaacgaggagaaauuacacaucacgcaguuuccagaggaagugcuaaguugcaaugguuuguagaacggaauaugguaauaccagaggggagaguuauagaccuaggaugcggccgcggaggguggagcuacuacugugccggacuuaaaaagguaacugaaguccguggguauacuaagggcggucccggccaugaggaaccagugccaaugagcacuuauggguggaacguuguuaaauuaaugagugguaaagauguauucuaccuuccaccugaaaaaugugauacacuacuaugcgauaucggagaaaguaguccuaguccuaccguggaggaaagcagaaccauacgaguauuaaaaaugguggaaccauggcucaaaaauaaccaguuuugcauuaagguguuaaauccauacaugccuacaguaaucgagcauuuagagaggcuacaacgaaagcauggagggauguugguaagaaacccacucagcagaaacagcacgcaugaaauguauuggauaaguaauggaacaggcaauauaguugcuuccguaaauaugguuaguagacuacucuugaaucgguuuaccaugacucauagaagaccaacaauagaaaaggacguagacuuaggagcaggaacaaggcaugucaacgcagaacccgaaaccccuaauauggacguaauaggggaacggauaaaacgaauaaaagaagaacacaacucuacuuggcacuaugacgacgaaaauccguauaaaacaugggccuaccacggcaguuaugaagugaaagcaacaggaucagccucuaguaugaucaaugguguaguaaaauuacuuacgaaaccaugggacguagucccaaugguaacacaaauggcaaugacugauacaaccccuuucggacaacagcgaguuuucaaagaaaaaguugauacuagaacaccacgaucgaugccaggcacccguagaguuauggguauuacagcugaaugguuauggcgaacacuaggaagaaauaaaaagccgcgccuauguaccagagaagaauuuacuaagaaggucaggacaaaugcagcaaugggagcagucuucaccgaggaaaaccagugggauagcgccaaagcagcuguagaagaugaagacuuuuggaaacugguagaccgcgaaagggagcuccacaaacuugguaaauguggaucauguguuuauaauaugauggguaaaagagaaaagaaacuuggcgaauuuggaaaagcaaaaggaucaagagcaauuugguauaugugguuaggcgccagauaucuggaauuugaagcacugggauuuuugaaugaagaccauugguuuuccagggaaaauaguuacucuggcgucgaaggugaagggcuucacaaacuggguuauauucugagagacauaucaaaaauuccaggaggcgcaauguaugcggacgauaccgcagggugggacacucgaauaacugaagacgauuuacacaacgaggagaaaauuacacagcaaauggauccggaacaccgacaauuagccaaugcuaucuucaaacuaaccuaucagaacaaaguagucaagguucaaagaccaacacccacuggaaccgugauggacauuauuagccgcaaggaccagcgaggaucaggacaaguuggcacauacgguuugaauaccuuuacaaauauggaggcacaauuaauacggcaaauggaaggugaaggaguguuaucgaaggcggaucuggaaaauccacaucuuccagagaagaaaaucacccaauggcucgaaacuaaggguguagagcgacucaaacggauggcuauaagcggagaugacugcguugugaaacccauugacgacagguucgcgaacgcacuacuggcacuaaacgauauggggaaaguuaggaaagacauaccucaguggcaacccaguaaaggauggcaugacuggcagcaaguaccauucugcagucaucauuuccaugaguuaauuaugaaggacggacgaaagcucgucguuccaugucgaccacaagaugaauuaauuggcagggcgagaauuagccaaggagccggauggucacugagagaaacugccugccucggaaaggcguaugcacaaauguggagccuaauguacuuccauagaagagacuugaggcuagcuucaaacgcuauaugcuccgcggugccuguucauuggguuccuacuucaagaacaaccuggucgauacacgcgcaccaccaauggaugacgacagaagauaugcugacagucuggaauagagucuggauugaagauaacccauggauggaagauaaaacaccuguaacaaccugggagaauguuccuuaccucggaaaaagagaagaucaauggugcgguagcuugauugggcucaccagucgugcgacgugggcacagaauaucccuacagcaauacaacaaguuaggucccuaauaggaaaugaagaauuuuuagauuacaugccgaguaugaaacgauuucguaaagaggaagaaucagaaggcgccauaugguga

SEQ ID NO: 23384 - RNA, 9873 nt, Artificial Sequence
  derived and/or modified CDS sequence (opt6) from DENV-3__KF955451__SS-prME
acaagucuauguuugaugaugauacuaccagcagcauuggcuuuucaucuaacaucaagggauggugaaccucguaugauagugggcaaaaaugaaagagguaaaagccuucuuuuuaaaacagcuucagguauuaauaugugcacguuaauagcaauggacuuaggugaaaugugugaugacacaguaacuuacaaauguccucauauaacugagguggaaccggaagauauugauuguugguguaauuuaacuucgaccugggucacguauggaacaugcaaucaagcaggagaacacagacgagauaaaaggagcgucgcacuugcgccucaugucgguaugggacucgacacuagaacacaaacauggaugucugcagaaggagcuuggcgacaaguggaaaaaguagaaacaugggcauuaaggcacccuggguuuacaauccuggcacuuuuccuugcacauuauauaggaacauccuugacgcaaaaagugguaaucuucauauuauugaugcucguuacuccaucuaugacgaugaggugugucggaguaggaaacagagauuucguagaaggacuuucaggagcaacauggguugauguaguguuagagcaugggggcugugucacaacgauggccaaaaauaaaccaacgcucgauauugaauugcagaaaacugaagcuacucaacuggcaacauugagaaaauuaugcauugaaggaaaaauaacaaauauuacuacagacucuaggugccccacacaaggcgaagcugucuugccugaagaacaagaucaaaacuauguaugcaaacauacguacguugaucgcggauggggcaaugguugcgggcuauuugguaaaggcucauuagucacaugcgcaaaauuucaauguuuagaacccauagaagguaaagucguccaauacgagaaucuaaaauacacaguuauaauuacaguccauacgggggaucaacaucaaguuggaaaugaaacccaaggaguaacugccgaaaucacaccacaagccagcacaaccgaggcuauucugccggaauacgggacucugggacuugaaugcucuccucgaacugguuuagacuuuaaugaaaugauucuauuaacgaugaagaauaaggcuuggaugguccauagacaaugguuuuucgacuuaccuuuaccuuggacaagcggugcuacgacagaaaccccaacuuggaauagaaaagaacuacucgugacuuucaaaaaugcucacgcuaagaaacaggagguuguaguacuaggaucacaggagggagcgaugcauacagcccuaacaggagcaaccgaaauacagaauagcgggggcacaucgauuuuugcaggucacuugaaguguaggcugaaaauggacaaauuagaacuaaaaggaauguccuaugcuauguguacuaacacuuuuguacucaaaaaggaagucagugaaacccagcacggaaccauacuuauaaagguugaguauaaaggagaagacguucccuguaaaauuccguuuuccaccgaagacggacaagguaaagcacacaaugggagguuaauuacggccaaucccguaguaacgaaaaaggaggagccugugaauaucgaagcagaacccccuuucggagaaucaaauauaguaaucggaguaggagacaacgcacuuaaaaucaacugguauaagaaaggcuccucuauuggaaagauguuugaagccacugcuagaggagcgagacggauggcgauuuuaggcgacacugcaugggauuuugggucuguuggugguguacuaaauagucuaggaaagaugguucaccaaauauuuggaagugcauauacagcauuauuuucaggggugucauggguaaugaagauuggaauuggcgucuuauuaacauggauuggacuaaauuccaaaaacacaaguaugucuuuuucuugcauugccauugguauaauaacuuuguaccuaggcgucguuguccaggccgauauggguuguguaauaaacuggaagggaaaagaauugaaaugugguaguggcauauucguuacaaaugaaguucauacuuggacagaacaauauaaauuucaagcggacucaccuaaacgcuuagcuacagcgauagccggugcaugggaaaauggaguauguggaauacggaguaccacuagaauggaaaaucuacuguggaagcagauugcaaacgaacuaaacuauauacuuugggaaaauaauauaaaguuaacaguagucguuggugauauuauaggaguacucgagcagggaaaaaggacucuaacaccgcaaccgauggaacuaaaauauucauggaaaacaugggguaaagcuaagauaguuaccgcagaaacccaaaacucaucauucauaaucgauggcccuaauacuccugagugcccaagcgcauccagagcuuggaauguaugggaaguugaagacuauggauucggaguauucacuacuaauauauggcugaaacuuagggaggucuauacucaguuaugugaucauagguuaaugucagcugcgguuaaagaugaacgagccguucaugcugauaugggcuacuggauugaaucccagaaaaacggaucauggaagcuagaaaaggcaucauuaaucgaagucaagacauguacauggccgaaaagccacacacuuuggagcaacgguguuuuagaguccgauaugauaaucccuaaaaguuuggcaggaccuauaucccagcacaacuacagaccagguuaccauacacagaccgccggaccguggcaccuagguaaauuagaacuagauuuuaacuauugugagggaacaaccgucguaauuacagaaaauuguggaacaagagguccgagucucagaacaacaacuguaucugggaaacugauccaugaaugguguuguagaucaugcacauuaccgccgcuaagguacaugggagaagauggcugcugguauggaauggaaauaaggccuaucagcgagaaagaagaaaauauggugaaaucacucguaucagccggaaguggagaaguagauaauuucacaaugggcgugcuauguuuagcuauacuauuugaggaggucaugagagguaaauucggaaagaaacacaugaucgcuggaguauuuuucacauuuguuuugcuuuuaaguggacaaauaacguggagagacauggcacacacauuaauaaugauuggaagcaaugcaucugauaggauggguaugggagugaccuauuuagcacuaauagcaacauucaaaauacaaccuuuucucgcuuuaggauucuuucuuaggaaacuaacaucaagagaaaauuugcuacugggagugggcuuagcaauggcaacaaccuuacagcuaccagaagaugucgaacagauggccaacggcauugcuuuaggucuuauggcacuaaaacuaauaacacaauucgaaacguaucagcuuuggacagcucugaucagucuaaccuguucuaauacgauuuuuacauuaacaguagcguggcgcacagcgacucuuauacuggcuggcguaaguuuguugcccguaugccaaucgucgucgaugagaaagacugacuggcucccaaugacuguagcugcuaugggcguaccuccucuaccccuguuuauuuuuagccuaaaagacacauugaaaaggagaagcuggccgcuuaacgaaggugugauggcuguaggccuaguaucuauucuggcgaguucguuacuaagaaaugacgucccgauggcgggaccucuaguagcaggaggucuucuaauagccuguuacgucauaacaggaacgucagcagaccugaccguagaaaaagccgccgacguuaccugggaggaagaagcagaacaaaccgguguuucucauaacuugaugaucaccgucgacgaugaugggacaaugagaauaaaagacgaugaaacggaaaauauauuaacuguacuauuaaaaaccgccuuacuaauaguguccggaauuuuuccuuacucuauaccagccacccuccuaguguggcauaccuggcaaaaacaaacacaaaggucagggguauuaugggacgugccauccccgccagaaacgcaaaaggcagaacuagaagaggguguuuaucggaucaaacaacaaggaauauuuggaaaaacacagguuggcgugggagugcaaaaagaaggaguuuuccacacuauguggcacguuaccagaggggcgguccucacauauaaugguaagagacucgaaccuaauugggcuagcgugaagaaagauuuaauauccuacggcggaggguggcgccucaacgcucaauggcaaaaaggugaagagguucagguaauagcagucgaaccuggcaagaaucccaaaaauuuccaaaccaugcccgguaccuuccagacuacaacuggugaaauuggugcaauagcccuugauuuuaaaccagggaccucagguucaccaauaaucaauagagagggaaaaguugucggauuguaugggaauggaguagucaccaaaaaugggggauauguguccgguauagcucaaaccaacgcagaaccagauggaccaaccccugaacuagaagaagaaauguucaagaaacgcaauuuaacgauaauggauuuacauccuggaucuggcaaaaccagaaaguaccuucccgcuauagucagagaagcaauaaaacgucgauugcgaacacuaauucuagcgcccacgaggguaguggccgcggagauggaagaggcacuaaaagguuugcccauuagguaccaaaccacagcaacuaaaucagaacacacaggaagagaaauaguagauuugaugugccaugcaacguuuacuaugagauuacugagcccuguucgagugccuaauuacaaucuuauaauaauggaugaagcacacuuuacggacccggcuuccauugcugccagaggauacauuagcacaagggugggcaugggagaggcugcagcgaucuuuaugacugcaacgccaccgggaacggcagacgcuuuuccgcagucuaacgcgccaauucaggaugaggaacgcgacauaccugaaagaucuuggaacucuggcaacgaauggauaaccgauuuugccgguaaaacagugugguuuguccccaguaucaaggcugguaacgauauagccaacugucuacgcaagaacggaaagaaaguaauucaguuauccaggaaaaccuuugacaccgaauaccagaaaacaaaacuuaacgacugggauuuuguaguuacaacggauauaagugaaaugggagcaaacuuuaaagcugaccgaguaauagacccacguaggugccuaaagccaguaauacuaacggaugggccagagcgaguaauauuagccggcccuaugccaguuacugcggcaucugcggcucaaagacgaggacgaguuggaagaaauccccaaaaggaaaaugaccaguacauauuuacuggacagccuuuaaauaaugaugaagaucacgcgcauuggacagaagcgaagauguuacuagacaacaucaauaccccugaagggaucauaccugcacuauucgaaccagaacgcgagaaaagcgcugcuaucgauggugaauaucguuuaaaaggagagagucgaaaaacuuuuguugaacuuaugaggcggggagacuugccugucuggcuugcccauaaaguggcuucagaagguaucaaauacacagacagaaaauggugcuucgauggccaacgaaacaaucaaaucuuggaggaaaauauggacguugaaauauggacaaaagaaggcgaaaagaagaaacuccguccacgguggcuggaugcacguaccuauagcgauccacuugcacucaaagaguuuaaggauuuugcagcaggcagaaagucgauagcguuggaucuagugacagagauaggacgcguaccaacacaccuagcucauagaacuagaagcgcucuagacaacuuagugaugcuucacaccagcgagcauggcggaaaggcuuacagacacgcgguagaagaguugccugagacaauggagacucuucuauuacuaggcuuaaugauauuacuuaccgggggcgccauguuauuccuaauuaguggcaaagggauugguaagacaucgauuggacugauaugcguuauagccucaucaggaaugcuauggauggccgaaauuccacuccaguggauagcaagugcuauaguucucgaguucuuuaugaugguauuauugauacccgaaccggaaaagcaaagaacuccucaagacaaucaauuagccuacguuguaauaggaaucuugacccuugccgccauuauagcugcaaaugaaaugggauuacuugaaacgacgaaaagagacuuagggaugucaaaggaaccggggguaguuaguccgacuucuuaccuugauguagauuuacacccggcaagcgcauggacccucuaugcaguagcaacuacggugauuaccccuaugcucaggcauacaauagaaaauagcacagcuaauguuucacuagcagcaauugcaaaccaagcaguaguucuaaugggucuugauaaaggcuggccaauauccaaaauggacuuaggagucccacuauuggcuuuagguugcuauucacaggucaauccacucacacuaaccgccgcagugcuauuacuaaucacucacuaugcgauaauaggcccuggucuucaagcaaaagcaacuagggaagcacagaaacgaacagcugcuggaaucaugaaaaauccaacaguagacggaaucaugaccaucgaucuggauccggucauauacgacaguaaauuugaaaaacaguuaggucaggugaugcuccuaguucugugugcuguacagcuauuacuuaugagaacaucuugggcuuuaugugaagcacuaacgcuggcaacgggaccaauuacaacacuuugggagggaagcccugguaaauuuuggaauacaacaaucgcgguaucuauggcuaacaucuuuagaggcucauacuuggcaggcgccggacuugcuuuuagcauuaugaaaagcguagguacagguaaaagaggaacugggucacagggagaaacacucggugaaaaauggaagaggaaauuaaaucaacuaucaagaaaagaauuugaccuauacaagaaaagcggaauuaccgaaguggacagaacggaagcaaaagaaggacuaaaacggggugaaauaacccaccaugccguaucaagagggagcgcuaaacuucaaugguuuguagagagaaauaugguuauaccagaagggcgagugauagaucuagguugugguaggggaggcuggucuuauuacugugcuggauugaagaaagucacggaaguaagagguuacacaaaagggggcccgggacacgaagaaccgguaccuaugagcacuuacggcuggaacauaguaaaacugaugucugggaaagaugucuuuuauuugccaccagaaaaaugugacacacuguuaugugauauaggcgagagcucaccaucaccaaccguagaagaaucaagaacuauaagagugcuaaaaaugguugaaccauggcucaagaacaaucaauucugcaucaaagugcuuaacccauauaugccaaccguaauagaacaucucgaaaggcuacaacgcaagcauggaggaaugcuugucagaaauccacuaucgcgaaauucuacucaugaaauguacuggaucagcaauggcaccgggaacauaguugcgagcguuaacaugguuucccggcugcuacuaaacagguucacaaugacucacagaagaccaacgauugaaaaggacguagauuugggggcgggaacaagacacguuaaugcugaaccggagacgcccaacauggauguuauaggggagcguauaaaaagaauaaaagaagaacacaauucaacauggcauuaugacgaugagaauccuuacaaaacaugggcauaucaugggucuuacgaaguuaaagcaacaggaagugcaucuaguaugauuaauggugugguuaaacuguugacaaagccgugggacguaguuccaaugguaacacagauggcaaugacugauacuaccccuuucggacaacaacgaguuuuuaaagagaagguggacacccggacuccucgcccuaugccagggacacgcagggugaugggaauaacugcagaaugguuauggcgaacgcuaggacgaaauaaaaagccucgacucuguacaagagaggaguuuaccaagaaaguuaggaccaacgccgcaaugggagcuguuuuuacagaggagaaucaaugggacagcgcuaaagcagcagucgaagacgaagacuucuggaaacuuguagaucgagaacgugaauuacauaagcuaggcaagugcggcucuugcguauauaauaugauggggaaaagagaaaagaaguuaggcgaauuuggcaaagccaaagguucuagggcuauaugguacaugugguugggagcaagauaucuugaauuugaagcauugggguuuuugaaugaagaucacugguuuaguagggaaaauucauauagugguguagaaggcgagggccuucacaaauuaggauacauauuaagggauauuucuaaaauccccgguggagcaauguaugcggacgauacagcaggcugggauacaaggauaacagaagaugaccugcauaaugaggagaaaauaacgcaacaaauggauccggagcauaggcaauuggcuaaugccauauuuaaacuuacuuaccagaauaaaguggugaaagugcaaaggcccacuccgaccggaaccguuauggauauaauaagucguaaagaccaacgaggaucaggacagguaggaacguacggguuaaauaccuuuacuaacauggaagcgcaauuaauacgacaaauggagggugagggaguuuugagcaaggcagaccuugaaaauccccaucucagugagaagaaaauuacucaaugguuagaaacuaagggugucgagagacucaaaaggauggcuauaagcggagacgacugugugguaaaaccaauagaugauagauucgcaaacgcccuguuagccuuaaacgauauggguaagguccgcaaagacauaccccaauggcaaccaucaaaaggauggcacgacuggcaacaagucccauuuugcucccaucauuuucaugaauugaucaugaaagaugggagaaaguuaguagugccaugucgaccacaagacgaacuaauuggcagggcaagaauaucucaaggagcaggauggucccucagagagacugcaugucuuggaaaggcuuaugcgcaaauguggucacuuauguauuuucauagacgagacuuaagauuagcuucuaaugcuauuuguucugcgguuccuguacacuggguaccgacuagcagaacaacauggagcauacaugcucaucaucaauggaugacuacagaagauauguuaacgguguggaacagaguauggaucgaagacaauccuuggauggaagauaaaacaccugucacgaccugggaaaauguaccauauuugggaaagcgugaagaccaguggugugguucguuaaucggauuaacaagucgugcuacaugggcacaaaacauuccaacugccauucaacagguacgcagucuuauaggcaacgaagaguuccuagacuacaugccaucaaugaaaagauuucgaaaggaagaagaaucagaaggggcaauuugguaa

SEQ ID NO: 23385 - RNA, 9873 nt, Artificial Sequence
  derived and/or modified CDS sequence (opt6) from DENV-3__KF955453__SS-prME
acaucacuaugcuuaaugaugauacuaccggcaacgcuggcauuucaucucacaaguagagacggagagccucgcaugauagugggcaagaacgaacggggaaaaucacuucucuucaagacagcaucagguauaaauauguguacgcuaauugcaauggauuuaggagaaaugugcgacgauacaguuaccuacaaguguccacauaucacugaaguagagccagaagauauagauugcuggugcaaccucacuucgacuuggguaacauacggaacuugcaaccaagcaggagaacacagacgcgacaagaggaguguagcccuagccccccacgugggaaugggcuuagauacacgaacacaaacauggaugagugcugaaggugcauggagacaagucgaaaaagucgaaacgugggcccuacgacauccgggauuuaccauucuggcauuauuucuugcacauuacaucgguacuucuuugacccaaaagguaguaauuuuuauuuuguugauguugguuacaccguccaugacuaugagaugcguaggagucggaaaucgcgacuuuguagagggauuaucaggcgccacuugggucgauguuguacuugaacauggcggaugcgucacgacgauggccaaaaauaaaccgacucuggacauagaacugcagaaaacagaggcuacccaacuagcaacccuacguaaacucugcauagaagguaaaauaacgaacauuacaacagauucaagauguccaacgcaaggggaggcaguauuaccagaagaacaagaccaaaauuauguauguaaacauaccuauguagaucgugguuggggcaacggaugcgguuuauucggaaaaggaucucuuguuacuugcgcgaaguuucaaugcuuagagccgauagaaggcaaaguaguucaguaugaaaaccugaaauauaccguuauuaucacagugcacaccggugaucaacaucagguaggcaaugaaacccaaggcguaacagcagaaauaacuccucaggcaucgaccacggaggcgacuuuaccagaauacggaacucuaggauuagaauguaguccgcguaccggacuugacuucaaugaaaugauccuguugaccaugaaaaacaaggcguggaugguacaccgucagugguuuuucgauuuaccccuaccuuggaccagcggcgcaacuacagaaaccccaacauggaauagaaaagaauuguugguaaccuucaagaacgcgcacgccaaaaaacaagagguagucguuuuagggucccaagagggcgcgaugcauacggccuugacaggagcaacugaaauacaaaacagcggggggacgucuauauuugccggccaccuaaaaugcagacugaaaauggacaaauuagaauuaaaagguaugucauaugcgaugugcacaaauaccuuuguguuaaagaaagaagucuccgaaacacaacacggaacaauacucauaaaaguagaauacaaaggagaagacgugccguguaaaauuccuuuuagcaccgaagauggucaaggaaaagcucauaauggaagauuaauaacggccaacccuguugucacuaagaaagaagagccugucaauauagaggcagaaccaccauuuggagagaguaauauaguuauaggcauaggcgauaaugcccuaaaaaucaauugguauaaaaaagguucuucaaucggaaaaauguuugaagcgacugcacgaggagcacgucguauggcaauccucggugauacagccugggauuuugguuccgugggagguguguugaauaguuuaggcaaaaugguccaccaaaucuuuggaucagcauacacugcacuguuuagcggugugagcuggguaaugaaaauagguaucggaguuuuacuaacauggauaggacuuaacagcaaaaauacaaguauguccuuuagcugcaucgcgaucggaauaauuacgcuuuacuuaggagcuguaguacaagccgacaugggcugcgugauaaauuggaagggaaaagaacuuaaaugugguagcgguauuuuuguaacaaacgagguccauacuuggacagaacaauauaaauuucaagcagacagcccuaagagacuagcaaccgcaauagccggagcuugggaaaauggagucuguggcauacguucuacuacacgaauggaaaaucuacuauggaaacaaaucgcaaacgaacugaauuacauucuuugggagaauaauauaaaguuaaccguugucguaggagauauaaucgggguguuggaacaggggaaaagaacacugacuccacaaccaauggaacuaaaguacagcuggaagacauggggaaaagccaagauaguaacugcagaaacgcaaaauucgucauuuaucauugauggaccaaauacgccugaauguccaucugcaucucgggcauggaauguaugggagguagaagauuauggguuuggaguuuuuacuaccaacauauggcuuaagcuaagagagguuuacacccaacucugugaccacagguuaaugucagcagcgguuaaggacgagcgggcgguucacgcagauauggguuacuggauagagucucaaaaaaauggcuccuggaaacuugaaaaagccagccucauagagguaaaaacguguaccuggccaaagucacauacuuuguggucuaaugggguauuagaaucagacaugauaauaccaaaaaguuuagcuggucccauuagucaacacaauuauagaccgggcuaucauacgcagacagcaggcccuuggcacuuaggaaaacuagaauuagacuucaauuacugugaaggaacaacagucgugauuaccgagaacugugguacuagagguccuucucuacguacgaccacagucucuggaaaguugauccacgaaugguguugucgaucguguacacuuccaccuuugagauauaugggcgaagacgguuguugguaugguauggaaauucggcccaucuccgaaaaagaagaaaauaugguaaaaagucuggugucugcgggcagcggcgaaguggauaauuuuaccauggguguuuuaugucuagcaauacuauuugaggaaguaaugaggggaaaauuuggaaaaaaacauaugaucgcugggguuuuuuuuacguuuguuuugcuauuguccggucagauaacuuggagagauauggcucacacacucauuaugauugggaguaaugcgucagacagaauggggaugggaguaacauaucuggcgcuuauagcuacauuuaagauccaacccuuucuagcacuaggauuuuuucucagaaaacugacaucgcgagaaaaucuuuuacuaggagugggauuagcgauggcgacaacguuacaacuccccgaagauaucgaacagauggccaacgguaucgcacuuggacuaauggcauuaaaauugaucacccaguuugaaacauaucaauuauggacagcauugauauccuuaacguguucaaauacgaucuuuacauugaccguagcauggagaacagccacucuaauacuagcagggguaucacuccuuccagucugucaaaguuccuccaugcgcaaaacagauuggcuacccaugaccguugcugcuauggggguuccuccccuaccauuguucauuuucaaucuaaaagacaccuugaaacgaaggucauggccguugaacgaaggaguuauggcuguuggauuagucucgauucucgcgucaagccuuuugagaaaugaugugccuauggcgggucccuugguugcaggcgggcuucuaauagcauguuauguaauuacuggaacgucagcugacuuaacaguagagaaggcggcagauguuacaugggaagaagaggcugaacaaacaggugucagccauaaccuuaugaucaccguagaugaugaugguaccaugagaauaaaagaugaugagacugaaaauauccuuacaguuuuacuuaaaacugcguuguuaauuguuaguggcauauucccuuacucgauaccugcuacauuguuaguguggcauacauggcagaaacaaacucagagaagugggguacuaugggauguaccauccccacccgaaacacaaaaagcagaacuugaagaaggaguauaucgaauaaaacaacaaggcaucuuuggaaaaacacaagucggagucgggguucaaaaggaagguguuuuccauacgauguggcauguaacucguggagcgguacuuacauauaacggaaagagacuagaaccuaacugggcuucaguuaaaaaagaucuaaucucguaugggggcggauggagacuaagugcucaguggcagaaaggagaggaaguacaaguaauagcugucgagccuggaaaaaauccaaaaaacuuucagacuaugcccgguacauuucagacuacgacaggugaaaucggugccauagcgcuugauuuuaagccaggaacauccgguaguccuauuauuaacagagagggcaaaauaguuggucuguacgggaauggcguaguaacgaaaaacggugguuauguaucaggaauugcgcaaacaaacgcugaaccugaugguccgaccccagaauuggaggaagaaauguuuaaaaaaagaaaucuaacaauuauggaccugcacccaggaucuggcaaaacaagaaaauaccuaccagcuaucguacgagaagcaauuaaacgaagauuaagaacgcuuauucuugcgccgacaagagucgucgcagcggaaauggaagaagcauuaaagggcuuacccaucagauaucaaacaacagcaacaaagucagagcacacagguagggaaauaguagaccugaugugccaugcaaccuuuacaaugagguugcuaaguccgguacgaguucccaauuauaauuuaauaaucauggaugaagcucauuuuacagaccccgcuuccaucgccgcucgaggguauauaucuacgagagugggaaugggagaagcagcagcuauuuuuaugacggcaacuccgccaggcacagccgacgcuuuuccgcaaucuaaugcaccuauacaagaugaagaaagagauaucccagagagaucauggaacucuggaaacgaauggauaacagauuuugcugguaaaaccgucugguuugucccuucgauuaaagcgggaaaugauauugccaacugccuuaggaagaauggaaaaaaggugauucaacuuucuagaaaaacuuucgauacggaguaucagaaaacaaagcuaaaugauugggauuucguaguaacaacagauauuagcgaaaugggagcaaauuuuaaagccgauagaguaauagacccucguagaugccuaaaaccaguuauauugacagauggcccugaaaggguaauauuggcuggaccaaugccuguuacagccgcuucagcagcgcagcgacgcggacgagucgguaggaauccucaaaaggaaaaugaucaauauauauuuacaggacaaccguugaauaaugaugaagaccaugcucacuggaccgaagccaagaugcuuuuggauaacaucaauacaccggagggcauaauaccugcgcuauuugaaccagaacgagaaaaaagcgcagcgauugauggagaguacaggcuaaaaggggagagccgaaaaacauucguugaguuaaugagaaggggagaucuuccaguuuggcuagcucauaaggucgccagcgaagggauaaaauacacggaccgaaaauggugcuuugacggccagaggaacaaccaaauuuuagaagaaaauauggauguagaaaucuggacaaaggaaggagaaaaaaaaaagcugagaccuagauggcuugacgcacggaccuacucggacccauuagcauuaaaggaauucaaagauuucgccgcugggcguaaaucuauugcuuuagaccuuguuacugaaauagguagaguaccuacucacuuagcacacagaacaagaaaugcacuagauaaucucguaaugcugcauacgagugaacaugguggaaaagcguauagacaugcaguugaagaacuuccggaaacgauggaaacucuguugcuauuaggacugaugauaucguugacugggggagccaugcuauucuuaaucagugggaaaggaauuggcaaaacguccauaggucuaauuugugucauagccagcuccgguauguuauggauggcagaaauuccauuacaguggaucgcaucagcuauaguauuagaauuuuucaugaugguuuuacucauuccugaaccagaaaaacaacguacuccccaagauaaucaacuagccuaugugguaauuggcauacugacacuagcagcgauaauagcagcgaacgagaugggacuauuagaaacaacaaagagggacuugggaaugaguaaagaaccgggaguaguuaguccgacuucguaucuagacgucgauuuacacccugcuucugcauggacauuauaugcgguagcaacuacgguuauuacaccuauguugaggcacacaauugagaacucaaccgcuaacgucaguuuggcugcuaucgccaaccaagcuguaguucuuauggggcucgauaaagguuggccuauaagcaagauggacuuaggaguaccucuacuugcacuggguuguuacagucagguuaacccauuaacuuugacggcagcaguauuacuuuuaaucacacauuaugccauaauagguccgggcuuacaagcuaaagccacaagggaggcacaaaaacggacagcugcuggaaucaugaaaaaucccacaguagaugguauaaugacaauugaccuugacccaguuauauaugacuccaaauuugaaaaacaguuaggucaggucauguuacuaguauuaugugcgguucaguuauuacuuaugcgcacaagcugggcuuuaugcgaagcauugaccuuagccacagggccgauaacuacacuaugggagggcucacccgggaaauucuggaauacaacaauagccgucucuauggccaauaucuuuaggggaucauaucucgcaggagccggauuagcauucucuaucaugaaaucgguuggcacgggcaaacgaggaacagguagucaaggagagaccuuaggugaaaaauggaaaaaaaaauuaaaucaacuuucccguaaagaguuugacuuauacaaaaaaaguggaauaacagaaguagaucgaaccgaagccaaggaagguuuaaaacguggcgaaaucacccaucaugcgguaucccguggaucagccaaauuacaaugguuuguagaaaggaauaugguaauaccagaaggcagagugauagauuugggaugugguagaggaggauggucguacuacugcgccggguuaaaaaaaguaacggaaguaagaggauauaccaaaggcggacccggucaugaagaaccugugccaaugagcacauaugguuggaacauaguuaaauuaaugagcgggaaagauguguucuaccugcccccagaaaagugcgauacauuacucugugauauaggagaaucaucucccucuccaaccguagaagagucacgaacaauaagaguauuaaaaaugguagaaccgugguuaaaaaacaaucaauuuuguauuaaaguauuaaauccauacaugccuacaguuauugaacauuuagaacgccuccaaagaaaacaugguggaauguuggucaggaauccacuuucuagaaauucuacacaugagauguacuggauaucaaacggaacgggcaauaucguggcgaguguaaauaugguuucucggcuauuacuaaauagauucacgaugacacaccgucguccgacuauugaaaaagauguugauuuaggagcagggacaaggcacguaaacgcagaaccggaaaccccuaauauggauguaauaggggaacguauaaaaagaauaaaagaagaacauaauaguacuuggcacuacgaugaugagaacccauauaaaacuugggccuaccacggcucauacgaaguuaaagcaacuggaucugccucuaguaugauaaacggaguggucaaacugcucacuaaacccugggaugucgucccaaugguaacgcaaauggccaugacggauacaacaccauuuggacaacaacgaguauucaaagaaaaagucgacacaaggaccccccgaagcaugcccggaacaagaagaguaauggggauuacagcagaauggcuuuggagaacacuagguagaaauaaaaagccuagacuauguacucgugaagaauuuacuaagaagguucguacgaaugcugccaugggagcaguauuuacugaagagaaccaaugggacuccgcgaaagcagccguagaagacgaagauuuuuggaagcuuguugaccgcgaacgugaacugcacaaacuagguaaauguggaagcugcgucuacaauaugaugggaaagcgugaaaaaaaacuaggugaauucggaaaagcaaaaggcagccgugcgauuugguauaugugguugggagcucgauacuuagaauuugaagcauuaggguuccuaaacgaagaccauugguucucgagagaaaacucauacucagggguggaaggugagggauuacacaaacuaggauacauccuaagagacauuuccaaaauaccagguggugcuauguaugcugacgauacggcaggaugggacacacgaauaacggaagacgauuugcacaacgaagaaaaaauaacacaacaaauggauccagaacaccgacagcuugcaaacgccauauuuaaacuaaccuaucaaaauaaaguaguaaaaguacaacguccuacuccaacagguacagucauggacauaauuucaaggaaagaucaacgcgggagcggccagguagguacuuacgguuuaaauaccuucacaaauauggaagcccaguugauaagacaaauggaaggagaaggcgucuuguccaaagcggacuuagaaaauccucaucuaccggagaagaaaauaacgcaaugguuagaaacuaaagguguagagcgauuaaaaagaauggcgauuucaggagaugacugugucguaaagccuaucgacgaucguuuugccaaugccuuacuggcacuaaacgacauggggaaaguucgcaaggauauaccacaauggcaacccucuaagggauggcacgauuggcagcaggugccuuuuuguagucaucacuuccaugaguuaauuaugaaagaugggagaaaauugguuguaccaugccguccgcaagacgaacuaaucggacgggcgcgcauaucacagggugcuggauggaguuuacgugagacagcuuguuugggcaaagcauacgcucaaauguggucauuaauguacuuucauagaagagaccuucgacuagcuaguaaugcaauuugcucagcaguacccguacacugggucccaaccagcaggacaacuuggucgauucaugcacaucaucaauggaugacaacagaagauaugcucacaguauggaaucgcguauggaucgaggauaacccauggauggaagacaagacgccuguaacuacgugggaaaacguuccuuaucuugggaaaagagaagaucaguggugcgggaguuuaaucggauugacaucgagagcaacaugggcacaaaauauucccacagcuauacaacagguuagaucuuugaucgggaaugaggaguuuuuagauuauaugccaucaaugaagcgauuucgaaaagaggaggaaucagaaggugcaaucugguaa

SEQ ID NO: 23386 - RNA, 9873 nt, Artificial Sequence
  derived and/or modified CDS sequence (opt6) from DENV-3__FJ373304__SS-prME
acaucuuuauguuuaaugaugauacuuccagcggccuuagcauuucaccucacgucgagagauggggaacccaggaugauaguggggaaaaaugaaagaggaaaaucacuacuauucaaaacggccucaggaauaaauauguguacacuaauagcaauggaucugggagaaaugugugacgacacaguuacauauaaaugcccccacauaacggaaguagaaccugaagauauagacugcuggugcaauuuaacuucaacguggguaaccuauggcacgugcaaccaagcuggagaacauagaagagacaaaaggagcguggcauuggcuccacacguagguauggguuuagacaccagaacccaaaccuggaugagcgcagaaggcgccuggagacaaguggaaaaaguagaaacaugggccuuacgacacccgggauuuaccauucuagcgcuauuuuuagcacacuacauuggaacaucuuuaacgcaaaaaguaguaauuuucauuuugcucauguuaguuaccccaucaaugacuaugagaugcguaggaguuggaaauagggauuuuguugagggucuaaguggagcaaccuggguggauguagugcuagagcauggaggaugcguuaccacgauggccaaaaauaaacccacccuggauauugagcuucagaaaaccgaggcaacgcaauuagcuacauugcgcaaacuauguaucgaaggcaaaaucacgaauauuaccacagacagccgaugccccacacaaggagaagcaguucuaccggaggaacaagaucaaaacuauguuuguaaacauacuuauguugacagaggcugggggaacgguuguggccucuuuggaaaaggcagucugguaacuugcgcaaaauuccaaugccuagaacccaucgaaggaaaagucguacaauaugaaaauuuaaaauauaccguuauaaucacaguucauacaggugaccaacaucaaguggguaacgagacccaagguguuacggcugagaucacaccacaggcuucaacaacagaagcaauacugccagaguaugguacccuggggcuagaaugcaguccacgaacgggacucgauuuuaaugaaaugauacuauuaacuaugaaaaauaaagcauggauggugcaucgucaaugguucuuugacuuaccauugccauggacgagcggcgcaacgacagagaccccuacuuggaacagaaaagaacuucuggucacguucaaaaaugcccacgcgaagaaacaagaaguugucguccuuggcucgcaagagggcgcaaugcacacagcacugaccggagccacugaaauccaaaauagcggugguacaucaauuuuugcuggacaucugaaaugcagauuaaaaauggauaaacuggaauuaaaagggaugucauaugcgauguguacaaacacauuuguuuugaagaaagaaguaagugaaacucaacaugggacuaucuuaauaaaaguagaguacaaaggugaagacgugccguguaaaauaccguuuucaacagaagacggccaaggcaaagcgcacaacggaagacugauaacagcgaacccaguaguaaccaagaaagaagaacccgugaauaucgaagcagaaccaccauucggagaaucuaacauugugaucgguaucggcgauaacgcacuaaaaauuaauugguauaagaaagggucuucaaucggaaaaauguuugaagcaacugcucggggugccaggagaauggcuauucuuggagauacugcaugggacuuuggcaguguaggcggaguucuaaacagucucggaaaaguagugcaccaaauuuucggcucagcauauaccgccuuguuuucgggaguguccuggguuaugaaaauaggcauaggaguccuuuuaacauggauuggacucaauagcaaaaauacuagcaugucuuuuagcuguaucgccauuggaauuauaaccuuauaucugggagcagucguucaagccgauaugggcugcguaauuaauuggaaagggaaagagcuaaaauguggcagugguauauucguuacaaacgagguacacacauggacugaacaauauaaauuucaagcagauucacccaaaagguuagcuacagcaauagcgggcgcgugggagaaugggguaugcgguauaagaaguacaacgcgaauggaaaaccuauuauggaaacaaauagccaaugagcuuaauuacauacuuugggaaaacaacauuaaacucacgguuguuguaggcgacaccaucgguguucuagaacaagguaaaagaacgcuuacaccacaacccauggaacuuaaauauagcuggaagaccuggggaaaagccaaaaucgucacggcagaaacacaaaacucuucuuuuauaauagacggaccaaauacacccgaguguccuucugcaucaagagcauggaaugucugggagguagaagauuacggcuuugggguauucaccacaaacaucugguuaaaauuaagggaaguauauacacaauuaugugaucaucgacuuaugagcgcggcagugaaggacgaacgagcaguacacgcagauaugggauauuggauugaaagucagaaaaauggaagcuggaaacuagaaaaagcaagccucauagaaguuaaaacauguacauggccaaagagucauacguuguggaguaacggaguacuagaaagcgauaugauaauccccaaaucauuagcaggacccaucucacaacacaauuauagaccuggcuaucauacacaaaccgcaggaccauggcaccuugggaaacuagaacucgauuucaauuauugcgaaggaacaacaguugugauuacagaaaacugcggcacucgaggcccgucacuaaggaccacgacuguaagugggaaacucauacaugaauggugcugucguaguuguacauuaccaccuuuacgauacaugggcgaagauggguguugguauggaauggaaauacguccuauuucugaaaaagaagaaaauaugguuaaaaguuuaguaagcgcgggauccggggaaguggauaacuuuacgaugggagucuuaugccuugcaauuuuauuugaggaggugaugcguggaaaauucgguaagaaacauaugauagcagggguauucuuuacauuugucuuguuacuuagcggacaaauaacauggagggacauggcacauacgcuaauaaugaucggcagcaaugcgucagauagaaugggaauggggguaacauauuuagcucugaucgcaacauuuaagauucaaccauuucuugcucuaggguuuuuccuucguaaacuaacaagucgcgagaaucuguuguuaggaguaggacuugcaauggcaaccacuuugcagcuaccagaagauauugaacaaauggccaauggaauugcgcuuggcuuaauggcuuuaaaacucauaacucaauucgagacauaucaguuauggacagcauugauuagcuuaacguguucuaacacuauauucacguuaaccgucgcauggaggacagcgacauuaauuuuagcuggaguuucucuuuuacccgucugucaaaguucaaguaugcggaaaacggacuggcuacccaugacagucgcugcgaugggggucccaccuuuaccucucuuuauauuuucguuaaaagauacacuuaaaagacggucuuggccacuaaacgaaggugugauggcaguaggucuagucagcaucuuagcgaguagucuauuacgaaaugauguuccgauggccggccccuuaguagcagggggauuacuaauugcauguuauguaauaacaggaacauccgcagauuuaacaguugaaaaagcggcagauguuacuugggaagaggaagcugagcaaacgggagucucucauaaucuaaugauaacaguugacgacgauggaacaaugaggauaaaagacgacgaaacagaaaacauucuaacaguacuacuaaaaacagcacuguuaauugucagugggauauuuccauauagcauaccagcuacccuccuaguuuggcauacuuggcaaaaacaaacacaaagaagugguguuuuaugggacguaccaucaccgccagaaacucaaaaagcagaacuagaagaaggaguauauaggaucaaacaacaaggaauauucggaaaaacacaaguaggggucggagugcaaaaagaaggaguauuccauacaauguggcauguaacaagaggagcaguucuuacauauaaugguaagagauuagagccaaacugggcaagugucaagaaagaccucauauccuaugggggcggauggagauugucggcacaauggcaaaaaggagaagagguacagguaauugcaguagaaccgggaaagaaccccaaaaauuuucaaacuaugccuggcacauuucaaacaacgacgggcgaaauuggugcaauugcacuagacuuuaaaccagguaccucaggaucuccuaucauaaauagggaaggcaagguaguaggucuguaugggaacgggguaguuacuaagaacggugguuauguuuccgggauagcacagacgaacgcggaacccgauggcccaacaccagaacuagaagaagagauguucaagaaaaggaaucuuacuauaauggaucuccauccuggaucugguaaaacacguaaguaccuuccugcaauugucagagaggcgauuaagcgaagauuaagaacacuuauauuagcuccaacaaggguaguagccgcagagauggaggaagcccugaaggggcuaccaauaagauaccaaacaacggcaacgaaaucagaacauacagguagagaaaucguagauuuaaugugccacgcgaccuucacaaugagauuacuaagccccguuagggucccuaauuacaaucuaauuauaauggaugaagcucauuuuacagacccagcuucaauagcggcgcgaggauacauaagcacaagaguagggaugggugaagccgcugcaauauuuaugaccgcgacaccaccaggaaccgcggacgcguucccccaaagcaaugccccaauccaggacgaggaacgagauauacccgagagaucauggaacucaggaaacgaauggauaacagauuuugcagguaaaacagucugguuuguaccgaguaucaaagcaggaaaugauauagcuaacugcuugcgcaaaaaugguaagaaaguaauacaacugucuagaaaaacauuugacacagaguaccaaaagacuaaguuaaacgauugggacuucgucguaacuacugauauaucggaaaugggggcaaacuuuaaagcagaccguguaauugacccuagacggugcuugaagccgguuauuuuaacggacgguccagagcgugugauucuggccgguccuaugccgguaacugccgccagcgcugcucaacgaagaggucggguggggaggaauccucagaaagaaaaugaucaguauauuuucaccgggcaacccuugaacaaugaugaagaucacgcgcauuggacagaggcaaaaaugcuguuagacaacauaaacacaccagagggcaucauuccugccuuauuugagccggagagagagaaaucagccgcaauagauggcgaauaucguuugaaaggcgaaucuagaaagacuuucguagaauugaugcgacgaggugaucuaccagucugguuagcacauaagguggccagugagggcauaaaguauacagauagaaaaugguguuuugauggucagagaaauaaccaaauauuagaggaaaacauggaugucgaaauauggacuaaagaaggggagaagaagaaacugcgcccacgaugguuggaugcucguaccuacagcgauccuuuagcauuaaaggaguucaaagauuuugcagcaggccgaaaauccauagcacuagaucuugugacagagauagguagaguaccaacacaccuagcccacagaacaaggaaugcauuagauaauuuaguaauguugcauacgagugagcacggaggaaaggcuuaucgucaugcaguagaagaauuaccggagacaauggaaacacuauuauugcuaggucuaaugaucuuacuaacgggcggagcgaugcucuuuuuaaucagcggaaaggggauuggcaaaacaucuauagguuuaaucuguguaauagcuucuucaggaauguuauggauggcggaaauaccacuacaauggaucgcgucugcaauuauccuagaguucuuuaugaugguauugcucauaccagaaccggaaaagcaaagaacaccacaagacaaccagcuagcauauguuguaauaggaauacugacauuggcagcaauaauagcagcaaaugaaauggggcuacuugaaacuacaaaaagggauuugggaaugaguaaagaaccugguguaguaagcccaaccaguuaucucgauguagacuuacauccagccucggcauggacacuuuacgcaguagccacuacggucaucacgccgauguuaagacauacaauagaaaauucaacggcgaauguuagucuagcagcaauugcaaaccaagcuguggucuuaaugggcuuagauaaagguuggccuauauccaaaauggacuuaggaguuccguuguuagcacuaggguguuauucucaaguuaauccauuaaccuugacugcagccguucuauuacucauuacccacuacgcuauaauuggccccggacuucaagcgaaagcaacucgggaagcucaaaaacgaacugcagcuggaauaaugaaaaacccgaccgucgacgggauaaugaccauagaucucgauccgguaauauaugacucaaaauuugaaaaacaauuagggcaaguaaugcucuugguauuaugugcgguacaacugcuucuaaugagaacgucgugggcccugugcgaagcucuaacacuagcaacgggaccaauaacaacacuaugggaaggcucgccaggaaaguuuuggaauacaacaauagcagugucgauggcaaacauauucagagguagcuauuuggccggcgcgggacuugcauucagcaucaugaaaucaguaggaaccggaaaaagaggcaccggaucucaaggcgagacauuaggcgagaaauggaagaagaaauugaaccaauuaagcagaaaagaguucgaucuauacaagaaaucagggauaaccgaagucgaucgaaccgaggcaaaagagggacucaaaagaggggaaauaacucaucacgcuguaucucguggaagcgcuaaacuacaaugguuuguagaaaggaauauggucauaccagaaggacggguuauagacuuaggaugcggcagaggcggauggaguuacuauugugcaggucuaaagaaaguuaccgagguuagaggauauacuaaaggggguccaggacacgaggagccgguaccaaugagcacguacggauggaacauaguuaaacuaaugaguggaaaagacguuuucuaccugcccccagaaaaaugugacacacucuugugugauauaggagagucaucaccgucgcccaccguugaggaaucuaggacaauaagaguauugaaaaugguggagcccuggcuuaagaacaaccaguucugcauaaaagugcuaaauccauauaugccgacugucauugaacaucucgagagacuucagcgcaagcacggcggcaugcucguucgaaauccccuuucuagaaacaguacacaugagauguacuggauuaguaacggaacagggaauauaguugcgaguguuaacaugguuucgaggcuacuguuaaaucgguucacuaugacacauaggagacccacaauugagaaagauguggauuuaggagcaggaaccagacauguaaaugcugaaccggaaacuccaaauauggaugucaucggagaacgcauuaaacgaauaaaagaagaacauaauucuacuuggcacuacgaugacgagaacccauauaagacaugggccuaccacgguagcuacgagguuaaggcuacagggucggcaucuaguaugauaaacggagucguuaaacuauuaacgaaacccugggacguaguaccaaugguaacacagauggcuaugaccgauacaacaccauucggacaacaacguguuuuuaaagagaagguagauacucgaacaccaagaagcaugcccggaacacgaagaguaaugggcauaacagcugaaugguuauggaggacgcuaggaagaaauaaaaagccaagauuaugcacucgggaagaguucacuaagaagguuagaacuaacgcagccaugggagcgguauucacagaagaaaaucagugggacucagcaaaagccgcuguagaagaugaggauuuuuggaaacucguugauagagaacgcgaauuacauaaacuuggaaagugcggaagcuguguuuacaacaugauggggaagagagagaagaaauuaggugaauuuggcaaggccaaagguagucgcgcaauaugguauauguggcuaggugcaagguaucuugaguucgaggcacuggguuucuuaaaugaggaucauugguucaguagagagaacucguacucaggagucgaaggugaaggacuucauaaauuggguuacauacuucgagauauaaguaaaauaccaggaggagcaauguaugcagacgauacugccggaugggacaccaggauuaccgaagaugauuuacacaacgaggagaaaauuacgcaacaaauggaucccgaacauagacaauuggcgaaugcuauauucaaacuuaccuaucagaauaaaguaguaaaaguucaacgcccuacaccaaccggcacuguaauggauaucaucagcagaaaagaucaacgcggcuccggacaggucggcacuuauggccuaaauacguucacgaacauggaagcacaauugaucagacaaauggaaggagaaggugucuuaucaaaagcagaccuagaaaacccucaucuaccggagaagaaaauaacgcaauggcuugagacuaagggaguugaaaggcucaaacggauggcuauuaguggugacgacugcgucgugaagccuauugacgacagauuugcuaaugccuuacuugcacuaaaugauaugggaaagguacguaaagacauaccacaguggcaaccuuccaagggauggcacgacuggcaacaagugccuuucugcucacaucauuuccaugaguuaauaaugaaggauggcagaaagcuaguaguaccguguaggccucaagaugaacugauaggcagagcucggauaagccaaggcgccggauggagccuccgagaaacagcuugucuaggcaaagcauaugcucaaauguggagcuuaauguacuuucacagaagagauuugaggcucgcaaguaaugcaauuugcucagcgguaccuguucacuggguuccaacgucgcguaccacauggucgauccaugcacaucaccaguggaugaccacugaagacauguugacaguauggaaccgaguauggaucgaagacaauccuuggauggaggacaaaacaccaguaacuacuugggaaaacguacccuauuugggaaaaagagaagaccaaugguguggcagcuugaucggauuaacaucaagagcuacaugggcacaaaauauacccacggcuauacaacagguccgaaguuuaauaggaaaugaggaauuuuuagacuauaugccauccaugaaaagauuucguaaagaagaggagagugaaggagcuauaugguag

SEQ ID NO: 23387 - RNA, 9873 nt, Artificial Sequence
  derived and/or modified CDS sequence (opt6) from DENV-3__EU854291__SS-prME
accucacuaugucugaugaugauauuaccagcggcuuuagcauuccaucucacuucgagggacggcgaaccacgaaugauagugggcaaaaaugaacguggaaaaucucuucuguucaaaacagcaucaggaauaaauaugugcacucuuauugcaauggaccuuggagaaaugugcgacgauaccauaacguacaaauguccucauauuacagaaguugaaccugaagauaucgauuguugguguaacuugacauccacaugggugacauacggaacaugcaaccaagcaggagaacaccguagagacaaaagauccguagcucucgcaccucauguuggaaugggucucgauacuagaacacaaacuuggaugucagcugaaggggcuuggagacaaguugaaaaaguagaaacaugggcuuuacgacaucccggcuuuacaauauuagcauuauuccuugcucauuacaucggaacgucuuugacucaaaaaguaguuauauuuauuuugcucaugcucguuacaccauccaugacuaugagaugcguuggugugggaaaccgcgacuuuguagaagguuugagcggagcuacuuggguagauguggugcuagaacaugguggaugcguuacaaccauggccaaaaacaaaccaacacuagacauagaacuacagaaaacagaagcaacucaacuagcuacacuaagaaaauuaugcauagaagguaaaaucacaaauaucacgacagacaguagaugcccuacucaaggcgaagcgguauuacccgaagaacaagaucaaaacuaugucugcaaacacacguacguagaucgaggaugggggaaugggugcggccuguucggaaaaggaucauuaguaaccugugcaaaauuccaaugcuuggaaccaauugaaggcaaaguaguucaauacgaaaaucuaaaauauacaguaaucauuacaguucacaccggugaucaacaccaggucgguaaugaaacucagggcguaacugccgaaauaacuccacaagcaaguacuacagaagccauacuaccggaauacggaacacuaggacuagaauguaguccacgcacaggccuagacuuuaaugaaaugauauuauuaacaaugaaaaacaaagcguggauggugcaucgacagugguuuuucgacuuaccacuaccauggaccucgggugccacuacggaaacuccaacauggaaucguaaagaacuguuaguaacguucaaaaacgcgcaugcaaagaaacaagaaguagucguuuuagggucccaggaaggugcaaugcauacugcauugacgggggcaaccgaaauacaaaauucuggcggaacuucaauauuugccggccauuuaaaauguagauugaaaauggauaaauuagaacugaaaggcauguccuaugcaaugugcaccaauacguuuguacucaagaaagaaguuucagaaacccaacaugguaccauccucauuaaagucgaauauaaaggagaagaugucccuugcaaaaucccauuuucaacagaggacggacaaggaaaagcucacaauggacguuugauaacugccaauccagugguaacgaagaaagaagaaccuguuaacauugaagcugaaccaccuuuuggggaaaguaauauaguaauagguauaggagacaaugccuugaaaauaaauugguauaagaaagggucaucgauaggaaaaauguucgaagcuaccgcucggggagcaagaagaauggcuauauugggcgacacagcaugggacuuugggucuguaggagguguauuaaacucccuagggaaaaugguacaucaaaucuuugggagcgcauauacggcccucuucaguggggucuccuggguaaugaaaauaggaauaggaguacuacucacuuggauuggccuaaauaguaaaaauaccaguaugucauuuaguuguaucgcgaucggaaucaucacccuauauuuaggagccguaguacaagcagacaugggaugcguaauaaauuggaaaggaaaagaguuaaaauguggaucaggcauauucguuacaaacgagguacacacuuggaccgagcaauauaaauuucaagcagauaguccuaaacgauuagcaaccgcgauagcaggggcuugggaaaacgggguaugcggaauaaggucaacuacgagaauggaaaacuuacuguggaaacagauagcuaacgaauuaaauuauauuuuaugggaaaauaacauuaaguugacaguuguuguuggugauacuauuggaguauuggaacaaggcaagcggacuuugacaccacaaccaauggaacuuaaguacaguuggaaaacgugggggaaagcaaaaauaguuaccgcagaaacacaaaacagcucauuuauuaucgacgggcccaauacaccagaaugccccuccgcgagcagagcauggaacguuugggaggucgaagacuauggcuuugggguuuuuacaacaaacaucuggcuaaaacuaagggaaguauauacccagcuaugugaucauaggcuaaugucagccgcaguaaaggaugagcgcgcaguacacgcagauaugggcuacuggauugagucacagaagaauggauccuggaaacuagagaaggcauccuuaauagaagugaaaacuuguacauggccgaaaucacauaccuuauggucaaauggaguccuagagagcgauaugauaauuccaaaaagccuugcugggccaauaucucaacauaacuauagaccuggauaucacacccaaacagcagggccauggcauuuggguaaguuagaacuagacuuuaacuacugugaagggaccaccguuguaauaacugagaauuguggaacaagagggcccagcuuaagaacuacaacaguaagcggaaaacuaauccacgaauggugcugccgcucuuguacacuucccccacuacgauacaugggggaagauggcugcugguacggcauggaaauuagaccaguaagugaaaaagaggaaaauaugguuaaaagccugguaucggcaggaucuggagagguagauaacuucacaaugggaguacucugcuuagccauucuauucgaggaagucaugcgcggaaaauuugggaaaaagcacaugauugcaggcguguucuuuacuuucguauuauuacuaagcggccaaauaacauggagggacauggcccauacucuaauuaugauaggaaguaacgcgagcgacaggauggguauggguguuacauaucuugcauuaauugcaacauuuaaaauacaaccguuccuugcacugggauuuuucuuacguaaacuaacuucuagagaaaaucuucuauuagggguaggacucgccauggcaaccacucuccaguuaccggaagauaucgagcaaauggcuaauggcauagcacucgguuuaauggcauuaaaacuaauaacccaauucgaaacauaccaacuauggacggccuuaauaucauuaacuuguucuaacacuauauuuacguuaacaguggccuggagaacggcgacacugauuuuagccgguguaagccuguuaccugugugccaaucguccagcaugagaaaaacugacuggcuaccuaugacugucgcagccaugggaguaccuccacuuccacucuucauauuuucacuuaaggacacacucaaacguagauccuggccauuaaaugaggguguaauggcagugggucuuguaagcaucuuagcaaguuccuuacuacgaaaugacguaccaauggccgggccgcuuguugcaggaggccuucuaauugcuuguuacguaauaaccggcaccucugcagaucuaacuguagaaaaagcugcugacguaacaugggaagaggaggcagaacaaacuggagugucccauaaucuuaugauaacaguagacgaugaugggacgaugcgaauaaaggaugaugaaacggaaaauauacuaacuguuuugcugaaaacugcucuauugaucgucucggggaucuucccauauucaauaccagcaacguugcuagucuggcauacauggcaaaaacaaacccaaagaucuggaguauuaugggacguacccagcccaccugaaacgcagaaagccgaacuagaggaaggaguauaucgcaucaaacagcaaggaauauuuggaaaaacucagguugguguugggguccaaaaagagggcguguuucacaccauguggcauguaacaagaggugcaguguugaccuauaacgggaaaagauuagaaccuaauugggcuaguguuaagaaagaccuaaucucauacgggggagguuggcgcuuaagcgcucaauggcagaagggagaagaaguccaaguaauagcaguagaaccagguaagaauccuaagaauuuccagaccaugccuggcacauuccaaacuacaacgggugaaauaggagcaaucgcauuagauuuuaaacccgguacgucaggcucgccuauaauuaaccgcgaggggaaaguugucgguuuguacggaaauggaguuguaaccaaaaaugggggauacguaagcggaauugcucaaacuaaugcagaaccagauggaccgacaccugaguuggaagaagaaauguuuaagaaaaggaauuugacaaucauggaucuacauccaggaucuggaaaaacccgaaaauaucuaccagccauuguacgcgaagcuauaaaaaggcggcuucguaccuugauacucgcaccuacacgaguuguagcggcagaaauggaagaagcucugaaaggcuuaccaauuagauaccaaacaacggccacuaaaagcgaacacacuggacgagaaauagucgaccuaaugugccacgcaacauuuacuaugagauugcuaucaccaguucgagucccgaauuacaaccucauaaucauggacgaagcacauuuuacugauccagcgucuauagcggcaagaggauauauaaguacgagagucgguaugggagaagccgcagcaauauuuaugaccgcuacuccaccagggaccgccgacgccuucccacagucaaacgcaccuauccaagaugaagaacgagauauaccagaacgaucguggaauaguggcaacgaauggauaacugauuucgcaggcaagacggugugguuuguuccaaguauaaaggcugguaaugacauugcaaauuguuugaggaaaaacggaaagaaagugauacaauugucgagaaaaacauucgauacagaauaucaaaagacuaaacucaacgauugggacuucguagucacaacugacauaagcgaaaugggagcaaauuucaaggccgacaggguuauagacccaagacguugccugaaaccugucauauuaaccgacggaucugaaagaguaauauuagccggcccuaugcccguuacagcagcuucugcugcucaacgaagaggucgaguggguagaaauccccaaaaggagaacgaccaauacauauucacaggacaaccucugaacaacgaugaagaccaugcacacuggacagaagcaaagaugcuccuagauaauauuaacacaccagaagggauuauuccugcuuuauuugaaccagaaagagagaaaucugcagccauagauggugaauacagacuuaagggggagucucguaagacguucguugaacuuaugagacgaggggaucuuccuguuuggcuagcccauaaaguagcuagcgagggaauaaaauauacugauagaaagugguguuuugacggucaaagaaauaaucaaauacucgaagaaaacauggacguggaaaucuggacaaaggaaggagagaagaagaaacuccguccgagguggcuagaugcacguacguauagcgauccacuagcccuuaaagaauuuaaggauuuugccgcuggaagaaaaagcauagcacuagacuugguaacugaaaucggaagaguuccaacacacuuagcacauaggacacggaaugcacuagacaaucuaguaaugcuucacacgucugaacauggcggaaaagcauauagacaugcuguugaagaacugccggaaaccauggaaacauugcucuuauugggauugaugauuuuacuuacagggggagcaauguuauucuuaauauccgggaaagguauagggaagacguccaucggcuugauaugcgugauugcaagcaguggcaugcucuggauggcagaaauucccuuacaguggauugcaagugcuauaguauuggaguucuuuaugaugguauuauuaauuccugaaccugagaagcaaagaacuccgcaagacaaucaguuagcauauguuguuauuggaauauuaacucuugcugcaacaauugcugcuaaugaaaugggacuauuagaaacuacuaagagagaucuugguaugaguaaagaaccuggcgugguaagccccacaucauaucucgaugucgaucugcauccagcauccgcuuggacacuauacgcaguugcgaccacaguaauaacucccauguugcggcauacuaucgaaaacucgaccgcaaauguaagucucgccgcaauugcuaaucaagcagucguacuaaugggacuagauaagggguggccgauaaguaaaauggaccuaggcguuccacuauuggccuuaggauguuacagccaaguaaauccacuaacacuaacggcugcagugcuacuucuuauaacucauuacgcuauaauaggaccaggguugcaagcgaaagcgacacgggaggcacaaaaacgaacagcggcgggaaucaugaaaaacccuaccgucgauggaauaaugacuauagaccuugacccaguaauauacgacaguaaauuugaaaagcaguugggacaaguaaugcuuuuaguacuaugcgcaguacaacugcuauuaaugagaacaucaugggcauuaugugaagcauugacacuugcaacugguccuauuacuacacuaugggaagggucuccaggaaaguuuuggaauaccacuauagcaguauccauggcgaauauauuuagaggaucauaucucgcuggggcagggcuggcguuuuccauuaugaaguccguuggaacaggcaaacgcggaaccggaagucaaggugaaacacugggugaaaaguggaagaagaaacucaaccagcuaucccggaaagaguucgacuuauacaagaagucgggaaucacagaaguagaucguacagaagcaaaagaaggcuugaaacgcggagaaauuacucaucacgcugucaguaggggauccgccaaacuacagugguucguagaaaggaauaugguuauaccugaagggcgagucaucgacuuggguugugggcgagguggaugguccuacuauugcgcggggcuuaagaaagucacggaaguuaggggcuauacuaaaggaggaccuggucacgaggagcccguuccaaugucuacuuauggcuggaacauaguaaaguuaaugaguggaaaagaugucuucuauuuaccgccugaaaaaugcgacacacuccucugcgacaucggugaaucgucaccaaguccaacaguagaagaaucuagaacuauccgagucuuaaagaugguggaaccuuggcucaaaaauaaucaauucuguauaaaaguucuaaauccauacaugcccaccguaauagaacaccuagaaagacugcagcgaaaacauggagguauguuggugaggaacccacuuucaagaaauaguacucacgagauguauuggaucucuaauggaaccggaaauauaguagccucggugaacaugguaucaagauuacuacucaaucguuucacaaugacucaccgucggccaaccauugaaaaagauguggauuuaggggcaggcacgagacaugucaacgccgaacccgaaaccccaaauauggauguaauaggagaaagaauaaaacggauaaaagaagaacacaacucuacauggcacuaugaugaugagaauccguacaagacaugggccuaucacggaagcuaugaaguaaaagccacugggagugcaucgucgaugauuaaugguguaguaaaacuauuaacaaagccaugggacgucgugccaaugguuacucaaauggcaaugacggacacaacaccuuuugggcaacagcguguuuuuaaagagaaaguggauacucgaacuccucgcccgaugccagguacuaggagaguaaugggaaucacagcagaaugguuauggaggacauuaggucgaaauaagaagccacggcucugcacucgugaagaauuuacuaagaaagucaggacuaaugcagcaaugggugcggucuuuacagaagaaaaccaaugggauucggcaaaagcagccguggaggaugaagacuucuggaaacucguagacagagaaagagaauuacauaaacucgguaaguguggaagcuguguguauaauaugaugggaaagcgcgagaagaaacuuggggaguucgguaaggccaaaggaucucgagcaaucugguacauguggcuuggcgcaagauaucucgaauuugaggcccugggauuucuuaacgaagaccacugguucagucgagaaaacucuuacucuggugucgaaggagaaggcuuacacaaauuagguuauauacuccgugacauaaguaaaaucccaggaggugcaauguacgcagaugauacggccgguugggauacacgcauuacugaagaugaccuacauaacgaagagaaaauuacccagcaaauggauccugaacauagacaacuugcaaacgcgauauuuaaacuuacauaccaaaacaaaguaguaaaaguccaaagacccacaccaacuggcacuguaauggacauaauuucaagaaaggaucaaagagggucgggucaaguagggaccuauggucuaaauacauuuacuaacauggaagcgcagcugauccgucagauggagggggaagguguauuaagcaaggcagauuuagagaauccucauuuaccugagaagaaaauaacccagugguuagaaacaaaaggaguagaacguuugaaaagaauggcaaucuccggggaugacuguguaguuaaaccgauugacgauagauuugcgaaugcauuacuugcguugaacgauaugggcaaagucagaaaagauauaccacaauggcaaccuuccaaaggguggcacgauuggcaacaggugccguuuuguagccaccauuuccacgaacuaauaaugaaggacggaaggaagcuagucguucccuguagaccacaggacgaguuaauaggacgugcaagaauaucccagggagcaggguggucauugagggaaacggcgugccuggggaaggcauacgcacaaauguggucauuaauguauuuccauaggcgugaccuacgguuagcaucuaaugcgauuuguagcgcuguuccugugcauuggguuccaacuagccggacaacuugguccauacaugcucaccaccaauggaugacuacagaagacaugcuuacuguauggaaucgugucuggauugaagauaauccguggauggaggauaaaacaccgguuaccacgugggaaaauguacccuacuuggguaaacgugaggaucaauggugugguucauuaauuggucugacuagcagagcgacaugggcacaaaauauucccaccgcgauucaacaaguaagaaguuuaauagguaaugaagaguuccuagauuacaugccaagcaugaaaagguuuagaaaagaggaagaaucagaaggagcuauuugguga

SEQ ID NO: 23388 - RNA, 9873 nt, Artificial Sequence
  derived and/or modified CDS sequence (opt6) from DENV-3__KF955454__SS-prME
accagcuuauguuuaaugaugauucuaccagcugcauuggcauuucacuugacaagccgcgauggcgaaccucguaugauagucgggaaaaaugaacguggaaagagcuuauuauuuaaaacugccucaggaauaaauaugugcacauugauagcaauggaucuuggugaaaugugugacgacacggucacuuacaaaugcccacacaucacagaagucgaaccagaagacauagacuguuggugcaacuuaacuucuaccuggguuacguacggaacaugcaaccaagccggagaacaucgacgagacaaacgguccguagcccucgcuccucauguugguaugggacuugauacacgaacccaaacguggaugagugcugaaggagcauggagacaaguugagaaaguugaaacaugggcgcuacgacauccaggguuuacaaucuuagcucuauuccuagcccauuauauaggaaccucgcuuacacaaaaaguuguaaucuuuauuuuauugauguugguaaccccaagcaugaccaugagauguguaggaguuggaaauagagauuucguagaaggauuaagcggagcaacauggguugauguaguacuagaacacgggggauguguaacuaccauggcuaaaaauaaaccaacuuuagacauugaauuacagaaaacggaagccacccaauuagcgacccuaaggaaauuauguaucgaaggaaaaauuaccaacauaacaacggacucaagaugucccacgcaaggagaagcagugcuuccggaagaacaagaccaaaauuaugucuguaaacauacuuauguggaccguggcuggggaaauggcuguggacuauuugguaaagggucgcugguaacgugcgcgaaauuucaaugucuagaaccaauagaaggaaaagugguacaauaugaaaauuugaaauauacaguaaucauaacaguacauacaggugaucaacaccaaguggguaaugaaacacaaggaguaaccgcugaaauaacuccacaggcgagcacgacugaagcaauacuaccggaauacgguaccuuggggcuagaguguucaccgagaacuggcuuagacuuuaaugaaaugauuuugcuaacuaugaaaaacaaagccuggauggugcaccgacaaugguucuuugacuuaccacucccuuggaccaguggcgcuacaacggaaacaccuacauggaaccgaaaagaacucuuaguaaccuuuaaaaaugcacacgccaagaaacaagaagucguaguacucggaucucaggagggggcuaugcauacugccuuaacuggagccacggaaauucaaaacucuggugguacuucgaucuucgccggacauuuaaaaugucgauuaaaaauggauaaauuggaacuaaaaggaaugucguaugcuaugugcacgaauacauucguacucaagaaagaaguuucggaaacccagcacgggacuauauuaauaaaaguagaguacaaaggugaagacgugccaugcaaaauaccguuuaguaccgaagauggucagggaaaagcccauaauggaagacuaauaacugcgaauccagucguaacuaagaaagaagaaccuguaaauaucgaagcugaaccuccauuuggugaaaguaauauuguaauaggaauuggcgauaaugccuuaaaaaucaauugguauaagaaagggaguagcauagguaaaauguucgaagcuacugcaagaggagcccggagaauggcaauacuaggagauacagcaugggacuuuggaagcgugggcggaguucugaacucauuaggcaaaaugguucaucaaaucuucggaucagcuuauacagcauuguucucgggaguuagcugggugaugaaaaucggaauugguguauugcuaacuuggauaggauuaaauucuaaaaauacgaguaugagcuuuagcugcauugcuauugggauuauaacccuuuaccuaggagcgguaguccaagcugacaugggaugcguuaucaacuggaaaggaaaagaacuaaaauguggaucggguaucuuuguaacgaacgaaguucauaccuggacggaacaauacaaauuucaagcggauucuccgaaacgauuagccacagcaauugcaggagcaugggaaaacggaguuuguggcauuagauccacaacucgaauggaaaauuuguuauggaaacaaauagcuaaugaacuuaauuacauauugugggaaaauaacaucaaauugacaguggucguuggugauauuauuggaguauuggaacaagguaaacgaacauuaacgccccaaccaauggaauuaaaauacucauggaaaacguggggcaaagccaaaauagugacggccgaaacacaaaauucgaguuucauaaucgacgguccgaauacgcccgaaugccccucugccucaagagcuuggaacguaugggaaguagaagacuacggcuucggaguguuuacuacuaauauuuggcuaaaacuaagggagguuuacacucagcucugugaucauaggcuuaugagcgcggccguaaaagacgagcgcgcuguucacgcagacaugggauauuggauagaaagccagaaaaaugggaguuggaaauuagaaaaagccagcuuaauagaaguaaagacaugcaccuggccgaaaucacacacccuauggucaaauggaguucuugaaggagacaugauaaucccaaagucacuagcuggcccuauuagucagcacaacuaccgccccgguuaccacacgcaaacugcuggucccuggcaccuaggaaaauuagaauuggacuucaauuacugugaagguaccacgguaguaauaacagaaaacuguggaacacgaggacccuccuuaagaacuacgacaguauccggcaaguuaauacacgaauggugcugucgaucuugcacucuaccaccauugagauauaugggagaggacggauguugguacggcauggagauuaggccaauauccgagaaagaagaaaauaugguaaagucccucguuucugcggguucaggcgaagucgacaauuucacaaugggcgugcuuugcuuagcaauccuauuugaagaaguaaugagaggaaaguuugggaagaaacauaugauugccggagucuuuuucacuuucguacuucuuuugucaggucaaauaacguggcgugacauggcccacacacuaauaaugaucgguaguaaugcgucugauagaaugggaaugggaguaacauaccuagcacuuaucgccacuuuuaaaauccaaccguuucuagcgcucggauucuuucuuaggaaacuaaccucacgagagaaucuacuccuaggaguaggacucgcuauggcuaccaccuugcaauuaccugaagauauugaacaaauggcaaacggcaucgcauuagguuuaauggcgcuaaaacugaucacgcaguucgaaacauaccaacuuuggacagccuuaauuagcuugacaugcucuaauacuauauuuaccuuaacggucgcuuggcgaaccgcaacccucauacuugcaggaguuuccuuguuaccaguaugucaaucuucgagcaugcgcaagacagacugguuaccaaugacgguagccgcuaugggaguuccaccguuaccacucuuuauuuucucacucaaagauacacuuaaaaggaggagcuggccgcuuaacgaaggcgucauggcaguuggauuagucucaauccuugcuaguucacugcuaaggaaugacguaccaauggcaggaccacuuguggccggagggcuuuuaauagcauguuacguuaucaccgggacaagcgcugaccugacgguagagaaggcugcagacgugacgugggaagaagaggcagaacagacagguguaucacacaauuuaaugauaacaguugaugaugaugguacuaugcgaauaaaagacgaugaaaccgaaaauauuuuaacaguacuacuaaaaacugcuuuacuaaucgugucgggaauauucccguacucaauuccagcaacuuugcuuguguggcacacauggcaaaaacagacacaaaggucaggcguucuaugggauguucccuccccacccgaaacucagaaagcagagcuugaggaaggaguauauaggaucaaacagcaaggcauuuuuggaaaaacacaaguagggguaggaguucaaaaggaagggguauuucacacaauguggcaugucacgagaggagcgguguugacuuacaauggaaagagauuggaaccgaauugggcgagcgugaaaaaggaucuuauaucauauggaggugguuggcgauuaucggcucaauggcaaaaaggagaggaaguacaaguuauagcaguagaaccagguaaaaaucccaaaaauuuucagacaaugccggguacuuuucagaccaccacgggugaaaucggggccauugcccuagauuuuaaaccaggaacaaguggaucaccaaucauuaaucgggaaggcaaggucguuggccuauacgggaacggagugguuacaaagaacggcggauauguaaguggaaucgcccaaaccaaugccgaacccgaugguccuacacccgaauuggaagaggaaauguuuaagaaaagaaauuuaacgauuauggaucuccacccggguagcgguaagacacgcaaauaucuaccagcaaucguucgagaagcuaucaaacgacgacuacgaacauuaauacuugcacccaccagaguaguggcggcugaaauggaagaagcacuaaaaggguuacccauccgauaucaaacaacugcaacaaaaucagaacauaccgguagagaaauuguugacuuaaugugucacgcuacuuucacaaugcguuuacugagcccaguuaggguaccaaacuauaaucuaauuauuauggacgaagcucauuucacagauccugcgucuauagcugcaagagguuacauauccacacgaguuggaaugggagaagccgcugccauauucaugacagccacaccucccgguacugcagacgcuuuuccgcaaucaaaugcaccgauucaggacgaagaacgagauauaccagaacggucuuggaacagugguaaugaguggaucacugauuuugcuggaaaaacagugugguuuguaccaaguauuaaagcaggaaaugauauagcaaauugucuaaggaaaaauggcaaaaagguaauccaacuaaguaggaaaacuuuugauaccgaguaccagaaaaccaaauugaacgauugggauuuugugguaacaaccgacauauccgagaugggggcuaacuucaaggccgauagaguaauugacccucgaagaugccuuaaaccagugauauuaacugacggccccgaacgugucauucuagcagggccaaugccagugaccgcggcaagcgcugcacaaaggcggggucggguuggucgaaacccucaaaaagaaaaugaucaauauauauuuacaggucagccacuaaacaacgacgaagaucacgcacacuggacggaagcaaaaauguugcuagauaauauuaacacuccugaaggcauuauaccggcgcucuuugaaccagagagggaaaagagcgcugcgauagauggcgaguaucgccugaaaggagaaucccgcaagacauucuuagaguuaaugagaagaggagauuuaccuguuuggcuggcuuauaaaguugcaagcgaaggaauuaaauacaccgaucgaaaauggugcuucgaugggcagagaaauaaccagauuuuagaagagaacauggacgucgagauauggacuaaagaaggagagaagaagaaauuaagaccccgguggcuugacgccagaacauauagugacccauuagcuuuaaaagaauuuaaagacuuugcugcaggcaggaaaucaaucgcacuugauuuaguuacugagauugggcgcguaccaacgcauuuagcucauagaacaagaaaugcacucgauaaccuugucaugcuacacacgucagaacauggaggaaaagcauaccgccacgcaguggaagaacuaccugaaaccauggagacucuucuccuacucggauuaaugauauuauuaaccggaggagcgaugcuuuuucuaaucucaggaaaaggcauagguaaaacaaguauaggucuaauaugcguaauugcaucauccggcaugcuauggauggcugaaauucccuugcaauggauugcaucggcaauaguucuugaguucuuuaugauggucuuauuaauuccagaaccagaaaaacagcggacaccacaggacaaccaguuagccuaugugguuauaggaauauugacccuagcagcuauaaucgcugcaaacgaaaugggacuauuggaaacaacaaagcgagaucuuggaaugucaaaagagccagguguugucucuccaacaaguuaucuugauguagacuuacaucccgccucugcuuggacacucuaugcggucgcaacuaccgucauuacaccaaugcuccgucacacuauagaaaauagcacggcgaacguaucauuagcggcaauugcgaaccaggcugucguucugaugggcuuggauaaaggcuggcccauuaguaagauggauuuaggcgugccacuguuggcacuagggugcuacucacaaguaaauccacuuaccuuaacggcagcaguacuccuauugauuacgcacuaugcaauaauaggacccggucuucaagcgaaagccaccagagaagcucagaaaaggacugcagcggggauuaugaaaaacccaacuguagacggaaucaugacgauugaucuugacccuguaauauacgacagcaaauuugaaaaacaacuaggacaagugaugcuauuaguauugugugcaguacaauugcuacuaaugcguacuucuugggccuuaugugaggcucuaacacuugcaacugguccuauuacgacacuaugggaaggaagccccggaaaauuuuggaauacaacuauugcgguuucuauggccaacauuuucagggggagcuaccuagcgggagcaggcuuagcauuuagcaucaugaaaaguguuggaacaggaaaaagaggaacugguagccaaggggagacauuaggugaaaaguggaagaagaaauuaaaccaacuuuccagaaaagaauuugaccuauauaagaaauccggaauaaccgaggucgacagggcagaagcuaaagaaggguugaaaagaggcgaaaucacgcaucaugcggugagcagaggguccgcgaaacuucaaugguuuguggaaagaaacauggucaucccugaagggagagucaucgacuuagguuguggacgagggggauggucuuauuauugugcagguuuaaagaaaguaacugaaguuagaggauacacuaaaggaggcccggggcacgaagaaccgguaccaaugucaacguacggauggaauauuguaaaauuaaugucaggcaaagauguauuuuauuugccgccggagaaaugugauacuuuacuaugcgacauaggcgaaucaaguccaucuccaaccguugaagagagcagaacuauucguguacuaaaaaugguagaaccuuggcucaaaaauaaccaauuuugcauuaaagugcuaaaucccuacaugccaacagugauugaacacuuagaacgauugcagagaaaacaugguggcauguuaguaagaaauccauuaucacggaacaguacacacgaaauguacuggaucucaaacggaacggguaauauaguagccucaguuaauauggucucgaggcuauuauugaacagguuuacaaugacgcaccgaagaccaacuauagaaaaagacgucgacuuaggugcugguacgagacacguaaaugcugaacccgaaaccccaaacauggacguuauaggagaacgaaucaaaaggaucaaagaagaacacaacaguacauggcacuaugacgaugagaauccauacaaaacaugggcguaucaugguucauacgaaguaaaagcaacaggaagugcaucuaguaugaucaauggagugguaaaguuacuaacaaaaccuugggaugucgucccaauggucacucagauggcuaugacugacaccaccccauucgggcaacaacggguguucaaagaaaaaguagauacacguacuccgcgaucaaugccagggacacgaagaguaaugggaauaacugcagagugguuguggcguacacuugggcgaaauaagaaaccuagacuaugcacccgagaagaguucacuaagaaagugcguacaaaugcggcaaugggagcuguuuuuacugaagaaaaccagugggacagugcgaaagcugcagucgaagaugaggauuuuuggaaacuuguggauagagagcgggaauuacauaaacuagguaagugcggaucaugcguauacaacaugaugggaaagagagagaagaaacucggggaauuugggaaagccaaaggcagccgagcaauaugguacauguggcugggagcuagguaccucgaauuugaagccuuaggauuccuuaacgaagaccauugguuuucucgcgaaaacaguuauucggggguagaaggagaaggccuacauaaacuaggauauaucuuacgggauauuucuaaaauaccagguggugccauguaugcagaugacacagccggcugggauacuagaauaacugaagaugacuuacacaacgaagagaaaauuacacaacaaauggacccugaacauagacaacuugccaacgcuauauucaaguuaacauaucaaaauaaaguaguaaaaguacaaaggccaacaccuacugguacagugauggauauaaucucuaggaaagaucaaagaggaagcggacaagugggcacauacggucuaaacacguuuacaaauauggaagcacaacucauacgccaaauggaaggagaaggcguauuaaguaaagcugacuuagaaaauccgcauccgcccgagaagaaaauuacgcaguggcuagaaacuaaagggguggaaagauugaaacgcauggcuauaucaggcgacgacuguguaguaaaacccaucgacgacagguuugcuaacgccuuauuagcauuaaaugauauggggaaaguuagaaaagauauuccucaauggcagccguccaaagguuggcaugacuggcaacagguacccuucugcagucaucauuuucacgaauuaauaaugaaggacgggagaaagcuaguagugccaugucguccacaagaugaguugaucgguagagcacgaauuagccagggagcaggcuggucauugagagaaaccgcaugcuuagguaaggcuuaugcacagauguggucccucauguauuuccacagaagagaucugcggcucgcauccaacgcaauuugcucagccguaccaguccauuggguaccaacuagcagaacaacguggaguauacaugcucaccaucaguggaugaccacagaagauaugcugacaguuuggaaucggguauggauagaagauaacccauggauggaggauaaaaccccgguaacaaccugggagaacguuccauaccuuggaaagagagaagaucaauggugugggagcuuaauaggacucacaagucgagcaacgugggcccagaauauuccgacugcuauccaacaaguccguucacuuauaggaaacgaagaauuuuuggauuauaugccuaguaugaaacgguuucgaaaggaagaagaaucugaaggagcaauaugguaa

SEQ ID NO: 23389 - RNA, 9873 nt, Artificial Sequence
  derived and/or modified CDS sequence (opt6) from DENV-3__EU854292__SS-prME
acgucucuaugcuuaaugaugauccuucccgcugcuuuggcauuccauuuaacuagcagagacggggaacccagaaugauagugggcaaaaaugaaagaggaaaaucgcuauuauuuaaaaccgcgaguggaaucaauaugugcacuuuaauagcaauggaccugggagaaaugugugacgauaccguaacuuacaaaugcccacauaucaccgaagucgaaccagaagauauugacuguuggugcaacuuaacguccaccuggguaacuuaugguacuugcaaccaagcaggagaacauagaagggacaaaagaaguguugcauuagcuccucacguagguaugggauuagacacccgcacacaaacauggaugucugcagaaggagccuggagacaagucgaaaaaguagaaacaugggccuugcgucauccaggauuuacaauacuagcgcuauuuuuggcgcacuacauaggaacaucgcugacacaaaaaguagucauuuuuauauuauuaaugcuuguaacaccaucuaugacaaugcgcuguguuggaauagguaaucgggauuuugucgaaggauuaucaggugccacuuggguagaugucguucuagagcauggagguuguguuacaacuauggcuaaaaacaaaccaacacuagacaucgagcuacagaaaaccgaagcaacccaauuagccacacugagaaaauugugcauugaaggaaaaaucaccaacauuacgaccgauaguaggugucccacacaaggagaagcugcccuaccugaagaacaagaccaaaacuauguguguaaacacacguaugucgauagaggaugggguaaugguuguggauuauucgggaaaggaagccuuguuaccugugcaaaauuccagugucuagaacccauagaaggaaaagugguacaacacgaaaacuugaaauauacuguuauuauaacuguucauacuggagaucaacaucaggugggaaaugagacacaaggggugaccgcggaaauaacgccucaagcuagcacgacagaagccauucuuccugaauauggcacuuuaggccuagaauguagcccacggacuggucuggauuucaaugaaaugauccuuuuaacaaugaaaaauaaagccuggaugguacauagacagugguucuuugacuuaccucucccuuggacaagcggugcaacuacagaaacuccaacguggaauagaaaagaguuauuagucacguucaaaaacgcacaugcuaagaaacaagaaguagucgugcuagguucgcaagaaggugcuaugcauacagcuuuaacgggagcaaccgaaauucaaaacaguggaggcacauccauauuugcaggucauuugaagugucggcuaaaaauggacaaacuagaguuaaaagguaugaguuacgccaugugcacgaacacauuugugcucaagaaagaaguuucugagacccaacauggaacuauccugauaaaaguagaauacaaaggggaagaugccccauguaaaauaccguucagcacagaagauggucaaggaaaagcacauaauggucguuuaaucacagccaauccagucguaacuaagaaagaagaaccaguaaacauugaagcugaaccaccguucggagaguccaacauuguuauaggaauaggagacaaugcacugaaaauaaauugguacaaaaagggauccagcauaggaaaaauguuugaagcaacagcacguggggccagacguauggcaauacuaggugacacugcuugggauuuugguucggucggggguguuuuaaauucacuaggaaaaaugguacaucaaauuuucggaagcgcauauaccgcuuuauucuccggagucaguuggguuaugaaaauaggcauugggguacuccugacuuggaucggacuaaacucuaaaaauaccaguaugucguuuucaugcauugcaaucggaaucauuacccuauaucuaggcgcaguuguucaagcugacauggggugcguaauaaauuggaaggguaaagagcuaaaauguggcucaggcauauuuguuacuaacgaagugcacacauggacagaacaguacaaguuucaggcagacaguccaaaacgucuagcaacggcaauagcaggagcuugggagaacggugucugugguauucgcagcacaacuaggauggaaaaccuguuauggaaacaaaucgccaacgaauuaaacuauauacugugggagaacaauauaaaauuaacgguagucguuggagauaucauuggcguccuagaacagggaaaaagaacauuaacgccacaacccauggaacuaaaauauucauggaagacgugggguaaagcuaaaauaguaacggccgaaacacaaaauucaucguucauaauagacgguccuaauacuccagaaugcccaucugcagcgagagcauggaauguaugggaagucgaggauuauggauuugggguguucacaacuaacauauggcuaaaauuacgagaaguguauacacaacugugcgaccaucgacucaugucggcagcuguaaaagacgagcgugccguacacgcugauaugggguacuggauagaaagccagaaaaauggcaguuggaaacuggaaaaggcuucacugauugaaguuaaaacuuguacuuggccuaaaagucauacgcuuuggagcaauggaguacuagaaucagauaugauaauaccaaaaagucucgccggaccuauaucgcagcauaaucaucgccccggcuaccacacacaaacugcaggaccauggcaucuagguaaacuugaacuagauuucaauuacugugaaggcacuacaguuguuauuacugaaaauugcggcaccagagggccgaguuuacggacaacaacaguaucaggaaaacugauccaugaauggugcuguagaaguugcacucugccaccacuacgguauaugggagaagacggauguugguacggaauggaaauuagaccgauuagugagaaagaggagaacaugguaaaaucccucgucucggccgggagcgggaagguagauaauuuuacuaugggugucuuguguuuagcgauuuuguucgaggaaguuaugcgaggaaaauucggcaagaaacauaugauugcaggcgucuuuuucacauucguucuccuucuaagcggacaaauaacauggagagacauggcacacaccuugauuaugauagggucaaaugcaucagaccgcaugggcaugggaguuacuuaucuagcacuuauugcaacauuuaaaauucaaccuuuccuagcguugggauucuucuuaagaaaacuaaccagcagggaaaacuuauuacuagguguuggucuagccauggccacuacucuucaacucccagaagauauugaacaaauggccaaugguauugcccuaggacuuauggcguuaaaacuaauuacacaauuugaaacuuaucaauuguggacagcgcuuaucagccucacaugcagcaacaccaucuucacauuaacaguagcuuggcgaacagcaacauuaauauuagcaggaguuagcuugcugccagucugucaaucaucaagcaugcgaaaaaccgauuggcuaccaauggcuguagcagccauggguguaccaccgcuuccauuguuuauuuucugcuuaaaagauacgcuuaaaagacguucauggccucucaaugaaggugucauggcggucggccuaguaucuauuuuagcuucuucccuacugcguaaugauguccccauggcaggaccauuaguggcuggagggcuauuaaucgcaugcuacguuaucacugguacaagugcagacuuaacaguugaaaaagccgcagauauuacaugggaagaagaagcagaacaaacugguguaagucauaauuuaaugauuacuguugaugacgacgguaccaugcgaauaaaagacgaugaaacagaaaauaucuuaacaguacuauuaaaaaccgcccuguuaaucguauccggaauauucccuuauucaauaccagcaacauuauuaguauggcauaccuggcagaagcaaacucaaagaaguggaguacuaugggauguucccucacccccagaaacacaaaaagcggaauuagaggagggugucuauaggauaaaacagcaagggauauuuggcaaaacucagguaggaguaggaguacaaaaagaagguguuuuccauacaauguggcaugucacuagaggugcagugcuaacauacaacgggaaaaggcuagagcccaauugggcaagcgugaagaaagacuuaauaucauauggcggagguuggcggcugagugcacaauggcaaaagggcgaagaaguacaagucauugcgguggaaccuggcaaaaauccaaagaacuuccaaacuaugccugguaccuuccaaacaacaacaggugaaaucggugcuaucgccuuggauuuuaagccuggcacauccggaucaccaauuauaaauagagaggggaaaguugucggacucuacgguaauggaguaguaacuaaaaauggugguuacguuucgggaauagcacaaacaaaugcagaaccugauggaccuacaccagagcuagaagaagagauguuuaagaaaagaaaucuuacaauaauggaucuacacccaggaaguggaaaaacacguaaguauuuaccggccaucguacgugaagcaauuaagagacguuugcgaacacuaauauuagcuccaaccagggucguugcugcugaaauggaagaagcauuaaaaggguuaccuaucagauaucaaaccacagccacuaagagugaacauacgggaagagagaucguggaccuaaugugucacgcgacauuuacgaugaggcuucuuucaccgguuaggguacccaauuacaaucuaauaauaauggacgaagcacauuuuacagacccugccucaauagcugcaaggggguauaucuccacucgagucggaaugggugaagcugcggccauauuuaugacugcaacgccuccagguacugccgaugccuuuccccaaucaaaugcaccaauccaggaugaagaaagggacauaccggaacguaguuggaacucgggaaaugaguggauaaccgauuuugccgggaaaaccguaugguuugucccgagcauaaaagccggaaaugauauagccaacugucuucguaagaauggcaagaaaguuauccagcuaagccguaaaacauuugacacggaauaucagaaaacgaaacuuaaugauugggacuucguagugaccacggacaucucugaaaugggagcuaauuucaaggcagacagaguuauugauccuagaagaugccucaaacccguuauucuaacggacggacccgaaagagucaucuuagcugggccaaugcccgugacagcugcuagugccgcccagaggagagggcgcguugguagaaauccacauaaagaaaaugaucaguauauauucacuggccaaccuuugaacaacgaugaagaccaugcccauuggacagaagcuaagaugcuacuugacaacauuaauacacccgaagggauaauaccagcacuuuuugaaccagaaagagagaaauccgcggcaauagauggagaauaccgauuaaaaggagaaucgagaaaaacuuucguagaacugaugcggcgaggugauuuaccaguuugguuggcucauaaagucgcuagugagggaaucaaauauaccgaucguaaguggugcuuugacggacaaagaaacaaccagauauuagaggaaaauauggacguagaaaucuggacuaaggaaggugagaaaaagaaauuacgaccucgcuggcuagaugcacggacauauagugacccauuggccuuaaaggaauuuaaggauuucgcugcaggacgaaaaucaauagcacucgaucuuguuaccgaaaucggacguguaccaucacacuuagcucauaggacgagaaacgcauuagauaaccucguaaugcuucauacaagugaacauggagggcgagcuuauagacaugccguagaggaacuacccgaaacuauggaaacccuccuauugcuaggucuaaugauucugcucacugguggcgcgauguuguuccuaauaucagguaagggaaucggcaaaaccucuaucggauugaucugugucauugcaagcaguggaaugcuauggauggccgaaaucccacuacaauggauagcuagcgcgaucguauuagaguuuuucaugaugguacuacuuauaccagaaccagagaaacaaagaacaccgcaagauaaucaacuggccuauguuguaauugggauauuaacucucgcggcuauaaucgccgcuaacgaaaugggacuguuggaaacaacuaaaagagauuuagguaugagcaaagagccgggaguaguaucacccacaaguuacuuggacgucgauuuacauccagcuagugcauggacucuauacgcuguugcaacuacgguaauaacuccgauguuaagacauacgauugaaaacagcaccgcaaaugugagucuagcugccauagcaaaccaagcgguuguuuuaaugggacuggauaagggguggccaaucucaaaaauggaucugggcguuccuuuauuagcccuagggugcuauucacaggugaauccuuuaacauuaacugcagcuguauuacuauugaucacacacuaugcaaucauuggcccaggauuacaagcuaaagcgacacgugaagcgcagaagagaacggcggcgggcauaaugaaaaaucccacgguagacgguauaaugaccauagaccuggauccugugauauaugauucuaaauucgaaaaacaacuuggacaggucaugcugcuaguguuaugugcgguucagcuauuacuaaugcguacuucuugggcccuuugugaagcacugacauuagcaacugguccaauuacaacacuuugggaaggcucccccggaaaauuuuggaacaccacuauagcagugucaauggcuaacauuuuuagaggaaguuaucucgcaggagcgggacucgccuucucaauaaugaaaucuguaggcacggguaaacgggggacaggaucucaaggagaaacccuaggugaaaaauggaaaaagaaauugaaccaacuuagccgaaaagaauuugaucuguauaagaaaucagguauuacagaagucgaucgaacugaagccaaagagggacucaaaagaggagaaaucacucaucacgcuguaagcagaggcagugcgaaauuacaaugguuugucgaaaggaacaugguaaucccagaaggacguguaaucgauuugggaugcggcagagggggcuggaguuacuacugcgcuggcuugaagaaagucacugaagucagaggauacacaaaagggggaccaggucacgaagaaccgguccccaugaguacauauggauggaacauugucaaacugauguccggaaaagauguauuuuacuugccaccugaaaaaugugacacccuccuuugcgauauaggggaaucauccccaucaccuacggucgaagaaucgaggaccauuagaguuuugaagaugguagaaccgugguugaaaaauaaucaauucugcauuaagguacuaaauccuuauaugccuacagugauugagcaccuugagagguuacaacgaaaacauggggguauguuagucagaaauccacucaguaggaacucaacgcacgaaauguacuggauaagcaacggcacagguaacauaguugcgucugucaauaugguaucuagguuacuacuaaauagauuuacuaugacacauagacgcccaacuaucgaaaaggacguagaccucggcgcgggaacucgacacgucaacgccgaaccugaaaccccgaauauggauguaauaggugaaagaauaaaacggaucaaggaagaacacaauucaacauggcacuaugaugacgagaauccuuauaaaacuugggcauaucacggauccuaugaaguuaaagcaacuggauccgcuaguaguaugauuaacggaguagugaaacuguuaacaaaaccuugggauguuguaccuauggucacucaaauggcuaugacugacacgacgcccuuuggucaacagcgaguguuuaaagaaaagguugauacaagaacaccuagaucaaugcccggcacaagacgcguuauggguaucacagcagaauggcucuggcgaacacucgguaggaauaagaaaccacgauuaugcacaagagaggaguuuacaaagaagguccguacgaacgcugcaaugggagcgguuuucacggaagaaaaccaaugggauucugccaaagcugccguagaggacgaagacuucuggaaacuuguagaccgagagagggaacuacauaaauuaggaaaaugugguagcuguguauacaacaugaugggcaaaagagagaagaaacuuggggaguucggaaaagcuaaagguucacgagcgauuugguauauguggcuaggugcgagauaccuggaguucgaggcucugggguucuuaaaugaagaccacugguucaguagagaaaacucuuauucgggcguugaaggcgaaggccuucauaaauugggauauauauuaagagacaucagcaagauaccuggcggagcuauguaugcagaugacaccgccggcugggauacucguaucacagaggaugacuuacauaacgaagagaaaauaacacaacaaauggaucccgaacauagacaacuagcaaaugcgauuuucaaguuaaccuaucaaaauaaagugguaaaaguccaacgaccuaccccaaccggaacagucauggacauaauuuccagaaaagaccaaaggggaucaggacaaguuggaacauauggucuaaacacuuucacaaacauggaagcacaauuaauaagacagauggagggagaagguguuuugagcaaagcugaucuggaaaauccgcacuuaccagagaagaaaaucacacaauggcucgaaacgaagggcguagagagauuaaaaaggauggcaauuucaggugacgauugugugguaaagccuauagaugauagauuugcuaaugccuuauuagcucuaaacgauaugggaaaagugagaaaagacauaccacaauggcaaccaucaaaagguuggcaugacuggcaacaaguaccauuuugcagucaucacuuccaugaauuaaucaugaaagacggcaggaagcuagucguccccuguagaccucaggaugagcugauagguagagcucgaauaucacaaggagcaggcuggagucuaaaagaaacugcaugcuuagguaaggccuaugcacaaauguggagucuaauguauuuccaucgucgagaccuccgauuagcuucaaacgcaaucuguucagccguuccaguccauuggguaccuacuucaagaacgaccuggucgauacacgcccaucaucaauggaugacaacggaggauaugcuaaccguauggaacagaguauggauagaagauaauccuuggauggaagauaaaaccccgguaacuaccugggagaacgugccauauuuaggaaaaagagaagaccaguggugcgguucacuaauuggacuaacaucaagagcaacaugggcucaaaauauuccuacagccauucaacagguacguuccuuaauugguaacgaagaguuucucgacuauaugccgucaaugaaacguuuuagaaaagaggaagagucugaaggugcaauaugguaa

SEQ ID NO: 23390 - RNA, 9873 nt, Artificial Sequence
  derived and/or modified CDS sequence (opt6) from DENV-3__FJ639746__SS-prME
acuagccucuguuuaaugaugauauugccugcagcauuagccuuccauuuaacaucuagagauggagaaccgcguaugauaguuggcaaaaaugaacgagguaaaucccuacuauuuaaaacggcgagcggaauaaacaugugcacacuaauugcgauggauuuaggcgaaaugugugaugacaccguuacguacaaaugcccucauauaacugaagucgaaccugaagacauugacugcugguguaaucugaccaguacuuggguaacuuauggaacuugcaaucaagcgggugaacauaggagggacaaacggucaguugcccucgcaccacauguggguaugggguuagacacgagaacacaaaccuggaugucggcagaaggcgcguggagacagguagagaaagucgagacuugggcacuacgucacccgggauucacuauauuggcucuguucuuagcucacuauaucgggacuucauugacacagaaaguaguuauauucauccuucucaugcuagucacuccaucaaugacuaugaggugcgucggagucggaaaucgcgacuuuguggaaggcuuaucuggagcaacauggguagacguuguacuggagcauggaggcuguguaacaacaauggccaaaaauaaaccuacuuuagauaucgagcuucagaaaacagaagccacccaacuugccacacugagaaaauuauguaucgaaggcaaaauaacaaauauaacaacugacucaagauguccgacacaaggggaggcaguccuuccagaagaacaagaucaaaacuaugucugcaaacauacauauguagaucgaggauggggaaauggcuguggauuauucgggaaagggagcuuagugacaugcgcaaaauuucagugcuuggagccaauugaaggaaaaguaguccaauacgaaaacuuaaaauauacuguuauaauaacaguucacacgggcgaucaacaccaaguaggcaacgagacacaaggagugaccgcugaaauaacaccacaagcaucaacaacagaagccauacuuccagaauauggaaccuugggacuagagugcaguccaagaacaggucuagacuucaaugagaugauucuucucacaaugaaaaacaaagccuggaugguacaccgacaaugguucuucgaccuucccuuacccuggacgaguggagcaacaacagagacgccuacuuggaaucgcaaagagcuacuuguaacauuuaaaaaugcacaugccaagaaacaagaagucgugguauuagguucacaggagggcgcaaugcauacugcguuaaccggagcuacugaaauacaaaauaguggcggaacgucaauuuucgcuggacaccugaaaugcagauugaaaauggauaaauuagaauuaaaaggaaugucauaugccauguguacgaauaccuucgucuuaaagaaagaaguaucugaaacucaacaugguacaauacuuauaaaagucgaguauaaaggggaggaugucccgugcaaaauacccuucucgacagaagauggacaaggaaaagcacauaauggcagauuaauaaccgcuaacccuguagugaccaagaaagaggaaccugucaauauugaagcggagccuccguuuggugaauccaacauaguaauagguaucggagauaaugcccugaaaauaaauugguacaagaaagguucgucuauaggaaaaauguuugaggcgaccgcccgaggggccagaagaauggcgauauugggggauacugcaugggauuuuggaagcguaggcgggguuuugaauagcuuaggaaaaaugguacaucaaaucuuuggauccgcuuacacugcacuuuuuaguggaguaagcuggguaaugaaaauagggaucggagugcuacugacauggauaggccuaaauagcaaaaauacgucuaugucauucucauguaucgcaauuggaauaauaacuuuguaucuuggagcgguaguacaagcggacaugggauguguaauuaacuggaaaggaaaagaauugaaaugugggaguggcauauuuguuacuaacgaaguacacacauggaccgaacaauauaaauuccaagcggauaguccaaaaagacucgcaacagcaauagcaggggcgugggaaaauggugucugcgggauacguagcacaacccggauggaaaauuugcuuuggaaacagauugcgaacgaacugaacuauauacuaugggaaaauaacauaaaauugacaguaguagucggagacauuauaggaguguuagaacaaggaaaacggacgcuaacgccacaacccauggagcuaaaauauucauggaagacaugggguaaagcuaagauuguaaccgcagagacucagaauaguucauuuauaauugacggaccaaauacgccagaauguccaucugcaaguagggcauggaaugugugggaggucgaagauuacggguucgggguauucacuaccaauauaugguuaaagcugagagaaguuuauacacaacuaugugaucacaggcuuaugucagcagcaguaaaagaugaaagagccguacacgccgauaugggauauuggauugagucucaaaagaacggcucauggaaacuugaaaaagcauccuuaauagaaguaaaaacauguacuuggccuaaaagccacacauuauggucuaacgguguacuugagucggauaugauaauaccaaaaucccuagcuggaccuauaucgcaacacaauuauagacccggauaucacacacagaccgcugguccguggcauuuaggcaagcuagagcuugacuuuaacuacugugaagggaccacuguagugauaacagaaaauugcggaacucgaggacccucuuuacguacaacaacuguuaguggcaaacucauccaugaauggugcuguagaaguuguacguugccgccuuuaagauacaugggggaagaugggugcugguaugguauggagauucgcccaauaucagaaaaagaagaaaacaugguaaaaagccuugucucugcaggaucaggugaaguagacaauuuuaccaugggcguuuugugucuugcaaucuuauuugaagaaguaaugagagguaaauucgggaagaaacauaugauagcugguguauucuuuacuuuuguauuguuacugucugggcaaaucacauggagggauauggcucauacucucaucaugauaggcagcaacgccuccgauagaaugggcaugggaguuacuuaucucgcgcuuauagcaacauucaaaauucaaccguuccuagcuuuaggguuuuuccuuaggaaacucacgucaagggagaacuugcuguuaggaguuggacucgcuauggcuacgacucuacaauuaccggaggauauagagcagauggccaacggaaucgcguuaggacuuauggcacuaaaacuaauuacacaguucgaaacauaucaacucuggacagcauuaauuagucuaacuuguagcaacacaaucuuuacuuuaacgguugccuggcgaacugcaacccuaauuuuagcugguguaucucuuuuaccugucugucaaucaucaucaaugcguaaaacagacuggcuaccuaugacuguagcggcaaugggugucccaccgcucccgcuguuuauauuuagcuugaaggauacacuuaaaagacgcuccuggcccuuaaacgaagggguuauggccguaggguuagucucaauccucgcauccucgcuucuucggaaugaugucccgauggcuggaccucuuguggcaggagguuuauugauugcuuguuauguuauaacggguaccagugcagaucuuacuguagagaaagccgcagacguuacaugggaggaggaagcagaacagaccggaguaucucauaaucuuaugauuaccguugacgaugacggaaccaugcgaaucaaagacgaugaaacagaaaauauccuuacaguauuauuaaaaacugcguuauuaauugugaguggcauauucccauacagcauuccagcuacccuauuagucuggcacacauggcaaaaacaaacacagaggucaggcgugcugugggacguuccuaguccuccugaaacacaaaaagcagaauuagaagaggggguguauagaaucaaacagcagggaauuuuuggaaagacacaaguuggcgugggaguccagaaggaagguguauuucacacaauguggcauguaacaaggggugcuguccuaacguauaacgguaaaagguuagaaccuaauugggcgucaguaaagaaagaccuaauauccuauggaggaggguggaggcuuucggcacaauggcaaaaaggugaagaaguacaaguuauagcaguagagccagguaaaaaucccaaaaauuuccaaacuaugccuggcacauuucaaacuacaacgggagaaauaggagcaauagcccuggacuuuaagcccgggacuucaggaucaccuauaaucaauagggaaggcaaagucguuggacuauacggaaacggugugguaaccaaaaauggugguuacgugucaggaaucgcucaaacuaaugccgaaccagacgggccuacuccagaguuagaagaagaaauguuuaagaaaaggaaucucacuaucauggauuuacauccgggcagugguaaaacuagaaaguaucuaccugcaaucgugcgcgaggccauaaagcguagauuacgaacccuaauacucgcuccgacgcggguagucgcugcagaaauggaggaagcauugaaggguuuacccauccgauaccaaacgacggcgacgaaaagugagcacacugguagagagauaguagaucucaugugucacgcuacauucaccaugcgauuacuaagucccguuagaguuccuaacuacaauuugauaauaauggacgaggcucauuuuacagacccagcaucaauugcagcacgaggauacauuaguacaagaguagggaugggugaagcugcugcgauauuuaugacagcuacaccaccuggcacugcggacgccuuuccacagaguaacgcaccgauacaagacgaggagagggauaucccagagcgaaguuggaacucugggaacgaauggauaacagacuucgcgggaaagacggugugguuuguaccaaguauaaaagcgggaaacgacaucgcuaacugcuugcguaagaacgguaagaaaguuauucagcugagcaggaaaacauucgacaccgaauaccagaagaccaaacuuaacgacugggauuuuguaguaaccaccgauauaucggaaaugggggcaaacuucaaggccgaucguguuauagacccuagaagaugccuaaaaccaguaauacuaacagaugguccggaaagaguuauauuagcaggucccaugccugugacagcugcaucagcagcacaaaggcgcggcaggguuggaagaaacccccaaaaagaaaaugaccaguauaucuucaccggccagccucucaacaaugacgaagaccacgcccauuggacggaagcaaagaugcuccucgauaauauaaauaccccagaaggaauaauuccugcauuauuugaaccugagagggaaaaauccgcagcaauagacggcgaauauagacugaaaggugaaaguagaaaaacuuuuguagagcucaugagacgaggcgaucucccuguauggcuagcccacaaaguugccagcgaggguauaaaguacacugaucgaaaaugguguuuugacggacaaaggaauaaccaaauauuagaagagaacauggauguggagauauggaccaaagagggagaaaagaagaaauuaagaccuaggugguuggacgcgcgcacauauucagauccguuggcauuaaaagaguucaaagacuuugcugcagguagaaagucuauugcccucgauuuaguuacugagauugguaggguuccgagucauuuagcucacagaacaagaaacgcauuagauaaucugguaauguuacauacuagcgaacacgggggcaaggcuuaccgacacgccguagaggaguuaccugagacuauggaaacauugcuauuacucggucuaaugauccuauugaccggaggagcuauguuauuucuuauuagcggaaaaggaauaggcaaaacaagcauaggauuaauuuguguaaucgcgaguucagguaugcuauggauggcugaaauaccccuucaguggauagccuccgcaauuguacucgaguuuuucaugaugguauuacugauccccgaaccugagaaacaaaggaccccucaagacaaucaauuagcauacguaguuauugggauacugacccucgcagcgauuauugcagcaaaugagaugggauuguuagaaacaacuaagagggaucuuggaaugaguaaggagccaggugugguaaguccgacaucauaccucgauguggaccuucacccggcaucagcguggacauuguacgcuguagcuaccacagugauaaccccgaugcucaggcauacaauugaaaacucaacugccaacgugagucuggcagcuaucgcaaaucaagcaguaguucugauggguuuggacaaagguuggcccaucaguaaaauggauuuaggcgucccgcuccuggcucuaggcugcuauagucagguaaacccacugacuuuaacagcagcuguucuucuccuuaucacacacuaugcgauuauaggaccuggucuacaggccaaggcuacucgagaagcacaaaagagaacagcagcaggaaucaugaaaaauccgaccguagacggaaucaugacuauugauuuagaucccguuauauacgauaguaaauucgagaaacaacugggacaaguaauguuauuaguccuaugugcagugcaacuauuacuaaugagaacuuccugggcacucugugaagcacugacacuagccacgggaccaauaaccacguuaugggagggaucaccggguaaauuuuggaacaccacaaucgcggucaguauggccaacauauuuagagguucauaucuagccggagcgggcuuagcuuuuucuauaaugaaaucuguggggacuggaaaaagagguaccggaagucaaggcgaaacacugggugagaaauggaagaagaaacuaaaccaauuauccagaaaggaauuugaccuuuacaagaaauccgggauuacagaaguugaucguaccgaagcgaaagaagggcucaaaagaggugagauaacgcaccacgcagugagcagaggaagugcaaaacuacagugguuugucgaacgaaauaugguaauaccugaaggacguguuauugauuuaggauguggacgaggcggauggucauauuacugugcuggacuaaagaaaguuaccgaaguuagaggcuacacgaaaggaggaccuggccaugaagaaccagucccaauguccacauauggauggaacaucguuaaauuaaugagcggaaaggauguauuuuacuuaccucccgaaaagugugauacuuuacuuugcgauauaggugaaagcucaccaucgccaacgguagaagaaagucggaccauacgaguucuuaaaaugguggaaccauggcuuaaaaauaaucaauucuguauaaaaguacuaaacccguauaugccgacaguggucgaacaucuggaacggcuccaaaggaaacacgguggaaugcuaguaagaaacccgcucucacguaauaguacgcaugagauguauuggauaucgaacggcacaggaaauauaguagcgucaguaaauaugguuucccgauuauuauuaaacagguucacuaugacacacaggcgaccaacuauugaaaaggauguagaccuuggagcaggcacacgccauguaaacgcggaacccgaaacaccaaauauggauguuauaggagagcgaaucaagagaauuaaggaagaacacaauuccaccuggcauuaugacgaugaaaauccauacaaaacgugggcauaucauggaagcuacgaggucaaagcaacaggcagugcaaguagcaugauaaauggcgugguuaaguuacuuacaaaaccuugggacguuguuccuaugguaacccaaauggcgaugacugacaccacccccuucggucaacaaagaguuuucaaagaaaaggucgacacuagaacaccccgaucaaugccggggacuaggagaguaauggguauaacggcugaauggcuauggagaacauuaggcagaaacaagaaaccacgacuguguacaagagaggaguuuaccaagaaagugcggacuaacgcugcaaugggugcaguuuucacagaagaaaaccaaugggauucugcgaaagcagcuguugaagaugaagauuucuggaaguuaguagauagagaacgcgaguugcauaaauuaggcaaauguggaaguuguguuuauaauaugaugggaaagagggagaagaaauuaggggaauuugguaaggcaaaaggguccagagcaauuugguacaugugguugggcgcaagauaccuagaauuugaagcgcuaggauuucuaaacgaagaccacugguuuagccgugaaaauaguuacagcggaguagaaggcgaaggucuacacaaacugggauauauacuacgcgauaucaguaagauaccugguggagcgauguaugcagaugacacggcgggcugggacacucguauuacagaagaugaucugcauaacgaagagaaaauaacacaacagauggacccggagcacagacaauuagcaaacgccauauucaaacugacuuaucaaaacaaaguagugaaagugcaacgaccuacaccuacuggaacagugauggauauaaucagccgaaaggaucagagaggaaguggacagguggguacguauggauuaaacacuuuuacgaauauggaggcgcaacuaauaaggcagauggaaggagaagguguauugucaaaagccgauuuagaaaacccccgacuaccagagaagaaaauuacacaaugguuagaaacuaaaggcguagagcgacuaaaaagaauggcaauaucaggcgaugacuguguggugaaaccaauagacgacagauucgcaaaugcucuccucgcacuuaacgacauggguaaaguaaggaaagacauaccgcaauggcaaccguccaaaggcuggcaugauuggcaacaagugccguucugcagccaucauuuucacgaguuaauuaugaaggacgggagaaagcuaguaguaccauguagaccucaagacgaauuaauugggagagcaagaauaagccagggugccggcuggagccuuagagaaacagcuugucuaggcaaagcauaugcacagaugugguccuugauguacuuucaccggcgugacuuaagacuggcgagcaaugcuaucuguucggcaguaccuguacacugggugcccacaucaaggacaacuuggucuauacacgcucaccaccaauggaugacuacggaggauauguuaacuguauggaaucgaguauggauugaagacaauccuuggauggaagauaaaacuccaauuacaacgugggaaaauguaccuuaucuaggaaaacgcgaagaccaguggugcggaaguuuaaucggucugacaaguagagccaccugggcccagaauauuccaacagcaauccaacaaguaaggucauuaauaggaaaugaagaguuccuugauuacaugccaucuaugaaacgauuuaggaaagaagaggaauccgagggggccaucugguaa

SEQ ID NO: 23391 - RNA, 9873 nt, Artificial Sequence
  derived and/or modified CDS sequence (opt6) from DENV-3__FJ639750__SS-prME
acaagucuuuguuuaaugaugaucuuaccagcggcacuggcguuucauuuaacuucacgggauggagaaccgagaaugaucguaggcaaaaacgaaaggggaaaaucgcuguuguucaaaacagccagugguaucaacaugugcacccuuauagcuauggacuuaggugaaaugugugacgauacugugacuuacaaauguccgcacauaacggaaguugaaccagaagauauagauuguugguguaaucugaccucuacauggguaacauauggaacgugcaaccaagcaggagaacauaggagagauaaacgaucuguagcucuugcuccacacgucggaaugggauuggacacccgaacgcaaaccuggaugagugcggaaggcgcauggagacaaguagaaaaaguugaaacgugggcguuaagacauccuggauuuacaauuuuggcgcuauuucuugcacacuauauagggaccucuuugacacaaaaaguuguaauauuuauucuucugaugcucguaacacccucaaugacaaugagguguguaggaguaggcaacagggacuucguggaaggacugagcggagccacaugggucgauguaguccucgaacauggagguugcguaaccacgauggcgaaaaacaaaccuacauuggauauagaacuucagaaaacugaagcaacacaacuagcuaccuuaagaaaauugugcauugagggaaaaauaaccaauauuacaacugauaguaggugucccacacaaggugaggccguacuuccagaagaacaagaucaaaacuaugucugcaaacauacauauguugaucggggguggggaaauggcugcggauuauuuggaaaagguagcuuaguuacuugugcgaaauuccaaugcuuagagccuauugaaggaaaaguggugcaauacgaaaaucucaaauauacggugauuaucaccgugcacaccggcgaucaacaccaaguggguaacgaaacgcaaggugucacugcugagauaaccccacaagcuaguacuacggaagccauuuuaccugaguacgggaccuugggauuggagugcuccccgcgaacuggacucgacuuuaacgaaaugauucuguuaacuaugaaaaauaaagcguggaugguucaucgucagugguucuucgacuugccauugcccuggacgucaggggcuacuacagaaacgccuacauggaauaggaaagaacuacucgugaccuucaaaaacgcacacgcuaagaaacaggaaguuguuguauugggcucacaagagggcgcaaugcauacagcucuaacaggcgcaaccgagauccaaaauuccgggggaacuucaauauuugccggucaucuuaaaugucgauuaaaaauggauaaauuagaacuaaagggaaugagcuaugcuaugugcacuaacaccuuuguucuaaagaaagaaguaucagaaacacaacauggaaccauacuaauuaagguagaauauaaaggagaagaugugccaugcaaaauaccauucucaacugaggauggacagggaaaagcucacaacggaagguugauaaccgcaaauccugugguuacgaagaaggaagaaccgguaaauauagaagccgaaccuccauuuggagaguccaacaucgucaucggaauaggcgacaacgcccuuaaaaucaacugguacaagaaaggcucaagcauaggaaagauguuugaagcaacagcucgaggugcuagaagaauggccauacucggcgauacugccugggauuuuggaagugucgggggagugcuaaauucccucggaaaaaugguucaucagauauucggaagugcuuauacagcuuuguuuagcggaguuucuuggguaaugaaaaucggaaucgggguccuucuaaccuggaucggacuaaauagcaagaacacaagcaugucuuuuagcugcauagcaauagguauuaucacacuauaucuuggagcuguaguccaagcagauauggguuguguaauuaacuggaaggguaaagaguugaaguguggaagcggaauuuucguuacaaacgagguacauacauggacagaacaauauaaauuucaagcagauaguccaaaacgccucgcaacugcaaucgcgggagcuugggagaaugguguaugugggauccguucaacgaccaggauggaaaaucuccuauggaaacaaauugcuaaugaguuaaauuauauacucugggaaaauaacauaaaauugacuguagucguaggagacaucauaggaguguuagagcaagguaaacggacuuuaaccccucaaccaauggaauugaaauauaguuggaaaacgugggggaaagcuaaaaucgucacugcagaaacacaaaacucgagcuuuauaauagaugguccaaacacgccugaauguccgucugcgagcagggcguggaacguaugggaaguggaagauuauggauuuggugucuuuacaacuaacauuuggcuaaaauugagagaaguauauacucaauugugcgaccaucgacuaaugagugcagccguuaaggaugaaagagcuguacaugcagauaugggcuacuggauugaaucacagaaaaauggaucguggaaacuagaaaaagccucgcuuauagaaguaaagacaugcaccuggccgaagucacauacauuaugguccaacggcguacuagaaagugacaugauaauaccaaagucacuagcugguccuauaagccaacacaauuacagaccaggcuaucacacucaaaccgccggucccuggcaccucgggaaacuugaacuagauuuuaacuauugcgaaggaaccacuguuguuauaaccgaaaacugugggacccguggaccaucacuaagaaccacuaccgucucaggcaaacuuauacaugagugguguuguaggucauguacacuuccaccccuacguuauaugggagaggacgguuguugguacgguauggaaauacgaccaauaagugagaaagaagaaaauaugguaaaaucccuuguaucagccggcucgggagaaguugauaacuucacuauggggguauuaugucuagcaauacuauucgaggaagugaugagaggaaaauuuggcaagaaacacaugauagccgguguauucuuuaccuucguuuuguuacuuagugggcaaaucacuuggagagauauggcacauacacucauaaugauuggaucuaaugccuccgauagaaugggaaugggggucacauauuuagcucuuauagcaacuuuuaagauucaacccuuuuuagcccugggauucuuucuucggaaacuuacuucuagagaaaaucuuuuacuaggaguaggucucgcuauggcaacaacacugcaauuaccagaggauaucgaacaaauggcaaaugguauagcacucggccuaauggccuugaaauuaaucacacaguuugaaacuuaucaacuauggaccgcccuaauaucuuuaacauguucgaauacaauuuuuacacuaacuguagcuuggagaacagcuacucuuauucuugcgggaguuucauuauugcccgugugucaauccucuagcaugagaaaaaccgauuggcuccccaugacgguggcagcgaugggagucccaccauugccacuuuucauuuucucgcucaaagauacauuaaaaaggaggagcuggccuuuaaaugaaggaguaauggcaguaggacucguuagcauuuuagcuuccagccuauugcgaaacgauguaccaauggcugguccccuuguagcaggaggcuuauuaauugcguguuauguaaucacggguaccagcgcggaucuaacaguggaaaaagcugccgauguuacuugggaagaggaggcggagcaaaccgggguuagucauaacuugaugauaacuguagacgacgauggaacaaugcgcaucaaggaugacgaaacagagaauauccuaacaguucuguuaaaaacugcuuuacucauaguuucuggcauauuuccuuauucaauuccagccacauuguugguauggcauacguggcaaaaacagacucaaagaucaggaguauuaugggaugucccuaguccgccagaaacacaaaaagccgaacuagaagaagggguauaucgcauaaaacagcaaggaauauucgguaagacacaaguagggguuggcgugcaaaaagaaggaguuuuccacacaauguggcauguuacaagaggugcuguacuaacauacaauggaaaaagacucgaacccaauugggcuagcguaaagaaagauuuaauuuccuauggugguggcuggaggcuaucagcucaauggcaaaaaggagaagagguucaaguuauugcuguugaaccuggcaaaaacccuaaaaacuuucaaaccaugccgggcacauuucagacaacaacaggugagauaggggccauagcguuagacuucaaaccagggacaaguggcagucccaucauaaaucgggaagguaaagucguagggcucuauggaaauggcgugguaacuaaaaauggaggauauguuagcgguauugcacaaacaaaugccgaaccagauggaccgacuccggagcuugaggaagagauguuuaagaaacgaaauuuaacaauaauggauuuacacccggggagugguaaaacuagaaaauauuuaccggcaauuguuagggaagcuauaaaaagaaggcugaggaccuuaauacuagcaccaacaaggguaguugccgcagaaauggaagaagcguuaaaagguuuaccaauuagauaucaaacuaccgcuacuaagagcgaacauacaggaagggaaauaguugauuuaaugugucaugcaacauuuacgaugcgacuauuaagcccaguuagaguaccaaacuauaacuuaauuauaauggaugaagcgcacuuuacagacccagccucaauugccgcuagaggauauaucagcacuagagucggcaugggcgaggcugcugcuauauuuaugacggcgacgccaccugguaccgcagacgcguuuccacaguccaaugcgccaauucaagaugaagaacgagauaucccagaaagguccuggaacucagggaacgaauggauuacagauuucgcaggaaaaacggucugguuuguaccaaguauaaaagcagguaaugacauagcaaacuguuuaagaaagaacggaaagaaaguaauacaauuaucacgaaaaacuuucgauacggaauaucagaaaaccaaauuaaaugacugggacuuuguuguuacuacugauauaucggagaugggagcaaauuuuaaggccgaccggguaauugacccccgaagauguuuaaagccaguaauauuaacugauggaccugagcgcguuauccuagcaggaccaaugccaguaacggcagcgucugcggcacaaaggagaggcagggugggacguaauccacaaaaagaaaaugaccaauauauauuuacgggccaaccacugaacaaugaugaggaucacgcacacuggaccgaggcaaaaaugcuacuagauaauauaaauacaccugaaggaaucauaccagcacuauucgaaccagaacgagagaaaagcgccgcaaucgauggugaauaucguuuaaagggugaaucaagaaagaccuucguggaacuaaugaggcgaggugaucucccaguaugguuagcgcauaaaguagcgagcgaggggauuaaauacaccgauagaaaaugguguuuugacggacagagaaacaaccaaauacucgaagaaaauauggacguggaaauuuggacuaaagaaggcgagaagaagaaacuucguccuagguggcuagaugcaaggacauacuccgacccauuagccuuaaaggaauuuaaagauuuugcugcuggaaggaagucgauagcacuagacuugguaacagaaaucggaagagugccgucgcacuuggcucacagaacacggaaugcacuagauaacuuaguaauguugcacacaagugaacacggagggaaggcuuaccggcacgcugucgaggaauugcccgagacgauggaaacauuacuacuacucggauugaugauucuauugacaggcggcgcuaugcuuuuucuaaucucggggaaaggcaucggaaaaacaucaauaggcuugaucugcguaauugcaucgucugggaugcuauggauggcagagaucccacuucaguggaucgcuagugcaauuguacuugaguucuucaugaugguuuugcuaauaccagaaccagaaaaacagcguacuccucaagauaaccaacuugcauaugucguaauagguauauugacacuagcugcgauaauagcagcaaacgagauggguuuacuugaaacuacuaaaagagaucuuggaaugucaaaagaaccaggugucgucucaccaaccaguuaucuugaugucgaucuccauccugcaagugcguggacguuauacgccguugcgacaacgguuauaacuccaauguuaagacacaccauagaaaauagcacagcgaaugugucgcuagcggcaauugcaaaucaagcagugguucuaaugggacucgacaaaggcuggcccaucucuaaaauggaucuaggcgucccucuccuagcacuugggugcuauagccaagugaauccuuuaacacugacagcagcaguuuuauuauuaaucacccauuacgcuaucaucggaccaggccuucaagccaaagcaacaagagaggcacagaaaagaacggcagcagguauuaugaaaaaucccacugucgauggcauaaugaccauagacuuagauccaguuauuuaugauuccaaauucgagaagcaauugggacaaguaaugcuauuaguuuuaugugcugugcaguugcuuuuaaugagaacaagcugggcucucugcgaagcucuuaccuuagcaacaggaccuauuaccacccuaugggaaggcagcccaggaaaauuuuggaauacuaccauagcgguuucaauggcaaauauauuccgugggagcuaccuagcuggcgcaggguuagcauuuagcauaaugaagucagucggcaccggaaaaagaggaacagguagucaaggagagacguugggugagaaauggaagaagaaauugaaucaguuaagucgaaaggaguucgaccuguacaagaagucaggaaucacagaaguugaccguacagaagcaaaagaaggucugaagcguggagaaauaacccaccacgcaguaucaagaggaucugcuaaguuacaaugguuuguagaacgaaauaugguuauuccagaaggaagaguaauagaccuagguugugggcgaggagguuggagcuauuacugcgcgggauugaagaaaguuacggagguucgugguuauaccaagggagguccugggcaugaagaaccaguaccuauguccaccuacggauggaauauuguuaaacugaugucaggcaaggaugucuuuuacuuaccuccagagaaaugcgacacuuuacuaugugacauaggcgaauccagcccaucaccuaccguagaagaaucaagaacaauucgcguccugaaaaugguugaaccauggcuuaaaaacaaucaauuuuguaucaaaguucuuaacccuuacaugccuaccguaauagagcaucucgaacgguuacaaaggaagcauggaggaaugcucguaagaaacccacuaagcagaaacaguacgcaugagauguauuggauauccaacgguacuggaaauauagucgcaaguguaaauauggucucaaggcuuuuauugaaucgguucaccaugacucauagacgaccuaccauugaaaaagaugucgauuuaggagcgggcacucggcacguaaaugcugaaccugaaacaccuaacauggauguaauaggagaaagaaucaaaagaauaaaagaagaacauaauagcacauggcauuaugaugaugaaaauccauauaaaacgugggcauaucauggaucuuacgagguaaaagcuacaggaagugcaagcucgaugauaaaugguguuguuaaguuauuaacaaagccgugggaugucgucccuaugguaacacaaauggcgaugacggacaccacuccauucggacaacagagaguauuuaaagaaaagguagauacuaggaccccacgaucaaugccaggcacgcgacgagucaugggaaucacagccgaguggcuguggaggacauuaggaagaaauaaaaagccaagacuguguacaagggaggaguuuacuaaaaagguuaggacaaacgcagcaaugggcgccguauuuaccgaggaaaaccaaugggacucugccaaagcagcaguggaagaugaagacuucuggaaacucguugaccgagagcgagaauuacauaaacuuggaaaaugcggcaguuguguauacaauaugauggguaaacgugagaagaaacuuggggaguucggaaaggcaaaggguucaagggccauuugguacauguggcuuggggcgagauauuuagaauuugaagcucuaggauucuugaacgaggaccauugguuuucgagggaaaacucauacucagggguggagggagaagggcuccacaaacuuggcuauauacuccgggacaucucaaaaauuccuggaggagcaauguacgccgaugacacggcagguugggauacucgcauaacugaagaugacuuacauaaugaggagaaaauaacgcagcaaauggauccagaacacaggcagcuggccaacgcaauuuuuaaauuaaccuaccagaacaaaguugugaaaguccaaaggcccacaccaacuggaacaguaauggacauaaucaguagaaaagaucaaagagggucuggccagguagguaccuacggauuaaauaccuuuacuaauauggaagcacaauuaaucagacaaauggaaggcgaagggguucugucgaaagcggacuuagaaaauccgcauuuaccggagaagaaaauuacccaauggcuagagacgaaaggagucgaacgacuaaaaagaauggcuaucaguggugaugauugcguaguaaaaccuauugaugaccgcuucgcaaacgcucugcuagcucuaaacgacaugggaaaaguaagaaaagauauuccgcaauggcaaccaucaaaagguuggcaugauuggcaacagguccccuucugcagucaccauuuucacgaacuaauuaugaaggacggcagaaaacuuguagucccgugucggccccaggacgaacuuaucgggagggcaagaauaagucaaggagcggguuggucacuucgcgagacagccuguuuagguaaggcauaugcacaaauguggucauuaauguacuuucauaggcgugauuuaagauuggccuccaaugcaaucuguucagccgugccuguccauugggugccaacuucaagaacaacauggaguauacaugcccaccaucaauggaugacuacugaagauauguuaacuguuuggaacagggucuggauagaagauaaucccuggauggaagacaaaacaccuguuacaacaugggaaaauguuccauauuuagguaagcgggaagaucaauggugugguaguuugaucggauuaacaagccgagcuacaugggcucaaaauaucccaacugcuauucaacaagucagaagccuuauuggaaacgaagaguuccuugacuauaugccuucaaugaaacguuuuagaaaagaagaagagucugaaggggcgauuugguaa

SEQ ID NO: 23392 - RNA, 9873 nt, Artificial Sequence
  derived and/or modified CDS sequence (opt6) from DENV-3__FJ639754__SS-prME
acaagccuuugccuuaugaugauucugcccgccgcuuuagcauuucauuuaaccucgagagauggugaaccucguaugauuguagggaaaaacgaacguggaaaaucacuuuuguuuaaaaccgcaucagguaucaauauguguacguuaaucgcuauggauuuaggagaaaugugcgaugauacagugacguauaaauguccucauauuaccgaaguugaaccggaagauauugauuguuggugcaaucugaccucaaccugggucacuuauggaacuuguaaucaagccggcgaacaccggagagauaaaagaucuguugcccuagcgccgcaugucgguaugggucuagauacaagaacgcaaacauggaugucagcggaaggagcauggagacaaguagaaaaagucgaaacaugggccuuaaggcacccugguuuuacgauccuagcauuauuccuggcucacuauauaggaacgaguuuaacacaaaaaguaguuauuuucaucuuguugaugcuagugaccccuagcaugacaaugagaugcguggguguugguaacagagauuuuguagaagguuuaaguggggcaacuuggguagaugucguucuagaacacggcggaugcguaacuacgauggcgaaaaacaaaccaacucuggauauagaacuucagaaaaccgaagccacccagcuagcaacuuuacgcaaacuauguauagaagguaaaauuacuaauauaacuacagauaguagauguccaacucaaggagaggcgguuuuaccagaggaacaagaucagaacuacguuugcaaacacacguauguagauagggguuggggcaacggauguggauuauucggaaaagggaguuugguaacuugcgcuaaauuccaaugcuuagaacccauagagggcaaaguuguacaguacgagaacuuaaaguacaccguaauaaucacagugcacacuggcgaccaacaucaagugggaaacgagacucaagggguaaccgcagaaaucacgccacaagcaucaacaaccgaggcaauacuuccugaauaugguacuuuagguuuggaauguucgccuagaacugguuuggacuuuaaugaaaugauacuauuaacaaugaaaaauaaagccuggauggugcacagacaaugguuuuucgaccuuccccucccuuggacuuccggagcuacaacagaaacaccgacuuggaaccgaaaagaauugcuaguaacauucaaaaacgcucacgcuaagaaacaagagguaguuguuuuagggucccaagaaggugcgaugcauacugcacugacuggggccaccgaaauccaaaauuccgguggaacauccauauuugcaggacacuuaaaaugucgacucaaaauggauaaguuggaauuaaaggguaugagcuacgcaaugugcacaaauacauucguauuaaagaaagagguuagugaaacgcagcacggaacaauucuaauaaaagucgaauacaaaggggaagaugucccaugcaaaauaccauucuccacggaagauggucaagguaaagcacacaaugggcguuugaucacagcaaauccaguagucacuaagaaagaggaaccaguuaacauugaagcagaacccccuuuuggagaaaguaauauaguaauaggcauuggagauaaugcgcuaaaaaucaauugguacaagaaaggaaguucuauugguaaaauguuugaagccacggcaagaggggcucgaagaauggccauacuuggagacacggcgugggauuuuggcucaguaggugggguacuuaauucucugggaaaaaugguacaucaaauauucgguagugccuauacagcauuauucucaggcgucucuuggguaaugaaaauagguauaggaguuuuauugacuuggaucggucugaacaguaaaaacacauccaugagcuuuaguugcauagcuauaggaauaaucacauuauaccuaggggcgguaguacaagcugauauggguuguguaaucaauuggaaggggaaagaauuaaaauguggaaguggcauauucgugacuaacgaaguacauacuuggaccgaacaauacaaguuccaagcggauucaccuaaacguuuagcaaccgccauugcuggcgccugggaaaauggagugugcgguaucagaucaaccacgcgcauggagaaucucuuguggaaacaaauagcgaaugaauugaauuauauuuuaugggaaaauaauauaaaacuaaccgugguuguaggagauauaauaggaguguuagagcaaggcaagagaacauuaacgccgcaaccuauggaacuaaaauacagcuggaaaacgugggguaaagcuaagaucgucacagcagagacgcaaaacucaucguucauaauagacgguccuaacacaccagaguguccuucugccaguagggcauggaacgucugggaaguagaagacuaugguuuugggguauuuaccacgaauauuugguuaaaacuuagagaaguauauacucaacuaugcgaucaucggcuaaugagugcggcuguaaaagaugaacgggccguccacgccgauaugggauauuggauugaaagccagaaaaacggcucguggaaacuggaaaaagcgagccuaauagaagucaagacuuguacauggcccaagucgcauacauuauggaguaaugggguauuagaaucugacaugauaaucccaaaaucauuagccgguccaauaucacaacacaacuaucgaccgggguaucauacgcagacugcagguccauggcaucuaggcaaguuagagcuggacuucaauuauugcgaggguacaacgguuguuauuacugagaauuguggcacccgaggaccaucguugcgaacuacaacaguuuccggaaaacuuauacaugaguggugcugcagaaguuguacacuacccccgcuuagauacaugggggaagacggauguugguaugggauggaaauaagaccaauaucugaaaaagaggaaaauaugguuaaguccuuagugagcgcuggaaguggugaaguugauaauuucacaauggggguacuauguuuagcgauuuuauuugaagaaguaaugcgggggaaauuugguaagaagcauaugauagcugguguauucuuuacauucguacucuuauuaucaggucaaauuaccuggcgggacauggcccauacuuugauuaugauagguaguaacgcaagugaccguaugggcauggguguuaccuaccuagcacuaauagccacuuuuaaaauucaaccauuuuuggcucuuggguuuuuccugcgaaaauuaacauccagagaaaacuuauugcucggaguaggucuugccauggcuacuacacuacaacuaccugaggacauagaacagauggcaaaugggauagcguugggccuaauggcucucaaacucauuacacaauuugagaccuaccaauuauggacagccuuaauuagccuaaccuguucuaauacuaucuucacacuaacgguugcuuggagaacugccacacuaauuuuagcgggaguuucauuauuaccgguuugucaaucgaguaguaugagaaagacagacugguuaccgaugacgguugcagccaugggggucccgccccucccccuuuuuauauucagucuuaaggacacuuugaaaagacgaaguuggccauuaaaugaaggaguaauggccgucggucuuguaagcauucuugccucaucccuucuuagaaaugauguaccaauggccgguccgcucguagccgggggacuccucauugcaugcuacgucaucacaggaacaagugccgaucucacugucgaaaaagcagccgaugugacaugggaagaggaagcagagcaaacaggcguaagucauaaucuaaugauaacaguagacgacgaugggacaaugagaaucaaagacgaugaaacugagaacaucuuaacaguauugcugaaaacugcucuauuaaucguuagugguaucuucccauauaguauaccggcaacacuauuaguuuggcacaccuggcaaaaacaaacgcaaagaaguggaguuuuaugggaugugccuucuccacccgaaacucaaaaggccgaacuggaagaaggaguuuacagaauaaaacaacaaggaauuuuuggcaagacucaagucggaguggggguucaaaaagaaggcguuuuucauacaauguggcaugugacacggggugccgucuugacauauaacgguaaaagacuagagcccaauugggcuucagucaagaaagaucugauuucauaugguggcggauggagacuaagugcccaauggcagaaaggagaagaaguccaaguuaucgcagucgaaccuggaaagaauccuaaaaauuuucaaacaaugccgggaaccuuucaaacaacuacaggagaaauaggagcuaucgcauuggauuuuaaaccaggaacaagugguucgcccauuauaaaccgggaaggcaaaguaguuggauuguauggaaaugguguggucacuaaaaauggugguuauguauccgguauagcacaaacgaacgcagaaccagacggccccacaccagaacuagaggaggaaauguucaaaaagagaaauuuaaccauaauggacuugcauccuggcagcgguaaaacacgaaaauaucuuccagccauuguacgugaggcaauaaaaagacgacugagaacacugauuuuagcaccgacucgaguaguugcagcagaaauggaagaggcuuuaaaagguuugcccauacgauaucaaacaacagccacaaaauccgaacauaccgggcgagagaucguagacuuaaugugucacgcaaccuuuacuaugagauuauuaagcccaguuagggugccgaauuacaacuuaauuauuauggaugaggcgcacuucacagacccagccucuauugcggcaaggggauacauaucaacgcgagugggcaugggcgaggccgccgcaauuuuuaugacagccaccccgccuggaacugccgaugccuuuccccaauccaaugcacccauacaggaugaagaaagggauauuccagaaaggucauggaacaguggaaaugaauggauaacugacuucgcuggcaaaacaguuugguuuguaccaaguauaaaagccgguaacgacauagcaaacugcuuaaggaaaaacggaaagaagguuauucaacuaucacguaagacuuuugauacagaauaccagaaaacaaaauugaaugauugggauuuuguaguaacaacggauauaucagaaaugggagcuaacuucaaagcggaccgggucauagacccgagaagaugccucaagccuguaauccuaacggauggaccagaacgugugauacuagcugguccaaugcccguaacagcagcaucagcugcacaaagaagagguagggugggacggaacccucagaaagaaaacgaccaauacauauuuacuggccaaccccuaaacaaugaugaagaccacgcucauuggacagaagcaaaaaugcuacuagauaacaucaauaccccggaaggaaucaucccugcauuauuugaaccggaaagagagaaaagugcugcaauagauggagaauauagacuaaagggggaaucgaggaaaacuuuugucgaacugaugcgaagaggggaucuacccguguggcucgcacacaagguggccagcgaagguauaaaauacacggauagaaaaugguguuuugacggucaaaggaauaaucagauauuagaagagaacauggaugucgaaauuuggacaaaagagggugagaagaagaaacuaagaccucgcugguuagacgcucgcacuuauucagaccccuuagccuuaaaagaauuuaaggauuuugcggcuggaagaaaaaguauugccuuagaucuggucacugaaauaggaagaguaccaucacaucuugcccauagaacaagaaaugcauuagauaacuugguaaugcuucacacuucugaacacggagggaaagcauauagacacgcaguugaagaacuaccugaaacgauggaaacgcuauuacuguuagguuuaaugauucuucuaacggguggggccaugcucuuuuuaaucucaggcaagggaauaggaaaaacgaguauagguuuaauuugcgucauagcaucaucagguauguuauggauggcagaaauuccucuacaauggauagccucggccauaguacuggaauuuuucaugaugguauugcuuauuccugagccagaaaaacagagaacuccacaagacaaccaacuugcuuauguaguaauaggaauacuaacucuugccgcaauaauagcugcaaaugaaauggguuuacucgagacuaccaaacgggaucuugguaugucgaaggaaccuggcguagugucuccuacauccuauuuagacguugauuuacaucccgcaucagccuggacauuguaugcaguugcuacaacaguaauaacuccgauguuaagacauacuauagaaaauucuacagcaaaugucagcuuagcugcaauugcaaaucaagccguuguacuuaugggauuagauaaaggcuggccgaucucaaagauggauuuaggagucccgcucuuagcauugggcuguuauucucaaguaaauccauugacgcuaacagcagcggugcuuuuacuaauaacccauuaugcaauaaucggcccaggucuacaagcuaaggccacaagggaggcgcagaaacggacagcagccggaauuaugaaaaaccccacgguugauggcauuaugacaauagaucuagauccaguaaucuacgacaguaaauuugaaaagcaauuaggucaagucaugcuauuaguauugugcgcaguucaacuacugcuuaugagaacuuccugggcacuuugcgaagcacugacccuagccacggggccaauaaccacucuuugggaaggaucucccgguaaauucuggaacacaacaaucgcaguaagcauggcuaauauuuuuagaggaaacuacuuggcaggagccggauuagcuuucagcauuaugaaaucagugggaacaggaaaaagaggcacagguagccaaggggagacucuaggagaaaaauggaaaaagaaguugaaucaauugucucggaaggaauuugacuuauauaagaaaagugguauuaccgaaguagaucguacagaggcgaaggagggucuuaaaagaggcgagauaacacaucacgccgucucaagaggaucggcaaaacuacagugguucguagaaagaaauaugguaauaccggaagguaggguuauagaccuaggauguggaagaggugguuggucuuauuauugugcaggccuuaagaaagucacggaaguccguggguacacaaaagguggaccgggucaugaggaacccgugccuaugagcacguauggauggaauauaguaaaacugaugucagguaaagacguguucuaccugccgccagaaaaaugugauacgcugcuaugugauauuggugaauccucaccuaguccgacaguugaagaaucaaggacaauacguguauugaaaaugguagaaccauggcuuaaaaacaaucaauucuguauaaagguucuuaauccguauaugccuacugucauagaacaccuugaacgacuacaaagaaaacacggugggauguuggugagaaauccguuaucuagaaauuccacgcaugaaauguacuggauaucuaacggaacggggaauaucguugcgucagucaauauggugagccgacuacucuugaaucgguucacgaugacucaccgacggccuacgauagaaaaggauguagauuugggagcagggacuagacauguuaaugcagaaccagaaaccccaaacauggaugucauuggcgaacgcauuaaaagaauaaaggaagaacauaacucaaccuggcauuaugaugaugaaaaucccuauaagacuugggccuaucauggcucguaugagguuaaagccacaggaucggcauccaguaugaucaauggcguugucaaacuacuaacuaaaccgugggauguggucccgaugguaacgcaaauggcaaugacugauacuacaccauuuggucaacagcguguauuuaaagaaaaaguagauacuagaacgcccagaagcaugccgggaacacgucgcgucauggggaucacggccgaauggcucuggagaacguuaggaaggaacaagaaacccaggcucugcacaagagaggaguucacaaagaaaguuagaacaaaugcggcaaugggugcaguguucacagaggaaaaccaaugggauucugcgaaagccgcaguagaagaugaagacuucuggaagcuaguugaucgagaacgugaauuacauaagcuaggaaaaugugguucuugcguauauaacaugaugggcaaaagagagaagaaacuaggcgaguucgguaaggcuaaagguaguagggcuauaugguacaugugguugggugcaagauaccuugaguuugaagcauuaggauuuuugaacgaggaccacugguucucacgagaaaauucauauucugggguugaaggagaaggauuacauaaauuaggguauaucuugcgagauauaagcaaaauuccaggaggagcaauguaugcagaugauacggccggaugggauacucgcaucacagaggacgauuuacauaaugaagagaaaauaacacaacaaauggauccugaacaccggcaacuugccaaugcgauuuucaaauuaacauaucagaacaaaguggugaaaguacaaagaccaacucccacaggcacagucauggacauaauuagcagaaaagaucaacgagguucaggucaaguggggacguauggauuaaauacauuuacuaacauggaggcacaacuaauaagacagauggaaggagagggcguauuaagcaaagcagaccuagaaaacccacaucuccccgagaagaaaauaacacaauggcucgaaacgaagggaguagagcgccuaaaacguauggcaauuucgggcgacgauugugucguaaaaccuauagaugaucgguucgcaaaugcuuuauuggcucuaaacgauauggggaaaguucguaaggauauaccccaauggcagcccaguaagggcuggcacgacuggcaacaaguuccauuuuguucucaucacuuucacgagcuaauuaugaaagacgguagaaaacucguuguaccguguaggccgcaagaugaacuaauagguagagcacgaaucucgcaaggggcaggauggucacuccgcgaaacagccugucuaggaaaggcguaugcgcaaauguggucguuaauguacuuccacagaagagauuugagacuggccagcaaugcgauuuguucagcaguuccaguacauuggguaccaaccuccagaacaacauggucaauucacgcucaccaucaauggaugacaacugaggauaugcugaccguuuggaauagaguauggauugaagauaaccccuggauggaagauaaaacgccaguuacaacaugggagaauguuccuuaccuuggcaagagggaagaucaaugguguggauccuugauagguuuaacauccagagccaccugggcgcaaaauauaccaaccgcuauccagcagguuagaucccucauugguaacgaagaguuucuagauuacaugcccucgaugaaaagauucagaaaagaagaagaaagugaaggagcaauaugguga

SEQ ID NO: 23393 - RNA, 9873 nt, Artificial Sequence
  derived and/or modified CDS sequence (opt6) from DENV-3__FJ639757__SS-prME
acgaguuuaugucuuaugaugauccuacccgcagcacuugcguuucaucuaacaucacgggauggagaaccucgaaugauuguggguaaaaacgaaagaggaaaaucguuacuauucaaaaccgcaaguggaauaaauauguguacguuaauagcuauggacuuaggagaaaugugcgaugacacagucacuuauaaaugcccacacauaacggagguagaaccagaagauauugauugcugguguaauuuaacauccacauggguaaccuauggaacauguaaucaagccggugaacaucguagagauaaaagaucaguugcacuugcaccacacguagggaugggccuagauacacgaacgcaaacauggaugucugcugagggagcauggagacaaguugaaaaaguggaaacuugggcacugagacaucccggguuuacuauccuugcauuauuucuagcacacuauauaggcacgucauuaacccaaaaagugguuauauuuauacuacuaaugcuaguaaccccgucaaugacuaugagauguguaggaguuggaaaccgugacuuuguugaaggucuuaguggagcgacauggguagacguaguauuagagcaugguggauguguuacgaccauggcuaaaaacaaaccaacuuuggauauugaacugcagaaaacagaagcaacacaacuugcaacacuaagaaaacugugcaucgaaggcaaaauuaccaacaucacaacagauucaagauguccuacgcaaggagaagcuguccugcccgaagaacaagaucagaauuacgucugcaaacauaccuaugucgaccgagguugggguaaugguugcggccuuuucggaaaaggaagccuagucacaugugccaaauuucaauguuuagaaccaauugaagggaaagucguacaauacgagaacuuaaaauacacgguuauuaucacagugcacacuggcgaucaacaucagguaggaaaugaaacucaagguguuaccgcagaaauaacuccacaagccucuacaacugaagcaaucuuaccagaauaugguacauuaggacuugaauguucaccuagaaccggccuugacuuuaacgaaaugauucuacucacaaugaaaaacaaagcauggaugguacaucgacaaugguuuuucgacuuaccgcucccguggaccuccggcgcaacgacugaaacuccgacuuggaaucguaaagaauuauuaguaacauucaaaaaugcacaugcgaagaaacaagaaguaguaguacugggaucacaagaaggagcuaugcacaccgcauuaacuggagcaacggagauacaaaacucaggcggcaccucuauauucgcuggacaucuaaaauguagacuaaaaauggacaaguuggaacucaaaggaaugucauaugcaaugugcaccaauacguuugucuuaaagaaagaaguuucggaaacacaacauggaacaaucuuaauaaaaguagaauacaagggagaggacguaccauguaaaaucccuuuuaguacagaggacggucaaggcaaagcacauaaugggcgauuaauaaccgcgaacccaguaguaacaaagaaagaggaaccagugaacauagaagcagaaccuccauucggcgagucuaacaucguuauuggcauaggagauagcgcgcuuaaaauaaacugguauaagaaaggcucaucgauagggaaaauguucgaagcaacagcuaggggugcacguaggauggcaauuuuaggcgauacagcuugggauuucggcucaguaggcggaguacucaauagucucgggaagaugguucaccaaaucuucggaucagccuauacagcacuauuuagcgguguauccugggucaugaaaauuggcauuggaguccuccuuaccuggauuggacuaaauaguaaaaauacuagcaugucauuuucgugcauagcaauaggaaucauaacuuuauauuuaggagcgguagugcaagccgauauggguugcgucaucaauuggaaggggaaagaacuaaaauguggaucugggauauuugugacuaaugaggugcacaccuggacagaacaguauaaauuccaagccgacucaccaaagcgauuagcuacggcaauagcuggagcuugggaaaauggaguuugcggcauuaggagcacuacacgcauggaaaacuuauuauggaagcaaaucgcgaacgaauugaauuacauuuugugggagaacaacauaaaauuaacaguaguugucggcgauaucaucggugucuuggaacaaggaaaacggacacuuaccccacaaccuauggaacuuaaauauaguuggaaaacaugggguaaggcaaaaauuguaacugcggaaacacaaaauucuucguuuaucauagauggcccaaauacucccgaaugucccucagcgagcagggcauggaauguaugggaggucgaagauuacggguuuggaguauuuacuacuaacaucuggcuaaaauuaagagaaguguauacacaacuaugugaccaucgguuaaugucagcagcaguaaaggaugaaagagcuguacaugcugacaugggauacuggauagagagucagaaaaacgguucauggaaacucgaaaaagcaagucugaucgaaguuaaaacuuguaccuggccgaaaucacauacucuauggagcaauggaguacucgaaagugacaugauuauuccuaagucucuugcaggcccaaucucacaacauaauuaucggccuggauaccauacucaaacugccgggccauggcaucucgguaagcuggaauuagauuucaacuauugugaagggacuacuguagugauuacugaaaacugcgguacucgaggaccgucacuacguacgaccaccgucucagggaaacuaauacaugaauggugcuguagaucauguacguuaccaccucucagauacaugggugaagauggauguugguacgggauggaaauuaggccuaucuccgagaaggaagaaaacauggugaaaucauuaguaagugcagggucaggagaagucgacaauuucaccauggggguauuaugucuugcaauauuguuugaagagguuaugagagguaaguucgggaagaaacauaugauugcuggcguauucuucacguuuguuuuacuauuauccggacaaauaaccuggagggauauggcgcauacccuuauaaugauaggaucuaacgccagcgaccgcauggguaugggaguaaccuaccuagcucucauagcaacuuucaaaauucaaccguuuuuagcucuuggcuucuuuuuaaggaaacugacgucacgagaaaacuuauuguuaggagugggccuagcuauggcuacaacccuccaauugccagaagacauugaacaaauggcaaaugguaucgcacuaggcuugauggcucuaaaauuaauuacacaauuugaaacauaccaacucuggacagcccuuauaucguuaacauguaguaacaccauuuuuacguuaacuguagcguggaggacagcaacauuaauuuuggcaggagugucuuuauuaccaguuugucaaagcuccaguaugcgaaaaacagauuggcuuccgaugacaguggcagcaaugggagucccuccauugccacuuuuuauauuuucucuuaaagacacguuaaaacguaggucauggccauugaacgaggguguuauggcaguagguuugguaagcaucuuggcuucuagccuacugagaaacgauguaccuauggcgggaccacugguugcaggaggacuauuaauagcauguuacgugauuaccgggaccagcgcugauuugaccguagaaaaagcggcagacguaacgugggaagaagaagcagaacaaacagggguaagccauaaucugaugauaacggucgaugacgacgggacaaugcggauaaaagaugaugaaacagaaaacauacuuaccguauuauuaaaaacagcuuugcuuaucguguccggaaucuucccauauucgauucccgcaacauugcugguauggcauacuuggcaaaaacaaacacaacggucuggagugcuuugggacguaccgucaccuccggagacucaaaaggccgaguuggaagaaggaguguauagaauaaagcagcaagguauuuuugguaaaacccaggugggagucgguguucaaaaggaaggaguauuucauacaauguggcauguuacacggggagccguguuaacuuacaacggaaaaagauuagaaccuaauugggcauccgucaagaaagacuuaauaaguuacggaggcggcuggcgacuaagugcacaauggcaaaagggcgaagaagugcagguuauugcuguagaaccagggaagaacccaaagaacuuucaaacaaugccagguaccuuucaaacaacaacaggcgagauaggagcaauagcacuugacuuuaaaccggguacaaguggaucaccuauuauuaacagagaaggaaaaguggugggucuguacgggaacggggugguaaccaaaaaugguggguauguauccgguaucgcacaaacuaaugcagaaccugacgggcccacaccagagcuagaagaagaaauguuuaagaaaagaaauuuaacgauaauggaccuucauccaggcucuggaaagacaagaaaauaucuuccugcuauagugagggaagcaauaaagcgucgacuacgaacauuaauuuuagcccccaccagagugguagcugcagaaauggaggaagcacuaaaaggauuacccauccgauaccagacgacugcgacuaaaucagagcauacaggaagagaaauuguagaccucaugugucaugcaacauuuacgaugcgacuauuaucuccaguucguguaccuaauuauaaucuaauuaucauggaugaggcacacuuuacagaucccgcaagcauagcugcuagggguuauaucucaacuagaguaggaaugggagaagcagcggcgauuuucaugacagcuacaccucccgggacggcagacgcauuuccacaaucaaacgccccaauacaagacgaagaaagagacauaccagaacguucauggaacucgggaaacgaauggaucacugacuucgcggguaagaccguaugguuuguuccaucgauaaaagccggcaacgauauugccaauuguuugaggaaaaacgguaagaaaguuauacaacucucgagaaaaacguuugacacggaauaucagaaaacaaaguuaaacgauugggauuuuguaguaacaacugacauuagcgaaaugggagcgaauuuuaaggccgaucgcgugauagauccacguagauguuuaaaaccagucauucugacugacggaccugagagggucaucuuagcuggaccgaugccaguuacggcagccagugcagcacaacgacgcgguaggguuggaaggaacccucaaaaagaaaacgaucaauauauuuuuaccggccaaccccuaaauaaugaugaagaucaugcccacuggacggaggccaaaaugcuguuggacaacauaaauacaccugaagguauuauccccgccuuauuugaaccugaaagggaaaaaucagcagccauugauggagaauacagacuaaagggagaaucucgcaaaacuuucgucgaauuaaugaggagaggugaucuucccguguggcuugcucacaaaguggcuagcgaagguauuaaauauacagacagaaagugguguuuugaugggcaaaggaauaaucaaauacuagaagagaauauggauguggagauuuggacaaaagaaggggagaagaagaaacuuagaccacgauggcuagacgcccguacuuauucugauccucuagcuuuaaaagaauuuaaagauuuugccgcagguagaaaauccauugcacuggaucugguuacugaaauaggcagaguuccaacacauuuagcacaccgaacacguaacgccuuagacaaccuaguaauguugcacacaagugaacauggagguaaagccuaucggcacgccguagaagaacucccagagacaauggaaacccucuuauuauuagguuuaaugauccuacuaaccggaggagcaauguuguuucugaucagcggaaaagguauagggaaaacuucuauaggacuaauuuguguuaucgccucuucuggaauguuauggauggcagaaaucccucuucaauggauagcuagcgcuauaguguuggaauuuuucaugaugguguugcuuauaccagaaccagagaagcaaagaacaccucaagacaaucagcuggcuuauguuguuaucgguauccuaacauuggcagccauaauagcugcaaacgaaaugggcuuauuagagacaacgaaacgagacuugggaaugucaaaagaaccaggugugguaucgccaacaucguauuuagauguagaucuucauccagcaucagcguggacacuuuacgcggucgccacaacuguaauuaccccgaugcuaagacauaccauugaaaauuccaccgcgaauguaucacuagccgcgauagcaaaccaagcagugguacugaugggucuagauaaggguuggccuaucucaaaaauggacuuaggcguaccucuucucgcacuaggauguuacucucaaguaaacccuuuaacauugacagcagccguacuccucuuaauaacacacuaugcaauuauuggcccugguuuacaagcuaaagcuacaagggaagcgcaaaaacggacggccgccgggauaaugaaaaauccaacggucgacggcauuaugacuauugaucuagauccaguuauauacgauucuaaauuugaaaagcaauugggccaagucaugcuacugguacucugugcaguacaacuacucuuaaugaggacuuccugggcucucugugaagcucuaacucuagccacagguccuaucacgacauuaugggaaggcucgccgggaaaauuuuggaauacaacuaucgcugucaguauggcaaauauuuuuagagggaguuaccuagcaggagcaggccucgcauucucaaucaugaaaucuguagguacgggaaaacgaggaacaggcagucaaggagaaacuuuaggagaaaaauggaagaagaaacucaaccaguuaucucguaaagaauuugaucuauauaagaaaagugguauaacggagguugaccguacagaggcaaaagagggucugaaaagaggagaaauuacccaccaugcuguaucaaggggaucugcaaaacuucagugguuuguggagcguaauaugguuauaccagaaggucgaguaauagacuuagguuguggacguggcggauggucguacuauugcgcaggucuaaagaaaguaaccgaaguaagaggauauacuaaaggaggaccuggacacgaggaaccuguaccaaugucaacauacggauggaauauaguaaaacuaauguccggaaaagauguguucuauuuaccaccagaaaaaugcgauacuuuguuaugcgauauaggagagucuucaccaucgccaacaguagaagaaucaagaacaaucaggguacugaaaaugguagagccauggcucaaaaauaaucaguucugcauaaaaguacuaaaccccuauaugccuacaguaaucgaacaccuagagcgacuacaaagaaaacacgggggcauguuaguaaggaauccuuuaucuaggaauaguacgcaugaaauguacuggauuucuaacggaacagguaauauaguagcgagcguaaacauggugucaagauuacuuuugaauagauucaccaugacucacagacgaccgacuaucgagaaagacguagaucucggagcggguacgaggcauguaaacgcagaaccugaaacgccgaacauggauguaaucggcgaaagaauaaaacgaauaaaggaagaacacaauucaacuuggcauuacgaugacgaaaaucccuacaaaacuugggcuuaccaugguaguuaugaagugaaagcgacgggauccgcuagcucaaugauaaauggcguagucaagcugcuuacaaagccaugggacguagucccgauggucacacaaauggccaugacggacaccacacccuuuggacagcaaagggucuuuaaagaaaaaguagauacaagaaccccacgcaguaugccgggcacacgccgaguuauggggauaacagcggagugguuauggaggacuuugggaagaaacaagaaaccucgauugugcacacgagaagaguucacgaagaaaguccgaacuaaugcugccaugggugccguauuuaccgaagagaaucagugggauucagcaaaagcagccgucgaagaugaagauuuuuggaaacucguagaucgggagcgagaauugcacaaauuaggaaaauguggaagcuguguguauaauaugaugggaaaacgggaaaagaagcuaggcgaguucggcaaagccaaaggaucccgugcaauaugguauauguggcuaggagcacguuaucucgaguucgaagcacugggauucuuaaaugaagaccauugguuuucaagggaaaacaguuauagugguguugaaggagaaggguuacacaaauuggguuacauacucagagauauuagcaaaauaccaggcggagcaauguacgccgaugacaccgcggguugggacacaaggauuacagaagacgaccuccacaaugaggaaaagauaacgcaacagauggacccagagcacaggcaacuggcaaaugcgaucuucaaacuaacguaucagaacaaaguagucaaaguacaacggccuacuccaacaggaacuguuauggauauuaucucucggaaagaucagagggguaguggacagguggggaccuacggcuuaaauacauucacaaacauggaggcucaauugauacgucaaauggagggagagggcgucuuguccaaggcagaucuagaaaauccgcaucuacccgagaagaaaauuacgcaauggcuagaaaccaaaggggucgaaagguuaaaaagaauggcaauaucuggggacgauuguguuguaaaaccuauagacgacagguuugccaaugcauuguuagcucuaaacgacauggguaaaguuagaaaggacauaccacaguggcaaccaaguaaaggauggcacgacuggcaacaaguccccuuuugcagucaucacuuccacgaacugaucaugaaggauggacgcaaacugguaguaccauguagaccacaagacgagcuuauaggucgcgcacggauaucacaaggcgcgggauggagucuaagagaaacagcaugccuaggcaaggcuuacgcucaaauguggucauuaauguauuuucaccggcgggauuugcgguuggcaucuaacgcaaucugcucugcuguuccaguacacugggugccuaccagucgaaccacauggagcauacacgcgcaccaucaauggaugacuacugaagauauguuaacuguauggaauaggguauggauagaagauaauccuuggauggaggacaaaacaccugucacaaccugggaaaaugucccauaucuaggcaaaagagaggaucaaugguguggaucacuuauaggccuaacaaguagagcaacgugggcucagaauauaccuacugcaauucagcaaguaagaagucuaauagguaaugaagaauuucuagacuacaugccguccaugaaaagauuucgcaaagaagaagaaucagaaggagcaaucugguag

SEQ ID NO: 23394 - RNA, 9873 nt, Artificial Sequence
  derived and/or modified CDS sequence (opt6) from DENV-3__FJ639758__SS-prME
acuuccuugugccugaugaugauccugcccgcugcacuugccuuucaucugacaagcagggacggagagccacgcaugaucguagggaaaaaugaacgugggaaaaguuuguuauucaaaacagcaucaggaauuaauauguguacucuaauugcaauggacuuaggagaaaugugugaugauaccguaacuuacaaaugcccacacauaaccgaaguugaaccugaagacauugacugcugguguaaucuaaccaguaccuggguaaccuauggaacuugcaaucaagcgggugaacaucgaagagacaaaaggagcguagcacuagcaccacauguaggaaugggauuagauacaagaacccaaacauggauguccgcagagggagcuuggaggcaaguagaaaaagucgaaacgugggcguuaaggcacccggguuucacaauauuggcgcuauuuuuagcccacuacauuggaacaagucuaacacaaaaaguaguaauuuucauacuccuaaugcuaguaacuccaaguaugacuaugcgcuguguagggguggggaaucgagauuucguugaaggauuaucaggggcuacguggguugacguuguauuggaacauggaggaugcguaacgacaauggcuaaaaauaaaccgacgcuugacauagaauuacagaaaacagaggccacucaacuugcaacacuuagaaaauuaugcauagaagguaaaauaacuaauauuaccacagacucaagaugcccuacgcaaggugaggcaguccugccugaagaacaggaucaaaacuauguguguaaacauacauacguggauagagggugggguaacggaugcggguuauuuggaaaagguucauuaguaacaugcgcgaaauuccaaugucuggagccaauagagggaaaaguagugcaauacgaaaaccuuaaguacacggucauuauaacaguacacacaggagaucaacaccaaguggguaaugagacucaaggugucacugcggaaaucaccccacaggcaucaacuaccgaagcgaucuuaccggaauaugguacacuaggacuggaaugcaguccucgcacgggacuagauuuuaaugaaaugauucuccucacaaugaaaaacaaagcauggauggugcaccgacagugguucuucgauuuaccuuugccauggacaucgggagccacuacagaaaccccaaccuggaauagaaaagaguuauugguaacauuuaaaaaugcucacgccaagaaacaagaggucguaguacuaggcucucaagaaggcgcaaugcauacugcuuugacaggggcuacagaaauacaaaauucgggagguacaucaaucuuugcuggacauuuaaaaugucguuuaaaaauggauaaacuagagcuuaaagguaugagcuacgcaaugugcacuaauaccuucguacuuaagaaagaaguaucagagacgcaacaugggaccauuuuaauuaaaguggaauacaagggggaagacgucccuuguaaaauuccguucaguacagaagauggacaaggaaaagcacauaaugguaggcuaaucacugccaauccgguaguaacuaagaaagaggaaccaguaaacauagaagcagaaccacccuuuggagaaucaaauauaguuauaggaauuggugauaacgcacuaaaaauaaacugguauaagaaagggucaaguauaggaaaaauguuugaagcgacugccaggggugccagacggauggcaauuuuaggagacacggcgugggauuucggaucaguaggugggguauuaaauagucuggguaaaaugguacaucaaauauucggaagugcguacacugcacucuucagcgguguuuccuggguaaugaaaauagguaucggaguguuguuaacuuggauuggccuuaauagcaaaaauacaaguaugaguuuuucauguauagcuaucgguauuauuacacuuuaccugggugccgugguacaagcggacaugggaugugucauaaauuggaaaggaaaagaacucaaaugcggauccggaauauuuguaacaaaugaaguacacaccuggacagaacaauacaaauuccaggcagacaguccgaagagauuagccacugcaaucgcuggggcuugggaaaauggagugugcgguauaaggucaacaacaaggauggaaaaccuauuauggaaacaaaucgcaaaugaacuuaauuauauccucugggaaaauaacauaaaacuaacgguggucguaggagacguaauagguguacuagagcaagggaagagaacacuuacuccacagccgauggaacuuaaauauucuuggaaaacuuggggaaaggccaagauaguaacggccgagacacaaaacucaucuuuuaucauugacggcccuaauacacccgagugcccuucggcauccagagcuuggaacguuugggaaguagaagauuauggguuuggcguauucaccacaaauauaugguuaaaauugagagagguuuauacucagcuaugugaucauagauuaaugagcgcggcagugaaagaugaacgagcgguccaugccgacaugggguacuggauugaaagucagaaaaacgggucauggaagcuagaaaaagcaucacuaauagaaguaaaaacauguacguggccuaagagucacacauuauggucaaauggcguacuugaauccgauaugaucauaccuaaaucgcuugcgggaccuauuucucagcauaauuaucgaccagguuaucauacacaaacugccggcccuuggcaccuugguaagcuagaauuggauuucaacuacugcgaggggacaacaguagucauuacggaaaauuguggaaccagagguccaucucugcgcacaacaacggugucaggaaagcuaauccaugaauggugcuguagaaguugcacauuaccaccuuuacgauauaugggcgaagacggaugcugguacggcauggaaauacgcccaauuagugaaaaagaagagaacaugguuaaauccuuagucucugcuggcucaggagagguagacaauuucaccaugggaguguuaugcuuagcuauacucuuugaagagguuaugagaggaaaauucggcaagaaacacaugauagcaggaguauucuuuacauuuguacuauuacucaguggucagaucacauggcgagauauggcacauacguuaauaaugaucggaucuaaugcauccgacaggaugggaaugggggucacauaccuugcucuuaucgcuacauucaagauccaaccguucuuggcccuggguuucuuuuuaagaaaauuaacaaguagggaaaauuugcuacuuggaguaggccuagccauggcaacaacucuacaauugccugaagauauugagcaaauggcuaaugguauagcucuagguuuaauggcccucaaguuaauaacacaauuugagacauaccaauuguggacggcucuaaucagccuuacuuguaguaauacaauauucacacuaacuguagcuuggcgaaccgcuacgcugauccuagcgggcguaucacuacuuccagucugucagucuucauccaugcguaaaacagacuggcucccgaugacaguugcugcuaugggaguaccaccacuaccauuauucauauuuucccuuaaagacacguuaaaaaggcgaaguuggccacuaaaugaaggaguaauggcgguaggucucguuucuauccuggcgaguagucuauuaagaaaugacguaccaauggccgguccauuaguggcaggcggucuucuaauagcauguuacguaaucacagguacuucagcggaccuaacuguagaaaaagccgcagaugucacaugggaagaagaggcagaacaaacaggugugucacacaauuugaugauaacaguugaugacgauggaacaaugagaaucaaagacgacgagacagaaaauauucuaacggugcuacugaaaaccgcccuauuaaucguuagcgggauuuuuccauauucaaucccagcgaccuugcuagucuggcacacguggcaaaaacaaacacaaagaucuggggugcucugggaugugccuucaccacccgaaacgcaaaaagcugaauuagaagagggagucuaucguauuaaacaacagggcauauuuggaaaaacacaaguuggaguagggguucaaaaagaaggcguguuccacacuauguggcacguuaccagaggagcuguuuuaacauauaaugggaaacguuuagaaccgaauugggccagugucaagaaagaucucauuaguuaugguggaggguggagguugucugcacaauggcaaaaaggugaagagguacagguaauagcaguugaacccgggaaaaaucccaaaaauuuccagacaaugcccggaacuuuucagacgacaacgggugaaauuggcgccaucgcucuagauuuuaagcccgggacuagcggaagccccauaauuaacagggaaggaaaagucgucggacuauauggaaacggaguaguuacuaaaaaugguggauaugugagcggaaucgcacaaaccaaugcagagccggaugggcccacgccagaguuagaagaagagauguuuaaaaagcgcaacuuaaccauaauggaucuacauccagggucagggaaaacuaggaaauaccuaccagcgauaguacgagaagcgauuaaaagacgccuccgaacccuaauauuagcuccaaccagagugguagccgccgaaauggaagaggcacuaaaaggucugccaauacguuaucagacaacagcaacgaaaucagaacacacaggaagggagauagucgacuuaaugugucaugccaccuucacaaugcgcuuauuguccccgguaagagugccgaauuacaaucucauaaucauggaugaagcucacuuuacagauccggcuucaaucgcggcuagaggguauaucucaacaagaguugggaugggagaggcugcagccauauuuaugacggccacuccacccggcacugcggacgccuuuccucaaaguaacgccccaauucaagaugaagaaagagacauacccgaacggaguuggaacucaggcaaugaauggaucacugauuucgcaggaaaaacaguaugguuuguacccucaauaaaggcaggaaaugauauugcgaacugcuugcgcaaaaaugggaagaaaguaauccagcuaucacguaaaacauucgauacugaguaucagaaaaccaaacuuaaugauugggacuuugugguaaccacagacaucagugaaaugggcgcgaacuuuaaagcagauagaguaauagacccccgcagaugcuugaaacccguaauucugacagaugguccugagcgggugauucuugcagggccgaugccaguaaccgcagcaucagcagcccaacgaaggggucgcguggggcggaauccccagaaggagaaugaucaauauauuuuuacuggccaaccguugaauaaugaugaagaucaugcgcacuggacagaagcuaaaaugcuucucgacaauauaaacacaccugaagguauuaucccagcccuuuucgaaccugaacgugagaaaagcgcugcuauugauggagaguauagacugaaaggugaaaguaggaagacauucguugaauugaugagaaggggugaucuaccugucugguuagcgcacaaaguggccucagaaggaauaaaauauacagauagaaaaugguguuuugacggccagagaaacaaucaaauacucgaggaaaauauggauguagaaauauggacgaaggaaggagaaaagaaaaagcuaagaccuagaugguuggaugccaggacguacucagauccucuggcacucaaggaauuuaaagauuuugcagcaggaagaaaaagcaucgcguuagauuuagugacugaaauuggucgaguaccgagccaccuagcucaucggacaaggaacgccuuagauaauuugguuaugcuucacacgucagaacacggcggaaaagcauacagacacgcaguggaggaguugccugaaacaauggagacacugcuuuuauuaggcuuaaugauauuacugacuggcggugccaugcuuuuucuuauuucagguaaagggauuggaaaaacaagcauagguuuaauuugcguuauugcuagcagcggaauguuauggauggcugaaauaccgcuacaauggauagccagcgcaauaguacuagaguucuuuaugaugguguuacuuaucccugaaccugaaaagcaaaggacaccacaagacaaccaacuagcauacguuguaauaggaaucuuaacccuagccgcuaucauugccgcaaacgagaugggguuacuggaaacaacaaaaagagaucucgguaugaguaaagaaccaggaguggugucgccgacaucauaccucgauguugaucuacaccccgcaucggcuuggacacuguaugccguugcgacuaccgucaucacaccaaugcuacgacauacuauugaaaacucaacggcaaacgucagcuuagcagcgauagcgaaccaagcaguuguauuaaugggacuagauaaaggguggccgauaaguaaaauggauuuagggguaccguuacuugcauuggguuguuauucacaggucaacccguuaacccuaacugccgcaguauuacuucuaauuacacauuacgcaaucaucgguccgggcuuacaagcuaaagcuacgcgugaggcacagaaacgaacggccgcagggauuaugaagaacccaacugucgacggcauaaugacuauugacuuagaccccguaauauacgacucuaaguuugaaaaacaauuagggcaaguuaugcuccuaguuuuaugugcuguucaacuacuacugaugagaacaucuugggcacuuugcgaggcuuugacacuagcaaccggaccuauuacuacuuuaugggaaggaucuccaggaaaauuuuggaacacgacaauagcgguguccauggcaaacauauuuaggggcuccuauuuagcuggugcaggauuagcauuuaguauaaugaaaucuguagguacaggaaaaagggguacagguucacaaggugaaacgcuaggggaaaaauggaagaagaaauugaaucaacuuaguagaaaggaguuugauuuauacaagaaaagugggaucacagagguugaucguacagaggcaaaagagggucuaaaaagaggugaaauaacacaccacgcagucucuagaggaagugcaaaacugcaaugguuuguagagagaaauaugguaauaccggaagggagagugauagauuuagggugugguaggggaggguggagcuauuauugugccggccuuaaaaagguaaccgaaguacgugguuauacuaagggcgguccaggucacgaggagccuguacccaugucgacuuauggauggaauaucgugaaauuaaugaguggcaaagauguguuuuacuuaccgcccgagaaaugugauacauuacuaugcgauauaggcgagucuaguccaucgccuacaguggaggagucuagaacgauacgcguacuuaaaaugguugagcccugguugaaaaacaaucaauucuguauaaaaguguuaaauccauacaugccuacaguuguagaacauuuagaacgauugcagcgaaaacauggaggaaugcuuguuagaaacccacuauccaggaacucuacacaugaaauguacuggauuaguaacggaacaggaaauauaguugcaucuguuaacauggugucuagauuauuauugaauagauuuacgaugacucacagaagaccuacaauagaaaaggacguagacuugggcgccggaacccgccacgugaacgcagagccugagaccccuaacauggauguaauaggcgaaaggauuaaaaggauuaaagaggaacauaacaguacauggcacuaugaugaugaaaauccuuauaaaacgugggcuuaucauggaagcuaugagguaaaagccacagguagugcaaguagcaugauaaacgggguaguaaaauuacugacaaaacccugggauguagugccaaugguaacccagauggcaaugacagacacaaccccguucgggcaacaaagaguauuuaaagaaaagguggauacaaggacgccacgcaguaugccuggaaccagaagagucaugggaaucaccgcugaauggcuuuggcguacauuaggaaggaauaagaaaccgaggcuuugcaccagggaagaguuuacuaagaaaguccgaacaaaugcggcaaugggagccguauuuaccgaagagaaucagugggauucagcaaaagcagcaguagaagaugaagacuuuuggaaacuuguagauagagagcgggaacuacauaaauuaggccgaugugguucauguguguauaacaugaugggcaaacgugagaagaaauugggugaguuugggaaagcaaaaggaaguagagcuauaugguauauguggcugggcgccagauacuuagaauuugaagcauuggguuuucuaaacgaagaccauugguuuaguagggaaaacucuuacucuggagucgaaggcgagggacuucacaaacucgguuacaucuuaagagauauaaguaagauaccaggcggagcaauguacgccgaugauacagcaggcugggacacgaggauaaccgaggaugacuugcacaacgaagaaaagaucacucaacaaauggauccagaacaucgacaacuagcaaacgcuaucuuuaaauuaacauaucaaaauaaagugguaaaagugcaaaggcccacuccaaccggaacaguuauggauauaauaucacgaaaagaccaacgcgggucaggucaaguaggaacuuauggacuuaauacguuuacaaauauggaggcucaauuaauccgucaaauggagggagaaggaguacuuagcaaggcggaucuagaaaauccaagguugccagagaagaaaauuacgcaaugguuggaaacaaaaggcguagaacgauuaaaaaggauggcaauaucgggugaugauuguguggugaaaccaauagaugauagauuugcuaaugcgcuuuuggccuuaaaugauauggggaaaguacguaaagauaucccacaauggcaaccgaguaaaggauggcacgauuggcaacaaguaccguuuuguucacaucauuuucacgaacuuauuaugaaagauggucgaaaauuagugguuccaugucgaccucaagaugagcuaauaggcagagcucguauaucccaaggugcgggguggucauuacgggaaacggcaugcuugggcaaggccuaugcucaaauguggucucuaauguacuuucaucguagagaccuccgucuugcaagcaaugcuauaugcucagcuguaccaguccauuggguuccaaccucuaggacaacauggagcauacacgcacaccaucaauggaugacuacggaagauaugcucaccguauggaaucguguuuggauagaagacaauccauggauggaagauaaaacccccgucacuacaugggaaaacgucccauacuugggaaaacgagaggaucaauggugcggaucacuuauaggcuuaacgucaagagcaacuugggcccagaacauuccaacagcuauacaacaaguacguucauuaauugggaaugaagaauuucucgacuauaugccuaguaugaaaagguuucggaaggaagaggaaagcgaaggagcaauaugguga

SEQ ID NO: 23395 - RNA, 9873 nt, Artificial Sequence
  derived and/or modified CDS sequence (opt6) from DENV-3__FJ639759__SS-prME
acuucucuuuguuuaaugaugaucuuaccggcagcauuagcuuuucacuuaacuucgagggauggagagccgcgaaugauagucggcaaaaaugaaagagggaaaucauuauuguuuaaaacugcgucgggaauaaauauguguacuuuaauagcuauggacuuaggagaaaugugugacgauacaguuacguauaaauguccccacauaacagaaguggaaccagaagauauugacugcugguguaauuuaacuuccacuugggugacuuacggaacuuguaaucaggcgggagaacauagacgagauaaaaggaguguugcccuagcuccccaugugggaauggggcuagauacacgaacgcaaacauggaugagcgcugaaggggcguggagacagguagaaaaagucgaaacaugggcccugcgccaccccggauuuacaauuuuagcuuuguuucuugcgcauuacaucggaacuucacuaacacaaaaagucguuauauuuauccuauuaauguuagugacucccuccaugacaaugagguguguagggguugggaaucgugacuuuguagaaggucucucaggagccacauggguugauguaguacuggaacauggcgggugugucacaacuauggccaaaaacaaaccuacacuugauauagaauuacagaaaacagaagcgacacaauuagcgacguuacgaaaacuaugcauagaagguaaaauaacgaauauuacaacugacucucguugucccacccaaggcgaagcuguuuuaccagaagaacaagaccaaaacuauguaugcaaacacaccuauguugaucggggcugggguaaugguuguggguuauuugggaaaggcaguuuaguuacuugcgccaaauuucaauguuuagagccaauagaagggaaaguaguucaauaugagaaccuuaaauauacaguaauaauaacggugcauaccggagaucagcaucaaguaggaaaugaaacacaaggaguaaccgcagaaaucacaccacaggcuucaacuacggaagcuauuuugccggaauacggaacacuggggcuugaauguucaccucguaccggacuagacuuuaaugaaaugauauugcugacaaugaaaaauaaggcuuggaugguucauagacagugguuuuucgauuuaccucuuccauggaccucuggagcuacaacugaaaccccuacguggaaccgcaaagaacuauuaguaacauucaaaaacgcccaugccaagaaacaagaagugguaguucuagggagucaagaaggugcaaugcacacggcauuaacuggagcaacagagauacaaaauucgggaggaacgucaaucuucgcaggucaucuaaaauguaggcucaaaauggauaaacuugagcuaaaagggaugagcuacgcgauguguacuaacacuuucguuuugaagaaagaaguaucugaaacucaacacggcacaauucugaucaaaguagaguauaaaggggaggacguuccguguaaaauaccauucagcaccgaagaugggcaaggcaaagcacauaauggaagauugauaacugcaaauccagugguaaccaagaaagaagaacccgucaacauagaagcagaacccccauuuggagaaucgaacauuguaauaggaauaggggauaaugcccuaaaaaucaauugguacaagaaaggaaguagcauagggaaaauguucgaggcuacugcaagaggggcgcgaagaauggcuauucuaggcgauacagcaugggauuuuggaucaguaggcgguguacuuaauucccuuggaaagaugguucaucagauuuuugguagcgcauacacggcucuauuuuccgguguauccuggguaaugaagauagguauugggguacucuuaacauggauuggccuaaacucuaaaaacacuagcaugaguuucucauguaucgccauuggaauaauaacguuauacuuaggagccguagugcaagcugacaugggcugcguaauuaauuggaaagggaaagaauuaaaauguggaucaggaauauucguuacaaaugaggugcacaccuggaccgagcaauacaaauuccaagcagauaguccuaaacgcuuggcaacagcuaucgcaggcgcuugggagaacgguguaugcggcauacgaaguacgacaaggauggaaaaccuccuuuggaaacagaucgcgaaugaauuaaauuauauuuuaugggaaaacaacauuaagcuaaccguuguuguaggugauacuaucgguguguuagaacaggguaaaagaaccuuaacgccacagccuauggaguuaaaauacaguuggaaaacuuggggaaaggcaaaaauaguaaccgcagaaacacaaaacucaucauuuauuauugacgguccaaauacuccagaauguccaucagcgagccgagcguggaauguuugggagguagaggauuauggauucgggguauuuaccaccaacauuugguuaaaguuacgggaaguauauacacaacuuugugaucauagacuaauguccgccgcagucaaggacgagcgagcuguacacgcggauaugggauacuggauagaaucacagaaaaacggaaguuggaaauuagaaaaagcaagucuaauagaagugaaaacauguacauggccuaaaagccauacucuguggucuaaugguguacuugaaagcgauaugaucauuccaaaaucacuagcaggaccaauaucccaacauaauuaucguccaggauaucauacacaaacagccgguccauggcauuuggggaaacuugagcucgauuuuaauuacugcgaggggaccacaguggucauaacagaaaacugcggcacgagaggaccuucucuaagaacaacuaccguaagugguaaauuaauacaugaguggugcugucgcaguuguacccuaccaccacuaagauauaugggggaggacggauguugguaugguauggagauacguccaaucucagaaaaagaagaaaacauggucaagucccuuguuucggcagggucaggggaaguggacaacuuuacgauggguguacuaugucucgcgauacuauucgaagagguaaugcguggaaaauuugguaaaaagcauaugauagcgggaguguuauuuacuuuuguucuuuuauuaucggggcaaaucaccuggagggauauggcucauacuuugauuaugaucggaaguaaugcuucggauaggauggggaugggagugacauacuuagcccugauagcgacuuuuaaaauacaaccguuucuggcgcuugguuucuuucuaaggaaacuaacaucucgcgagaaucuuuuacuaggcguagggcuagcuauggcuacgacccuacaauugccagaagauauagagcaaauggcaaaugggaucgcccuaggacuuauggccuuaaaauugauaacucaauuugagacauaucaacuuuggacugcauugaucucuuuaacaugcaguaauacaaucuucacauuaacaguggcauggaggacagcgacacugauuuuggcugguguaucucuccuuccaguuugucaaaguucaaguaugaggaaaacagauuggauacccaugacaguugcagcaaugggcguacccccuuuaccccuauuuauauuuucacucaaagauacucuaaaacgucgaagcuggccucucaaugaaggcguaauggcaguggggcucguuucaauacuagcaagcucucuguuaaggaaugauguaccuauggccgggccccuagucgccggagggcuacuaauagcaugcuacguaauuacaggcaccucagcugauuuaaccguggaaaaggcagcagauguuacuugggaggaggaggcagagcaaacuggcguaucccacaauuuaaugaucacaguagaugacgacggcaccaugagaauaaaggaugaugagacugaaaauauacuaacaguacugcuaaaaacugcccucuuaaucguuaguggaauuuucccguauagcauaccagccacacucuuagucuggcauacauggcagaaacagacucagcggaguggcguacuaugggaugucccaucuccacccgaaacucaaaaagcagaacucgaagaagggguauauaggaucaaacaacaagguaucuuugggaaaacacaagucggagucgguguucaaaaagaaggaguguuucacacgauguggcaugucacgcguggagcuguuuuaacauauaauggaaaacguuuagaaccaaacugggccuccguaaagaaagauuuaauaucguacggaggaggcuggagacuaagcgcacaauggcagaaaggagaagagguacaagucauugcuguagaaccaggcaaaaauccgaaaaauuuccaaacaaugccagguacauuccaaacgaccacaggugaaauaggagcaauugcacucgacuucaaaccaggaacuucagguucuccgaucaucaauagagaaggaaaaaucgugggucuauacggaaacgguguuguuacgaaaaacggcgguuacgugagugguauagcucaaaccaaugcagaaccugaugggccgacaccagagcuagaagaagaaauguuuaagaaacgaaauuugacaauaauggaucuucauccaggcagcggcaaaacaagaaaguaucuaccugcuauaguuagagaagcgauuaaacgaagacuccgcacucuuauuuuagcucccacuagaguaguagcugcugaaauggaagaggcacuaaagggccucccaauaagauaucaaacgagugcaacuaagagugaacauaccgguagagaaaucguagaccuaaugugccacgcaaccuuuaccaugagacuacucucaccaguacgggucccaaauuauaaccuaauaauuauggacgaagcccauuuuacugacccagccuccauugccgcccgugguuacauaagcacucgagugggaaugggagaggccgcggccauuuuuaugacagcaacuccaccagggacugcagaugcuuuuccacaaaguaaugcaccuauccaagacgaagaacgugauauuccagagcguucuuggaacucuggaaaugaguggaucaccgauuuugcggguaaaaccguaugguuugugcccucgauaaaagcagguaaugauauagcuaauugucuccgcaaaaaugggaagaaaguuauccaauugucuagaaaaacauucgauacugaguaccagaaaaccaaauuaaaugacugggacuuugucguuacaacagacauaucggaaaugggugcuaauuucaaagcugacagggucauagauccccguaggugucucaaaccagugauacuaaccgauggacccgaaaggguaauacucgcugguccuaugccaguuacagcggcaagugcagcacaaaggagagggaggguagggagaaauccccaaaaagaaaaugaccaauacauauuuacaggccaaccacuaaauaacgacgaagaucacgcgcauuggacggaggcaaaaauguuguuagacaacauaaauacgccggaaggaauuauuccugcccucuucgaaccagaaagagaaaaauccgcggcgaucgauggugaauaucgcuuaaaaggugaaucaagaaagacuuuuguugaacuuaugcggcgaggagacuugccugucuggcucgcucacaaaguugcaucggagggcauaaaguacacagaucgaaaaugguguuuugauggacagcgaaauaaucaaauauuggaagaaaacauggacgucgaaauuuggacuaaagagggugaaaagaagaaacuucguccccgauggcuagaugcaagaacuuacucggauccucuugccuugaaagaguucaaggauuucgcagcaggcaggaaaagcauugcucuugaucuaguuacagagauugggcgaguuccuacacaucuugcucauagaacaaggaacgcacuugauaaccuagucauguugcacacuucagaacacggcggaaaagcauauaggcaugcuguugaagaacuuccagagacgauggaaacauugcuccuauuaggccugaugauccuuuuaacaggcggagcaauguuguuccuaauaucagguaaggguauaggaaagacgaguauagggcuaaucuguguuauagcuaguuccggaaugcucuggauggcagaaauuccguuacaguggauagcuagcgcaauugucuuagaguucuuuaugaugguacuuuugauacccgaaccagaaaaacagcgaacuccacaggacaaucagcuagccuauguaguuauugggauucugacgcuagcugcaaucauugcggcuaaugaaaugggacuucuagaaacaacaaaaagagacuuaggaaugucaaaagaaccaggagucguuucaccgacaucauaccuugauguugauuuacauccagcaagcgcauggacgcucuacgcgguggcgacaaccgugauuacacccaugcucaggcauaccauagaaaauuccacggcaaacguuagucuagcagcaauagcgaaccaggcaguuguccucauggggcuagacaaaggauggccuauaucgaaaauggauuuagguguaccacuucuagcauugggguguuauagccagguaaacccucuaacuuuaaccgcugcagugcuuuuacuuauaacgcauuaugcaauaauuggcccaggcuuacaagcuaaagcaacaagagaagcucaaaagcgaaccgcagcgggcaucaugaagaacccuacgguugacggaauuaugacuauagaccuugaccccguaauuuacgauuccaaauucgaaaaacaauuaggucaaguaaugcuacuuguucuaugugcuguucagcuuuugcuaaugcgaacuagcugggcguuaugugaggcacuuacccuagcaacuggacccauuacaacacuaugggaggguuccccgggaaaauucuggaacacaacaauagccguuucaauggccaauaucuuucgaggaucguaccuagccggugcaggucucgcuuuuaguauaaugaaguccgugggaacuggcaagagaggaacagggagucaaggggagacacuaggagaaaaauggaagaagaaauugaaccaguuaucgcggaaagaauuugaccuuuauaagaaaagcggaauaacggaaguagacaggaccgaagccaaggagggacuuaaaaggggagaaauaacucaucacgcggucaguagaggcagcgccaaacuacaaugguuugucgagagaaauaugguuauuccagaagggagaguuauugaccuaggcugcggaaggggaggauggucguacuacugugcuggacuaaagaaagucacagaaguccgugguuauacaaaaggagguccgggccacgaagaaccggucccaauguccacuuacgguuggaacauuguaaaauuaaugagcgguaaggauguauuuuacuugccgcccgaaaaaugugacacacuucuuugugauauuggagagucaaguccuaguccaacagucgaagagucacguacgauucgagugcuuaaaaugguggaaccauggcucaaaaacaaccaguucugcauaaaaguuuugaauccauauaugcccaccguaauagagcaucuagaaagacugcagaggaaacauggaggaauguuaguccguaauccguugagccgcaauagcacacaugaaauguauuggauaucaaaugguacaggaaacauaguagcgucuguaaacauggucagccgacuacugcuaaauagauucaccaugacgcacagaagaccgaccauagagaaagacgucgacuugggugcugggacaagacauguaaaugcagaaccugaaacuccgaauauggacguaauaggcgaacgaauaaagcguauaaaagaagaacauaauucgacguggcacuaugaugaugaaaacccauauaaaacaugggcuuaucauggaucuuaugaaguaaaggcaacgggcagcgcaucgucuaugauaaacggcguuguaaaacuacuaacuaaaccaugggacgugguccccauggucacccaaauggcuaugacugauacuacgccauucggacaacagagggucuuuaaggaaaagguugauacucgaaccccaagaucaaugccaggaacaagacgcguaauggggauaacggcugaauggcuauggagaacucuaggaaggaauaagaaaccacgacuaugcacgagggaagaauuuacuaagaaaguccgcacaaaugcagcuaugggggcuguauucacugaagaaaaucaaugggacagcgcuaaagcagcaguagaagaugaagauuucuggaaauugguagaucgggaaagagaacuucacaaauuaggcaaauguggaucuuguguauauaauaugauggguaaaagagagaagaaacucggcgaauuuggaaaagcuaaagggucaagagcgauaugguacaugugguuaggagcaagauauuuggaguuugaagcauuaggguuuuuaaaugaagaucauugguuuagcagagaaaauucguauaguggaguugagggugaagggcuccacaaauuaggauauauauuacgagacauuucuaaaauuccggguggagcgauguaugccgaugauacggcugguugggauacuagaauaacagaagaugaucuacauaaugaagaaaagauuacacaacagauggaccccgaacauagacaacuagcaaaugccauuuucaaguuaacauaccaaaauaaaguugucaaagugcaacgaccgacuccuaccggcacaguuauggauauuauaucucgaaaagaccagagaggaagcgggcaaguuggaacauauggauugaacacauuuacgaauauggaggcgcaauuaauacgccaaauggaaggagaaggaguucucucaaaagcggacuuggaaaacccacacuuaccagagaagaaaauuacacaaugguuagagacaaaggguguggagagauuaaagagaauggcuauaaguggagaugauuguguaguaaagccuauagaugacagguuugccaaugcccuguuagcauuaaaugauaugggaaagguaaggaaagauauuccccaauggcaaccuaguaaaggauggcaugacuggcaacaaguacccuucuguucacaucacuuccaugagcucauuaugaaagacggacgcaaauuaguaguccccugucgaccgcaagaugaacuuauaggaagggcaagaauaagccaaggagcuggauggucucuacgagagacugcgugucucggaaaagcauaugcacaaauguggucuuuaauguauuuucauagacgggaucucagauuagcuuccaaugcaaucuguagugcaguuccuguacacuggguccccacaagucgaacaacuuggucgauacaugcccaucaucaguggaugacuacugaagauaugcuaacagucuggaacagagucuggauugaagacaauccauggauggaggauaaaacaccaguaacaacaugggaaaacgucccguaccuagggaaacgagaggaucaguggugugguagucuaaucgguuuaacuucaagggcuacgugggcacagaacauaccaacggcaauacagcaaguuagaucucucauuggaaacgaggaauuucucgauuacaugccauccaugaaacgauuccguaaagaggaagaaucagaaggugccauuugguaa

SEQ ID NO: 23396 - RNA, 9873 nt, Artificial Sequence
  derived and/or modified CDS sequence (opt6) from DENV-3__FJ639761__SS-prME
accagucugugucugaugaugauuuuaccagcagcauuagcuuuucaucuaacgucaagggauggagaaccacggaugauaguagguaaaaaugaaagagggaaaucccuauuauuuaaaacagcguccggaaucaauauguguacuuuaaucgcaauggacuuaggagagaugugugacgauacaguuacauauaaaugcccacacauaacagagguugaaccugaagauauagacugcuggugcaaccuaacuucaaccuggguaaccuacggcacuugcaaucaagcgggcgaacaccguagagauaaaaggaguguugcauuggcuccccauguugggaugggacuugacacaagaacacaaacauggauguccgcagaaggagcauggcgucagguagaaaaaguugaaacgugggcuuugcgacacccggguuucacaauucuagcucuguucuuagcucauuauauaggcaccucuuugacacaaaaaguugucauuuuuauccuuuuaaugcuaguaacgccaucuaugacaaugagauguguagguguugggaaucgcgauuuuguagaaggacuaagcggggcaacuuggguagacguuguauuagaacauggcggcuguguuaccacuauggcgaaaaacaaaccaacgcuagacauugaauuacagaaaacagaggcaacgcagcuagcaacacuuagaaaacugugcauagaaggaaaaauaacuaauauaacuacagacaguagauguccaacucaaggagaagcaguacuaccagaagaacaagaucaaaauuauguaugcaaacacacauacgucgacagaggauggggaaauggauguggucuuuucggaaaagguagucucgucacgugugcaaaauuucaaugcuuacagcccaucgaggguaaaguaguccaauaugaaaaccuaaaauacacggucauaaucacaguacauacaggggaccaacaucagguaggcaacgaaacccagggaguaacagcagaaauaacuccacaagcuaguaccacagaagcuauauuaccagaauaugguaccuuagggcuagaguguucuccucgaacgggucuugacuuuaaugaaaugauauugcuaacaaugaaaaacaaagcguggaugguccacagacaaugguuuuucgacuuaccacugcccuggaccucgggcgcgacgacagaaaccccaacuuggaacagaaaagaacuacucguuacauuuaaaaacgcacaugccaagaaacaagagguaguaguauuagggucucaagaaggggcaaugcauacagcuuuaacuggagcaacugaaauucaaaauucuggagggacuagcauuuuugcgggucauuuaaaaugucgucuaaaaauggauaaacuugaacuuaaagguauguccuacgcaauguguacuaauacuuucguacugaagaaagaaguaucugagacgcaacauggaaccauccugauaaaaguagaauauaaaggggaagacguaccgugcaaaauucccuucaguacagaagaugggcaagggaaagcacacaacgggcgauuaauaacagccaauccaguaguaacuaagaaagaggaaccuguuaauauagaagcugagccgccuuuuggugaauccaacauaguaaucgggauuggcgauaaugcucuaaaaauaaacugguauaagaaaggaaguucaaucggaaaaauguucgaagcgacagcaaggggagcacggcgcauggcgauucuaggagacaccgcgugggauuucgggucggugggcgggguacuaaauucauuagguaaaaugguucaucagauauuugguucugcauauacugcauuguuuaguggagugaguuggguaaugaaaauuggaauagguguauuacuaaccuggauuggucuuaauaguaaaaacaccaguaugaguuuuucuugcauagcaauuggaauuaucacucuauacuuaggggccguaguccaagcugacaugggcugcguuauaaauuggaaagguaaagaacuaaaaugcgguucugggauauucgugaccaacgaaguacacacuuggacugaacaguacaaguuucaagcagacaguccuaagagguuagccaccgcgauagccggugcaugggagaaugguguuugcggcauucguaguacaacgaggauggaaaaccuucuuuggaagcagauugcaaacgaauuaaacuacauacuuugggagaacaauauaaaguuaacaguaguggugggggauauaauugggguucuggagcaagguaaacgaacgcugacaccacaaccgauggaacugaaauauucauggaagacguggggaaaggccaaaauaguuacugcggaaacucaaaauucuucguuuauuaucgacggcccuaauacuccugaauguccgucugcuucaagagcauggaacgucugggaaguggaagauuacgguuuuggaguguucaccaccaauauauggcuaaagcugagagaaguauacacucagcuuugcgaccaccggcuaaugagcgcagccgugaaggacgagagggccguacacgcagauauggguuacuggauugagucacagaaaaacggauccuggaaauuagaaaaagcaucauugauagaagucaaaacaugcacauggccuaagucacauaccuuauggagcaauggaguauuagaaucagacaugauaaucccaaaaucacuugcgggaccuauaucacaacacaauuaucguccaggauaccacacgcaaaccgcuggaccuuggcaccuaggaaaacuugagcuagauuucaacuauugcgaggguacgacgguaguuauaacggaaaauugugguacaagagggccuaguuugcguacaaccaccguaucaggaaaacucauacaugaaugguguugcaggaguuguacauugcccccuuuacgcuauaugggugaggaugguugcugguauggaauggaaauuagaccgaucagugaaaaggaagaaaacauggucaagucuuuaguuagcgccgguucuggggaaguggacaacuuuaccauggguguucuaugccucgcaauauuguuugaagaaguuaugcgagguaaauucggaaagaaacauaugauugcagggguauucuuuacguuuguacuguuacuauccggccagauaacuuggagggauauggcacacacacuuauaaugauaggaaguaaugcaagcgaucgaaugggcauggggguaacuuauuuagcucuaauagccacauuuaaaauacagccuuucuuagcccucggguucuuuuugcgcaaacucacaucccgugagaauuuacuauuaggcguaggucuagcaauggcaacaacauugcaguugccugaagacauagagcaaauggcaaaugguauugcucuaggucugauggcgcuuaaacugauuacccaauucgaaaccuaucagcuguggaccgccuugauuucuuuaacuuguagcaacacaauuuuuacacuaaccguugcauggcgaacugcuacacugauacuagccgguguuucauuacuaccaguaugucaauccucaucgaugagaaaaacagauugguugccaaugacuguugcugcaauggggguuccaccccucccccuguuuaucuucagccuuaaagacacgcuaaaaaggcgaucuuggccacuaaaugaaggugucauggcgguaggauuaguuucaauacuugcaucaagucuacuaaggaaugauguaccuauggcaggacccuuaguugcuggggguuuauuaauagcaugcuauguuauaacgggaacuuccgcagauuuaacggucgagaaggcugcagaugucaccugggaagaagaagccgaacaaacuggcgugagucacaacuuaaugauaaccguagaugacgauggaaccaugagaaucaaagaugaugaaacugagaacaucuuaacaguacucuuaaaaacggccuuauugauagugagcgguaucuuucccuacucaauuccagcgacucuuuuaguauggcauacauggcaaaaacagacucaacggagcggcguacucugggacguuccaucgccgccagaaacucaaaaagcagaacuagaagaagggguuuauagaaucaaacaacagggaauauucggcaagacccaagugggaguuggaguucagaaagaggggguuuuccauaccauguggcacgugacucggggugccguacuaacauacaauggaaaaaggcuagagccaaacugggcaaguguuaagaaagacuuaauaaguuauggaggaggauggcgauugucagcccaauggcaaaagggagaagagguccaaguuauagcaguugaaccaggcaaaaacccuaaaaauuuccagacgaugcccgggacauuccagaccacgacaggugaaauaggagcaaucgcuuuagacuuuaaaccugggacaucaggaucgccuauuaucaaccgggaaggaaaaguagucgguuuauacggcaacggaguaguaaccaagaaugggggauacgugucaggcauugcacagacaaaugcugaacccgauggaccaaccccagaacucgaagaagaaauguuuaagaaacgaaaccuaacgauuauggauuuacauccgggaaguggcaaaacccguaaauacuuaccagcuauaguacgugaggcaaucaaacgacgguugaggacauuaauacuggcucccacaagaguaguugcagcagagauggaggaggcacuaaaaggcuugccaaucagauaucaaacuaccgccaccaaaagcgaacauacaggaagagagauuguagaucuaaugugucacgccacauuuacgaugcguuugcuaucgcccgugcgaguaccaaauuacaaucucaucauuauggaugaagcacauuucacagauccugccaguauagcugcaagagguuacauuagcacucgaguaggaaugggagaggcagccgccaucuucaugaccgcaacuccaccugguaccgcagaugcauuuccacaaaguaaugcaccuauccaagacgaggagagggauauuccugaaaggucguggaauagugggaacgaauggaucacagauuuugcaggaaagacaguuugguuuguuccauccauuaaggccgguaacgauaucgcaaauugucuccgcaaaaaugguaagaaagugauacaauugucaagaaaaacguucgauacagaauaccagaaaaccaaacuaaaugacugggauuuuguaguaacaacggauauaagcgagaugggagcuaauuucaaagcagauagaguaauugacccaagaagaugcuugaagccaguaaucuugacugacggacccgaaagaguaauacuagcgggcccaaugccugucacugcggcaagugccgcgcaaagaagagggcgugucgggagaaacccccagaaagaaaaugaccaauauauauucacaggacaaccauuaaauaaugaugaagaccaugcccauuggaccgaagccaagauguuauuagauaacauuaacacgccugagggaauuaucccggcuuuauucgagccggaaagagaaaaaucugccgcaauagacggugaauauagacuaaaaggggagagcagaaaaacguucguagaguugaugagacgaggagaucuacccguuuggcuagcacauaaagucgccagcgaaggaauuaaauauacggaccgcaaguggugcuucgauggucaaagaaauaaucagauauuagaagaaaauauggaugucgagauauggacaaaagagggcgagaagaagaaacuaagaccacgcuggcuggaugcuagaacuuacucugacccucuagcccuaaaagaguuuaaggacuucgccgcugggcggaaaucaauagcgcucgauuuggugacggagauaggucggguuccgacucaucuagcacauagaacuagaaaugcacuagacaaucuagucaugcuacacacaagugaacauggcgguaaagccuauagacaugcgguagaggaacucccggaaacaauggaaacacugcuauuacuaggauuaaugauauuacuaaccggugguguaauguuauuuuugauaagugguaaaggaauaggcaaaacuucaaucggacuuaucugcguuauugcuucaucuggcaugcuauggauggcagaaauaccacuucaguggauagcuuccgcaauagucuuagaguucuuuaugaugguguugcuaauuccggaaccggaaaaacaaagaacgccacaagacaaucaauuagcguacguuguuauuggaauccuaacgcuagcggcgauaauagccgcuaacgaaauggguuuauuagaaacuacuaagcgugaucuaggaaugucaaaggaaccaggcgugguauccccgaccucguauuuagacguugaucugcaccccgcuucggcuuggacucuuuacgcgguagcuacuacaguaauuacgccuaugcuccgacauaccaucgaaaauuccacagcuaacgugagccuagccgcaauagccaaccaggcgguaguauuaaugggacuagacaagggauggccuauaucaaaaauggaccuuggugucccauuauuagcuuugggauguuacucacagguaaaccccuuaaccuuaacggcagcgguccuauuacuaauaacacauuaugcgauuauuggacccggucuacaagcuaaagcgacgagggaagcacaaaagagaacagcggcaggaauaaugaaaaacccuacgguagaugggauuaugacuauagaucuagauccuguuauauacgacaguaaguuugaaaaacaauuaggucaaguuaugcuccugguauuaugugcgguacaauugcuuuugaugagaaccagcugggcucucugcgaagcucugacauuagcgacagggccaauuacaacauuaugggaaggaagucccggaaaguucuggaauacuacaauagcaguuucaauggcaaacauauuccgaggauccuaucuagccggugcgggcuuagcauuuucaauaaugaaaucgguggguaccggcaaacggggaacugguuugcagggagaaacauuaggcgaaaaauggaaaaagaaauugaaucaauuguccaggaaagaauuugacuuauauaagaaaucgggaauaacugaaguugacagaacagaggcaaaagaagguuugaaacgaggugagauaacucaccaugccguaucucggggcucagcgaaauuacaaugguuuguagagaggaauauggucaucccagaagguagggucauagaucucggaugcgggagagguggauggucauacuauugcgcugggcugaaaaagguaacugaaguaagaggauacacaaaggguggaccaggucacgaggaaccggucccaaugucuacuuacggauggaauauagugaaacuuaugucuggaaaggacguauuuuaucuuccaccagaaaaaugugacacccuccuuugugauauaggugaaucuaguccauccccuaccguggaagaaagucguaccauuagaguucuuaaaaugguugaaccauggcucaaaaauaaccaauucuguauaaagguauuaaauccauauaugccaacgguuauagagcacuuagaacgguuacaacgcaaacauggcggaauguuaguaaggaauccauuaucccguaacucaacucaugagauguacuggauaucuaauggaacaggcaauauaguugcaagcguuaauauggugagucgauuacuacuuaauagauuuacgaugacccaccgucggcccacaauagaaaaggacguugaucuuggugcuggcacaaggcaugugaacgcggagccagaaacaccuaauauggacgugaucggagaaagaauaaagcgaauuaaggaggagcacaauucuacauggcacuacgaugaugagaacccguauaaaaccugggcauaccauggcucauacgaaguaaaagcaacaggcucugcaucaaguaugauuaauggaguaguaaaauuacuaacgaaaccaugggauguaguuccuauggucacacagauggcaaugaccgauacgacaccauucggucaacaaagaguauuuaaagaaaaagucgauacuagaacuccaagaucaaugccuggaacaagacggguuaugggaaucacagcugagugguuguggagaacgcuagguagaaacaagaaaccaagguuaugcacccgugaggaauuuaccaaaaaggugcgcacgaaugcugccaugggugcuguuuucaccgaagagaaccaaugggacucagcaaaggcugccguagaggacgaagacuuuuggaagcuaguugauagagaaagagaauuacauaaauuaggaaagugcggaucaugcguauauaacaugaugggaaaaagagaaaagaaacuaggcgaguucggaaaagcaaaagguaguagagcaauaugguauaugugguuaggcgcacgauaucucgaauuugaggcccuuggcuuuuugaacgaggaucauugguucucuagagagaacaguuauucuggcgucgaaggagaaggauugcacaaacucggcuauauucuacgggauauaagcaagauaccaggaggggcaauguaugcugacgacacagccggaugggacaccagaauaacagaagacgacuuacauaaugaagagaaaaucacacagcagauggauccugaacaccgccaacuugccaaugccauauuuaaacugacauaccaaaauaaagugguuaaaguccagagaccuacuccaacggguacaguaauggauauaauaaguagaaaggaucaacgagguagcggacaaguuggaacauaugguuuaaacaccuuuacaaacauggaagcucaacuuauacgucaaauggaaggagaaggaguacuaaguaaagcagaucuagaaaacccacacuuacccgagaagaaaauuacacaaugguuagaaacaaaaggaguagaaagacucaaacgaauggcaauaaguggagaugacuguguaguaaaaccgaucgacgaccguuuugccaaugcuuuacuugcucuuaacgauauggguaaaguaagaaaagacauuccacaauggcagccuaguaaagguuggcaugacuggcagcagguuccauucugcucgcaucauuuucacgaacuaauuaugaaagacggaagaaaacuuguagucccaugcaggccucaagaugagcuaauaggacgagccagaauaagccaaggagcaggauggucacuaagagaaacagccugucuaggaaaagccuacgcacagauguggagucuuauguacuuucaccggagagaucucagauuagcaagcaaugccauauguuccgcuguaccaguacauuggguaccaacuucacguacaacauggucuauccacgcacaucaccaauggaugacaacugaggauauguuaacuguauggaacagggucuggauagaggauaaucccuggauggaagauaagacuccuguaacaacaugggagaauguuccauaccuggguaagcgcgaagaucaaugguguggaucguugauaggguuaacuucuagggcuacuugggcacagaacauacccacagccauacaacaagucaggucacuaaucgggaacgaagaauuuuuagauuacaugccaucuaugaaaagauuuagaaaagaagaagaaagcgaaggagcgauaugguaa

SEQ ID NO: 23397 - RNA, 9873 nt, Artificial Sequence
  derived and/or modified CDS sequence (opt6) from DENV-3__FJ639762__SS-prME
accuccuuaugucucaugaugauuuuaccugcagcauuagcuuuucauuuaaccucacgugauggugaaccgcgcaugauaguaggcaaaaaugaaaggggaaaaagccuacuuuucaaaaccgcaucuggaaucaacaugugcacauuaauagcaauggaccuuggagaaaugugugaugauacuguaaccuauaaaugcccucacaucacagaaguugaaccagaagauauugauuguugguguaaucucacuucaacauggguaacuuacggaacuugcaaucaagcaggagaacaucgaagggauaaacgaucaguugcguuagcuccccauguugggaugggguuagauacucguacacaaacuuggaugagugcugaaggagcauggagacaaguagaaaaaguagaaacuugggcacuuagacauccuggcuuuacaauccuugcccucuuccuggcacacuacauagguacgaguuugacccaaaaaguuguaaucuucauacucuuaaugcuaguuacaccaucuaugacgaugaggugcguaggcguuggcaacagagauuucguagaaggguuauccggcgcuacauggguagacguaguacuugagcauggaggcugugugacaacaauggccaaaaacaaaccuacacuggacaucgaguuacagaaaacugaagcuacccaauuagcaacgcuaagaaaacuuuguauugaaggcaaaaucacaaauaucaccacagauaguagauguccgacacaaggcgaagcgguacucccggaagaacaagaccagaauuauguuuguaaacauacguauguggacagaggauggggaaacggauguggacuauucggaaaagguucauuaguaaccugugcuaaauuccaaugucuagaacccaucgaaggaaaagugguacaauaugagaauuugaaauauacaguuauaauuacaguacauaccggggaucaacaccagguaggcaacgaaacacaagggguaaccgcagaaauaacaccccaggcuagcacgacugaagcaauauuaccggaauauggaacauuaggacucgaaugcagcccacgaacagggcucgacuucaacgaaaugauccuacuaacuaugaaaaauaaagcauggaugguacaucgacagugguucuuugaucugccucucccuuggacuuccggagcaacaaccgaaacucccacguggaaucguaaagaauuacuggugacauuuaaaaaugcacaugccaagaaacaagaaguugugguauuagggucucaagagggugcgaugcacacagcucuaacuggggcuacugaaauacagaacagcggcggaacuucgauauuugcuggacaccugaaaugcagauuaaaaauggauaaacuugaauuaaaagguaugaguuaugcaauguguacaaauacguuuguucugaagaaagaaguaucugaaacacaacaugguacaauacucaucaaaauagaauauaaaggugaggacguaccuuguaaaaucccauucucuacagaggacggucaggguaaagcacacaacgggcgauuaauaacugcaaacccaguaguuaccaagaaagaagaacccguuaacauagaagcagaaccgccuuucggagaauccaauauagugaucgggaucggggauaaugcccuaaaaauaaauugguauaagaaaggaucaucaauaggcaaaauguuugaagcaacggcgaggggagccagacgcauggccauuuuaggagauacugcaugggauuuuggaagcguaggagggguauugaacagucuaggaaaaaugguccaucaaauauuuggaucagcuuauaccgccuuauucucuggaguaagcuggguaaugaaaauaggaaucgggguauuguuaacguggauaggacucaacagcaagaauacaucuaugaguuucucuuguauagccauuggaauaauuacucuauaucuuggugcaguaguacaagcagacauggguugcgucaucaacuggaaaggaaaagaauuaaaauguggaaguggaaucuuuguaacuaaugagguucacacauggacggagcaguauaaauuucaagcagacucccccaaacgucuagcgacagcaauagcaggagcgugggaaaauggcguuugugguauaaggaguacuacgagaauggagaaucucuuauggaaacaaauugcuaacgaacuaaauuauauucuaugggaaaauaauauuaaacuaaccguuguagucggagauauaaucggaguacuagagcaaggcaaacgaacacuuacgccgcaaccaauggaacucaaauacucauggaaaacuugggguaaagccaaaauugugacagcugagacccaaaauagcagcuuuaucauugacgggccaaauacaccggaaugcccaagugcgucaagagcuuggaauguaugggaaguugaggauuacggauuuggggucuucacgacuaauaucuggcugaaacucagggaaguguauacacaacugugugaccacagguuaaugagcgccgcagucaaggaugaaagagcaguacacgcagauaugggauacuggauagaaucucagaaaaaugguaguuggaaacuugaaaaagccaguuugauugaagucaaaaccuguacuuggcccaaaucacauacacuauggucaaaugggguccuagagagcgacaugauaauucccaaaucacuugcugggcccauaagccaacacaacuacagacccggguaucauacacaaacagcugguccauggcaucucgguaaguuagaauuagauuucaauuacugugaaggaacgacagucguuauuacagagaacugcggaacccguggcccgagucuaagaacaaccaccgucucagguaaauugauacacgagugguguugcagguccugcacucuuccgcccuugcgauacaugggggaggauggcugcugguacgguauggaaauacgaccaauuucggaaaaagaagagaauauggugaaaucauugguauccgcaggaaguggugagguugacaacuucacaaugggaguauuguguuuagcuauacuauuugaagagguuaugcggggaaaauucggaaagaaacauaugaucgcaggaaucuuuuucacauucguucuauuguuaagcgggcagauuacguggagagacauggcccauacccuuaucaugauagguagcaacgcaucagaccggaugggaauggggguuacauauuuagcguuaauagcuacauuuaaaauccaaccauuuuuggcuuuaggauucuuuuugaggaaauuaaccagcagagaaaauuuacucuuaggcgugggauuggcuauggccacuacucugcaacuaccggaggauaucgaacaaauggcaaacgguauugcccuuggucuuauggcacuaaaauugauaacucaauucgaaacauaccaauuauggacagcccuaaucucucuaacaugcucuaacacuauauucacguuaacaguagcguggagaacagcaacauuaauacuggcaggagucagcuugcugccaguaugucagagcucaagcaugcgaaagaccgauuggcuaccuaugacaguugccgcuaugggaguaccuccgcuuccauuguuuauauucucuuuaaaagauacucuuaagaggcggaguuggccacugaacgaaggagugauggcgguaggccugguaucaauauuagccagcaguuuauuacguaaugauguaccuauggcuggacccuuaguagcgggugguuuauugauagcuuguuauguaauuacagguacaagugcggaucuaacgguugaaaaagcagcggauguuacaugggaagaggaggccgaacagacaggagugagucauaacuugaugauaacuguggacgaugacgggacaaugcgaauuaaggacgaugaaacagaaaauauauuaaccguguugcuuaagacugcacuuuugaucguaagugggauauuuccuuacaguauaccagcuacauuguuaguuuggcacacguggcagaaacaaacgcaacguucagggguacuaugggacguaccaaguccaccagaaacgcaaaaggcagaguuagaagaaggagucuauagaaucaaacaacaagguaucuucgguaagacacaaguaggcguaggcgugcagaaagaaggugucuuucacaccauguggcacguaacccggggugcgguauuaacuuacaauggcaaaagacuagaaccgaacugggcaucagucaagaaagauuuaaucagcuaugguggugguuggagacuaagugcacaguggcaaaaaggagaagaaguccagguuauagcaguugaaccggggaaaaaccccaaaaacuuucagacgaugccagguaccuuccaaacaacaacaggagaaauuggagcaaucgcccuagauuuuaaaccaggaacaagcggcucuccuauaauaaacagggagggaaaaauugucgggcuuuaugggaacgguguaguuacuaagaauggcgguuacguauccggcauagcacaaacgaacgcggaaccagacgggccuacaccagaauuagaagaagagauguucaaaaagagaaaucuaacaauuauggaucuacauccaggcucgggcaaaacaagaaaauaccugccagcgaucguaagagaggcaauuaaaagacgacuacgcacccuaauccuugcaccaacaagggucguagcagccgaaauggaagaggcuuugaagggacuaccgauucgauaucagacuacagcgacaaaauccgaacacacaggacgagaaauaguagaucugaugugucacgcgaccuucacgaugcgucuacucaguccuguaagaguacccaauuauaauuuaauaauaauggacgaagcccauuucacagaccccgcgucuauagcagcacgugguuacauaucaaccaggguuggaaugggagaagccgcagcaaucuuuaugaccgcaacaccacccggcacggcagaugcguuuccgcaaagcaaugcgccuauccaagacgaagaacgagacauacccgaaagaucauggaacucugggaaugaauggaucacugauuuugcaggaaaaacugucugguucguuccuaguauaaaagccggcaacgauaucgcgaacuguuugagaaagaauggcaagaaaguuauucagcuaucacguaaaacauuugauacugaauaccaaaagaccaaguuaaaugauugggauuucguaguaacuacagacaucagugagaugggagcgaacuuuaaggccgaccgaguaauagauccccgucgaugccuaaaaccaguuauacugacagacggaccagaaagaguuauacuugcggguccuaugccugugaccgccgcaucugccgcacaacgcagggguagagugggcagaaacccacagaaagaaaaugaccaauauaucuuuacaggacaaccauugaacaaugacgaagaucaugcucauuggacugaagcuaaaaugcuacucgacaauauaaauacaccagaaggaaucauuccagcguuauucgaacccgagagagaaaagagcgcagcaaucgauggggaguacagacuaaaaggagaaagucggaagacauucguugaacuuaugagacguggcgacuuacccgucuggcucgcacacaaaguggcaucugaagggauaaaauauacugacagaaaaugguguuucgauggccagagaaacaaucaaauacuugaagaaaacauggacguagaaauuuggacuaaggaaggagagaagaagaaacuaagaccaagguggcuagaugcgagaacuuacucagauccguuagcccugaaagaauuuaaggacuucgcagcaggucgcaaauccauagccuuggaccugguuacggaaauuggacgaguaccaacccaucuugcacauaggacaagaaaugcccuugacaauuugguaauguuacauaccagcgaacacgggggaaaagcguaucgucaugcuguagaggaacuuccugaaacaauggaaacucuacuccuauugggauuaaugauuuuauuaacuggaggcgcuaugcuguuccuaaucucuggaaagggaauaggaaaaaccucaaucggccugauaugcguaauagcaagcucuggcauguuguggauggcagaaauaccgcuacaauggauagcuagcgcaauaguacuggaauuuuucaugaugguuuuauuaauucccgagccagaaaaacaaagaacgccacaagacaaccaauuggcauaugucgugauuggaauacuaacacuugccgcgauaaucgcagcuaacgaaaugggauuauuagaaacuacaaaaagagaccuaggcaugaguaaagaaccuggaguaguaucaccaacgaguuaucuugauguagacuugcauccugcaagcgcuuggacacuguacgcaguagcaacaaccgucauaacaccaaugcuuagacauacaauagaaaacucaacagcgaacguuucgcuagcggcuaucgcuaaucaagcaguaguucugaugggauuggacaaggguuggccaauuuccaagauggauuuagguguaccccuauuagcgcuugguugcuauagucaagucaacccucuaacucugacagcggcggucuuacuguuaaucacucauuaugcgauaauagggccgggcuuacaagcaaaagcaacaagagaagcacagaaaaggacagccgcaggaauaaugaaaaacccaacuguagaugguauaaugacaauagaccuugauccaguaauauacgauucaaaguuugagaaacaacucggccagguaaugcuuuuaguacuaugcgcgguacaguuguuguuaaugagaaccaguugggcgcuuugcgaagcacuaacuuuggcaacaggacccauuaccacauuaugggaagguuccccagguaaauuuuggaacaccaccaucgcggugucaauggccaauaucuucagagguuccuaucuagcaggggcuggcuuagcguucagcauuaugaaaucaguaggaacuggaaaaagggggacaggcucccagggagaaacgcuaggagaaaaauggaagaagaaacugaaucaauuaucgcguaaagaguucgacuuauacaagaaaucggguauuacagagguagaucgcacugaggcaaaagaaggucugaaaagaggggaaauaacacaucacgcaguaaguagaggauccgcaaagcugcaaugguucguugagcgaaacauggucaucccugaaggaagagucauagacuuagguugugggagaggugggugguccuauuauugcgccggguuaaagaaaguaacagaagugaggggauacacuaaaggaggacccggccacgaggaacccguaccaaugucaaccuauggguggaacaucgugaaacuaaugagugggaaagacgucuuuuauuuaccaccagagaaaugugacacucugcuuugugauauuggagagucgucaccaucaccuacgguagaagaaagcagaacgauaaggguccuaaaaaugguagagccuuggcuaaagaauaaccaauuuuguaucaaagucuuaaacccauauaugcccaccguuauagagcacuuagaaagauuacaacgaaagcauggaggcauguuaguuagaaacccacuaucccgaaauagcacgcaugaaauguauuggauauccaaugguacgggaaacauaguggcgagugucaauaugguaagcagacuauuacuaaacagauuuacgaugacacacagaaggcccaccauagaaaaagacguagaccuuggagcaggcacacggcauguaaacgccgaaccagaaacgccuaauauggacguuaucggcgaaagaauaaaaaggauaaaagaggaacauaauaguacuuggcacuaugaugaugaaaauccauacaagaccugggcauaucaugggucuuaugaagugaaagcaacugggucagcuucaucaaugauaaauggcgucguaaaacucuugacuaaaccaugggauguaguuccgaugguaacacagauggcaaugacagauacaacgccauuuggacaacagagagucuuuaaggagaagguagauacacgaacaccaaggucaaugccagguacaaggagaguaaugggaauuaccgcugagugguuguggcgcacauuaggccgaaacaagaaacccagauuguguacgcgugaagaguuuacaaagaaggugaggacgaaugcggcuaugggugcuguauuuacagaagaaaaucaaugggauucagcuaaagccgcaguagaagaugaagauuuuuggaaguuaguagacagagaacgagaacuacacaaacuaggaaaauguggaucgugcguauacaauaugaugggaaagagagaaaagaaguuaggugaguucggaaaagcuaaaggcaguagggccauaugguauaugugguuaggugcccgauacuuagaguuugaggcuuugggauuucucaaugaagaucacugguucucuagggaaaacagcuauagcggcgucgaaggggaggguuugcacaaauuaggcuauauccucagggacaucagcaaaauaccaggaggggcaauguacgcugaugauaccgcuggaugggauacuaggaucacugaggaugaucuacauaacgaggaaaagauuacgcaacaaauggauccagagcaccgacaauuagcaaacgccauauuuaaguuaacguaucaaaauaaaguaguuaaaguacagcgaccaacuccaaccgguacgguaauggacauaauaucccgaaaagaccaaagagggagcgggcagguaggaaccuacggucugaacacuuucacaaauauggaagcucagcuaauaagacaaauggaaggugaagggguacuaucgaaagccgacuuggaaaacccccaucuaccagaaaagaaaauaacacaguggcuagaaaccaaaggcgucgagcgcuuaaaaagaauggccauuaguggugacgacugcguuguuaaacccaucgacgauagauuugcuaacgcucuauuagcccugaaugauaugggaaagguuagaaaggauauaccacaguggcagccuucgaaaggauggcacgauuggcaacagguuccauucuguagucaucauuuccaugaacuuauuaugaaagaugggagaaaacuugugguaccaugcagaccucaggacgaauugauugguagagccagaaucucucaaggggcggggugguccuuaagggaaacagcauguuugggaaaggcuuaugcucaaauguggagccugauguauuuccacaggagagaccuaagacuugcaucaaacgccauaugcucagcgguuccuguucauuggguaccuacuagccguaccaccuggaguauucaugcccaucaccaauggaugacaacugaagacauguuaacuguuuggaauagaguauggauugaagauaauccauggauggaggauaagacuccaguaacaaccugggagaacguuccauaucuagguaagcgcgaagaucaaugguguggcagccuaauaggacuaacguccagagcaacuugggcucagaauauuccaacggcgauacagcaagugcguagcuugaucgggaaugaagaguuccuagacuacaugccaaguaugaaaagauuuagaaaggaagaggaaagcgaaggcgcaauaugguga

SEQ ID NO: 23398 - RNA, 9873 nt, Artificial Sequence
  derived and/or modified CDS sequence (opt6) from DENV-3__FJ639763__SS-prME
acaaguuugugucuuaugaugauccuaccggcagcuuuagcguuucaccuaacaucgcgcgacggagaaccccgaaugauagugggcaaaaaugaaagagguaaaagucuguuauuuaaaaccgcaucuggaaucaacaugugcacauugaucgcaauggacuuaggugaaaugugcgacgauacagucacguacaaaugcccucacaucacggaaguugaacccgaagacauugacugcugguguaacuuaaccuccacaugggucacauacgguacguguaaccaggcaggggaacacaggagagauaaaagaagcguagcccuagcuccacauguagggauggggcuagauacacgaacacaaaccuggaugucggcagaaggugcauggagacaaguagaaaaaguugaaacaugggcuuuaagacauccaggauuuacuaucuuagcccuauuccuagcacauuacauagggacauccuugacccaaaaagcaguuauauuuauuuuacuuauguugguuacgccaucuaugacaaugagauguguuggaguugguaacagagacuucguugaaggauuaaguggcgcgacauggguagauguuguacuugaacacgguggcugugugacaacuauggcuaaaaacaaaccgacacuagacauagaacuacagaaaacugaagcgacacaacuggcaacacuaagaaaauuaugcaucgaaggcaaaauaaccaacaucacuacugauucucgaugucccacacagggggaagcggucuuacccgaagaacaagaucaaaacuauguuugcaaacacacguacguugacagaggcuggggcaaugguugcggauuauuugggaaaggaagucucgugacaugugccaaauuucagugccuggaaccaauagaagggaaaguuguacaauacgaaaauuuaaaauauacaguaauuauaacgguacauacaggcgaucaacaccagguaggaaacgaaacacaaggaguaacagccgaaauuacuccacaagccaguaccacugaagccauacuaccagaauacggaacuuugggacuagaauguagcccgcguacaggucuugauuuuaaugaaaugauacuauuaacgaugaaaaauaaagcguggaugguacauaggcaaugguucuuugacuugccauuaccuuggacaaguggagcgacgacugaaacuccaacauggaaucgaaaagaguuguugguaaccuuuaaaaacgcucacgcgaagaaacaagaaguagugguacuagguucucaagaaggggccaugcauacugcacuaacuggggcaacggaaauacaaaauuccggcggaacaaguauauucgccggacauuuaaaauguagguuaaaaauggauaaauuagaauuaaaaggaaugucuuacgcaaugugcacaaauacguuuguacucaagaaagaaguuagugaaacucaacauggaaccauucuaaucaaaguugaauauaaaggugaagacguuccauguaaaauucccuucaguacagaggauggacaagggaaagcacauaauggacgcuugauuacagcaaauccaguggucacuaagaaagaagaaccagucaacauugaagccgaaccacccuuuggggagagcaauauaguuauaggcaucggagacaaugcccuaaaaauaaauugguauaagaaaggcaguucaauagguaaaauguuugaagcuacggcacgaggagcuagacguauggccauacuaggugacacagcuugggacuucggaucaguuggagguguauugaacagcuuaggaaaaaugguucaccaaauauuuggaagcgcuuacaccgcacuuuucucaggggugucgugggugaugaaaauuggaauaggaguuuuauuaacguggauuggacuaaauucgaaaaacaccaguaugucauuuucuugcauugcaauaggcaucauuacgcuauaccuaggcgcugucguacaggccgauauggggugugugauuaauuggaaagguaaagaauuaaaauguggaucgggaauauuugucaccaaugagguucacacauggacggaacaauauaaauuccaagcagauucuccaaaaagguuggcgacggcaauugccggugcuugggaaaauggaguauguggcauucgcucgaccacccggauggaaaauuugcuuuggaaacaaaucgcaaaugaacuaaacuauauuuuaugggaaaauaauaucaaacuuacuguagugguuggcgauauuauaggcguacuugaacaggggaagcgcacacugaccccucaaccaauggagcuuaaauacuccuggaaaacguggggcaaggcuaaaauaguaacagcagaaacucaaaacagcucauuuauaauagaugguccuaauacuccagaguguccaucagccucgagagcuuggaauguaugggaaguagaggauuauggcuucggaguguucaccacaaauaucugguuaaaauuaagggaggucuacacacaacuaugugaccaucgcuuaaugucagcggcuguuaaagaugagagagcaguccaugcagauaugggcuacuggauugaaucccagaaaaacggaagcuggaaacucgaaaaagcuagucuaauugagguaaagacauguacauggccuaaaucucacaccuuauggagcaaugguguccuugagucagacaugauuauacccaagucacuggcaggacccauaagccaacauaauuaucgacccggauaccauacucaaaccgcuggcccuuggcaucucggcaagcuggaauuggauuuuaauuauugcgaaggaaccacagucguuauuacagaaaacugugggacaagaggaccuagccuacgcacuacgacaguaagcgggaaacuaauacaugaaugguguuguagaucuuguacuuugcccccacuacguuauaugggggaggacggguguugguacgguauggaaauucguccaauuucggaaaaggaagaaaauauggugaagucguuaguaucugccgguucaggggaaguagacaauuucacgauggggguacuguguuuagcgauauuguucgaagaaguaaugagaggaaaguuuggcaagaaacauaugauugcaggaguauucuuuacguuuguauuauuacuuagugggcagauaacguggcgagacauggcacacacgcugauaaugauagguaguaaugccagcgauagaaugggcaugggaguaacauauuuagcauuaauugccacuuuuaaaauccaacccuuucuugccuugggcuucuuucuuagaaaauuaacuucaagagaaaacuuacugcuaggaguaggauuggcaauggccacuacauugcaacuucccgaggacaucgaacagauggcaaaugggauagcacuuggauugauggcccuaaaauuaauaacucaauuugaaacauaccaauuauggacagccuuaauuucuuuaacaugcucaaacaccauauucacccuaacuguggccuggagaacagcgacacucauuuuggcugguguaucgcuguuaccggugugccaaaguuccucaaugagaaaaacagauugguuaccuaugaccguugcagcgauggggguaccuccgcuaccccuguucauauucagucuuaaagacacucucaaacgaagauccuggcccuuaaaugaaggugugauggcgguuggauuaguuucaauacuagcaagcaguuuauuacguaacgauguuccaauggcuggaccacuuguugcgggcggauuacuaaucgcauguuacgucauuacaggaacaagugcugaucuuacgguugagaaggcagcagaugugaccugggaagaagaggcggaacaaacuggagucucccauaacuuaaugauuacuguagaugaugaugguacgaugcguauaaaagaugacgaaacugaaaauauucucacaguacuacuuaaaacagcauuauuaauagucucggggauuuuuccauauaguauaccggcaacucuuuuaguuuggcacacauggcaaaagcagacccaacguagcggaguucuuugggacguuccuucaccaccagaaacucaaaaggccgagcuagaagaaggugucuaccgaaucaaacaacaaggcauauucggcaaaacacagguagguguaggcguccaaaaagaaggcguauuucauaccauguggcauguaacacgaggugcgguccuuacuuauaauggcaaaagacuagaaccuaacugggcauccgugaagaaagaucugauuucguacggagggggauggcgucuaagugcacaguggcaaaaaggagaggagguacaggucauugccguagaacccgguaaaaauccgaaaaacuuccaaacgaugccagguaccuuccaaaccacgacaggagaaaucggugcuauugcccuagauuucaagccuggcacaucggggagcccaauuauaaaucgugaggguaaggugguaggauuauacgggaauggagugguuaccaaaaaugguggauauguuucaggaauugcucaaaccaacgcagaaccggacggaccaacaccagaacuagaggaagaaauguucaaaaagagaaauuuaaccauaauggacuuacacccaggaagcggcaaaacuagaaaguaccuuccagcuauaguaagggaagcaauaaaaagaagguugcguacacuuaucuuggcuccaacaaggguaguugcagcggaaauggaagaggcccuuaagggacuacccauaagguaucagaccacugcaacaaaaucagaacauacgggacgcgaaaucguagaucuaaugugucacgccacguucaccaugcgacugcucucgcccguccgcguaccaaauuacaaccuaauuauuauggaugaagcccacuuuacugacccagcaaguauugcagcaagggguuacauaaguacaagggugggaaugggagaagcagcagcaauauucaugacugcaaccccacccgguacggccgaugcauuuccacagagcaacgcccccauucaagacgaagagagagauauaccugaaagaucauggaacucaggaaaugaguggauaacagauuuugcaggcaagacaguaugguuuguaccaaguauuaaagcagguaaugauauugcuaacugccugcgcaaaaaugguaaaaaggugauacaauugucacgaaaaaccuuugauacggaguaucagaaaacaaaauuaaaugacugggauuuugugguuacaaccgauauaagcgaaaugggagcaaauuuuaaggccgauagaguaaucgauccgaggcgauguuugaaaccaguuauacugaccgauggaccagaacgggucauauuagcaggaccaaugccaguaacagccgcgagugcagcacaaaggagaggacgcgugggucggaacccgcagaaagaaaacgaucaguauaucuuuacuggccaaccccuuaauaaugaugaagaccaugcucauuggacugaagcgaaaauguuguuagauaauaucaauacaccagaaggaauaauacccgcauuauuugaaccugaacgugagaaaagcgcugccauugacggugaauauagacuaaagggagaaucucguaaaacguucguagaauuaaugcgccgcggagauuugccuguuuggcuggcacacaaaguagcuagugaagggauuaaguauacggauaggaaaugguguuucgacggccaacgaaauaaucagauauuagaagaaaauauggacguggagauauggacgaaagagggcgagaagaagaaacuuagaccuagguggcucgaugcaagaacauauucugacccucuugcacuaaaggaguuuaaggacuuugcugccggaagaaagucaauagcccuagacuuaguaaccgagaucggaagaguacccucucaucuggcacacagaacccguaaugcacuugacaauuuggucaugcuacauacaagugaacauggagguaaagcauaccgacacgcaguugaagaacuacccgaaacaauggagacccugcuucuacuaggauuaaugaucuuauuaacagggggcgcuauguuauuuuugaucagcgggaaaggcauagggaagacaaguauaggucuuauaugugucauagccucaucaggaauguuauggauggcugaaauuccucugcaauggauugcaucagccauaguacuagaguucuuuaugaugguacugcucauaccagaacccgaaaaacagaggaccccucaagauaaucagcucgcauacgugguuauugguauauugacacuggcggcaauaauagcggcuaacgaaauggguuugcucgaaacuacaaagagggaucuuggcaugucgaaagaaccugggguugugucaccuacaucguauuuagauguagaucuccacccggcaagugcauggacguuauacgcuguagcaacgacuguuauuacuccaaugcucagacacacaauagaaaauucuacugcgaauguaucucuagcagcgauugcuaaccaagcgguuguguugaugggacuugauaaagguuggcccaucucgaagauggacuuaggaguaccccuccuagcgcuagguuguuacagccagguaaacccguugacacuuacugcagccgugcuacuauuaaucacacacuacgccauaauaggaccuggguuacaggcuaaagcuacacgagaagcgcaaaaacggacugcugcaggaauaaugaaaaauccuacaguagaugguauaaugacaauagauuuggacccaguuauuuaugacagcaaguuugaaaaacaauugggucaagucaugcuuuugguacuaugcgcaguacaacuauuauuaaugaggacaucgugggccuuaugugaagccuuaaccuuggcuacaggacccauaaccacccugugggaggguagcccagggaaguuuuggaauacgacaauugcugugucaauggcuaauauauuucgcggaucauacuuagcgggagccggauuagcguuuuccauuaugaaaucggucggaacuggaaagcgcgguacaggaucacaaggugagacauuaggugagaaguggaaaaagaaguuaaaccaacuaagucguaaggaguucgacuuauacaagaaaagcggaauuacugaaguugauagaacagaagcaaaagaaggauuaaaaagaggagaaauuacucaccaugcuguaaguaggggauccgcgaaacuacaaugguuuguggagaggaauaugguuauaccagaggguagaguuauagacuuagguugcggaagaggaggauggucauauuacugugcuggccuuaagaaaguuacagagguuagaggauauaccaagggcgggcccggacaugaagaaccagucccaaugaguacuuauggauggaauauaguuaaacuaaugaguggaaaagauguuuucuaccuucccccagaaaaaugcgacacguuguuaugugauaucggagaaucaucaccaucgccaacuguagaagaaagccggacgauucgaguucuuaaaauggucgaaccuuggcuuaaaaauaaucaauucugcauuaaaguacuaaacccauauaugccgacuguaauugagcauuuggaaagacuccaacgaaaacauggagguauguuagugcgaaauccauuaagcaggaauaguacacaugaaauguauuggauuaguaacggcacaggcaauauaguagccagcguaaauaugguuaguagacugcuccugaaucgauuuacaaugacacacagaagaccgacaauugagaaagacguagaccuuggagcaggaaccagacacgucaaugcugaaccggaaacaccaaauauggacguuauaggugagcgaaucaagagaauaaaagaggaacauaacucaacauggcacuacgacgaugagaauccguauaaaacuugggcuuaucacgggaguuacgagguaaaggccacaggauccgcgaguucgaugauuaauggcguagucaagcuccuaacaaaaccgugggauguuguaccuaugguaacucaaauggcuaugacagauacuacucccuucggacaacaacgaguuuuuaaagaaaaaguggauacucgaacgccaaggucuaugccgggaacaaggagaguaaugggcauaacggccgaauggcuauggagaacucucggaagaaauaagaaaccgcguuugugcacgagggaagaauuuacgaagaaaguacguacaaacgcugcuaugggcgcuguauucacggaagaaaaucaaugggauagugcgaaagcagcaguugaagaugaggacuucuggaaguuaguagauagggaaagagaauugcauaagcuagggaaauguggaucgugcguguauaacaugauggguaagagagagaagaaauuaggugaauuugggaaagcuaaaggaagcagagccauaugguauauguggcugggggcaagauaccuagaauuugaggcucugggguuucuuaacgaagaccacugguuuagcagagaaaauucauauucugggguugaaggagagggacuccauaaacugggcuacauacuucgcgauauaagcaaaauuccgggaggagcaauguaugcagacgacacagcaggaugggauacacgaauaacugaagaugaucugcauaacgaagagaaaauaacacaacaaauggacccagaacaccgacagcuagcaaaugcaauauucaaacuaacuuaccaaaauaaagucguuaaaguacaaagaccuacuccaaccggcaccguuauggacaucauaucuagaaaagaccagcguggaucaggacaaguagguacauauggacugaacacguucacuaauauggaagcacaauuaauaagacaaauggaaggagaaggaguccugucuaaggccgacuuggaaaacccucauuuaccagagaagaaaauuacgcaaugguuagaaacgaauggcguagagagauuaaaacgaauggccauuaguggcgaugauuguguaguuaaacccauagaugauagauuugccaaugcacuccuugcacuuaacgauauggggaaaguccgaaaagacauuccgcaauggcagccgucgaaaggauggcaugacuggcaacaaguaccauuuuguagucaucauuuucaugaauuaauaaugaaagacgguagaaaacucguugucccguguaggccucaagacgaauuaauugggcgggcuaggaucagucagggagccggauggucguuacgagaaaccgcgugccuaggaaaggcuuaugcucaaauguggucacuuauguauuuucacagacgggaucugcgucuagcguccaacgcuauauguagugcaguucccguucacuggguaccuaccagcagaacaacuuggucaauucaugcacaucaucaauggaugacuacagaagauauguugacgguuuggaaucguguauggauagaagauaauccguggauggaagauaagacaccaguuacuacgugggaaaacguuccguaccuaggcaaacgcgaagaccaaugguguggcucgcuuauuggacucacaucgcgugcgacaugggcccagaauauaccaacagcuauacaacaaguacgaagccuuauagguaaugaagaauuuuuagacuauaugccaucaaugaagcguuuuagaaaagaagaagaaagcgagggugccaucugguaa

SEQ ID NO: 23399 - RNA, 9873 nt, Artificial Sequence
  derived and/or modified CDS sequence (opt6) from DENV-3__FJ639765__SS-prME
acaagucuaugcuuaaugaugauucuuccugcugcuuuagcuuuucaucucaccucucgagauggugaaccacgaaugaucguagguaaaaacgaaagaggcaaaucucuccuauucaaaacugcuagugguauuaauauguguacguugaucgcaauggauuuaggagagaugugugaugacacgguaacguacaaauguccucauauaaccgaagucgaaccagaagacauugauuguugguguaacuugacuucgaccuggguuacuuaugggacaugcaaucaagcaggagaacaccggcgugauaaacggaguguagcacuugcaccacauguggguaugggauuagacacuagaacacaaacuuggaugagugcggaaggugcguggcgacaaguagaaaaaguagaaaccugggcgcuaagacaucccggauucacuauacuggcgcuauucuuagcucacuauauagguacaucauuaacccaaaaaguuguaauauucauacuacucaugcuuguuacccccaguaugacgaugagguguguuggagucgggaaucgugacuuuguagagggacuuucaggcgcaacguggguagaugucguacuugagcauggcggaugcgugacgacgauggccaaaaauaaaccuacucucgauauagaacuacagaaaacggaggcuacccaauuagcuacucuaagaaaauuauguauagagggaaaaauaacuaauauuaccaccgacaguagauguccaacucaaggcgaagcaguacucccggaagaacaagaccagaacuauguuugcaaacauaccuauguagaucguggcuggggaaauggaugugguuuauuuggcaaaggaucgcuugucacgugugccaaauuccaaugucuagagcccauagaggguaaaguaguucaauaugaaaauuugaaauacacaguaauaauaaccguacacaccggggaccaacaccaaguuggaaacgagacacagggagucaccgcugaaaucacaccacaagcgaguaccaccgaagcaauucugccggaguacggcacacuuggccuggaaugcaguccacgaaccggucuagauuuuaacgaaaugauucuacuaacgaugaaaaauaaagccuggaugguucacagacaaugguucuuugaccucccccuacccuggacuucaggagcaacaacagaaacaccaacuuggaaccgaaaagagcuccuuguaacguuuaaaaaugcucaugccaagaaacaagaaguuguaguccuaggcagccaagagggugcgaugcauacagcacuaaccggcgcaacagagauucaaaauagcggaggaacaaguauauucgcuggucauuuaaaaugucgcuugaaaauggauaaacuugaacuaaaaggcaugaguuaugcaauguguaccaauaccuuuguacuuaagaaagagguaagugaaacacagcauggaacaauacuaauuaaagucgaauauaaaggagaagacguuccauguaaaauuccauuuuccacagaagacggacaagggaaagcucauaauggacgacugaucacugcaaauccgguaguuacuaaaaaggaagaaccgguuaauaucgaagcugaaccuccuuuuggggagucuaacaucguaauaggaauuggggauaacgcucuuaaaauaaauugguacaaaaagggaagcucaauaggaaagauguucgaggcuaccgcucgaggagcacguagaauggcaauucuuggagauacggcuugggauuuuggaucaguuggagguguacuaaauucucugggcaaaaugguacaccaaauuuuuggaucugcuuauaccgcauuguuuucaggaguaucaugggucaugaaaauaggaaucggagugcuucugacguggauugggcuuaacagcaaaaauacgaguaugucguucucauguaucgcgauugguauaaucacacuuuauuugggcgccguaguacaagcggauaugggaugcgucauuaauuggaaaggcaaggaacuaaaaugcgggucaggaauauuuguaacaaaugaagugcauacuuggacugaacaauauaaauuucaagcagauuccccaaagcgacuagcaacugccauagcuggcgcaugggagaauggcguuuguggcauccgaucaacaaccagaauggagaaccucuuguggaagcagauagcaaaugaacuuaauuacauuuugugggaaaauaauauaaaacugacagucguugucggggacauaauuggagugcucgaacaaggaaaacgcacacuuacuccacagccgauggaacuaaaguacaguuggaaaaccugggggaaagcuaaaauaguuacggcagagacccaaaacaguaguuucauaaucgauggaccgaacacgccggaauguccgucagcaagcagagcauggaauguaugggaaguagaagauuacggcuuuggugucuuuaccacaaauauuuggcuaaaacucagggaaguguauacccaauuaugcgaucauagacuaaugucagcagcaguuaaggaugaacgugccgugcacgcagacauggguuacuggauagaaucacaaaagaauggaagcuggaagcuagagaaagcuaguuuaauagaaguaaagacauguacguggccgaaaagucauacguuauggucuaauggaguauuagaguccgacaugauuauuccaaagagccuagcuggcccgauaagucaacacaacuaccgaccugguuaucacacucaaacugcaggaccauggcaccucgguaagcuagaacuagacuucaacuauugcgaaggcaccacaguugucauaacggaaaacuguggcacaagagggccaagccuacgaacuaccacaguaucaggcaaacuuauucaugaaugguguugucguaguuguacauuaccuccucuaagauauaugggagaagaugguugcugguacggaauggagauacgaccgauaucagaaaaggaagagaauauggugaaaagccugguauccgcaggaucgggagaaguagauaacuucacaauggguguauuaugucuggcaauccuauuugaagaaguaaugagagguaaauuuggaaagaaacauaugauagcggguguauucuuuacuuucguuuuacuacuaagugggcaaauuacuuggagagauauggcucacacacuuauaaugaucggaagcaacgcuucugaucguaugggcaugggagugacuuaucuggcccucauugcaacuuuuaaaauucaaccauucuuagccuuaggauuuuucuuaagaaaauuaacaagucgugagaauuugcuacugggcguggguuuggcuauggcgacgaccuuacaacuuccagaagacaucgagcagauggcuaacggaaucgcacuuggacugauggcacugaaacucauuacacaauucgaaacuuaccaacuuuggacggccuuaauaucuuuaacguguucaaauacgauuuucacuuuaacgguagcguggcgcacggcuacccuaauacuagcuggaguuucccuuuuaccugugugucaaagcucuaguaugagaaaaacugacuggcuaccaaugaccguggcagcgauggggguuccaccccugccgcuauuuauauuuagucuaaaggauaccuuaaagcggagaagcuggccacugaaugagggcguaauggcgguuggccuagucucaauauuagccucuagccuuuuaagaaaugacgucccuauggcggguccacugguagcggguggauugcuuauugcuuguuauguuaucacagguacaagugcugaucuaacggucgaaaaggcugcugauguuacuugggaagaagaggcagaacaaacgggugucucucauaaucugaugauaacgguagaugaugauggaacaaugaggauaaaagaugaugaaacugaaaauauucuuacaguacuucuaaagacggcauuacuaaucguaaguggaauauuuccauacaguaucccagcaacgcuauuaguuuggcauacuuggcaaaaacagacccagagaaguggaguucuaugggaugugccaucaccuccagaaacacagaaagccgaauuagaagaaggcguauauagaaucaaacaacagggcaucuuugguaaaacacagguugguguaggaguucaaaaagaaggaguauuucauacuauguggcacgucacuagaggagccguacuaacuuacaacggaaagcgguuagaaccaaacugggcuaguguuaaaaaggaccucauuucauacggagguggguggcgucuaucugcacaauggcaaaaaggggaagaaguucaagucauagcaguagaaccugguaagaauccgaaaaacuuccaaacuaugccaggaacauuucagacuacgacuggggaaaucggagcgauagcgcucgauuucaagccagggacuagcggcuccccaauuauaaauagagaagguaaaguugucggauuguaugggaacggaguugucacgaaaaauggcggauauguuucaggaauugcccagaccaacgcagaaccugaugguccaacuccagaacuagaagaagagauguucaaaaagagaaaucuaacuauaauggauuugcauccagggucaggcaagacccggaaguacuuaccggcaauaguaagagaagcgaucaaaagaagauuaagaacucuuaucuuagcgcccacaagggugguugcagccgaaauggaagaggcccuuaaaggccugccaauaagguaucaaacuacugcuacaaagucagaacauacggggcgagaaauaguugaccucaugugucacgccacauuuacuaugagacuauuauccccgguaagaguccccaauuauaauuuaauaauaauggaugaagcacauuuuacggauccugcaucaauagcugcaagagguuauauaucaacucgugucggaaugggagaggcugcggcaauauuuaugacugcaaccccuccagguaccgccgaugccuuuccucaguccaaugcuccaauacaagaugaagaaagggacaucccagaacgaucauggaacagcggaaacgaauggaucacugacuucgcagguaaaacugugugguuuguuccaaguaucaaggcaggaaacgauauugcaaauugccugcgcaaaaaugggaagaagguaauucaacuuaguagaaaaacauucgacacagaauaucagaagaccaaguugaacgauugggauuuuguugucacaacagauauaagugaaaugggcgcaaacuucaaggcugaucgaguaaucgaucccagacgaugucuaaaacccguaauauugacugaugguccagaaaggguaauacuagccggucccaugccgguaacggcagccucugcugcucaacgacgaggccgugugggacgaaacccccaaaaagaaaacgaccaguauaucuuuacaggacaacccuuaaacaaugaugaagaucacgcacauuggacagaagcuaaaaugcugcuggauaacauaaacacgccagaaggaaucauuccggcucuuuuugaacccgagagagaaaagagugcagcuaucgacggugaauaccgcuugaaaggugaaucucguaaaacauucguugaacuaaugaggcgaggugacuuacccgucuggcuagcacacaagguagcauccgaaggcaucaaauauacugaucgaaaaugguguuucgauggacaaagaaauaaccaaauucuugaggaaaacauggacguagaaauuuggaccaaagagggagagaagaagaaauuacggccaagguggcuggaugcccgcacuuacucagauccuuuagcauuaaaagaauuuaaagacuuugcagcggggaggaaaaguauagcauuagauuuaguaacagagauuggacgaguucccacacaccuagcucauaggacaaggaaugcacuagauaaucucguaaugcuacacaccucagaacacgguggaaaagcauauagacacgcuguugaagaauugccagagacgauggaaacauuacuccuauuggguuugaugauuuuauugacuggaggagccaugcuguuucucauaaguggaaaagggaucggaaaaacauccauaggauuaaucuguguuauugcuucaaguggaaugcuauggauggcagaaauaccauugcaauggaucgccagcgccauuauccuagaguucuuuaugaugguauuacucauacccgaaccagaaaaacaacggacuccacaagacaaccagcucgcauacguuguuauuggaauccuuacacucgcagcuauaaucgcagcaaaugaaaugggauuacuagagacuacgaagagagauuuaggcaugaguaaagaaccaggaguaguaucaccuacaucauauuuagaugucgauuugcauccagccucagcauggacauuguacgcaguagcuacgacaguaauaacuccaaugcuaagacacacaauagaaaauuccacagcuaaugugucauuagcugccauagcaaaccaagcgguuguccuaaugggacuggauaaagguuggccaauaucaaaaauggaccuaggugugccacuauuggcucuggguugcuauucacaaguaaauccucuaacacuaacagccgcaguccuuuuacuaauaacucauuacgcuaucauaggaccuggauuacaagcaaaagcuacucgagaagcacaaaaacgcacagcagcagguauaaugaaaaacccaacaguggaugggauaaugacuauagacuuagauccuguuauauaugacaguaaguuugaaaagcaacuaggucagguaaugcuccuaguccuaugugcuguccaacucuuguuaaugcgaacaucuugggcacuaugcgaggcgcuaacguuagcgaccggaccaauuacuacauugugggagggaucacccggaaaauuuuggaauacaacuauugccguuucuauggcaaacaucuuucgggguaguuauuuagcaggagcaggucucgcguucucaauaaugaaauccguggguacuggaaaacgugggaccgguagucaaggagaaacauuaggagaaaaauggaagaagaaauuaaaucaauuaagccgaaaagaguucgauuuauauaagaaaucagguauaacugaagucgauagaacagaggcaaaagagggacuaaaaaggggugaaauuacgcaucaugccguguccagaggcuccgcaaaacuacaaugguuuguggaacguaacaugguaauaccugagggcagaguaauagaucucgggugcggucgaggggguuggucguacuauugcgcuggacuuaagaaaguuacugaaguacguggcuauacaaaaggagggcccggacaugaggaaccaguuccgaugucaacauauggauggaauaucguuaagcuaaugagcggaaaagauguauuuuaccuaccuccagaaaaaugugauacuuuacucugugacaucggcgaauccucacccucaccuacuguggaggagucucgaaccauucgagugcuaaagauggucgaaccauggcugaaaaauaaccaauucuguauaaaggugcugaauccuuauaugccuaccgucauagaacauuuagagcgccuccaaagaaaacaugguggaaugcuagucagaaauccauugucccgaaauagcacacaugaaauguauuggauuucaaauggaacuggaaacauaguagcuucaguuaacaugguaagccgccucuuauuaaauagguuuacuaugacucauaggaggccaaccauagagaaagacgucgauuuaggagcaggaacucgucacgugaacgcagaacccgaaaccccuaauauggacguaauuggagaaagaauaaaaaggaucaaagaagaacacaauucaaccuggcauuaugacgaugaaaaucccuauaagacaugggcauaccacgggucauacgaagugaaagcaacaggaucggcgaguucaaugauaaacggcguaguuaaacuauugaccaaaccgugggauguagugccuauggucacccaaauggcgaugacugauacuacaccuuucggucaacaacgaguauuuaaagaaaaggucgauacccgaacuccgcgcucuaugccgggcacaagaaggguaauggguauuacugcagagugguuauggagaacgcuagguagaaacaagaaaccaagauuauguacaagagaagaguuuacuaagaaagucagaacgaacgcggcgaugggcgcgguguucaccgaggaaaaucaaugggauagugcuaaagccgcugucgaagaugaagauuuuuggaaauuaguagauagagagcgagaguuacacaagcucgguaagugcggaagcuguguuuauaauaugauggguaaaagagagaagaaacuaggugaguuugguaaagcuaaaggaaguagagccauaugguacauguggcuuggagcccgauauuuggaauuugaagcgcucggcuuccuaaacgaggaucauugguuuagucgagagaacaguuacaguggaguagaaggagagggacugcauaaauuaggauacauauugagagauauauccaaaaucccagggggcgcgauguaugcggacgauacggcagggugggauacuagaauaacugaagacgaucuucauaacgaagagaaaaucacgcagcagauggauccggagcacagacaacuggcgaaugcgauuuuuaaacuuacauaucaaaacaaaguuguuaaaguccaacgaccaacaccaacaggaacaguaauggauauaauauccagaaaagaccaacggggaucaggacaaguuggaacauacgggcuaaacacuuucacuaacauggaagcacaacuaauccggcagauggaaggugaaggcguacuaagcaaagcugaucuugaaaauccccaccucccggagaagaagauaacccaauggcuggaaacaaaagguguggagcgauuaaaaagaauggcuauaagcggagaugauuguguuguaaaaccaauagaugauagguuugcaaacgcacuucucgccuuaaaugauaugggcaaaguaaggaaggauauaccacaauggcagccuucaaaaggcuggcaugauuggcaacaaguucccuucugcagucaucauuuucacgaacucauaaugaaagacggaagaaaauuagugguaccgugucgaccccaagacgaauuaauaggucgagcuagaauaucacaaggcgcgggauggagccuacgcgagaccgccuguuuagguaaagccuaugcacagauguggaguuuaauguacuuucaccgacgggaucuuagauuagcgucaaaugcuauaugcagugcugucccuguucauuggguccccacaucacggacaacguggucaauacaugcucaucaucaauggaugacaacagaagacaugcucaccguuuggaauagaguauggauagaggacaacccauggauggaagauaagacaccaguaacaacgugggaaaaugucccauaucuaggaaagagagaagaucagugguguggaucuuuaauugggcugacaucaagagccacgugggcacagaacauaccuaccgcaauucagcagguacgaagucuuauaggaaaugaagaauuuuuggacuauaugccuucgaugaaaagauucagaaaagaagaagagucagaaggggcgauaugguag

SEQ ID NO: 23400 - RNA, 9873 nt, Artificial Sequence
  derived and/or modified CDS sequence (opt6) from DENV-3__FJ639766__SS-prME
accucucuuugccuuaugaugauccucccugcagcuuuagcuuuccacuuaacaagccgagacggagaaccaagaaugauuguugggaaaaacgaaagagggaaaagccuuuuauuuaaaacagcaucagggauuaacauguguacgcuuauagcaauggacuuaggggaaaugugugaugacacgguuacuuauaaauguccacauaucacggagguggaaccugaagacauagacugcuggugcaauuuaacaucuacguggguuacauaugggaccuguaaucaagcaggggaacaccggcgugauaaacgaucuguggcauuagcaccacacgucggaaugggguuggacacgagaacucaaacauggaugagcgcagaaggggcuuggagacaaguagagaaaguugagacaugggcuuugagacauccuggauucacaauucuugcgcuauuuuuagcucacuauauaggaacaucauuaacacaaaaaguaguaauauucauacuuuuaaugcucguuacaccgucaaugaccaugcgaugcguagggguuggaaaucgugacuuugucgaagggcuuagcggagcaaccuggguggaugucgucuuggagcacggaggauguguaacaacaauggccaaaaacaaaccaacucuagacauagagcuucagaaaacagaagccacacaacuugcaacccucaggaaacuauguauagagggaaaaauuacaaacauaacgacugauucccggugccccacucaaggggaggcggucuugccagaagaacaagaccagaauuauguauguaaacacacauauguagaccgaggguggggaaauggcuguggauuauuuggcaaaggaaguuuaguaaccugcgcuaaauuucaguguuuagaaccuauugagggcaaaguugugcaauaugaaaauuuaaaauauacuguaauaauaacuguccauacaggagaccaacaucagguugguaaugaaacgcaaggggugacagcagaaauaacgccucaagcaucuacaacggaagcaauucuaccggaauaugggacauuagguuuagagugcagcccuaggacaggccucgauuuuaaugaaaugauacugcugacaaugaaaaauaaagcauggaugguccaccgucaaugguucuucgauuuaccauuaccguggacgaguggagcaacaacugaaacaccgacuuggaaccguaaagaacugcuagugacguucaaaaacgcccaugcgaagaaacaagaaguagucguuuuggguagucaagaaggggcuaugcacaccgcacucacuggagcaacugaaauccaaaauuccggcggaacuucaauuuuugcgggucauuuaaaguguagauuaaaaauggauaaguuagagcuuaaagguaugucuuaugcgauguguaccaauacuuuuguauuaaagaaagaagucucugagacgcaacauggcacuauacuaauuaaaguagaauacaaaggugaggacgucccauguaagauuccauucaguacggaagaugggcaaggaaaggcacauaaugguagacuaauaacugcaaauccaguaguuacaaagaaggaagaaccaguaaauauagaagcggaaccucccuuuggagaaucuaauauaguuauuggcauaggagacaaugcauuaaaaauuaauugguacaaaaagggcuccucaauaggcaagauguuugaggcgaccgcaagaggcgcaagacgaauggcaauuuuaggugauacagcgugggacuuuggaucaguagggggaguauuaaauagcuuaggaaagaugguacaucaaauauuugguucagcguauacugcauuauuuucaggagucucaugggucaugaagauuggcaucggaguacuacuuacuuggauuggacuaaauaguaaaaacacuagcaugaguuuuuccuguauugccauagguauaauuacucuguaccuaggagcaguaguccaagcggauauggggugugugauaaauuggaaagguaaggaauuaaaaugcgguagcgguauuuuugugacaaacgaaguccauacguggacagagcaauauaaauuucaagcagauagcccaaaaaggcucgcgaccgcgauagcuggagccugggaaaauggagucugugggauucgaaguaccacaagaauggagaaucuuuuguggaaacaaauugccaaugaauuaaauuauauuuuaugggaaaauaauauaaaacuaacagugguagucggagauauuauaggaguguuggagcagggaaagagaacucugacuccacaaccgauggaauuaaaguauucuuggaaaacguggggaaaagcgaaaauaguuacugcugagacacagaacuccucuuucauaauagacggaccaaacacacccgaauguccguccgcuagcagggcuuggaaugugugggaaguugaggacuaugguuuugguguuuucacaacuaacauaugguugaagcugagagagguuuauacacaauuaugugaucacagacuaaugucugcggcgguaaaggaugaaagagcaguacaugccgacaugggauacuggauugaaucucagaaaaauggaaguuggaaguuggaaaaagccagcuugauagagguaaaaaccuguacguggccgaaaucccacacgcuuuggaguaauggcguguuggaguccgauaugauaauaccaaaaucauuggcgggaccgauaucacaacauaauuacagaccuggauaccauacucaaacagcagggccauggcaccucggcaaguuggagcuggacuucaauuacugugaaggcacaacaguuguaauuacugaaaacuguggaacucgcgggccuucauugcgaacaacgacuguuucagggaaauugauacaugagugguguugcagauccugcacguuacccccacuaagauauaugggagaggacggauguugguauggcauggagauaagaccgauuagcgaaaaagaagagaacaugguaaaaucccuugucuccgcuggaucaggagaaguggacaauuuuacaaugggaguacuauguuuagcuauucuguuugaagaaguaaugcgaggcaaauuuggcaagaaacauaugauugcuggugucuuuuucacauucguccugcuacuaagcggacaaaucacauggcgagacauggcacauaccuuaauaaugauuggcagcaacgcaagugaucguaugggaaugggagucacuuaccucgcauugauagcuacauuuaaaauacaaccauuuuuggcgcucggauucuuucugaggaaacuaacaucgagagaaaauuuacuauuaggaguggguuuggcaauggcaacaacccugcaacuaccagaagauaucgaacaaauggcaaacggaauagcauugggacugauggcucuaaagcuaauuacgcaauuugaaacguaucaauuguggacagcuuuaauaagccugacauguucaaauacgaucuuuacauugacaguggcguggagaacagcgacauugauccuagcuggugucagucugcugccaguuugucaaaguucgaguaugagaaaaacggauuggcuaccaaugacagucgcagccauggguguuccaccacuaccgcuguuuauauuuaaucuaaaggauacauuaaaacgucgaucuuggcccuuaaaugaaggugugauggcuguuggucuagucagcauccuagcgaguagucuucugagaaacgaugucccuauggcagguccauuaguugcaggaggucuucuaauugcuugcuauguuauuacuggaaccucagcagaucuuacggucgaaaaagcugcggauguaaccugggaggaagaagcagaacaaacuggaguuucccauaacuuaaugauaacgguugacgaugacgguacgaugagaauaaaagaugacgagacugaaaauauacuaacaguguuauuaaaaacugcucucuuaauugucucaggaauauuuccuuauagcauaccggcaacguuauugguauggcauacuuggcaaaagcaaacucaaagaaguggcguccuaugggauguaccuuccccgccagaaacacaaaaggcugaacuagaggaggguguauaccgaauaaaacaacaaggcauauuuggcaaaacgcagguuggaguaggaguucaaaaagaaggggucuuucauaccauguggcacgugacgaggggagcgguacuaacauauaauggcaaaaggcuagaaccaaauugggcaagcguuaagaaagacuugauaucuuacgggggaggauggaggcugucugcccaauggcaaaaaggagaagaaguacagguuaucgcgguagagccaggcaaaaacccuaagaauuuucaaacuaugccaggaacguuucaaacaaccacaggagaaauuggggcuaucgcccuugauuucaaaccggguacuucggguucaccaaucauaaacagagaagguaaaguagugggucuauauggaaacggaguaguaaccaaaaaugggggcuaugugaguggaauagcacagaccaaugcggaaccagacggcccaacgccagaauuggaagaggaaauguuuaagaaaagaaaucuaacaauaauggacuugcacccgggaagugguaaaacgcguaaauaccuaccugcuauaguucgagaagcaauuaagagaagacugagaacucuaauccuugcucccacuagaguaguagcugccgaaauggaggaagccuugaaagguuugccaauaagauaucaaacuacagcaacaaagucggaacacacuggacgagagauaguagaucuaaugugccacgcgacauucacgaugagauuacucucaccuguaagagugccaaacuauaaccugauaauaauggacgaagcacauuucacugacccagcauccauagcagcaagaggauauaucaguacuaggguagguaugggagaagcagccgcaaucuuuaugacggcgacaccaccagguacagcugaugcauuuccgcaaaguaacgcgccaauucaggaugaggagagggauauuccugaaagauccuggaauaguggaaaugaauggauaacugacuuugcaggaaagacgguaugguucguaccaaguaucaaagcagguaacgauauagcgaauuguuuacguaagaacggcaagaaaguuauucagcuaagccguaagacguuugauacugaauaccagaaaacaaagcuaaaugauugggauuucgucgugacaacagacauuagcgaaaugggagcgaauuuuaaagcagauagaguaauagauccuagacgcuguuuaaaaccuguaauauuaacagacgguccagaaagagugaucuuagcgggaccuaugccuguuacggcugcaucggcggcccaaagaagaggaagagugggucguaauccacaaaaagaaaaugaccaauauauauuuacgggacaaccgcuaaauaaugaugaggaucacgcucauuggacggaagcaaagauguuacuggauaauauuaauacaccagaggggauaauaccggcauuauucgaaccggaaagagagaaaagugcggccauagauggugaauacagguuaaaaggagaaucucgcaaaacguuuguagaauugaugagaagaggagaucugcccgugugguuggcacauaaaguagcgucugagggaauuaaauauacagaucggaaaugguguuucgaugggcaaagaaauaaccaaauauuagaagaaaauauggauguagagaucuggacuaaagagggggaaaagaaaaagcucagaccaagaugguuagacgcacguacuuacucagauccucuagccuugaaagaauuuaaggauuuugcugccggaagaaaaagcauagcacuugauuuaguuaccgaaauuggucggguaccuacacacuuagcccauaggacuagaaacgcucuugauaaucugguuauguuacacacgagugaacacggcggaaaggcuuaucgacacgcgguagaagaacuaccggaaacaauggaaacgcuccuauuacuuggucuaaugauuuuguuaacagggggagcuauguuauuccugaucaguggaaaagggauaggcaagacuuccaucggguuaauaugcguaaucgcaaguucuggaauguuguggauggcagaaauaccgcuacaguggauugcaucggcuauaguucuugaauuuuucaugaugguacuacuaauaccagaaccugagaaacaaaggacaccacaagacaaucagcuagcuuacguggucauagggauacugacauuagcagcuauuauugcagcuaaugagaugggguuacuggaaacaaccaaaagagaucucggaauguccaaagaaccagggguaguuucaccaacaucguacuuggauguugauuuacauccugcuucugcauggacucuauaugcgguagccacaacagucauaacaccaaugcuuagacauacuauagagaacaguacagcaaaugugucauuagcagcaauagccaaccaggcuguaguccugaugggacuagacaagggguggccuauuagcaaaauggaucuaggggugccccugcuagcccugggauguuauagucagguaaauccacucacgcucaccgcugcugucuuauuacugaucacacacuaugcuauuaucggaccagggcuucaagcaaaggcaacuagggaggcgcagaaaagaacugccgcaggcauuaugaaaaacccuaccguugauggcauuaugacaaucgacuuagauccuguaauuuaugauucgaaauuugaaaaacaguuaggucaaguuaugcugcuaguucuaugcgcuguucaacuacugcucaugagaacuuccugggcauuaugcgaagcacuaacacuugccacagguccaauuaccaccuugugggaaggaucaccggguaaauuuuggaauacaaccauagccguaaguauggcaaauaucuuccgugguucauacuuagcaggagcaggauuagccuuuucaauaaugaaaagcguugguacugggaaaagaggaaccggaagucaaggagagaccuuaggagaaaaguggaagaagaaauuaaaccaauuaagucgaaaagaguuugaucuguauaagaaaucuggaauaacagagguagauagaacagaggcgaaagaaggcuuaaagagaggagagauuacucaccacgcagucucucggggaucugcaaaguuacaaugguucguugaaaggaacaugguaauuccugaaggaagaguaauugaucuuggauguggaagggguggcuggucguauuacugcgccgguuuaaagaaaguuacugaaguaaggggguauaccaaaggagggccagggcacgaagaaccaguaccgaugucaacauacggauggaauaucgugaaacugaugaguggcaaagauguauuuuacuugccaccggaaaaaugcgauacguugcuuugcgacauaggugaaaguucacccaguccuacgguugaagaaaguagaacaauccggguccugaaaaugguagagccaugguuaaagaacaaccaguucuguauuaaaguauugaaccccuauaugccuaccgucauagaacauuuagaaagguugcaaaggaaacauggcggaauguugguaagaaacccacuaagcagaaauucgacucaugaaauguauuggauuucaaaugguacagggaacaucguggcaucgguaaauaugguuucucgucucuuauuaaauagauuuacgaugacucacaggagaccaacgauagagaaagauguagauuuaggugcagguacaagacauguuaacgcagaaccggagacacccaauauggauguuauaggugagaggaucaagcgaauaaaagaagaacacaacucaacauggcauuaugaugaugaaaacccuuauaaaacuugggcauaucacggaucuuacgaaguaaaggccacaggcucagccucaucuaugauuaauggggugguaaaacuccuaacuaaaccaugggauguuguuccaaugguaacgcaaauggcaaugacggauacgacgccuuuuggucaacagagaguauuuaaggagaaaguagauacuagaacuccaagaagcaugccaggcacgcgaagagucaugggaauaacugcagaaugguuauggcguacauugggaagaaacaagaagccccggcuauguacacgugaagaguucaccaagaaaguaagaacuaaugccgccaugggggcagucuucacugaggagaaucaaugggauucugcuaaagcagcaguggaagaugaagacuuuuggaaauuaguagacagggaaagagaauuacauaagcucggcaaaugcgguucgugcguuuauaacaugauggguaaaagagaaaagaaacucggugaguucggaaaagcgaaaggaucaagagcuauuugguacaugugguugggagcaagauaccuagaauuugaagcacugggcuuuuuaaaugaagaucacugguucucuagagaaaauucguauucaggcgucgagggagaaggacuacauaagcuaggguauaucuuaagggauauuaguaaaauacccgggggagcaauguaugccgaugacacggcaggcugggauacacgaauaacagaggaugauuuacacaaugaagagaaaaucacacagcagauggacccggagcacagacaacuagcuaaugcuauauuuaaauuaacauaccagaauaagguaguaaaaguacaaaggccaacuccaacggguacgguuauggacauaauaucaaggaaagaucaaagaggaucaggucaaguagguacauacggucugaacacauucacaaauauggaagcacaacugauccgucaaauggagggggaggguguuuuaaguaaagcggacuuagaaaacccgcacuuacccgagaagaaaaucacacaauggcuagaaacuaaaggaguagagcgacuuaaacgaauggccauaagcggugaugacugcgugguuaaaccuauugacgaucgauuugcuaacgcacuacucgcacuuaaugacauggggaaaguacgaaaagacauaccccaguggcagcccucuaaaggguggcaugacuggcaacagguaccauucugcucacaccacuuucaugaacuaauuaugaaagacggucgaaaauuagugguacccuguaggccacaagacgaauuaauaggucgugcacgaauaucacaaggggcaggguggucacuuagagaaaccgccugucuaggaaaagcguaugcccaaauguggucauugauguacuuucaccggcgcgacuuaagacuagcuuccaacgcaauauguucugcaguacccgugcauuggguacccaccaguaggacuaccuggucuauucaugcgcaccaucaauggaugacaacagaggauauguuaacuguguggaaucgcguauggauagaggauaacccuuggauggaagacaagacaccagugacaacgugggagaauguuccauacuuagguaaaagagaagaucaaugguguggaagucuaaucggacuuacuucuagggcaacaugggcccaaaauaucccuacugcaauucaacaagugcgaucacuaauuggaaaugaagaauuucuagauuauaugccguccaugaaaagauuccggaaggaagaggaaucagagggugccauaugguaa

SEQ ID NO: 23401 - RNA, 9873 nt, Artificial Sequence
  derived and/or modified CDS sequence (opt6) from DENV-3__FJ639767__SS-prME
acauccuuauguuugaugaugauuuugccagcagcacuagcuuuucaccuaaccuccagagacggugaaccaagaaugauagucgguaaaaacgagagaggaaaaucauuacuuuucaaaacugcgucugguauaaacauguguacacuuauagcuauggauuuaggagagaugugugacgauacaguuaccuacaaauguccucacauaacagaagucgagccggaggauauagauugcugguguaaccuuacaucaacauggguaaccuauggaacuuguaaccaagccggugaacaccggcgggauaaaagaucugucgcacuugcaccacauguaggaaugggauuggauacacgcacccaaacauggaugagcgcagaaggggcauggcgccaaguugaaaaaguggaaacaugggcacuaaggcauccuggauucacaauauuggcuuuauuccuagcacauuauauaggaacgucccuaacacaaaaaguugugaucuucaucuuauuaauguuaguaacaccuucaaugacgaugagauguguagguguugggaaccgcgauuucguagagggacugucaggagcaacauggguugacgugguccuagaacacggaggcuguguaaccacgauggccaaaaauaaaccaacucuagauaucgaguuacagaaaacggaagcaacacaguuagcaacuuuacgaaaacuguguauagagggaaaaauaacuaauauaacuacagacucuagaugcccaacgcaaggugaagcaguacuacccgaagaacaagaccaaaacuaugucugcaaacauacauauguggaucggggauggggaaaugguuguggucuauucgggaaagguucccuagucaccugugcaaaauuucaauguuuggaaccgauagaaggaaaaguuguccaauaugaaaaucuaaaauacacuguaauaauaacggugcacacuggagaucaacaccagguaggcaaugaaacacaagguguaacagcagaaauuacgccucaagcaucgacaaccgaagcgauuuuaccagaguauggaaccuugggacuggaguguucaccucgaacgggcuuggauuuuaaugaaaugauacuacucacaaugaaaaacaaggcuuggaugguacaucgucaaugguuuuucgacuuaccauuaccuuggacaaguggagcaaccacagaaacaccaaccuggaaucgcaaagaacugcuaguaaccuuuaaaaaugcucaugcgaagaaacaagaggugguagugcuugggucgcaggaaggggcaaugcacacugcuuugacuggugcuacagaaauucaaaauucaggcggcacaucaauauuugcuggucaccuaaaaugucgucuaaaaauggauaaacuagaauuaaaagguaugucauacgcaaugugcacgaauacauuuguucuaaagaaagaaguaucagagacacagcacggaacgauucuaaucaaaguagaauacaaaggagaagauguuccguguaagauucccuuuucaacggaagacgggcaaggaaaagcccauaacggaagauuaauaacagcuaacccgguaguuacuaaaaaggaagaaccgguaaacaucgaagcagaaccuccauuuggcgaaucgaauauaguuauagggauaggagacaaugcguuaaaaauaaacugguauaagaaaggauccucaaucggaaaaauguucgaagcuaccgcaagaggcgcacguagaauggcuauucucggagacacagcaugggacuucggaagugugggcggaguauuaaacucccuugggaaaaugguucaucaaauuuuuggcagugcuuauacagcacuauuuucaggcgucagcuggguuaugaagauuggcauagguguucuccuaaccuggauaggccucaacaguaagaacacaagcaugagcuucucauguauagcaauagggaucauuacucuauacuuaggagcuguuguucaagcggacaugggaugcgucauuaacuggaaaggcaaagaacucaaaugcgguaguggaauauuuguaacaaacgaagugcacacauggaccgaacaguauaaauuucaggcggauuccccgaaaagacuagccacggcaauagccggugcuugggaaaaugggguuugugggaucagaaguacgacaagaauggaaaaccuucuguggaagcagauugcaaacgagcuaaacuacauauuaugggaaaacaauauuaaauugaccguggucguaggugauaucauaggcguucucgaacaaggcaaaagaacguuaacaccacagccuauggaauuaaaauauucguggaagacaugggguaaagcuaaaaucgucacagcugaaacccaaaacucuagcuucauaauagacgggccaaauacuccagagugcccuagugcuucaagggccuggaaugucugggaaguagaagauuacggauuuggaguauucacaaccaauaucugguuaaagcucagagagguuuauacacaacuaugugaccauagacuaaugucagcagccguaaaagacgaaagagcaguacacgcagacaugggauauuggauagaaagccagaaaaacggaucuuggaaacuagaaaaggccucacuaaucgaagugaaaacguguacuuggccgaaaagucacacucuaugguccaaugguguuuuagaaucagauaugauuauaccaaagagccucgcaggaccaauaagccagcauaacuauaggccagguuaucauacccaaacagcaggaccuuggcacuuaggaaaacuagaguuagauuucaauuauugugaagguacaacuguggugaucacugaaaauuguggcacgcguggcccgagccuacguacuacgacaguaaguggcaaacucauacacgaaugguguugccgcuccuguacacuuccucccuuacgauacaugggugaggaugguuguugguacgguauggagauaaggccaauaucagaaaaagaagaaaauaugguaaaaucguuaguuucugcagggagcggcgaggucgauaacuucacaaugggaguguuaugcuuagcaauauuauuugaggaaguaaugcgagguaaauuuggcaagaaacauaugaucgcaggcguguucuuuacauucguccuuuuacucucgggucaaauaaccuggagggauauggcacacacacugauaaugaucgguaguaaugcaagugacaggaugggaaugggcguaacauaccucgcgcuaauagcaacuuucaagauucagccguucuuggcacugggauucuuuuuacguaagcuaacaucgagggagaauuuacuuuuaggcguggguuuagcuauggcgacaacgcuccagcucccugaagauauagaacaaauggcgaacggaauugcacucggcuuaauggcccugaaauuaaucacacaguuugaaacauaccaauuauggacagcacuuaucagcuugacguguaguaacacaauauucacauugacaguagcauggcgaacagccacuuuaauccuagcagggguaucacugcuaccgguaugucaaucaucuucaaugagaaagacggacuggcuaccaaugacuguugcagcaaugggaguuccaccccuaccuuuauucaucuucucucugaaagauacacuaaagaggagaucuuggccuuuaaacgaaggaguuauggcgguaggccuugucucaauacuggcgucuagcuuauugcggaaugacguacccauggccgguccccuagucgcgggaggacuacuaaucgcaugcuaugucauaaccgguacgucugcagaccucacaguagagaaagcagcagauguaacaugggaggaagaagcagaacaaacaggugugucccacaaucuaaugauuacagucgaugaugauggaacaaugcgaaucaaggacgaugagacagaaaacauacugaccguccuccucaagacugcacuccuuauaguauccgguauuuuuccguacucgauacccgcaacgcuucugguuuggcauaccuggcaaaagcagacucagagaucugguguacugugggauguuccuaguccgccugaaacgcaaaaggcagaacuugaggaagggguuuacagaaucaaacaacaagguauuuucggaaaaacucaaguugggguggguguacagaaagaaggaguauuucacacuauguggcaugugacaagaggagcuguucuuaccuacaacgggaaaagguuagaaccaaacugggcaucuguuaaaaaggauuuaauuucauauggaggaggcuggagguuaagugcacaauggcagaagggggaagaaguucaagucauagcuguagagccuggcaaaaaccccaaaaacuuccagacuaugccugggacuuuccaaaccaccaccggagaaauuggugcaauagcccuggauuucaaaccugguacgucaggcucacccauaauuaacagggaaggaaagguaguaggacucuaugggaaugguguagugacuaaaaacgguggauacgucucaggaauagcacaaacaaacgccgaacccgaugguccaacuccugaacuggaagaagagauguucaagaagagaaaccugacuaucauggaucuacauccugguagugguaaaacuagaaaauacuugccggcaauuguucgcgaagcuauaaaaaggcgauuaaggacccugauuuuggcgcccacuagggucguagcagcagaaauggaagaagccuuaaaggguuuaccaaucagauaccaaacuaccgcuacaaaaucugaacacaccgggagagaaauaguugauuugaugugucacgcuacguuuacaaugagguugcugucaccggugagaguaccgaauuacaaccuaaucaucauggaugaagcacacuucacagacccggcauccauagccgcaagggguuauauaaguacacggguagggaugggggaagcugcggcuauauuuaugacugcaaccccaccuggaaccgcugaugccuuuccacaaaguaaugcgcccauucaagaugaagaacgggauaucccggaaagaucguggaacuccggcaaugaauggauaaccgacuuugcagggaaaacaguuugguucgucccaagcauaaaggcagguaacgacauugcuaacugucucaggaaaaacgggaagaaagucauacaacuaagucgcaaaacguucgauaccgaauaucagaaaacuaaacuaaaugauugggauuuuguuguuacaacagauauaucagaaaugggugcuaacuuuaaagccgacagaguaauagacccacgacgcugccuuaagcccgucauccuaacagacgggccagaaagaguaauauuagcaggacccaugccaguaacggcagcuagugccgcacaaagaagggguagggucggaagaaacccccagaaggaaaacgaccaguauauauucacaggucagccauuaaauaacgaugaagaucacgcucauuggaccgaggcgaaaaugcuauuagauaacauuaacaccccagaaggaauaauccccgccuuauucgaaccugaaagagaaaaauccgcagcaauagacggggaguauagauuaaaaggugagagccguaagaccuucguagaacugaugaggagaggugaucugccaguauggcuugcucauaaaguugccucagaaggaauuaaauauacagauagaaaauggugcuucgauggacagcgaaauaaucaaauucuagaagaaaacauggauguggaaauuuggaccaaagagggagaaaagaagaaauuacgaccacgauggcuagacgcgagaacuuauucggauccacuugccuugaaagaauuuaaagauuuugcagcagggagaaaaucaauugcguuggaucuaguuacggaaauuggacgugucccaucacaucuagcgcacaggacgaggaaugcucuugacaacuuaguaauguuacacacgucugagcacggaggaaaagcauauagacaugccguagaagaguuaccagaaacuauggaaacucuauuguuacuagggcugaugauauuguugacuggaggggcaauguuauuccuuauuucuggaaaaggaauagguaagacaaguauagguuuaaucugcguaaucgcaaguaguggcaugcuuuggauggcagaaauaccauuacaauggauagccagugcaauagugcuugaauuuuucaugaugguuuuacuuauaccagaacccgagaaacaacgaaccccacaagacaaucagcuggcguacguuguaauaggcauccuaacgcuagcagcaauuaucgcagcuaaugaaaugggccuucucgaaacuacaaaaagagacuuaggaaugucgaaagaaccuggaguaguaagucccauuucauaucuagauguugaucuacauccagcaucagcauggaccuuauaugcaguggccacaacgguaaucacgccaauguuacgacauacaauagaaaauucaaccgcuaaugucagccuugcugcaaucgcuaaccaagccguagucuuaaugggguuagauaaaggcuggccgauuucaaaaauggauuuaggugucccguuacuagcguuaggaugcuauucacaagucaauccauuaacacucacagcagcaguacuucucuuaauuacucacuaugcgauaaucggaccuggccuucaagcuaaagcaacccgagaagcucaaaaacguacugccgcaggaauuaugaaaaaccccacuguugacgggauaaugacuauagaccucgauccaguaaucuaugacucgaaauuugaaaaacagcuaggacagguuauguuguuagugcuuugugcaguacaacugcuauugaugagaacaagcugggcauuaugcgaagccuugacguuggcgacugguccaaucaccacacuuugggaaggaaguccagggaaauuuuggaacacaaccauagcgguaagcauggcgaauauauuucgugguaguuacuuagccggugcaggauuagcuuucucaauuaugaaaucaguuggaacugguaaaagggguacuggaagccaaggagaaacacuuggagaaaaauggaagaagaaacuaaaucaacuaucacgaaaggaguuugaccucuauaagaaaaguggcauaaccgaaguagaccguacagaagcaaaagaaggacugaaaagaggggagauaacacaucaugccgucagucgaggcucugcaaaacuucaaugguuuguugagcggaacaugguaaucccugaggguagaguuaucgauuuaggaugugggagaggcggauggucauauuacugugcaggguuaaagaagguuacggagguucgaggauauacuaaaggggguccuggacaugaagaaccagugccaaugucaacuuacggauggaacauaguuaaacuuaugucaggcaaagauguuuucuaccuucccccagaaaaaugcgauacauuacucugcgauaucggcgaaaguucaccaucaccaaccguagaagaauccagaaccauaagaguccuaaaaaugguugaaccuuggcucaaaaacaaccaauuuugcauuaaagugcucaaucccuacaugccuacaguuauugagcaucuagaacgacuccaaagaaaacacggugggaugcugguaaggaaccccuuaaguagaaacaguacacaugagauguacuggaucucaaacggaacggggaauauaguagcaucagugaacaugguaaguagauuauuacuaaaccgauuuaccaugacacacagaagacccacuauugaaaaggaugucgauuuaggagcugggacucgacauguaaacgcagaaccagaaacaccgaacauggacguuauaggagaacgaauaaagaggaucaaagaagaacacaacucuaccuggcacuacgacgaugaaaauccuuauaaaacaugggcguaucaugguucguaugaaguaaaggcuacaggauccgcaucaucuaugaucaaugguguaguuaaacuucuuacaaaaccaugggacguuguaccaauggucacucaaauggcaaugaccgauacuacucccuuuggacagcagcggguauuuaaagagaaaguagacacuagaaccccgaggagcaugccuggaacccgcagaguuaugggaauaacugccgaaugguuauggcgaacacuuggcagaaacaagaaaccacggcuguguacaagagaagaauuuacgaagaaaguuaggaccaacgccgcaaugggugcaguauucacggaggaaaaucaaugggauagugcaaaagcugccguagaagaugaagauuucuggaaauuaguugacagagaacgagaauugcacaaacuuggaaaaugugggaguugcguuuacaauaugaugggaaagagagaaaagaaauuaggggaauuugggaaggcaaaagguucuagagcaauaugguacaugugguugggcgcgcgauauuuggaguuugaagcauuagguuuucuaaaugaagaccauugguuuaguagagaaaacaguuacuccggugucgaaggugaaggguuacauaaacuuggauacauacuacgagauauuucaaagauuccaggcggggccauguacgcugaugauacggcagguugggacacacgcauuacagaagacgaccuucauaacgaagagaaaauuacucaacaaauggacccugaacauagacagcuggccaaugccauuuuuaaacuuacuuaccaaaauaaaguaguuaagguacaaagaccuacgccaaccggaacgguaauggauauuauaagccgaaaagaccaaagagguucaggacaagucggaacauauggucuuaauacauuuacuaauauggaagcacaauuaauacgacaaauggaaggcgaagggguucuuucaaaagcagaucuugaaaacccucacuuaccugagaaaaagauuacucaauggcucgagacgaagggcguagagcgacuaaagcggauggcgaucucuggagacgacugugucguaaagccgaucgacgaucguuuugcaaaugcauuauuggcccuaaaugauauggggaagguaaggaaggauauuccgcaauggcagccuucaaagggauggcaugacuggcaacaagugcccuucugcucucaucauuuucaugaauugauaaugaaggauggccgaaaacugguaguuccaugucgaccucaagaugagcuuauuggacgagcccgcauaucucaaggcgcgggguggagucuucgugaaaccgcaugucuaggcaaggccuaugcacaaauguggucauuaauguauuuucaccgaagagaucuucgguuggcauccaacgcaaucuguuccgcaguacccguacacuggguaccaaccagcaggacuacauggaguauccacgcucaucaccaauggaugacuacagaagacaugcugaccguuuggaacagaguauggauagaggacaaccccuggauggaagacaaaacgccaguaacgacgugggagaauguaccuuaucucggcaaacgagaagaucaauggugcggaagucuuauaggucugacaucaagggcuacgugggcucagaauauaccaacagcuauacagcaaguucgcucacuaauagguaaugaagaguuccuagacuacaugccauccaugaaacgauuccguaaggaagaagaaucagaaggagcaauaugguga

SEQ ID NO: 23402 - RNA, 9873 nt, Artificial Sequence
  derived and/or modified CDS sequence (opt6) from DENV-3__FJ639768__SS-prME
acaucacugugccuaaugaugauauuaccagcagcucuggcauuccacuuaacaucccgagauggugaaccuagaaugauuguuggcaaaaaugaacgggguaaaucauuacucuuuaaaacagcaagcggaauuaauauguguacucuaaucgcaauggauuuaggugaaaugugugacgauacgguaaccuauaaauguccucauauaacggaaguugaaccugaagauauagauuguugguguaacuuaacuagcacgugggucacauauggaacaugcaaccaagccggugaacauaggagggacaaacgaucuguagcauuggcaccccacguaggaaugggccuggauacuagaacacaaacauggaugucggcugagggagcauggcgucaagucgaaaaaguagagaccugggcauugagacacccuggguucacaauacuugcacuauuccuggcacauuauaucggcaccucacuaacacaaaaaguuguuaucuuuauacuuuugaugcuuguaacucccaguaugaccaugagaugcguaggugugggaaaccgugauuuuguugaaggucuuucgggugcaaccuggguugauguaguacuagaacacggaggaugcgucacgacaauggcuaaaaauaaaccgacgcuggauauagaauuacagaaaacagaagcaacacaauuagcuacacuuaggaaauuguguauugaaggaaaaauaacuaauauaacgaccgacuccagauguccaacacaaggagaagcagugcuucccgaagaacaagaccaaaauuacguuuguaaacacaccuauguugauagaggguggggaaauggauguggacuuuuuggaaaagguucucuagucacuugcgcaaaauuccaaugccuugaaccaaucgaaggaaaaguagugcaauaugaaaacuugaaauauacugucaucauaaccguucauacuggagaccaacaucaaguugggaacgaaacacaaggagucacugcugagauaacgccccaggcuucaaccacagaagcuauuuugccagaauauggaacauugggccucgaauguucaccaagaaccggacuugacuuuaaugagaugauuuuauuaacuaugaaaaauaaagcguggaugguccauagacaaugguucuuugauuugccuuuaccauggacgucuggcgcaacaacugaaacaccuacguggaauagaaaagaauugcuugucacauuuaaaaacgcccaugccaagaaacaagaagucguuguucuugggucucaagagggugcaaugcauacugcauugacaggcgcaacggagauccaaaacucgggaggaacaucaauauuugcgggacauuugaaaugucgucugaaaauggacaaauuagaguuaaaagguaugucauacgcaaugugcacuaauacuuucgucuuaaagaaagaagugagugagacgcaacacgguacuaucuugauaaaagucgaauacaaaggagaggacgugccgugcaaaaucccauucaguacagaagacgggcagggaaaagcucacaauggacggcucauaacagcgaaccccgucgucaccaagaaagaggagccagugaauauagaggcugaacccccauuuggcgaaucuaauauaguuauugggauuggugauaaugcuuuaaaaauaaauugguacaagaaaggaucaucgauugggaaaauguuugaagcaacugcacgaggagcacguaggauggcaauacuuggugauacugcaugggauuucgguucuguagguggugucuuaaauucuuuagguaaaaugguucaucaaauauucgggagugccuauaccgccuuauucagugguguuuccugggugaugaaaaucggaauaggaguucuuuuaacauggauuggacuaaauaguaaaaauacuucuaugucguuuucuugcauagcgauagguaucauaacgcuguaccuaggagcugugguacaagccgauaugggauguguaauuaauuggaaaggaaaagaauuaaaauguggcucaggcauauuuguuacaaacgagguccacaccuggacagaacaauacaaauuccaagcugacucuccaaaaagguuagcaacagcaauugccggugcaugggaaaaugggguaugcggaauaagauccacuacccguauggaaaaucuguuauggaaacaaauagcuaacgaacucaauuauauucucugggaaaacaacauuaaacuaaccguaguugucggggauauuaucggcguacuugaacagggcaaaagaacacuaacuccacaaccaauggaacuuaaauacucauggaaaaccugggguaaagcuaaaauaguaacugccgagacacaaaacuccucuuucauuaucgaugguccaaauacaccagaguguccaagcgcaucaagagcuuggaauguuugggaaguugaagauuauggauuugguguauuuaccacgaacaucuggcucaaauuaagggagguuuauacgcaguuaugugaccaccgucuaaugucagcagcugugaaagaugaacgggcaguacaugcugauaugggauacuggauugagucccagaaaaacggauccuggaaacuagagaaggcuucacucauugaggucaaaacauguacguggccaaaaagccauacauuauggagcaacgguguucuugaaucugauaugauaauaccaaaaagucuugcaggccccauaagccagcauaauuaucgcccaggauaccauacacagacagcaggaccauggcaccugggcaaacuagaacuggacuuuaacuacugugaaggaacuaccguaguuauaaccgaaaauugcgguacaagagggccaagucuaagaacaacaacagucuccggaaaacuaauacaugaaugguguugucgaucaugcacauuaccaccucuaagauauaugggugaggaugguuguugguacgguauggaaaucaggccaauuucugaaaaagaggaaaacaugguuaaaucguuaguaagugcggguucgggugaaguagacaacuucacaaugggaguauuauguuuggcgauccuauuugaagaaguaaugagagguaaauucgguaaaaagcauaugauagcaggagucuucuuuacuuuuguccuccuucugagcggacaaauaacuuggagagacauggcacauaccuugaucaugauuggaucaaacgcuagugaucguaugggcaugggaguaacguacuuagcgcuuauagcuacauucaaaauucaacccuuucuugcguugggguuuuuccuccguaaacuaacaucaagagaaaacuuacugcuugguguuggucuugcaauggcaacaaccuuacaauuacccgaagauauagaacagauggcaaauggcauagccuuaggauuaauggcccugaaauuaauaacacaauuugaaacauaucaguuauggaccgcccucauaucgcuaacaugcagcaauacaaucuuuacuuugacuguugcuuggagaacggcaacguugaucuuagcuggggucucucuuuuaccaguaugccaaucaucaucaaugcgaaaaacagauugguuaccgaugacaguagccgcaauggggguaccgccacuaccuuuauuuauauuuucauuaaaagauacacugaagcgccgcuccuggccuuuaaaugaagguguaauggcgguuggucucguuagcaucuuggcaaguaguuuacugagaaaugacgugccgauggcugguccucugguagcugguggcuuacuaaucgcauguuauguuauaacagguaccuccgcagaucucacaguugaaaaagcagccgauguuaccugggaagaagaggcggaacaaacagguguuucccauaacuuaaugauaacagucgacgacgaugggaccaugcgaauaaaggacgaugagacagaaaauauucuaacuguacugcuaaaaacagcauuguuaauuguuucuggaaucuucccuuauagcauaccugcgacacuacuuguguggcacacguggcaaaaacaaacacaacggaguggaguauuaugggacguaccaagucccccagaaacacaaaaagcugaacuggaggagggcguguacagaauaaagcaacaaggcaucuucggaaagacucaaguuggcguaggaguccaaaaggaaggagucuuucauacgauguggcauguuacccgaggcgcuguauugacauacaaugggaaacgacucgaacccaauugggccagugucaagaaagaucuuaucaguuauggcgggggauggcgauuaaaugcgcaauggcaaaaaggugaagaagugcaagucauugcaguagaaccggguaagaauccaaagaauuuccaaacuaugccagggacauuucaaacuacaacuggcgagauaggcgcaauugcauuggacuuuaaaccggguacaucaggaucaccaauuauaaauagagaaggcaaaguagugggacucuacgguaauggaguagucacuaaaaauggaggauauguaucgggaauagcacaaacaaaugcagagccagauggccccacacccgaauuagaagaagaaauguuuaagaaacguaauuugacaaucauggacuuacacccuggaucaggcaaaacucggaaauaccuuccugcaauaguacgagaggcaauaaagcgaagauuaagaacuuugauacuagccccaacgcgaguaguagccgcugaaauggaagaagcucuuaagggacuuccuauacguuaccaaacaacugcgacaaaaagcgaacauacagguagagagauaguggaucuuaugugccaugcgacauuuacaaugagauuacuuucgcccguaagggugccaaauuacaaucuaauaauuauggaugaggcccauuucacagaccccgcguccauagcugcuagaggcuacauaucaacucguguggguaugggagaggccgcugcaaucuucaugaccgcaacuccgccggggacagcugacgcguuuccacaaagcaaugcuccgauacaggacgaggagagagauauaccggagcguagcuggaacucaggcaaugaguggauaaccgauuuugccggcaaaacgguuugguuuguuccgagcaucaaagcgggcaaugacauagcaaacugcuugaggaaaaauggaaagaaaguuauacagcucucuagaaaaacuuucgacacugaauaucagaaaacaaaauugaaugacugggacuuugugguaacgacggauauaagugaaaugggcgcuaauuuuaaggcugacagaguaauagauccucgacgaugucuaaaaccaguaauauugacagaugggccugaaagaguaauacuagcagguccuaucccuguuacagcggcaagcgccgcgcagagacgcggccgcguaggucggaacccacaaaaagagaaugaccaguauaucuuuacaggacaaccucuaaauaacgaugaagaucaugcgcauuggacagaagcgaaaaugcuucuagauaauauuaacacaccugaagggauaauacccgcuuuauucgaaccugagagggaaaaaucagcggcuaucgacggcgaauaccgucucaaaggugaaagucguaaaaccuucguugaacuaaugagaagaggugaccuuccuguuuggcuagcacauaaagucgcauccgaagguauaaaauauacugacagaaagugguguuucgauggucagaggaacaaucaaauauuagaagagaauauggacguugaaauauggacuaaagaaggugagaagaagaaauugaggccaagauggcuagacgcucgaaccuauucugacccguuggcucugaaggaauuuaaagacuuugcagcaggucguaaaaguauagcucuagaccugguuacggaaauaggacgcguaccuagccacuuagcacaucggacaagaaacgccuuagauaacuugguuaugcuucacacuucggaacauggcggaaaggcuuacagacaugcgguugaagaauuaccggaaaccauggaaacguuauugcuauugggauuaaugauucuauuaaccgggggagcaaugcuauuucucauuucagggaaaggcauugguaaaaccaguauuggccuuauaugcguuauugccucaagcgguauguuguggauggcagaaauaccucuucaauggaucgcuucggcaaucguguuagaguucuuuaugaugguccuguugauaccagaaccggaaaaacaaagaacuccccaagauaaucaacuagcauauguaguaauaggcauccucacacucgcugccauaauagcagcaaaugaaauggguuugcuagaaacaacaaaaagagaccucgguaugucaaaagaaccgggaguaguuuccccuacaagcuaucuagauguggacuuacaccccgccagcgcuuggacauuauacgcaguagcaacgaccgucauuacuccaaugcuuagacacacuaucgaaaauucgaccgcaaacgugaguuuagcagcuauagcaaaucaagcuguaguauuaauggguuuagauaaagguuggccaaucucuaaaauggaucuaggcgugccuuuauuagcacucggaugcuauucacaggugaauccuuugacacuuacagcagcagucuuguuacuuauaacacacuacgcaauaauugggccaggccugcaagcuaaagccacgcgggaagcacagaagagaacugcugcugguauaaugaaaaaucccacugucgacggcauaaugaccauugacuuagacccggucauauacgauucaaaauucgaaaaacagcuaggucaaguaaugcuucuuguucuuugcgccguacaacuuuugcugaugcggacaucuugggcccugugcgaggcacuuacuuuagcaacagguccgauuacaacuuuaugggaaggaucgccgggaaaguuuuggaauacuacaauugcggucucaauggcaaauauauuucgggggucuuacauugccggugcaggacuggcuuucucaaucaugaagucugucggaacaggaaagcgggguacgggaucccagggagagacucugggagaaaaauggaagaagaaacuuaaucaauuaucaagaaaagaguucgaucucuauaagaaauccggcauaacugagguagaucguaccgaagcaaaagagggguuaaagaggggagaaauuacacaucaugcugucagccgugggucagccaaacugcagugguuuguugaaagaaauauggugaucccugaagggagagugauagaucuaggaugcggaagaggggguuggucuuauuacugcgcaggucuaaagaaagugacagagguacgaggauauacaaaaggagggccaggucaugaagaacccguccccaugucaaccuacggauggaacaucguaaaacugaugaguggaaaagauguauuuuacuugccaccagaaaaaugugauacacuauuaugugacauaggcgagucgagcccuucaccuacaguagaagaaucucguacaauaagaguccucaaaaugguggaaccuugguugaaaaauaaccaauucugcauaaaaguacuaaacccuuauaugccgaccgugaucgaacauuuagaaagguuacaaaggaaacacggugguauguuagugcgcaauccgcucagcaggaacucuacacaugaaauguacuggauaucaaaugguacgggcaauauuguugcaaguguaaacaugguaaguagacuguuacucaauagauuuacgaugacacauagacgaccuacgauagagaaagacguagaccucggagcugggaccagacacguaaacgcugagccagagaccccuaauauggauguaauuggugaaagaauuaaaagaauaaaagaggaacauaauucuacauggcauuaugaugaugaaaauccguauaaaacaugggcauaccacggcucauaugagguuaaagcaacggggagugccucuaguaugauaaauggcguagugaaacuacuaacaaagccgugggauguagugccaaugguaacacaaauggcaaugaccgacacgaccccauucggacaacaaagagucuucaaagaaaagguagacacgagaaccccaagguccaugccaggaacuaggcguguuauggggauaacggcugaauggcuuuggagaacccuuggaagaaauaagaaaccgagguuaugcacuagagaggaguucacuaagaaaguucggacaaaugcugcaaugggggccguauuuacggaggaaaaccagugggacucagcaaaagccgcaguagaagaugaagauuuuuggaagcuaguagauagagaacgggaguuacacaaacuagggaaaugcggaucgugugucuacaauaugaugggaaaaagagagaagaaacuuggagaguucggaaaagccaaagguucccgggcgauaugguauaugugguuaggugcaagguauuuagaguuugaagcucuaggauuuuugaacgaggaccauugguucucacgugaaaauucuuacagugggguagagggcgaagggcuucauaaacuaggauauauacugcgugacauaagcaagauacccggcggagcuauguaugcugaugauacggcuggaugggauacucgaaucacugaagacgaccuacacaaugaggagaaaauuacgcaacaaauggacccagaacacagacaacuggccaaugcaaucuucaaauuaacuuaucaaaacaaaguuguuaaaguccaaagacccacaccgacggguacaguuauggauauaauuucaagaaaagaucagagagguaguggacaaguuggaacauacggacugaacacauucacuaacauggaagcacaacuaaucaggcaaauggaaggagaaggcgugcuaucuaaagcggacuuagagaauccacaucugccagaaaagaaaauuacgcaauggcuugaaacgaaaggaguagaaagguuaaaaagaauggcaaucaguggugacgacugugucguaaaaccuauugaugauagauuugccaacgcacuacuugcccuuaacgauaugggaaaagucaggaaagauauaccgcaguggcagccuaguaaagguuggcaugauuggcaacagguacccuuuuguagucaucauuuucaugaacuaauaaugaaagauggcagaaaacuggucgucccuugucggccccaggaugaacuuauuggccgagcucgaauuucacaaggggcugguuggucacuaagggaaacagccugucugggaaaagccuaugcccaaauguggucgcuuauguauuuccauagacgcgaccugagauuagcgagcaaugccauaugcucugcuguccccguacauuggguaccuacaagccgaacaacauggaguauacaugcacaccaucaauggaugacaaccgaagacauguuaacaguguggaaucggguuuggauugaagauaauccguggauggaagauaaaacuccagucacuacaugggaaaaugugcccuauuuagguaaaagagaagaucaauggugcggaagucuuauaggauuaacgagucgggcgacuugggcacaaaauauacccacggcuauacaacaaguacgcucgcucauagggaacgaggaguucuuagauuacaugccuagcaugaaaagauuuagaaaggaagaggaaagugaaggcgcaauaugguaa

SEQ ID NO: 23403 - RNA, 9873 nt, Artificial Sequence
  derived and/or modified CDS sequence (opt6) from DENV-3__FJ639769__SS-prME
acgucguugugucugaugaugauacuaccugcugcuuuagcuuuccaucuaacaaguagagauggagaaccacgaaugauuguaggcaaaaaugaaaggggaaaaagccuucuuuucaaaacagcaagugguauaaauaugugcacucugauagcgauggaucuaggagagaugugcgacgauacagugacauauaaaugcccccauauaaccgaagucgaaccugaggauaucgacugcuggugcaaucuaacaaguaccuggguaacguaugggacauguaaccaagccggugaacaucgaagagauaaaagauccgucgcgcuagcgccacauguugggaugggacuagauacgaggacgcaaacauggaugucagcagaaggagcauggaggcaaguugaaaaagucgaaacaugggcauuacgacacccaggauuuacuauccucgcauuguuucuugcacauuauaucggaacuucacugacucaaaaaguggugaucuuuauauuguuaaugcuggugaccccauccaugacaaugagaugcgucgguguaggaaaucgagacuucguugaaggauuauccggagcaacauggguagaugugguguuagaacacggaggaugcgugacaacuauggccaaaaauaaaccaacacuagacauagaauuacagaaaacggaggcuacacaguuggcuacucuuaggaaauuaugcauagaaggaaaaauuacuaacauaacuacggauagucguuguccaacacagggagaagcgguacucccugaagaacaagaccaaaacuacguauguaaacauacauauguagauagaggcugggguaauggcugcggauuguuuggaaaagguagucucgugacuugugcaaaauuccaaugucucgaaccaaucgaaggcaaaguagugcaauaugaaaauuuaaaauauacuguuauuauuaccguacauacaggcgaccaacaucagguaggcaaugagacgcaaggugugacagcugaaauaacaccccaggcaagcacgacagaagcaauauuacccgaauacgguacauuaggucuugaaugcagcccuagaacaggucuugauuuuaaugaaaugauacuucuuacaaugaaaaauaaggcuuggaugguucaucgccagugguucuuugauuuaccuuuacccuggacgaguggggcuacaacggaaacaccgacuuggaacaggaaagaacucuuggucacauuuaaaaacgcucaugcaaagaaacaggagguaguuguucuggggagucaagaaggggcuaugcauacagcguuaacaggagcaaccgaaauacaaaacuccggcgggaccucgauauuugcaggacauuuaaaaugccgauuaaaaauggacaaacuagaacuuaaagguaugucauacgcaaugugcacaaauacuuuugugcucaagaaagaaguaagugaaacucaacacggaaccauucuaauaaaaguagaguauaaaggugaggacgugccguguaaaauaccguuuagcacagaagacggccaaggaaaagcgcauaaugggcgacuuauaacagcgaauccuguaguaacuaagaaagaggaaccggucaacauagaggcugaaccaccauucggagaauccaauauaguaauaggcauaggagacaaugcacuaaagauaaacugguauaagaagggcaguaguauaggaaagauguuugaagccacugcaagaggagcucgcagaauggcuauauugggagauacagcaugggauuuugguucaguaggcggagucuuaaacucacucggaaaaaugguacaucaaauuuucgguagugcauacacagccuuauucagcggcgucagcuggguaaugaagauuggaauaggaguguuacuuacauggauaggccuaaacaguaagaauacaucgaugagcuucucauguauagcaaucggaauaauaacauuguacuugggggcaguuguucaagcggacaugggaugcguaauaaacuggaaaggaaaagaauugaaaugcgguagcggaauuuuugucacgaaugaaguucauacguggacagaacaguauaaauuccaggcugacaguccuaaaagguuagcgaccgcuaucgcaggagccugggaaaacggaguaugcgggauacgaucgacaacacgaauggaaaauuuacucuggaaacaaauagcuaaugaauuaaauuacauacugugggaaaauaacauuaaacucacgguaguagucggugauauaauuggugucuuagaacaaggaaagcgaacauugacaccgcaaccaauggaguuaaaauacucauggaaaacuuggggcaaggcuaagaucguuacagcagaaacucaaaauagcucuuuuauuauagauggaccaaacacuccagagugcccaagcgcauccagagcuuggaacguaugggaaguugaagacuauggcuuugggguguuuacaacaaauauuugguuaaaauuacgagaaguguauacccaauugugcgaucaccgauugaugagcgcagcaguuaaagaugagagggcuguacacgcugauauggguuacuggauagaaagccagaaaaacggaucauggaaauuggaaaaggcaucguuaauugagguuaagacauguaccuggccgaaaucgcacacacucuggaguaauggugugcuggaaagcgauaugauuaucccaaaauccuuagcaggcccgauaagccagcacaauuaucgccccggauaccacacacagaccgcugguccauggcaucuugguaaauuagaacucgauuuuaacuauugcgaaggcaccacaguaguaauuaccgaaaacugugguaccagaggaccuaguuugcguacgacgaccguaagcgguaagcucauacaugagugguguugcagaucguguacauuaccaccacuaagauacaugggcgaagacgguugcugguaugggauggagauacgcccuauaagugagaaagaagaaaauaugguaaaaucccuaguaucugcagguagcggcgaagucgacaacuuuacaaugggaguacuuugcuuggcgauacuauuugaagaaguuaugcgggggaaauuuggcaagaagcauaugauagcuggaguguucuuuacguucguauugcuacucuccggucaaauuacguggagagacauggcgcauacacuuaucaugaucggauccaacgcauccgauagaauggguauggguguaacauauuuagcauugauugcaacguuuaaaauacaacccuuuuuagcgcucggauucuuuuuaagaaaacuuacaucccgagaaaauuuauuauuaggagucggucuagcuauggcaaccacuuugcaacugccagaagauauugaacaaauggcgaauggaauugcacuaggacuaauggcacuuaaauuaauaacacaauucgaaacuuaucaguuauggacugcgcuaauuaguuuaacguguagcaauaccaucuucacacucacgguagccuggcgcacagcuacacuaauacuggcuggcguuucacuacuacccguaugucaaaguucaucuaugagaaaaacggauuggcugcccaugacaguagcugcuaugggcguacccccacuuccccucuucauauuuagucuaaaagauacucugaaaagaagaagcuggccauugaaugaagguguuauggccgucgggcuuguaucaauauuagcauccuccuuacuccggaaugaugucccuauggccgggccauuaguggccgguggacuacuuaucgcaugcuaugucauaacagggaccagugccgaucugacaguugaaaaagcugcagacguaacuugggaggaagaagcggagcaaacagggguaucacacaauuuaaugauaacgguagaugaugacggcacaaugcgaaucaaagacgaugaaaccgaaaauaucuugaccguguuacuaaaaacagcacuuuuaauagugagcggcauuuuuccguauucuauuccugcaacacuacuuguauggcacacauggcagaaacaaacgcaacgaaguggugugcucugggauguuccaucacccccugaaacucagaaagcugaacuagaagaaggugucuaccgcauaaaacaacaaggcaucuucggaaaaacacagguuggaguggguguacaaaaagaaggaguauuucauacaauguggcauguaacgcgaggggcaguacucacuuacaaugguaaaagacuagagccgaauugggcaucagucaagaaggaucucauuucguacgguggugguuggagauuaucggcacaauggcaaaagggagaagagguacaagucauagcgguggaaccugggaaaaaucccaagaacuuccaaacuaugccugggaccuuccaaaccaccaccggugaaauaggugcaaucgccuuagauuucaagccgggaacgucaggcucaccuauaauaaauagagaagggaagguagugggcuuguaugguaauggaguugugacuaaaaauggcggguacgucagugguauugcccaaacaaacgcggaaccugacggaccaacaccagaauuggaagaagaaauguuuaagaagaggaauuuaacaauuauggauuuacaccccgggucagggaaaacgcgaaaauauuuaccugcaauaguucgggaagccauuaaacgaagguuaagaacucugauuuuggcuccuacacgagugguagcugcugaaauggaggaggcccuaaagggauugccuauacgauaucagaccacagcaacaaaaagugaacacacggguagggaaaucguggauuuaaugugucaugcaacauuuacgaugagauuacuuagccccgucaggguaccaaacuacaaccuuauuauaauggaugaagcucacuuuacggauccagcaucaauagcagcuagaggguauauaaguaccagaguagggaugggagaagcagcugccauuuuuaugacggccacaccaccugggaccgccgaugcuuuuccacaaucuaacgcaccuauucaagacgaggaacgcgauauaccagaacggaguuggaacuccggaaacgaauggauuacugauuucgcaggaaaaacaguaugguuugucccaagcauuaaagcaggaaacgauauagcaaauuguuuacgaaagaauggcaagaaaguaauacaacucaguagaaagacauuugauacagaauaucagaaaacgaaacuaaacgacugggacuucgugguaacgaccgacauuucugaaaugggagccaauuucaaggcagauaggguuauugauccccgaagaugccuuaagcccgugauucuaacagacggacccgaaaggguaauucuagcuggacccaugccaguaacagcagcuagugcugcgcaacgacgugguaggguaggccguaauccgcaaaaggaaaaugaccaauauauuuuuacaggacaaccuuuaaauaaugaugaagaucacgcgcauuggacagaagcaaagauguugcucgacaauauuaauacacccgaaggaauaauaccagcacucuuugaaccagagagagaaaaaucugcagcuauagauggggaguacagguuaaaaggagaaucccgaaaaaccuucguugaauuaaugcgacgaggagauuuaccggucuggcucgcucacaaaguugccuccgaaggaaucaaauauacggaccgaaaaugguguuuugaugggcaacggaauaaccaaaucuuagaagaaaacauggauguugaaauuuggacuaaagaaggagagaagaagaaacuaaggccuagguggcuagaugcucggaccuauucggacccguuagcgcuaaaagaauuuaaagacuuugcggccggaaggaaaucgaucgcucuugacuugguaacggagauaggccgagucccaacucaucuagcucaccgaacucgaaaugcacuugacaaucuuguuauguuacauacaucugagcacgguggaaaggcauauagacacgcaguggaggaacuaccugagacaauggaaacauugcuuuuauuaggacuaaugauucucuuaacugguggagcuaugcuuuuucuaauaucggguaaaggaauaggaaaaacaaguauaggauuaaucugugugaucgcgucauccgguaugcuuuggauggcagaaaucccuuugcaguggauagcuucagcuaucguucuugaauuuuucaugaugguucuucucaucccggaaccagagaaacagagaacuccacaagacaaccaacuggcuuacguugucauaggcauucugacuuuagcugcgauuauugcggcaaaugaaauggguuuacuagaaacaacaaaaagggauuuaggaaugucuaaagagccgggagucgucucucccacgucuuacuuagacguggauuugcauccugcaucagccuggacacuuuaugcaguggcgaccacuguaauaacaccaaugcuacgucauacaauagagaauaguaccgcaaauguaucguuagcugcaauugcaaaccaagcaguuguauugaugggguuagacaaaggauggccuauuuccaaaauggaucuaggaguaccucuacuugcauuaggauguuauucgcaaguaaauccacuaacgcuaacugcugcaguauuauugcuaauaacgcacuaugcaaucaucgggcccggucuucaagcgaaggcgacucgagaagcacaaaaacgcaccgcagcuggaauaaugaaaaacccaacaguggauggcauaaugacgauagaccucgacccuguaauuuaugauaguaaauuugaaaaacaacuuggucaagucaugcuccuaguauuaugcgugguacaauuacuacuaaugagaacaaguugggcacuuugugaagcacuuacgcuagccaccgggccuauuacgacgcuaugggaaggaucuccgggcaaguucuggaauacuacaauagccguaagcauggcaaauauauucagagguucauaccuagcaggagcuggacuagcauuuaguaucaugaagaguguaggaacaggcaaacgggguaccgguucucaaggugagacgcuaggcgagaaguggaaaaagaaacuaaaccaacuaucacguaaagaauuugaucuauacaagaaaucugggauaacggaaguagaccggacagaagcgaaggagggacugaaacguggggaaauaacucaucaugcugucucacgugguuccgccaaacuucaaugguuuguggagagaaacaugguaauucccgaagggaggguuauagaccuugguuguggccguggaggauggaguuauuauugcgcuggauuaaagaaaguaaccgaaguccgaggcuauacuaaaggugggcccggacaugaggaacccguuccuaugucuacauauggauggaacauugugaaacuaaugagcgggaaagacguauucuacuuaccacccgaaaaaugcgacacguuacuuugugauauaggagaaucaucuccuucuccaacaguagaggaaaguagaacaauaagagugcuuaaaauggucgagccguggcucaaaaauaaucaauucuguauuaaaguacuaaaucccuacaugcccacugugauagagcauuuagagagacuacaacguaaacauggcggaaugcuuguacgaaacccccugucacgaaauucuacccaugaaauguacuggauaaguaacggaacugguaauauaguugcgucuguaaacaugguuagucgucuccuccugaauagauuuaccaugacacaucguagaccuacgauugaaaaagacguagaccuuggcgcggggacuagacaugucaacgccgagccugaaacgcccaacauggacguaauaggugaaaggauaaaacggauaaaggaagaacauaauagcacuuggcauuacgaugacgaaaauccauauaagacuugggcauaucaugguagcuaugagguaaaggcaacagggucggcaagcucaaugauuaauggagugguaaaacucuugacuaaaccaugggauguaguuccaauggugacucaaauggccaugacagacacuacgcccuucggacaacagaggguauucaaagaaaaaguugacacgcgaacaccuagauccaugcccgggacuagaaggguaauggggauuacagcggaauggcuuuggagaacuuugggacgaaacaagaaaccgagacuauguacacgagaggaauuuaccaagaaaguaagaacgaaugcagcgaugggugccguauuuacggaagaaaaccagugggauucagcuaaagcagccgucgaagaugaggacuuuuggaaauuaguagaucgugaaagagaauuacauaaacuaggcaaaugugguuccuguguauauaacaugauggguaagcgcgagaagaaauugggagaauuuggaaaagcaaaaggaucaagagccauuugguacauguggcuaggagcgagguaucucgaguucgaagcucucggauuccuaaaugaggaccacugguuuucuagagaaaacagcuauaguggcguggaaggagaaggacugcauaagcuaggauacauacucagagauaucucgaaaauuccgggaggcgccauguaugcagaugauacagcuggaugggacacaaggauaacugaagacgaucuacauaaugaagagaaaaucacucaacaaauggauccggagcaucgucaauuagcuaaugcaauauucaaauuaacauaucaaaacaagguagugaaggugcaacgucccacacccacaggaacaguuauggacaucauaucuagaaaggaccagagaggaagcggccaaguaggcacguacggccucaauacuuuuacaaauauggaagcccaacuaaucagacaaauggaaggagaagguguauugucuaaagcagauuuggaaaauccacaucugccggagaagaaaauuacacaauggcuagaaacaaaaggagucgagcgucuaaaacgcauggcaauaaguggagaugacugugucgugaagccgauagaugaccgauucgcaaaugcgcuccucgcgcucaacgacaugggaaaaguccgaaaagauauaccacaauggcaaccaucaaagggauggcaugauuggcagcagguucccuuuuguagccaucauuuccacgagcuuauaaugaaagacggucgaaaauuaguagugcccugcagaccucaagaugagcucaucggccgagcucgaauuucacaaggcgccggauggagucugagagaaacagcaugcuugggaaaggcuuacgcucaaauguggucuuugauguacuuucauaggcgugaucuuagacuagcaucuaaugcaaucugcucggccguuccaguacauugggugccaacuagcagaaccacauggucuauccacgcccaucaucaauggaugacgaccgaagauaugcucaccguguggaaccgaguauggaucgaggauaaccccuggauggaggacaaaacaccaguuacgaccugggagaacguucccuauuuagguaaacgcgaggaccaguggugcggaucgcucauaggucuaacuagcagggcaaccugggcacaaaacaucccuaccgcaauacagcagguacgaagccugauugguaacgaagaauuuuuagacuacaugccgucgaugaagagguuccggaaggaagaggaguccgaaggagcaaucugguaa

SEQ ID NO: 23404 - RNA, 9873 nt, Artificial Sequence
  derived and/or modified CDS sequence (opt6) from DENV-3__FJ882577__SS-prME
acaagccuuuguuuaaugaugauauugcccgcagcauuggcuuuccaccuaacaucacgagauggagaaccacgcaugaucguuggcaaaaacgagagagguaaaucucugcuauucaaaacagcaagugguauuaauauguguacccuaauugcgauggacuuaggagaaaugugugaugauacugugacuuauaaaugcccgcacauaacagaaguugaacccgaagauauugacuguuggugcaauuuaacaucuacguggguuaccuauggaacauguaaucaagcaggagaacacagaagagacaaacguucgguugcacuagcgccacauguaggaaugggauuagauacacggacccaaacuuggaugucagcagaaggagcauggcgucaaguagagaaaguagaaacaugggcgcuacgccacccggguuucacuauacuagcucuauuccucgcacacuauauagguacaaguuugacgcaaaaaguuguuauauucauauuauuaauguugguaacuccuagcaugacaaugagaugugucggaguaggcaauagagacuucgucgaaggguuaagcggugccacauggguugacgugguacuugaacacggcggcugcguaacuacaauggccaaaaauaaaccuaccuuagauauagaguuacagaaaaccgaagccacucaauuagcaacguugaggaaacucugcauagaagggaaaauuacgaauauuacgacagacaguagaugucccacucaaggagaagcuguucuuccugaagaacaagaucaaaauuauguuuguaaacacacauacguugaucgaggaugggguaauggaugcggacuauuuggaaaaggaucguuagucacaugugcaaaauuccaaugucuugaaccgauagaagggaaaguaguacaauacgaaaaucucaaauacacaguuaucauaaccgugcauacaggugaucaacaucaagucggaaaugaaacgcaaggagugacagccgaaaucaccccacaagcaucuacaacagaagcaauucugccugaauacgguacacuaggauuagaguguucucccaggacaggacuggauuuuaacgaaaugauucuauugacuaugaaaaauaaagcauggaugguacacagacaaugguucuucgaccuuccguuaccguggacaucaggugcaacuacagagacacccaccuggaauagaaaagaauugcuuguuacguuuaaaaacgcccaugcgaaaaagcaagaaguaguaguacuuggaucucaggagggggcaaugcacacagcacugacaggcgcaacggaaauccaaaacuccggcggaacaaguauuuucgcaggacaucuaaagugucgguuaaaaauggauaaacuagaacuaaaaggaaugucauaugcgauguguacaaauacauuuguucugaagaaagaaguaagugaaacacagcacggaacuauuuugauuaaagucgaauauaaaggagaagacgugcccuguaaaauaccuuuuuccacggaagacggccaaggaaaagcucacaauggucgacuaauaacggcaaaccccguggucacuaagaaagaagaaccgguaaauaucgaggccgaacccccauucggugaaucuaauauaguuauugguauuggagauaaugcccuaaagaucaacugguauaagaaagguucaucuauugguaaaauguuugaagcaacggccaggggcgcucguagaauggcaauacuuggagacacugcuugggauuucggcagcguaggaggaguauuaaauucguuaggcaaaaugguucaucagaucuucgguagcgcauacacugcacuuuucucgggaguaagcuggguaaugaagaucggaauaggcguucuauuaacauggauaggucuaaacagcaaaaauacuucaauguccuuuucauguauagcuauaggaauaaucacccuauaucucggcgcaguaguacaagcagacaugggcugcguuauaaauuggaaggggaaagaacuuaaaugugguucugguauuuuugugacuaaugagguacauacuuggacggaacaguauaaguuccaggcagauucgccgaagagacuagccacagcaauugcuggagcaugggagaauggaguauguggaauuaggagcaccacuagaauggagaaucuauuguggaagcaaauagcuaacgaacuaaacuacauacuuugggaaaauaauauaaagcuaacuguuguagucggggacaucauaggaguucuugaacaaggaaaacggacguugacuccacagccuauggaacugaaauauaguuggaaaacaugggguaaagcaaaaauagugacagcagaaacacaaaacaguucauuuauuauagaugguccuaacaccccggaguguccgucggcuaguagagccuggaacgugugggaggucgaagauuacgguuuugggguauuuacaacgaacaucuggcuuaaauuacgugaggucuacacccaacuaugugaucauaggcucaugucagcugcgguaaaagaugagcgcgccguacaugccgacaugggcuacuggauagaaucacagaaaaaugggucuuggaaacuugaaaaagcauccuuaauugaaguaaaaacauguacuuggccaaaaagucacacacuuuggucaaacgguguacuugaaucggacaugauaauuccaaaaucucuugccggcccaauaucacagcauaacuaucgcccugguuaucacacucaaacggcggguccauggcaccuggguaaauuagaacuugacuucaauuauugcgagggcacaacaguagucauuacugaaaauugcggaacaagaggaccgucauuaagaacuaccacugucagugguaaacuaauccaugagugguguuguagauccugcacguuaccgccccuaagauacaugggagaagauggauguugguacggcauggaaauaagaccaauaagugagaaggaggaaaauauggugaaaucuuuaguuagcgcugguucaggagaaguagacaacuuuacgaugggaguccuaugcuuggcuauccucuuugaagaagugaugagggguaaauuuggaaagaaacacaugauagcagggauauucuuuacuuucguucuucuacuaucuggccaaauaacuuggagagauauggcacauaccuuaauaaugauaggaucuaaugcuuccgacagaaugggaaugggcguuaccuaccuugcucucauugcuacuuuuaagauacaaccauuccuugcacuuggauucuuucucagaaaauugaccuccagggagaauuuguuguuggguguuggccuggcuauggcaacuacgcugcaacuaccugaagauauagaacaaauggcaaacggcaucgcgcuugggcuuauggcacuaaagcugaucacucaauucgaaacuuaccaacucuggacggccuuaaucagcuugaccugcagcaauacaauuuucacacuaacuguagcuuggagaaccgccacucuuauucuagccgguguaagccuucuacccguuugucaaagcagcucuaugaggaaaacggauuggcugccgaugacuguagcggcaaugggagugccgccacuucccuuauucaucuuuucauuaaaagauacacuuaaacgaagaucauggccauuaaacgaaggaguaauggcgguugggcuagucucgauauuagcgaguuccuuacuacgaaaugacgugccaauggcugggccguuaguagcaggcgguuuacuuauugccugcuaugugauaacgggcacuucagcggaucuaacaguugaaaaggcggcggacgugacaugggaagaagaggccgagcaaacaggcgucucacauaauuuaaugauuacuguagacgaugacgggacgaugaggauaaaagaugacgaaaccgaaaauauauugacagucuuauuaaaaacagcccuuuuaauuguaucugguauauuuccguauagcauaccagccacccuauuaguguggcauacauggcaaaaacaaacacagaggucaggcgucuuaugggauguuccaaguccaccugagacucagaaagcggaacuggaagaaggcguauaccgaauuaaacaacaggguauauucgggaaaacacaaguuggugugggagugcaaaaagaaggagucuuucacacgauguggcaugugacacguggagcggucuugacguauaaugguaaaagacuagagccgaauugggcgucagucaagaaagaccuaauuaguuacggaggcggauggcguuuaagcgcccaguggcaaaaaggugaagaaguucaaguaauugccguugaacccggcaagaaccccaaaaacuuccaaacaaugccugggacuuuucaaacuacuacaggagaaauaggagcuauagcgcuagacuuuaaaccuggcacaucaggcagcccuauaaucaauagagaaggaaaaauaguaggcuuauacgguaacgguguagugacuaaaaauggaggcuauguaaguggaauagcccagacaaacgcagaaccggauggccccacuccagagcuagaagaagagauguuuaagaagagaaaucucacaauaauggaccuccacccuggcucggguaagacaagaaaauaucuuccugcgaucguaagagaagccauuaaacgaagacuacgaacauugauccucgcuccaaccagaguugucgcagcagaaauggaggaagcacuuaaagguuuaccaauuagguaucaaacuacagcaacgaaaagcgaacauacaggcagggaaauuguugauuuaaugugccacgcuacuuuuaccaugagguuacuaagcccagugagggucccaaauuacaauuuaauaauaauggacgaagcgcacuuuacagauccugccucaauagccgcuagaggauauauuuccacucgaguuggaaugggugaagcagcugcuaucuucaugacagccacgccacccggaacagccgaugcauuuccacagucaaaugcccccauucaggacgaagaaagggauaucccagaacguuccuggaacucgggcaaugaauggauuacagauuuugccggaaaaaccguuugguuuguaccgucaauaaaggcagguaaugauauagcgaauugccuuaggaaaaauggcaagaaaguaauacagcuuucacgaaagacuuuugacacagaauaucagaaaacaaaacuuaaugacugggacuucguuguaacuacagacauaagugaaaugggcgcaaauuuuaaggcugauagaguaauagauccaagacgauguuuaaagccgguuauauuaacagauggaccagagcgaguaauauuagcagguccaaugcccguaacagcugcaagcgcugcucagcgacgaggucgaguuggacguaauccucaaaaagaaaaugaucaauauauauucacaggucaaccucugaauaacgacgaagaccaugcccacuggacugaagcaaaaauguuacuagacaauauuaauacaccugaggggauaauuccugcacuauuugagccagaacgagagaaaucagcggccauugacggugaauacagauugaaaggcgaguccagaaaaacauuuguggaauugaugagaaggggugaccuuccaguuugguuggcgcauaagguugcaagugaaggaauaaaguacacagacagaaaaugguguuuugacggacagcgaaauaaucaaauacuggaagaaaauauggauguugaaauauggacaaaggaaggagaaaagaaaaaguugagacccagguggcuugacgcaagaaccuacagugauccacuugcauuaaaggaauuuaaggauuucgcagccgggagaaaaagcauagcauuggaucuaguaaccgaaauuggacguguaccuacgcauuuggcucaccggacaagaaaugcucuugauaacuuaguaaugcugcauacauccgaacaugggggcaaggcguacagacacgcgguagaagaacucccugaaaccauggagacauuauuauugcugggucucaugauauuacuaacgggcggagcgauguuauuuuugauuucugguaaaggaauugggaaaacaucaauaggccucaucugcgugauagcgaguaguggaaugcuauggauggcugaaaucccacuacaauggauagcuucggcuauaguauuagaguuuuucaugaugguucuucuuaucccagaacccgaaaagcaaagaacaccccaggacaaccaguuagcauacguaguuauugguauucuaacgcuggcagcaauuaucgcagcaaacgaaaugggacuacucgagacuacuaagagagauuugggaaugaguaaagaaccaggagucguuucgccaaccucguacuuggauguugaccuucacccagcaucagccuggacuuuauacgccguagccacgacuguaauaacaccgaugcuaaggcauacuauagaaaacagcacugcaaaugucagccuggcagcaaucgcaaaucaagcuguuguauuaaugggucuugacaaaggcuggccgauaaguaaaauggaucuagguguaccuuuacucgcacugggaugcuauucccaaguaaaucccuuaacacuaaccgcagcaguguuacucuuaaucacucauuacgccauuauaggaccuggacuucaagcaaaggccacaagagaagcucaaaaacguacugcagcagguauuaugaaaaauccaaccgucgacgguauaaugacaauugauuuagaucccguuauuuaugacagcaaauuugagaaacaauugggacaagucauguuauuaguacuaugugcagugcaauuacuauugaugaggacuucaugggcauuaugugaagcucuaacauuggccacaggaccaaucacuaccuugugggagggauccccaggaaaauucuggaauacuacaauagcgguuagcauggcuaauaucuuccgcggcucauauuuagcuggcgcgggccuagcuuucaguauuaugaaaucgguugguacaggaaaaagagggacuggaagucaaggugaaacuuugggagaaaaauggaaaaagaaacuaaaccaacugagucggaaagaguuugaccuauacaagaaaucaggaaucacagagguggaucgaacagaagcaaaagaaggauugaaaagaggagagauaacacaucacgcaguuaguagaggaagugcuaaacuucaaugguuuguugagcggaauaugguuauacccgaggguagggugauugaucugggguguggaagaggcgguuggucauauuacugugcuggacuaaagaaagugaccgaagugagaggcuacacaaaagguggucccggucaugaagaaccuguuccuaugucuacuuauggauggaacauuguaaaauuaaugagcgguaaagauguauuuuacuuaccaccagagaaaugcgauaccuuauuaugugacauaggcgaaucaucaccuucaccaacagucgaagaaucuagaacaauccgugucuuaaagauggucgaaccguggcucaaaaauaaucaauuuuguauaaagguauugaauccauacaugccaacuguaauagagcaucucgaaagacuucagagaaagcacggcgguauguuggugagaaauccauugucucgcaacagcacacaugaaauguauuggauaaguaacgguacugggaacauagucgcaucagugaauaugguaucaaggcuacuguugaaccgcuucacuaugacacaccgucgaccgacuauagaaaaagauguugaucuaggcgcggggacacgacauguaaaugcugaaccagaaaccccuaauauggauguuaucggcgaaaggauaaaaagaauaaaagaggaacauaacaguacuuggcacuaugaugaugaaaauccuuacaaaacaugggcauaucacggaaguuacgaagugaaagccacgggaagugcgaguucaaugauaaauggcguggucaaauuauugacgaagccuugggacguaguuccuaugguaacccaaauggcaaugacugacacaacuccuuuugggcaacaacgaguuuucaaagaaaaaguagauacucguacaccucgcagcaugccagggacuagaagaguuauggguauuacagcagaauggcuauggaggacacucggaagaaauaagaaaccaagguuauguacgagagaagaauuuacuaagaaaguaagaacuaaugccgcaaugggugccgucuuuaccgaagaaaaccaaugggauucggcgaaggcagcaguggaagaugaggauuucuggaaacuuguagaccgugaaagagagcuacauaaauugggaaaguguggaucuugcguuuauaacaugaugggcaaacgugagaagaaauuaggugaguuugguaaagccaagggaucacgggccauaugguauauguggcuaggcgcucguuaccucgaauuugaagcguuaggcuuuuuaaacgaagaucauugguuuaguagagaaaauucauauucaggaguagagggagaaggucuucauaagcugggguauauucuuagggacauaaguaaaauaccagguggcgcgauguaugcagaugacacugcuggaugggacaccagaauuacagaggaugaucuacauaacgaggagaaaauaacacaacaaauggauccagaacaccggcaguuagccaaugcgauauuuaaacuuacauaucagaacaaagugguuaaaguucaacgaccaaccccuacagguacaguuauggauaucaucagccgaaaagaucaaagagggucaggacaaguuggaacauauggguuaaauacauucacuaauauggaagcucaauuaauaagacaaauggaaggcgagggcguguuaucaaaggcugaucuagaaaauccucaucuaccugagaagaaaauaacucaguggcuagagacgaaaggcguggaaagauuaaaacguauggccauuaguggggacgauugcguaguaaaaccaauagacgaucgauucgcgaaugccuuguuagcauuaaacgauauggggaaggugcggaaggauaucccacaguggcaaccuucgaaaggguggcacgauuggcaacaagugccauuuuguucccaucacuuucaugaacucaucaugaaagauggucgcaagcuaguagugcccugucgcccucaagacgaacuaauagguagagcaagaaucagccaaggcgcugguuggucacuccgugaaacagcuuguuuaggcaaggcauacgcacaaauguggucacuaauguacuuucaccgccgcgaucuucgauuagcgucaaacgccauaugcucggcaguaccuguacacuggguacccacaucuagaaccacauggagcauacaugcacaucaucaauggaugaccacugaagauaugcuuaccguauggaaucgaguguggauugaagacaacccuuggauggaagauaagacgccgguuaccacaugggaaaaugucccuuaucuaggcaaacgggaagaucaauggugcgguucgcuaauuggcuuaacuuccagagcgacgugggcucagaauauuccaacugccauccaacaaguacggucucuaauugguaacgaagaguucuuagauuacaugccgucaaugaaaagguuucguaaggaagaagaaagugagggugcuauaugguaa

SEQ ID NO: 23405 - RNA, 9873 nt, Artificial Sequence
  derived and/or modified CDS sequence (opt6) from DENV-3__FJ850096__SS-prME
acgagucuaugucugaugaugauucugccagcagcucuugccuuucaucuaacuucuagagauggagaaccaagaaugaucguagggaaaaaugaaagaggcaaaucuuuauuauucaaaacagcuaguggcauaaacauguguacgcuuauagccauggauuuaggggaaaugugugacgauacaguaaccuacaaauguccucauauuacagaagucgaaccugaagacauugauuguuggugcaaccugacuucgacuugggucacguacggaacuuguaaucaggccggugaacaccgucgagacaaaagauccguggcauuagccccgcauguuggcaugggacuugauacucgaacucaaacuuggaugagugcggaaggcgcauggagacaaguagaaaaaguagaaacgugggccuuaagacacccuggcuuuacaauauuggcauuauucuuggcucauuauauagguacaagucuaacgcaaaaaguuguaauuuucauccuauugaugcuaguuacgcccucaaugacaaugaggugcguugguguggguaauagagauuuugucgaaggacuaucaggagccacauggguugaugugguacuugagcacggcggauguguaacaacuauggcgaaaaacaaaccaacguuagauauagaacuacagaaaacugaagcaacacaacuagcgacacuaagaaaauuguguauugaggggaaaauaacaaacaucacgacugauucuagaugcccgacgcaaggagaagccguauugccagaggaacaagaccaaaacuacguaugcaagcacacauauguagauaggggcuggggaaauggcuguggccuuuuugguaaaggaucgcuaguuacaugugccaaauuucaaugccuggaaccaaucgaagguaagguuguacaauaugaaaauuuaaaauacacuguaauuauaacuguucauacgggggaccagcaucagguaggcaacgagacacaagguguaacagccgaaauuacgccgcaagccaguacuacugaggcaauucuacccgaauacgggacacuuggccuugaaugcucuccaagaacaggacuggauuucaaugagaugauacuucuaaccaugaaaaauaaggccuggaugguucaucgacaaugguucuuugaccugccacuuccauggaccucaggagcgacaacggaaacacccacuuggaaccgcaaagaacuauuaguaacauucaaaaacgcccaugccaagaaacaagaaguuguaguauuagguagucaagagggagcaaugcacacugcauugacuggugcaaccgagauacaaaauagcgggggcacaucuaucuuugcaggacacuuaaaauguagacuaaagauggacaaauuagaguugaaagguaugaguuacgcgauguguacaaauaccuuuguacuaaagaaagagguaucagagacacaacaugggacgauucuaauaaagguugaauacaagggggaggaugucccauguaagauaccuuuuucgacagaagauggucaaggaaaagcucacaacgguaggcuaaucacugcgaaucccguagugacgaagaaagaagaaccaguaaacauagaggcagaaccgccguuuggcgaaucuaauauaguuauagggauuggagauaaugcccuaaaaauaaauugguacaagaaagggucaucaauuggaaagauguuugaggcaacugcgcgaggcgcaaggagaauggcaauuuuaggcgauacggcuugggacuuuggaucaguuggagguguacuaaauucauugggcaagaugguacaccagauauucggaagugcuuacacagcucuguuuagcgguguuagcugggucaugaagauugguauaggucuacuguugacguggauuggacuaaauucuaaaaacacgaguaugagcuuuucauguauugcgauagguauaauaacauuguaucuuggugcaguugugcaagcugauaugggauguguaauuaauuggaaaggaaaagaacuaaaguguggaucuggaauuuucguaacuaaugaaguucacacuuggaccgaacaguauaaauuucaagcggauucaccuaaacgacuugccacagcaauugccggcgcaugggaaaauggcguauguggcauucggucaacaacgcgcauggaaaauuuacuguggaaacaaauagcaaacgaauuaaauuacauacuaugggaaaacaacaucaaauugacuguaguaguuggugauauaauuggaguccuggaacaaggcaagagaacguuaacaccacaaccuauggaauuaaaauauucauggaaaacuugggggaaagcaaaaauagucacggcggaaacacaaaauagcaguuuuaucaucgaugguccaaacaccccggagugucccagcgcauccagagcauggaacguaugggaaguggaggauuacggcuuuggaguuuucacaacaaauauaugguugaaacugagagaaguauauacucaauuaugugaucacagguuaaugagugcggccguaaaggaugaacgcgcaguacaugcagacaugggguauuggauagaaagucagaaaaaugguucauggaaacuugaaaaagcgucauugauagagguaaagaccuguaccuggcccaaaucgcacacauuauggagcaaugguguauuagagagugacaugauaauaccaaaaucguuggcaggaccgaucucacagcauaacuauaggcccggauaccauacacaaacagccggcccguggcacuuggguaaauuagaauuagauuucaauuacugcgaagguacgacgguaguaauuacggaaaacugcggaacaagaggcccaaguuugcggacuacaacgguaucugguaaacuuauacacgaauggugcugucgaaguuguacauuaccgccauuacgcuauaugggcgaagauggcuguugguacgguauggaaauuagaccgauaagugagaaagaggagaacaugguaaaaucgcugguuucagcggguagcggagaaguugauaacuucacaaugggaguauuaugcuuagcaauuuuauuugaagaggugaugcgggguaaguuugguaaaaagcacaugauagccgggguauucuuuacauuuguuuuauuacuaucuggacaaauaacauggagagacauggcccacacauugaucaugauaggauccaacgcuucagaucgaauggggaugggcguaaccuaucucgcauuaauagcuacguucaaaauacaacccuuccuugcguuaggguucuuuuugagaaaacuuacuucaagggaaaaccuacuacuagguguaggacuagcaauggcuacaacacugcaacuuccagaagauauagaacaaauggcaaaugguauagcucuaggccuuauggcguugaaacucaucacacaauuugaaacauaucaacuauggacagcauugauaucuuuaacuugcuccaacacuaucuucacguuaacaguagcauggaggacugcuaccuuaauacuagcuggcgucagucuccuaccagucugucagucaucaucuaugaggaaaacggacuggcuaccuaugacuguggcugccaugggaguuccuccgcuaccuuuguuuauauucaguuugaaagauacucugaaaagaagaaguuggccguuaaaugaaggagugauggcggugggauuaguuucaauccucgcaucguccuuauuacggaaugacgugccuauggcagguccauuaguugcgggcgguuuauugauagcuuguuaugucauaacaggaacgagugcagaccuuaccguggaaaaggcggcggacguuacaugggaagaagaagcugagcagacaggaguaagccacaaccuuaugaucacaguugaugaugaugguacaaugaggauaaaagaugaugaaacagaaaacauucuaacaguacuuuuaaaaacggcacuacugauaguaucagggauauucccuuauucaauaccugcgacauuauuaguauggcacaccuggcaaaagcaaacgcaaaggaguggaguguugugggaugucccgaguccgccugaaacucaaaaggcagaguuagaagaaggaguauauagaaucaaacaacaaggaauuuuugggaagacacagguaggcguuggcguacaaaaagaaggagucuuccacacaauguggcauguaacucgcggugcuguuuuaacuuacaacgguaaacguuuagaaccuaauugggcaagugucaagaaagaucuuauuaguuacggaggugguuggcgcuugagugcucaauggcaaaaaggagaagagguucaggugauagcagucgaaccaggaaagaauccgaaaaauuuucaaacaaugccagggacauuucagacuacaacaggcgaaaucggagcuauagcauuagacuuuaaaccugguacaucaggaucuccaauaauuaacagagagggcaaaguggugggucuuuauggcaauggcguuguaacuaaaaacggaggauacgugagcgguaucgcgcaaacuaacgcugaaccagaugggcccacaccggaacuagaagaagagauguucaagaaacguaacuuaaccauuauggauuugcauccagggagcgguaaaacacgaaaguaucucccagcaauaguaagagaagcaauaaagcgaagguuacgcacacuuauuuuggcgcccacgcgagugguagcagcagaaauggaggaagcucuaaaaggauuaccaaucagauaucaaacuacugcaacaaagucggaacauacgggcagagaaauuguggauuuaaugugccaugcgacauucacaaugcgcuuauugucaccaguacgaguuccaaacuacaauuuaauaauaauggaugaagcccacuuuacugauccggcaucgauugccgcgaggggcuauauaagcacaagaguaggcaugggagaagcagccgcaauuuuuaugacggcaacgccaccaggaacugcugacgcauuuccccaaucaaaugcuccuauucaggaugaagaacgggauauuccagagagauccuggaacucaggaaacgaauggaucaccgauuuuacaggcaaaacaguaugguucguaccaagcauuaaggcagguaaugauaucgccaauugccuaaggaaaaaugguaaaaaggugauccaauuaucacgaaaaacguuugauaccgaauaucagaaaaccaaacuuaaugacugggauuucguaguaacuacugacauuucggaaaugggcgcuaauuucaaggcugaccgaguuauagaccccagacgaugucugaagccaguaauuuugacagacgggccagaaagaguuauuuuagcgggcccuaugcccgucaccgcggccagugcagcacagagacguggacguguuggaaggaauccucaaaaagagaacgaucaauacauauucaccggucagccacuaaauaacgaugaagaucaugcacacuggacugaggcgaagauguuacucgauaauauuaauacuccggaaggaauaauucccgcauuauucgagccagaaagagagaagucagcagccaucgacggagaguaucgucuaaagggcgaaucacguaaaacguuuguagaacugaugcgucgaggugaucuucccguuuggcucgcacauaaaguagcuagcgaagguaucaaauacacagaucgcaaauggugcuuugauggacaaaggaacaaccaaauauuggaggaaaauauggauguggagauuuggacuaaagaaggggagaaaaagaaacuacguccgcgaugguuagaugcacgaacauauagcgacccccuugcucuaaaagaauuuaaagacuuugcagcgggaagaaaauccaucgcucuggaccuuguaaccgaaauagguagaguuccaagccacuuggcgcauaggacgcguaaugcacuugauaacuuaguaaugcuucauacaagcgaacauggcgguaaagccuaccgccaugcaguagaagaauuaccagaaaccauggaaacgcuacuucuauuggggcuaaugauucuauuaaccggcggagcaaugcuguuccugauaaguggaaaaggaauaggaaaaacaucuauaggguuaauaugcguaauugcuaguaguggaaugcuauggauggcggaaaucccacuccaguggauagcaucagccauaguacuggaauuuuucaugaugguguuacugauuccugaaccagaaaaacaacggacaccacaggacaaucaauuagcauacguagugaucggcauauuaaccuuggcagcgauuauagcagcuaacgagaugggacuacucgaaacuacuaaaagggaccuaggaaugaguaaagagccuggaguuguuucgccaacaucauacuuggauguagacuuacacccugcauccgcuuggacauuguaugccguagccacuacaguaauaacacccaugcuaagacacaccauagaaaauagcacggcaaauguaaguuuagcagccauagcaaaucaggcaguagugcucaugggucuugacaaaggauggcccauauccaaaauggauuuggguguuccauuauuggcucucggguguuauucacaagucaaccccuugacccucaccgcugcuguguugcugcuuaucacacacuacgcgauaauuggaccgggacuccaggcaaaagccacucgcgaagcgcaaaagagaacugcugcaggaauaaugaaaaacccaacaguggaugggauaaugacaauugacuuagauccaguuauuuaugacaguaaauuugaaaaacaacucgggcaaguaaugcucuugguauuaugcgcaguucaacuacuuuuaaugagaacaucaugggcauuaugcgaggcguuaacacuugcuacgggaccaauaacaacucuaugggaaggaucaccagguaaauuuuggaauacuacgauagcugucucgauggcgaauauauuuagggggucuuauuuagccggugcuggacuagcuuucagcauuaugaagucuguggguaccggaaaacgaggaacuggaucucaaggagaaacucuaggugagaaauggaagaagaaauuaaaucagcucagucgaaaagaguucgaccuauauaagaaaagugggaucacagaaguugacaggaccgaggcaaaagaaggccuuaaaagaggggagauaacucaucaugcaguuaguaggggaagcgcaaagcuacaaugguucguugaaaggaauaugguuauaccagagggacgaguaauagaucuugggugugggagaggcggauggagcuauuauugcgcuggccuuaaaaaggucacugaaguaagaggauacacgaagggaggcccaggccacgaagaaccaguaccuaugucaacuuauggcuggaauauaguaaaacuuauguccggaaaagacguauuuuaccuuccaccagaaaaaugcgauacccuacuaugcgauauaggagagucaucuccaucacccacaguugaagaaucacgcacuauacgcguacuaaaaauggucgaaccuugguugaaaaacaaucaauuuugcauuaagguguuaaacccuuauaugccgacuguuauagaacaucuugaaagguuacaaaggaaacacggagggaugcuaguaagaaacccgcugagccggaacagcacacaugaaauguauuggauauccaacgggacuggcaauauagucgcgucugugaacaugguaucaagacuauuauugaauagauuuaccaugacucaucgaagaccaacuauugagaaagauguagaccuaggagcuggaacuaggcacguaaacgcugaaccagaaacaccaaauauggauguuauuggggaaagaauuaaaagaauuaaagaagaacacaacucaacguggcacuaugaugaugaaaauccuuacaaaacaugggcauaucaugggagcuacgaaguuaaagcuacgggaagugcuucaucuaugaucaauggaguagucaaacuccuaacaaaaccaugggaugucgucccaaugguaacgcaaauggcaaugacugacaccacuccuuucggccagcaaaggguauuuaaagaaaaaguugacacccgaaccccacguaguaugccuggaacacgaagagugaugggaauaacugcugaaugguuguggcgaacauuaggccggaacaaaaagccgcggcucuguacacgagaggaguucacuaagaaaguacguacuaaugcugcuaugggcgccgucuuuacugaggagaaucagugggacucagcaaaagcggcggucgaagaugaagauuucuggaaauuaguagaucgagaacgcgaguuacacaaauuagggaaaugcggcucuugcguuuacaauaugaugggaaaacgcgagaagaaauuaggggaauuuggaaaagcuaaaggaagcagagcuaucugguauaugugguuaggagcaagauaccuagaauuugaggcucucggcuuuuuaaacgaagaucacugguuuucaagagaaaacaguuauagcggaguugagggugaagggcugcauaaauuaggguauauuuugcgugauauaucgaagauucccgggggagcaauguaugcagaugauacagcggggugggacacgagaauaaccgaagaugauuugcauaaugaggagaaaauaacccagcaaauggauccagaacaccggcaacuugcgaaugcuauauuuaaacucacauaccagaauaaaguaguaaaaguacaacgaccgacaccaacggguacugugauggacauuaucucaaggaaagaucagcguggaucuggacaagugggcaccuacggauuaaacacauucacuaacauggaggcccaacuaaucagacaaauggagggcgaagguguauuauccaaagcugauuuagaaaauccucauuuacccgaaaagaaaauuacacaauggcuagaaacuaaaggcguugaaagguuaaaacgaauggccaucuccggagacgauugugucguaaaaccgauugaugaucguuucgccaaugcgcuguuggcauuaaaugacaugggcaaaguucgaaaagacauaccacaauggcagccaucaaaaggauggcacgacuggcaacaaguucccuuuuguucacaucauuuccacgagcuaauaaugaaagacggacguaaacugguaguucccugcagaccccaagacgaguuaauagggagagcucguauaucgcaaggggcagguuggucucuuagagaaacagcaugccuagguaaagcauacgcacaaauguggagccuaauguacuuucauagaagagaucuacgucuagcaucaaaugcaaucuguagugcgguucccguacauugggucccaacgucgcguacuacguggucgauacaugcucaucaccaauggaugacaaccgaagauaugcuuacaguauggaacagaguauggauagaagauaauccguggauggaagauaagacaccuguaacuacaugggaaaacguaccauaucuugguaaacgagaagaucaaugguguggcucuuuaauugggcuaacaucgagagcaacaugggcucagaauauaccaacugcuauccaacaaguacgaagucuuauuggaaaugaagaauuucuugauuauaugccuucgaugaaacgguuuaggaaagaagaggaaucggagggagccaucugguaa

SEQ ID NO: 23406 - RNA, 9873 nt, Artificial Sequence
  derived and/or modified CDS sequence (opt6) from DENV-3__FJ882578__SS-prME
accucacuaugccuaaugaugauauuaccagcagcucucgcuuuccaucuaacgaguagagacggagaaccgaggaugauaguugguaaaaaugaaagaggaaaaucgcuacuuuuuaaaacagcaucugggauaaacaugugcacacuaauagcaauggaucugggagaaaugugugacgacacuguaacauauaaauguccccauauuacagaaguugaaccagaagauauugacuguugguguaacuuaacaaguacuugggucacguaugggacauguaaccaagcgggagaacaucgaagagauaaaaggaguguugcucuagcgccgcauguuggaaugggguuggacacaagaacucaaacuuggauguccgcugaaggcgcauggagacaaguagagaaaguagaaacaugggcacugagacacccggguuuuacuauuuuagcacucuuuuuagcacauuauauagguacaagccucacgcagaaaguaguaauuuucauucucuuaauguuagugacaccguccaugacuaugaggugcgucggcgugggcaauagggauuucguagagggauuguccggggcaaccuggguggauguagucuuagaacauggaggauguguaacaaccauggccaaaaacaaaccaacauuagauauagaauuacagaaaaccgaagcaacacaguuagcuacucuacgaaaacuuuguaucgaaggaaagauaacaaauaucacaacagacucuaggugcccuacgcagggagaagcaguacuaccagaagaacaagaccaaaacuauguuugcaagcauacguauguagauaggggauggggcaauggaugcggauuauuuggcaaaggcucguuggucacaugcgcuaaauuucaaugccuagaacccauugaggguaagguuguucaauacgaaaauuuaaaauacaccgucauuaucacuguccacacaggagaucaacaccaaguaggcaaugaaacacaaggaguaacagcggaaauuacaccccaggcaucaacaaccgaagcaauucugccagaauauggcacgcuagggcuagagugcucgccaagaacagguuuggauuucaaugagaugauauuauuaacaaugaagaacaaggcuuggaugguccacaggcagugguucuuugacuugccauuaccuuggacuucuggugcaacaaccgaaacgccaaccuggaauaggaaagaauuacuuguuacuuuuaaaaaugcacaugcaaagaaacaagaaguaguaguacuuggcucacaagaaggagcuaugcauacugcacuaaccggugcaacagaaauccagaauagcgguggaacaucuauauucgcuggucaccuuaaauguagacucaaaauggacaaacuugaacuaaaggggaugucguaugccaugugcacaaauacuuuuguauugaaaaaggaagugucugaaacacagcacggcacgauucuaauaaagguagaauacaaaggagaagaugucccauguaaaauuccauucagcacagaggauggacaaggaaaagcacauaacggacguuuaauuacugcgaacccugucgugacuaagaaagaggaaccgguuaauauagaagcugaaccacccuuuggcgaaagcaauauuguuauaggaaucggagacaacgccuuaaagauuaacugguauaagaaagguaguucgauuggcaaaauguuugaagcaacggcaagaggugcucgaagaauggcaauccugggggauacggcuugggauuuuggauccgucggcggaguucuaaauagucuuggaaagaugguccaucaaauauuugggucagcauacaccgcacuguuuucaggaguuucguggguuaugaaaauuggaauuggaguacugcuaaccuggaucggguuaaauucuaaaaacacaaguaugucauuuucuuguauagcuauuggaauaauaaccuuauaucuaggggcaguagugcaagcggauaugggguguguaauaaacuggaaaggaaaagaacuaaagugcggaucggggaucuuugucacaaaugaaguacauacuuggacggagcaauauaaauuucaggccgauucaccaaagcgacuagcaaccgccauagcaggcgcaugggaaaacgggguauguggcauuagaucuacuaccaggauggaaaauuuauuauggaaacagauagcaaacgagcuaaacuacauccuuugggaaaauaauaucaagcugacagucguaguuggggacacuaucggaguacuagagcaaggaaaaaggauccucacaccucaaccaauggaguuaaaguacucguggaaaacuuggggaaaagcuaaaaucguaacggccgaaacacaaaauucuucauuuauuauugacgggccuaauacaccugaauguccauccgccagucgagccuggaacguaugggaggucgaagacuacggauuuggcguauuuaccacaaauauaugguugaaacuaagggagguauacacucaauuaugcgaucauagacucaugucggcagcuguaaaagacgaacgagccguacacgcagacaugggauacuggauagaaucacaaaagaacggaucuuggaaacuugaaaaagcaucacugaucgaaguaaaaacauguacauggccaaaaagucauacauuauggucaaacggagugcucgaaucagacaugaucaucccgaaaucuuuagcggguccaaucucucagcacaauuacagaccuggauaucacacucaaacugccggaccauggcauuuagggaaacuagaacuugacuuuaacuauugcgaaggcacuacuguagugauaaccgagaauugcggcacaagaggaccuaguuugagaacaacaacaguuaguggaaaacuuauacaugaauggugcugcagaucuuguacuuuaccuccuuuaagauauaugggggaagauggaugcugguaugguauggagauacgacccauuuccgagaaggaagagaacaugguaaagucucuagugucagcuggaaguggagaaguagauaacuucacaaugggcguguuaugucuggccauacuuuuugaggaaguuaugcgcggaaaauucggaaagaaacauaugauagcaggaguauuuuucacauuuguuuugcuacucagugggcaaauaacauggcgagacauggcacauacucucaucaugauagguaguaaugcgagcgaccgaaugggaaugggugugacauaucuggcacuuauugcaacauuuaaaauacaacccuuucuagcauuaggauucuuucucagaaaauuaaccucucgagaaaaucucuuacuaggggucggucuagcgauggcaacuacacuacaguuaccagaagauauagaacaaauggcgaacggaaucgcacuagguuuaauggcacuaaaauuaaucacgcaauucgaaacauaucagcuauggacugccuuaaucucucuaacuugcucaaacaccauauuuacccuuacaguagcauggaggacagccacacuaaucuuggcaggaguuucacuuuugccggugugucaaucaucgaguaugcguaaaaccgacuggcuuccaaugacaguugcagcuaugggggucccacccuuaccgcuuuuuaucuucucauuaaaagacacucugaaacgccgaaguuggccauugaaugaggggguaauggcagugggauugguuucaauacuagcaaguaguuuauuacguaaugacgugccaauggcuggaccacugguagcgggugguuugcuaauagccuguuaugucauaacagggaccagcgcagaucuaacaguagaaaaagcagcagauguuacaugggaagaagaagcggaacaaaccggaguuagucacaaucuaaugaucacagucgaugaugacggaaccaugcguauuaaagaugaugaaacugagaauauauugacggugcuauuaaagacggcuuuauuaaucguaagugggauauuucccuacuccauaccugccacguugcucguuuggcauacuuggcagaaacaaacccaaagguccggggucuugugggauguaccaucuccaccugaaacucagaaagcagaguuagaagaagguguuuauagaauuaagcaacaaggaauauuuggaaagacacaaguuggugucggcgugcagaaggaaggcguuuuucacaccauguggcauguuacacgaggggcuguacuaacauacaaugguaaacgauuagaaccuaacugggcaucaguuaaaaaggaucuuauaaguuacggaggcggcuggcguuuaagcgcgcaauggcaaaaaggggaagaaguacaaguaauugccguugagccaggcaaaaacccuaaaaacuuccaaaccaugcccgguacauuucagacaacaacgggcgaaauaggugcuauugccuuagauuucaaaccaggcacuucugguucaccgaucauaaauagggaagguaaaguuguaggccuguacgggaacgguguagucacuaaaaaugguggcuauguaucaggaauugcacaaacaaaugcagaaccagacggacccaccccugaacuugaagaggaaauguucaagaaaagaaaucuuacaauaauggaccugcauccagggaguggaaaaacccggaaauauuuaccugcuaucgucagggaggcaauuaagaggagauuaagaacguugauccucgcucccacacgcguaguggcugcagaaauggaggaagcauuaaaaggcuuaccuauuagguaucaaacaacggccaccaagucagaacacacaggaagagaaauaguagaucuaaugugccaugcuacuuuuacaaugaggcuucuauccccaguuaggguacccaauuacaacuuaauuaucauggaugaagcacauuuuaccgauccugcaaguauugcugcacggggauacauaagcacccgcguaggaaugggcgaagccgcugcaauuuucaugacugccaccccaccaggaacggcugacgcauuuccgcaaagcaaugcaccaauacaggaugaagagagggacaucccagaaaggucuuggaacaguggaaacgaauggaucacggauuuugccgguaagaccguaugguuuguuccaucuauaaaggcaggaaacgacauagccaacuguuuaaggaaaaacggcaagaaaguaauacaauuaucuagaaaaacauuugauacggaauaccagaaaacuaaacuaaaugacugggauuuuguaguuacaacagauaucuccgaaaugggagcaaauuuuaaggcagaucguguuauugacccaagaagauguuuaaaaccggugauauugaccgaugguccagaacgaguuauccuagccgggccuaugccagugacggccgccagugcagcacaaagaagaggacgugucggaagaaauccgcaaaaagaaaacgaccaauacauauuuacaggacaacccuuaaauaacgacgaagaucaugcacacuggacagaggcaaaaaugcuccucgauaacauaaacacucccgaaggaaucauuccagcucuuuuugaaccagaaagggagaaaucugccgcuauugauggugaauaccgucucaaaggugaaucccgcaagaccuucgucgaauuaaugcguagaggugaucuuccaguauggcuugcacauaaaguagccucagaggggauaaaauauacagaucggaaauggugcuuugacgggcagaggaacaaucagauuuuagaggagaauauggaugucgaaauauggacaaaagagggugagaaaaagaaacuuagaccccgauggcuagacgcucgaacauauuccgacccuuuagcucuuaaagaguucaaagacuucgcugcggguagaaagucaaucgcacuggaucucguaacugaaauagguaggguaccaacucauuuagcacauaggacaagaaaugcacuggauaauuuaguaaugcuacauaccucugagcacgggggcaaggcuuauaggcaugcggucgaggaacugccagaaacuauggaaacauuacugcuauuaggucuaaugauauuacuaacugggggcgcgauguuauuuuuaauuucaggaaaagguauuggaaagaccaguaucggucuaauaugcguuauugcuagcucugguaugcuauggauggcagaaauuccccuucaauggauugcaagcgcuauaguacuagaguuuuucaugaugguccuacuuaucccagaacccgagaaacaaaggacuccacaagacaaucaacuggcauauguaguaauaggcauacucacacuugcugcaauaaucgccgcaaaugagauggguuuacucgaaacgacuaaaagagauuuaggaaugaguaaagaaccgggaguaguaagcccuacaucguaucuugauguggaucuucaucccgcuucagcuuggacucuauaugcgguagcaacuaccguuauaacgccgaugcuuagacacacaauagaaaauucuaccgccaaugugucacuagcagcaauugcaaaucaagcagugguauugaugggacuagauaaaggauggccgaucuccaaaauggauuugggugucccgcucuuagcuuuggguuguuacagccaaguuaacccgcucacauuaacagcugcaguauugcugcuuauuacucacuaugcgaucauuggaccugguuuacaagccaaggcaacaagagaagcucagaaaaggacggcugccggaaucaugaaaaauccuacaguagaugguaucaugacaauagaucuagauccaguaauauaugauucgaaguuugagaaacaauugggucaaguaaugcuacucguccugugugcaguccaauuacuacuaaugaggaccaguugggcguuaugcgaggcuuuaacccuagccaccggcccaauuacaacauuaugggagggauccccuggaaaguucuggaacacaacuauagcaguuagcauggcgaacauuuuuaggggaucguaucuggccggugcagggcucgcauucucgaucaugaagucaguaggaacuggcaaaagaggcacggguucgcaaggggaaacacucggagaaaaguggaaaaagaaacuaaaccaacuaucaagaaaggaguuugaucuauauaaaaagucuggaauaaccgaagucgaucguacugaggcaaaagagggucuaaaaagaggagaaauaacgcaucaugcgguuucacgcgguucggcuaaacugcaaugguuuguugaaagaaacaugguuauuccagagggacgcguuaucgaccugggaugcggucgugggggcuggagcuauuacugcgcaggacuuaagaaaguaacagaaguucgcggguacaccaaaggaggcccaggacaugaagaaccgguaccgaugagcacuuacgguuggaauauuguaaaacuuaugucuggaaaagacguauuuuacuuaccaccggagaaaugcgacacguuacucugugauauuggggaaucuaguccuucaccaacuguggaagaaucuagaacgauaaggguguuaaaaaugguagaaccuuggcuaaagaauaaccaauuuugcauuaaaguucuaaacccuuacaugccgacuguuauugagcauuuagagcgucuucaacggaagcacggugguaugcuaguccgaaauccauuaucaagaaacucuacucaugaaauguauuggauuucuaacggaacggguaacauaguagcuuccgucaacaugguaucaagacuauuguuaaauagguucacaaugacacaucgacggccaacaauagaaaaggacguugaccuaggagcuggcacaagacauguaaacgccgaaccagagacgccuaacauggacgucauaggggaaagaauuaaacguauaaaagaagaacauaacagcacauggcacuacgacgaugaaaauccauauaaaacgugggccuaucaugggucuuacgagguaaaagccacuggaucagcuucaucaaugauaaauggggucguaaaauuauuaacuaaaccaugggauguaguuccaaugguuacgcagauggcuaugaccgauacaaccccauuuggacaacaaagggucuucaaggagaaaguagauaccagaaccccacgaucuaugccaggcacaagaagaguaauggguauuacugcagaauggcuauggaggacguuagguagaaauaaaaagccuagauuauguacacgugaggaauuuaccaagaaagugcgaacuaaugccgcaaugggugcaguuuuuacggaagagaaucagugggacucugcuaaagccgcuguggaagacgaggauuuuuggaaguuaguugacagagaaagagaauuacacaaauugggaaaguguggcucaugcguauacaauaugaugggcaaacgggagaagaaauugggggaguucggcaaagcaaaagggagccgggccauaugguacauguggcuuggugcccguuacuuggaguucgaggcccuagguuucuugaaugaagaucacugguuuucacgagaaaauucuuauagcgguguagagggugaagggcuccacaaauuaggcuacauacucagagacauaucgaaaaucccagggggcgcgauguacgcagaugacaccgcagggugggacacccguaucacggaagaugaucuacauaaugaagagaaaaucacgcagcagauggauccagaacaucgucagcucgcaaaugcaauauucaaauuaacauaucaaaauaaaguaguaaaaguccaacggccaaccccaaccgggacugugauggauauuauaucuagaaaagaccaaagaggaucgggucaaguuggaacauauggauugaacacuuuuacgaacauggaagcccaacuaauaagacaaauggagggagaggguguccugucaaaagcagauuuagaaaauccgcacuugccugagaagaaaauuacacaaugguuagaaacaaaaggaguugagagacuuaagagaauggcaauaucaggcgaugacugcguaguaaaacccauagacgacagauuugcaaaugcacuacuggcgcuuaacgauaugggaaaaguaagaaaagauauaccacaauggcaaccgagcaaaggauggcacgauuggcaacaaguacccuuuuguucacaccacuuccacgaacuaauaaugaaggacgguaggaagcuagugguaccuugucggccucaagaugaacuaauugggcgggcuaggauaucgcagggagcuggguggucgcuucgugaaaccgcuugucuugggaaagcauaugcucaaauguggucccugauguacuuccauagacgugaucuacgauuagcauccaacgcaaucuguagugcaguuccgguucauuggguucccacaucaaggaccacuuggagcauacaugcacaucaucaguggaugacaacagaagacaugcuuaccguguggaaccgaguuuggauagaagauaaccccuggauggaagauaagacccccgucacuaccugggaaaauguaccauaccuuggaaaaagggaagaucaaugguguggaagccuaauuggcuuaacauccagagcaacuugggcacagaauaucccaacagcaauacaacaagugaggucucuaaucggcaaugaagaauuuuuagacuacaugcccucuaugaagcgauucagaaaagaggaagaaucagagggagcuauaugguaa

SEQ ID NO: 23407 - RNA, 9873 nt, Artificial Sequence
  derived and/or modified CDS sequence (opt6) from DENV-3__FJ639770__SS-prME
acaaguuuaugucugaugaugauacuuccugcagcacuagcauuccauuuaacuagccgugauggagaaccuagaaugauagucgguaaaaacgaacgggggaaaucacugcuauuuaaaacagcuucuggaaucaauaugugcacacuaauagcaauggaccuaggagaaaugugcgaugauacuguuacuuacaaaugcccgcauauaacggaaguagaaccagaagacauugauugcugguguaauuugacuucaacaugggugacuuauggaacuugcaaccaagcaggagaacacagaagagacaaaagauccguugccuuagcgccacauguagguaugggauuagauacaagaacacaaacauggaugucagccgaaggugcguggaggcaaguugaaaaaguagaaacaugggcacuuaggcaucccgguuucacuauucuagcccuauuucucgcgcauuauauugguacgucacucacacaaaaagugguuaucuuuauacuccuaaugcuaguaacacccaguaugacaaugagaugcguggggguagguaaucgugauuuuguggaagggcuuucuggagcuacuuggguggauguaguauuagagcacggagguugcgugacaacaauggccaaaaauaaaccgacucucgauauagaauuacagaaaaccgaggcuacacaacuagcaacacugcguaaauuguguauugaaggaaaaauuacgaauauuacaacugauagucgauguccgacacaaggcgaagcaguauugccagaagaacaagaucaaaacuaugucuguaaacauacuuauguugauagaggaugggggaacggaugugguuuguuuggcaaaggaagucugguuacuugugcaaaauuucaaugucuagagccaauagagggaaaaguuguccaauaugaaaauuugaaauauacagucauaauaacuguacauacuggggaccaacaccaaguagggaaugaaacacaaggaguaacagcugaaauaacuccccaagcuagcacaacagaagcuauacugccagaauauggcacucuggggcucgaauguucuccaagaacaggccuagacuuuaaugaaaugauuuuguuaacaaugaaaaauaaagcauggaugguacaucgucaaugguucuuugacuuaccuuuaccauggaccaguggagcgacgacugaaacuccaacuuggaauagaaaagaguuacugguaaccuuuaaaaaugcgcacgccaagaaacaggaaguagucguauugggaucucaggagggcgcgaugcauaccgcuuugacuggggcaacggaaauacaaaacuccgguggaacuagcaucuucgcaggccaccucaaaugucgacuaaaaauggacaaauuggaauugaaagguaugaguuacgcuaugugcacaaacacuuuuguuuuaaagaaagaaguuagcgaaacacaacaugguacaaucuuaauuaaaguagaauauaaaggcgaagacgugccauguaaaauuccauucucaacggaggauggucaagguaaagcucauaaugggcgucugauaacagccaauccaguagugacuaagaaagaagaaccagucaacaucgaagcugaaccacccuuuggagaaucaaauaucguuaucgguauuggggauaaugcucugaaaauuaacugguacaagaaaggauccuccauagggaaaauguucgaagcaacggcuagaggcgcgcgaaggauggcaauauuaggagauaccgcaugggacuuugguucugugggugggguauuaaacucgcuugguaaaaugguccaccaaauauucgguucugcguauacggcccuauuuagcggcguaucguggguuaugaaaauagguauaggcguacuucuaacauggaucgguuuaaacagcaaaaacacuagcaugagcuucaguugcauugccauuggcauaauaacauuguaucucggcgcagugguacaagcagauaugggguguguaaucaacuggaaagguaaagaauuaaaaugugguucaggaauuuuuguaacaaaugaaguacacacauggaccgaacaauacaaauuccaagccgauucacccaaaagacucgcaacagcgauugcaggagccugggagaauggaguguguggaauacggucaacuacaaggauggaaaaucuacuuuggaaacagauagccaaugaacuaaauuauauauuaugggagaacaacaucaaauuaacaguuguuguaggagacgugauuggaguacuugaacaagguaaacgaacucuaacacuacaacccauggaguuaaaauacucauggaagacgugggguaaagcaaaaauuguaacagcugaaacacaaaauucauccuuuauaauugauggaccaaauacgccagagugcccaucagcgucaagggcuuggaacguaugggaaguggaagauuacggauucgggguauuuacaacgaacauaugguuaaaauugagagaagucuauacucagcuaugugaucaccgguuaaugagugccgcuguuaaagaugagagagcggugcaugccgauaugggauacuggauagaaagccagaaaaauggaucguggaaauuagaaaaagcgagccuaauagaagugaaaacauguacguggccgaaaagccacacccuuuggaguaaugguguucuagagucggacaugauuaucccaaaaucccuagccgguccaauuucacagcacaacuaccggccgggguaucauacacagacagccgguccauggcacuuagguaaauuagagcuggauuuuaacuauugugaaggaaccacuguuguaaucacugaaaauugcggaacacguggaccaagucuacguacaaccacaguuucaggaaaacugauacacgagugguguugucgaagcuguacccuuccuccucuuagguauaugggggaagacggguguugguacgguauggaaauuagaccaauuuccgagaaggaagaaaauaugguuaaaucuuugguaucggcagguucaggagaaguagauaauuuuacaauggguguuuuaugcuuagcaauauuauuugaagaaguaaugagagggaaguucgggaagaaacacaugaucgccggagucuucuucaccuuuguacuacuucucagcggacagauaaccuggagggauauggcucauacucugauuaugaucggaaguaaugcaucggaucgcauggguaugggggugaccuaucucgcccuuauagcaacuuucaaaauacaaccuuuccuagcauuaggauucuuucuuaggaaacuuacaucaagagaaaaucuacuacuuggggugggauuagcuauggcgacaacccuacaauuacccgaagauauagaacagauggcaaaugguauagcgcucggcuuaauggcccuaaaauuaauaacacaguuugaaacguaucaacucuggacagcccuaauaagccucaccuguagcaacacaauauucacacuuacaguugcuuggagaacggcgacgcugauacuugcgggcguuucccuauugccaguuugccaaucuaguucaaugagaaaaacggacuggcuacccaugacuguagcugcuaugggagugccuccccucccacuauucauauuuucgcuaaaagauacacuuaaacgacguucuuggccuuuaaaugaggguguaauggccguugggcuugucagcauacuagcuaguucuuugcuuagaaacgacguaccaauggccgggcccuuaguggcgggaggguuacuaauagcaugcuacguaauaacaggaacuucugccgacuugacgguugaaaaagcugcugauguaacaugggaagaagaagcagagcagacggggguaucacauaaucuaaugauuacaguagaugacgauggcaccaugcgaauaaaagaugacgagacggaaaauauauuaacugucuugcuaaaaacggcuuugcuuauaguuagugguauauuuccauauucuauuccugcuacguuacugguuuggcauacguggcaaaaacaaacucaacgcagcgggguucuuugggacguacccucgccaccagaaacgcagaaagcugagcucgaggaaggaguguaucgcauaaaacagcaagggauauucgggaaaacccaaguugguguggguguacaaaaggaagguguauuucauacgauguggcauguuacgaggggcgcuguacuuacguauaaugggaaacggcuugaaccgaauugggcgagcguaaagaaagauuuaauuagcuacggcgguggauggcgacugucugcacaauggcagaaaggagaagaaguucaaguaaucgcaguagaacccgguaaaaacccaaagaauuuucaaaccaugcccggaacuuuucaaacuaccacaggagaaaucggggcaauugcauuagauuuuaaaccgggaaccucgggaagcccuaucauaaauagagagggaaaaguagugggauuguauggaaacggaguuguaaccaaaaacggagguuacgugucgggaauugcgcagacgaaugcagagccagacgguccuacaccagaauuagaagaagaaauguuuaagaaaagaaauuuaacaauuauggauuuacacccagggaguggaaaaacuagaaaauauuugccggcaauaguccgugaagccauuaaaagaagguuaaggacucuuauacuugcuccuacgaggguagucgcggcagagauggaggaagcacuaaaagggcuaccaauacgauaccagacgacagcaacgaaaagugagcauaccgggcgagagauagucgauuuaaugugccaugcaacguuuaccaugcgacugcuuucacccgugagaguaccgaauuauaaccuaauuauuauggaugaagcccacuucacagacccugcaucaaucgcagcaagagguuacauaucuacuagagucggaaugggagaagccgcugcuauuuuuaugacagcuacucccccagguacugccgaugcguuuccucaaagcaaugcaccuauacaagacgaagaaagagacauaccugaaaggaguuggaacagugguaaugaauggauuacagacuucgcaggaaagacaguaugguucgugcccagcauuaaagcagggaaugacauugccaauuguuugaggaaaaacgguaagaaaguuauacaacuaucucguaaaacauucgauacagaauaucagaaaacuaaauuaaaugauugggauuuuguagugaccacagauaucagugaaaugggagcaaacuuuaaagcagauagaguaauagauccuagaagaugcuugaaaccggucauccugacugauggaccagaacgaguaauucuugcagggccaaugccgguaacagccgcgucagcugcacaacgacgagggagaguaggcagaaacccccaaaaagaaaacgaucaguacauuuucacagggcagccgcuuaauaacgacgaagaucaugcacacuggacagaggcaaaaaugcuauuagauaacauaaauaccccagaaggaauaauaccugcuuuguucgaaccagaaagggaaaaaucagcugcuauagauggagaauaucgccuuaaaggcgaaucaagaaaaacauuuguggaauuaaugcggcgcggagacuuaccaguaugguuagcacauaaagucgcuuccgagggaauaaaguauacagauagaaaauggugcuucgacggacaacguaauaaucaaauccuagaggagaauauggauguggagauuuggacaaaagagggcgaaaagaagaaacuaagaccacguugguuagaugcaagaacauauuccgacccacuggcacuaaaggaguucaaagauuucgcagcagguagaaagaguauagcacuagaucuaguuacagagaucggaagagugccuucucauuuagcacacagaacacgaaaugcccuugacaaucugguuaugcuccacaccagcgaacauggagggaaagcauaccggcaugccguugaagaacugccggaaaccauggaaacccuuuuacucuuaggacugaugauucuccuaacgggaggggcuaugcuauuuuuaauuucagggaaagguauaggaaaaacuagcauaggucugauuuguguuauagcgucaaguggcauguuauggauggccgagauacccuuacaguggauagcaagugcuauaguuuuagaguucuuuaugaugguacuacucauaccugaaccugaaaaacaaaggacgccgcaggauaaccaguuagcguacguaguuauagggaucuugacuuuggcagccauaauagcggcgaaugaaauggguuuauuagaaacuacaaagcgggauuuaggcaugucaaaggaacccggaguaguauccccuacauccuacuuggacgucgaccuacauccggcaucagccuggacuuuauacgcaguagcuacuaccguuauuacuccuaugcuaaggcauacuauagaaaauucgacagcgaacguaucacuagccgcuauugcgaaucaggccguuguacuaauggggcuggauaaaggcuggccgauuucaaaaauggauuuaggagugccacuguuagcguuagggugcuauagucaaguaaacccccuaacacuaacagcagcgguacugcuacucauaacacauuaugcuauuauaggaccuggacuacaagcgaaagcaacaagagaagcacaaaagaggaccgcugcuggaauuaugaaaaauccaacaguggauggcauuaugacuauugaccucgacccuguuaucuacgacuccaaauucgaaaaacaauuaggucaaguaauguuacugguccugugugcaguacaacuacucuuaaugcgaacaucuugggcacuuugcgaggcgcuuacauuagcaacaggaccuauaacaacauuaugggagggaucaccugggaaauucuggaauacaacaaucgcuguuaguauggccaauauuuuucgcgggucauaccuugcaggcgcaggucuagcuuucucaauuaugaaaagugucgguacagggaaaaggggaacaggaucacaaggcgaaacauugggcgagaaauggaagaagaaauuaaaucaauugucaagaaaagaauuugauuuguauaagaaaucgggaauuacggaaguagauagaacggaagcuaaagagggacuuaaaaggggagagauuacgcaccaugcugugagcagagguagugcuaaauuacaaugguucguggaaagaaacaugguaauuccggaggggcggguaaucgaucucggauguggaagagguggauggucuuauuauugugcaggguuaaagaaagucacagagguacgugguuauacaaaaggaggaccuggccacgaagaacccguuccgaugaguacuuacggcuggaacauuguaaaauuaaugucugguaaagacguauuuuaucucccgccggagaagugcgacacgcuacuuugugauauuggagaaucuagcccuucgccaacuguagaagagucgagaaccauucgaguacuaaaaaugguagagcccuggcugaagaacaaccaauucugcauaaaaguguuaaaccccuauaugccgaccguaguagaacaucuagagagguugcaaagaaaacauggaggaaugcuaguuagaaacccacuaagccguaauagcacacaugaaauguacuggauaaguaauggcacagguaauauuguggcgucaguaaauaugguuagccgucuguugcuaaaucgguucacaaugacacacaggagaccuaccauugagaaggauguugacuuaggcgcagguacucgucauguaaaugcugaaccagaaacgccuaauauggaugucauuggagagagaauaaagaggauuaaagaagaacauaacucaaccuggcauuaugaugacgaaaacccuuacaaaaccugggcguaucauggaagcuacgaagugaaagcaaccgguucugcgucgucaaugauaaaugggguaguuaaauuauugacaaaaccaugggacgugguaccaauggucacacaaauggcuaugacggauacaaccccauucggacagcaaagaguauucaaagaaaaaguugauacacggacaccaaggucaaugcccggaacucgacgcguuaugggaauaacagcggaauggcuguggagaacucuuggucgaaacaagaaacccagacuauguacucgagaagaguuuaccaagaaagucagaacaaaugcggcgaugggugcugucuucacagaggaaaaucaaugggauagcgcgaaagccgccgucgaagaugaagauuuuuggaagcuaguugauagagagcgcgagcuacauaaauuaggaaaaugcgggaguuguguauacaacaugaugggaaaacgagagaagaaacuaggagaguucggaaaagcuaaagguagucgugcaauaugguauauguggcuaggagcaagauaucuagaauuugaggcuuuaggguuccuaaaugaagaucacugguuuaguagggaaaacaguuacucaggaguagagggugaaggucuucacaaauugggcuauauauugagagauaucucaaagaucccuggcggagcaauguacgcagacgauacugccgguugggacacccguauaacugaagacgaucuacauaacgaagaaaagaucacgcaacaaauggaccccgaacaucgacaauuggccaacgcuauuuucaaacuaaccuaucaaaauaaagucguaaaaguacagagacccaccccaacagguacagucauggacauaauaagccguaaagaccaaagaggaucaggacaggucggcacauacgggcuaaauacauuuacaaauauggaggcccaguuaauucgucagauggaaggugagggaguacuaucaaaagcugacuuagaaaaccccaggcuuccagagaagaaaaucacucaaugguuagaaacgaaaggcguugaaagguuaaaaagaauggccauuucgggugaugacuguguuguaaaacccauagacgauagauucgcgaaugcucuguuagcacuuaaugacaugggaaaagugagaaaggauaucccucaguggcaaccaucgaagggauggcacgauuggcaacagguuccuuuuuguucgcaucauuuucacgaacucauaaugaaggacgguaggaagcuaguaguacccugcaggccacaagacgaacuuauuggcagagcacgcauuucgcaaggggcgggguggucacuacgugagacagcaugcuuagguaaggcuuacgcccaaauguggaguuuaauguauuuccauagaagagauuuaaggcucgcuagcaaugcaauauguuccgccguaccugugcauuggguaccuacguccaggacaacuuggucaauacaugcccaucaucaauggaugacaacagaagauaugcuuaccguauggaauagaguauggauagaagacaacccuuggauggaggauaaaacuccagugacaacaugggagaacguucccuaccuuggaaaacgagaggaccaaugguguggaucucuuaucgguuuaacgucaagggcaacaugggcacagaauauaccaacagcuauacaacaaguuagaucacuaaucgggaacgaagaguuccucgacuacaugccuucaaugaaaagauuuagaaaagaagaagaaagugaaggcgcaauaugguga

SEQ ID NO: 23408 - RNA, 9873 nt, Artificial Sequence
  derived and/or modified CDS sequence (opt6) from DENV-3__FJ639771__SS-prME
acaagccuaugccuaaugaugauauuaccugcagcacuagcauuucauuuaacuucacgugacggagaaccacguaugaucguuggcaaaaaugaaaggggaaaaucccuucuauuuaaaacagccucaggaauuaacauguguacacuuauagcaauggaucuaggugaaaugugugaugauacuguaacuuacaaauguccccauaucacagaaguugaaccggaagauauagauugcuggugcaaucuuaccucaacuuggguaacauaugguacgugcaaccaagcuggugaacauagaagagauaaaaggagugucgcuuuggcgccacacgucgggaugggacuugacacuagaacucagacauggauguccgccgaaggagcuuggagacaaguugaaaaaguggaaacaugggcauuaagacacccaggcuuuacaauacucgcacuuuuccuagcacauuauauaggaacaucuuuaacgcagaaaguagugauauuuauucuauuaauguugguuacaccuagcaugacaaugagauguguaggugucggaaaucgcgauuuuguagaagggcuuucuggugccaccuggguagacguuguacuugagcacggaggaugugucacaacuauggccaaaaacaaaccaacucuggauaucgaacugcagaaaacugaagccacacaacuugcaacacuaaggaaacuuuguaucgaaggaaaaauaaccaacauuacaacugauucgagguguccaacacaaggggaagccguucuuccugaagaacaagaucaaaacuacguaugcaaacacacguauguagauaggggaugggguaacggauguggauuauuugggaaagggagcuuaguaacuugcgcgaaauuucaaugucuggaaccgauugaaggaaaaguaguucaauacgagaaucuaaaguacaccgugauaauuacaguucacacaggugaccaacaucaagugggcaacgaaacacaagggguaacugcugaaaucaccccacaagcuaguacaacugaagcgauuuuacccgaauaugggacacuaggauuagaaugcucuccacgaaccggacuugacuuuaaugaaaugauacuauugacuaugaaaaacaaggcauggaugguucauagacaaugguucuuugaucugccucuacccuggacguccggugcgacaacggaaacucccacauggaauagaaaagaauuauuaguaacauuuaaaaaugcucaugcuaagaagcaagagguaguaguucuagguucacaagaaggugcaaugcauacugcucuaacuggcgccacagagauacaaaacucuggagguacaucaauauuugcuggccaucuaaaaugccgacuaaaaauggacaagcuagaacuuaaaggaaugucuuacgcaaugugcacuaauacauuugucuugaagaaagaaguaucggaaacgcaacaugguacaauacuuauuaaaguggaauauaagggugaagacguucccugcaaaauccccuuuaguaccgaggauggacaagggaaagcacacaacggacgacucauuacugcuaaccccgucguaaccaagaaggaagaaccgguaaauauugaagcagaaccaccauuuggggaaucgaauauaguaauagguauaggcgacaaugcauuaaagauaaacugguacaaaaagggcaguucaauaggaaaaauguuugaagcgacggcuagaggcgcucguagaauggcuauccuuggggauacugcuugggauuucggcagcguuggcggaguauuaaauucguuaggcaaaaugguucaucaaauauucggaagcgccuauacugccuuauuuucagggguguccugggugaugaagauagguauaggaguucugcucacuuggaucgggcuaaacagcaagaauacaucgaugucauuuucauguaucgcuauugggauaaucacauuauaucuaggugcaguagugcaggccgauauggggugugucauaaauuggaaaggaaaggagcuaaaaugcgggucagguauauucguaaccaacgagguacauacauggacagagcaguauaaguuucaagcagacaguccaaaacgucuggcaacagcuauagccggggcuugggagaacggcguauguggaauaagguccacuaccagaauggaaaaucuauuguggaaacaaauugcaaacgaacuaaauuauauauuaagagaaaauaauauaaaacuaacuguaguugugggugauguaauugguguucuagaacaaggaaaacgaacgcuaacgccgcaaccuauggaauugaaauacagcuggaaaacuuggggaaaagcuaaaauaguuacugcagagacucaaaacucgaguuuuauaauugacggaccaaacacgccagaaugcccuucagcaucgcgagcauggaauguuugggaaguugaggacuacggguucgguguuuuuacaacuaacauauggcuaaaauuacgugagguauauacucaauuaugcgaucaucgguuaaugagugcugcaguaaaagacgaacgcgcaguacacgcagacaugggauauuggaucgagucgcaaaagaacgguucauggaaguuagaaaaggcuagucugauagaagucaaaaccugcacauggccuaaaagccauacccuuuggagcaauggaguucuugaauccgacaugaucauaccuaaaucguuggcagguccuauuagucagcauaacuauagaccuggauaucauacacaaacugcgggcccguggcacuuagggaaacucgagcuugacuuuaauuauugcgaaggaacuacaguuguaaucacugaaaauugugguacacgggggcccucucuucgcacaacuacagucucuggaaaguuaauacacgagugguguugccggucauguacacuaccuccgcuaagauauaugggagaggauggcugcugguauggaauggaaauucguccaauuagugaaaaagaagagaauauggugaaaucuuuaguuucugcaggcucaggugaagucgauaauuuuaccaugggcguuuugugucucgcaaucuuauucgaagaaguaaugcgggggaaauucggcaagaaacauaugaucgcaggaguauuuuucacauucguuuuauuguuaaguggccagauaaccuggagagacauggcacauaccuuaaucaugauaggaucaaaugcaagcgauagaaugggaaugggaguuacauauuuagcucuuauugcaacauuuaagauucaacccuuuuuggcacuaggauucuuuuuacggaaacugacaucacgcgaaaauuugcuccuagggguagguuuagcgauggcgacaaccuuacaauugccugaagauauugagcagauggcaaauggcauagcuuuaggacugauggcucucaaacuuauaacacaguuugagacauaucaguuauggacugcccuaauaagccugacguguaguaacacaaucuuuacucuuacgguugcuuggcgaacagcaacacuaauuuuagcaggagugucacuacuuccagucugucaaucaucaucaaugagaaagacagauuggcugcccaugacugucgcugcgaugggagucccgccucuaccguuguuuaucuucuccuuaaaagacacccuaaaacgucguucuuggcccuuaaacgaaggcguaauggcaguuggacuuguuucaauucucgcaaguucgcuucuucguaacgauguuccaauggcaggaccgcuugucgcuggaggucuuuuaauugccugcuauguuauuacuggaaccuccgccgaccuuacagucgaaaaagccgcugacguaacaugggaagaagaggcagaacagaccgggguaucacauaauuuaaugauuacaguggaugaugacggcacaaugagaauuaaagacgacgaaacagagaacaucuuaacugugcuuuugaaaacagcccuccuuaucguaagcggaauauucccauauagcauaccugcgacccuauuagucuggcacacauggcaaaagcaaacccaacgcagcggggucuuaugggaugugccaucuccgccagaaacucaaaaagcagagcuggaagaagguguauacagaauaaagcagcaaggcaucuucggaaaaacgcagguaggcguagguguccagaaagaaggcguguuucauaccauguggcauguaacucggggagccguauuaacguacaauggaaagcgacucgagccgaacugggccaguguaaagaaagaucuaauuaguuauggcggugguuggcguuuaucggcacaauggcagaaaggggaagaaguacagguuauagcaguagagccuggcaaaaaucccaagaauuuucaaaccaugccagguacauuccaaaccaccacgggugaaauaggcgcaauagcacucgauuuuaaacccgguacgagcgguucaccgauuaucaacagagaagguaaggucguaggacuguaugggaaugggguaguaacuaaaaacggaggcuaugugagcggaauugcacaaacuaaugcagagcccgaugguccuaccccggaauuagaggaagaaauguuuaagaaacguaaucuuacuauaauggauuuacauccuggguccgggaaaaccaggaaguauuuaccggcaaucguaagagaagccauuaaaagacgacugagaacucugauucuggcaccgacuagagucguagccgccgagauggaagaggcacuaaaaggacuuccaauacgcuaccaaacuacugcaacaaaaucggaacauacggggcgggaaauugucgaccucaugugccacgcaaccuucacuaugcgacuacuaaguccgguccgggugccaaacuauaaucuaauaauaauggaugaagcacacuucacagacccagccucuauagcagcaagaggcuacauaucuacaagaguagggaugggugaagccgcugcaaucuuuaugacagccaccccuccugguacugcugaugcauucccacaauccaaugcaccaauucaagaugaagaaagggacauuccggaaagaucauggaauagcggaaacgaguggauaacagauuuugcugguaagacaguaugguuuguaccauccauuaaagccggcaaugauauagccaauugccuacguaaaaacggaaagaaaguaauacaacuuagccgaaaaacauuugauacagaauaucagaaaaccaaauugaacgauugggacuucgugguuacaacagacauaucugaaaugggagcgaauuuuaaagcagauaggguuauugacccaagaagauguuuaaaaccuguaauacucacagauggcccagaaagggugauccuugcaggcccuaugcccguaacugcugcaucggcagcucagcgacgagggagagucggccgaaacccucaaaaagaaaaugaucaauauauauucacaggucagccccuaaauaaugaugaagaccacgcgcacuggacagaagcaaaaauguugcuagacaauauaaacacuccggaagggauaauuccugcucucuucgaaccugagcgcgaaaagagcgccgccauagauggagaauauagacuuaaaggggaaucacgaaaaacguucguagaacuuaugcgucgaggagauuuaccaguauggcuagcacacaaaguggcaagugagggcauaaaauauacagaccgcaaauggugcuuugacggucagagaaacaaccaaauucuagaagaaaauauggauguggaaauuuggacaaaggagggugagaagaagaaauuaagaccgcgauggcucgacgcuagaacguauagugauccauuagcacuuaaagaauuuaaagauuuugcggcaggaagaaaaucgauagcucuagaccuagugacugaaauuggccgaguacccagccaucuugcacaucgcacgcgaaacgcauuagauaaccuuguuauguugcacacaagcgagcacgguggaaaagcguacagacaugcuguagaagaguuaccggaaacaauggaaacacuauuguuauuaggucuaaugauucuauuaacagguggagcgauguuauuucuaauaagcgguaaagguauuggaaagacaucaauuggucuuauuuguguuauagcuucgucuggucuucuauggauggcagaaauaccacuucaauggaucgcuagcgcgauaguacucgaauuuuucaugaugguucuacuaauaccugaaccagagaaacagaggaccccacaggauaaucaauuggcauauguaguaauaggcauuuuaacacucgccgccauuaucgccgcaaaugagaugggauugcuugaaacuacuaaacgagauuuagguaugagcaaagagccagguguuguuaguccuacaucuuacuuggauguugacuugcacccugcuucggcauggacauuauaugcaguagcaacaacaguaauuacaccaaugcuacgccauacuaucgaaaacaguacagcaaauguaagucuugcagcaauagcaaaucaagcgguaguauugaugggauuggauaaggguuggccaauaaguaaaauggaccuuggggucccgcuuuuagcccuaggauguuauucgcaagugaauccgcucacccuuaccgccgcgguacuuuuauugaucacucauuaugcuaucaucgguccaggcuuacaggcaaaagcuacaagagaggcacagaaacgaacugcugcuggcauuaugaaaaauccaacggucgauggcaucaugacaauugacuuagacccaguaauauacgauucaaaauucgaaaaacaacuagggcagguaaugcuucuaguucuuugcgcaguacaacuauuacuaaugagaacauccugggcccuuugcgaagcucuuacacuggcuaccgggccaauaaccacacuuugggaagggucuccgggaaaguuuuggaauacaacuauagcagugucaauggcaaauauuuucagagguaguuauuuagcuggugccggucuagcauuuucaauuaugaagucgguagguacggguaagagagggacuggaucccagggagaaacacuaggugaaaaauggaagaagaaauuaaaccaguuaagcagaaaagaguuugauuuauacaagaaaagcgggauaacugaaguagaccgcacagaggcuaaagaagguuuaaaacguggagagauaacgcaccaugcaguaagucggggaagugcaaaacuccagugguuuguagaaagaaauaugguaauuccagaagggagaguaauagacuuaggcugcggccgaggcggcugguccuacuauugcgcaggucucaagaaaguuacugaagugagggguuacacuaaagguggaccugggcacgaagaacccguaccgaugaguacauauggguggaauauaguaaaguuaaugagcgggaaggaugucuuuuaccucccgccagaaaaaugugacacauuauugugcgauauuggagaaaguuccccuaguccaacuguugaggaaaguagaacaauacgaguguuaaaaaugguagaacccugguuaaagaauaaccaguucuguauaaaaguauuaaacccuuauaugccaacggucgucgagcacuuagagcgauugcaaaggaagcacggaggaauguuaguuagaaacccgcuaagccgaaacagcacacaugagauguacuggaucucuaauggaacaggaaacaucguagcgucugugaacauggucagccggcuacuauugaauagauucacaaugacgcaucgucguccgacuaucgaaaaagacguggaucuuggcgcgggaaccagacauguaaaugccgagccugaaaccccuaacauggauguaauuggcgaaaggauaaaacguauaaaagaagaacauaauucaaccuggcacuaugaugaugagaacccauacaaaaccugggcuuaccacgguagcuacgaagugaaagcuacgggcagcgcaagcucaaugauaaacgguguuguuaaacuacucaccaaaccaugggauguaguuccaauggugacgcagauggccaugacugacacaacgccuuuuggacaacaacguguauuuaaggaaaaaguagacacacguacuccaagaagcaugccuggaacgaggcgagugauggguauuaccgcggaauggcuauggagaacacuugguagaaauaaaaagccucgcuugugcacaagggaagaguucaccaagaaaguccggacaaaugccgcgaugggagcaguauuuacugaagaaaaccaaugggauagcgcaaaagcugcaguggaagaugaagacuuuuggaagcuaguggacagggaaagagagcuucacaaacucggaaaauguggaucauguguauauaauaugauggggaaaagagaaaagaagcugggugaguucggaaaagccaaagguucacgagcuauuugguauaugugguuaggugcgagguaucuagaguuugaggcgcugggauuuuuaaacgaagaucauugguucucucgcgaaaauucauauucuggcguagaaggagaaggccuacacaaacuuggauauauacucagagauaucaguaagauaccuggaggcgcaauguaugcugacgacacugcuggcugggacacaagaauuacagaagaugacuuacauaaugaagagaagaucacacaacagauggaucccgagcaucgccaauuagcaaaugccauauuuaaauuaacauaucaaaacaagguuguuaaaguacaacgucccacaccuaccggaacggucauggacaucauaaguaggaaagaucaacguggcucaggucaaguaggaacuuauggauugaacacauucacgaacauggaggcgcaacuaauaagacaaauggaaggggaaggagucuuaagcaaagccgaccucgaaaauccacgacuaccagagaagaaaaucacgcaauggcuugaaacaaaaggaguagaaagacuaaaacgaauggcgaucucgggggacgacuguguagucaagccgaucgaugacagauucgcaaaugcucuauuagcauuaaaugacauggguaaaguaagaaaagauauaccacaguggcagccaaguaaagguuggcaugauuggcaacaggucccguucugcucgcaccacuuucaugaacuaaucaugaaagauggaaggaaauugguaguucccugccguccacaagaugaguuaauaggaagggcgagaauuucacaaggagcuggcuggucacuaagagaaacagcaugccuuggaaaagcauaugcacaaauguggagccugauguauuuucauagacgugacuugagauuagcgaguaaugcaauauguagcgcaguaccgguacauugggugccgacaucccggacaacauggucgauccacgcacaucaucaguggaugacuacagaagauaugcuuacuguuuggaaccguguauggauagaagacaauccauggauggaagauaaaacaccuguuaccacaugggaaaauguuccguauuuaggcaaacgagaggaccaguggugugguucccuuauaggacucacaagucgcgcaacuugggcacaaaauauaccaaccgcuauucaacagguacggaguuuaauaggaaacgaagaguuccucgauuauaugccuagcaugaaaagauuucguaaggaagaagaaucagaaggagcgauaugguaa

SEQ ID NO: 23409 - RNA, 9873 nt, Artificial Sequence
  derived and/or modified CDS sequence (opt6) from DENV-3__FJ639772__SS-prME
acuucguuaugccuuaugaugauuuuaccggcugcacuugcuuuucauuuaacaagccgugacggggaaccaagaaugaucgucgguaaaaacgaaaggggaaaaagucugcuuuuuaaaacggcuagcgguauaaauauguguacauugaucgcaauggacuugggagaaaugugugacgacacgguuaccuauaaauguccacacauaacggaaguagaaccggaggacauagacuguugguguaauuuaacaagcacguggguuacauacgguacuuguaaucaagcuggagaacauagacgagauaaacguucaguagcucuggcaccucacguaggaaugggauuagacacuagaacacaaacauggaugagcgcagaaggugcauggagacaagucgaaaaagucgagacaugggcgcugcgacauccugguuuuacaauuuuagcucuguuuuuggcccauuacauagguacaucauugacgcaaaaaguaguaauuuucauccuauuaaugcuaguuacaccaaguaugacaaugagauguguuggaguaggaaaucgcgauuuugucgaagggcuauccggggcaaccuggguugauguaguccuggaacauggcggaugcguuacuacuauggcuaaaaacaaaccaacgcuagauauagaacugcagaaaacagaagcgacccaauuagccacacugcgaaaacuguguaucgagggcaaaauuacaaauauuacgacugauuccaggugcccuacacagggagaagcaguccuacccgaggagcaagaucaaaacuacguauguaaacauacuuacguugacagaggauggggcaacggcuguggacuuuuugguaaggggucauuaguuaccugugcuaaguuccaauguuuggaaccgaucgaaggaaagguuguacaguaugaaaaucuuaaguauaccguuauaauuaccguacacacuggagaucagcaucaaguagggaaugaaacucaggggguuacagcagaaauaacgccccaagcaucuacuacugaggcaauauuaccagaauaugguacauuaggacucgagugcaguccacgaaccggauuagauuuuaaugaaaugauccuguugacaaugaagaacaaggccuggaugguucauagacagugguucuuugaucucccguuacccuggacuucaggagcaacaacagagaccccaaccuggaaucguaaggaacuuuuaguaaccuuuaaaaaugcccaugccaagaaacaagaaguagucguauuagguagccaagaaggagcaaugcauacagcucugacaggugcuacagaaauacaaaauucuggaggaacaaguauauucgcgggacauuuaaaaugcagacuaaagauggacaaguuagaacuuaaaggaaugucuuaugcaauguguacaaauacuuuuguauugaagaaagaaguuagugaaacccaacauggaacaauucucaucaagguagaauacaaaggagaagaugcacccugcaagauuccauuuucuacagaagacggucaaggaaaagcucacaacgggagacuaaucacagcaaacccagucguaacaaagaaagaagaaccuguaaauauugaagcagaaccgccguucggggagucgaacauuguuauagggauuggagauaaugccuuaaaaauaaauugguacaagaaaggauccagcauagguaagauguucgaagccacagcacgaggagcgcgacguauggcuauucuaggggauacagcuugggacuuugguucagucggagggguacuaaacucacuuggaaagaugguucaucaaauauuuggcagcgcguacacugcuuuguucaguggggugucauggguuaugaagauagggauuggaguacuuuugaccuggauaggucugaacucgaagaauacaucaaugucguuuucauguaucgcuauaggaaucaucacgcuuuauuuaggagcaguuguacaagcugacaugggaugugucaucaauuggaaagggaaagaauuaaaaugugguaguggaauuuucgugacaaaugaaguucauacuuggacagaacaauacaaauuccaagcagacuccccgaagaggcuugcaacugcuauagcgggcgcuugggaaaauggaguaugcggcauacggucaacuacgcguauggaaaaucugcuauggaagcaaauugcaaaugaguuaaauuauauucuuugggagaauaauauuaaacuaacaguagucguuggagauauuauuggaguuuuagaacagggaaaacgaacccuaacaccgcaaccaauggaacuuaaguauucauggaaaaccugggguaaggcaaaaauaguuacagcagaaacccaaaauagcagcuuuauaauugauggcccaaauacuccagaaugcccuuccgcaucucgagccuggaacguuugggaaguagaggacuacgguuuugggguguuuaccacaaauauaugguuaaaauuaagggagguguauacgcaauuaugugaccacaggcuaauguccgccgcaguaaaggacgaaagggcaguacacgcugauauggguuacuggauugaaucucagaaaaauggaaguuggaaguuggagaaagcaucuuuaaucgaagugaagacauguaccuggccgaaaagccauacgcuauggucuaacgguguacuagaaucugauaugaucauaccaaaaaguuuagcggggcccauaucacagcauaacuaucggccaggauaccauacacagacagcagguccguggcaccucggaaaacuggagcuagauuucaauuauugcgaagguacaaccguagucauaacugaaaacuguggcacccgcggcccaucccuacgcacuacaacagucucagggaagcucauacaugaguggugcuguagguccuguacgcuaccaccguuaagauauaugggagaggacgguuguugguacgguauggaaauaagaccuauuagcgaaaaagaggaaaauauggucaaaucccuaguuuccgcuggaagcggggaaguagacaacuuuaccaugggaguucuguguuuagcaauccuuuuugaagaagugaugcgggggaaauucggcaagaaacacaugaucgccggaguauucuuuacauuuguacuuuuguuaucugggcaaauuacuuggcgagauauggcacauacucuaauaaugauaggcucuaaugccucagaucggaugggaaugggaguuacuuaccuugcuuuaauagcgacauucaagauacagccauuucuggcauuaggcuucuuucuuaggaaacuuaccaguagagagaaucuccuacuuggagucggccucgcgauggccacgacucugcaauugccagaggauauagaacaaauggccaacggaauagcacuuggguuaauggcacuuaaacuaauuacucaauuugaaacuuaucaacuauggacagcccuuauaucucuaacauguucaaacacuauuuucacgcugacaguagccuggcgaacugcuacauugauucucgccgguguaucacuccuuccugucugucaaucaucaucaaugcgaaaaacagauuggauaccgaugaccguugcagccaugggugugccuccgcugccacuauuuauauuuucauuaaaagacacgcuaaaaagacgaucuuggccacuaaaugaagggguaauggcagucggccuuguaucaauacuagccagcagucuacuaagaaaugaugugccgauggccggaccgcucgucgccgggggccuuuuaauugccugcuacguuauaacagguacgucagcagacuuaacuguagaaaaagccgcagaugucacaugggaagaagaagcagaacaaacuggggucucgcauaaucuuaugauaacaguagaugaugaugguacgaugcgaauuaaagaugacgaaaccgaaaauauuuuaacgguacuacuuaaaacggcauuacuuaucguaucagggaucuuuccauauucaauaccugcgacgcucuugguuuggcacacuuggcaaaagcaaacucaaagaaguggggucuuaugggacguaccuucaccaccugaaacccaaaaagcugaacucgaggaaggcguguaucgaauuaagcaacaaggaauuuuuggcaaaacacaagucggaguaggaguacaaaaagaggguguauuccauacaauguggcacguaacccgaggugcugucuugacauacaacggaaaaagacuagaaccaaacugggcuucuguaaagaaagauuuaaucucuuacggaggggguuggagacucucagcacaauggcagaaaggagaagaaguucaaguuauugcuguugaaccgggcaaaaaucccaaaaacuuccaaacuaugccaggaaccuuccaaacuacuacaggggaaauaggagcaauugcccuggauuuuaaaccaggcacaucuggcaguccaaucaucaacagggaggggaaaauuguaggauuguacggaaacggggucguaacuaaaaauggaggauauguuucuggcauugcgcagaccaaugcugagccggacgggccuacaccugaacucgaagaagaaauguuuaagaagaggaaucugacgaucauggaccuucauccgggaucagguaaaacacgaaaguaucuaccggcaauaguacgagaagcgauaaaaagacgucugcgaacucuaauccucgcucccaccagagucguagcagcagaaauggaagaagccuuaaaaggacuaccaauccgauaucagacaucugcuacaaaauccgagcacacaggaagggagauaguugaucuaaugugccaugcaacuuuuacaaugaggcuacugaguccagucagaguaccuaauuacaacuuaauuaucauggacgaagcucauuucacagauccagcgucaauugcagccagaggauauaucuccacuagaguugggaugggagaagcugcggcuauuuuuaugaccgcaacuccuccuggcacagccgaugcuuucccacaaagcaaugcuccgauacaagacgaagaacgagauauuccagaacguucuuggaacaguggaaaugaauggauuaccgauuucgcaggaaagacuguuugguucguuccuucgaucaaagcggggaacgauauagcaaauugcuuacguaagaacgggaagaaaguuauucaacugucuagaaagacguuugauacagaauaucaaaagacgaaacuuaacgauugggauuuuguaguaacaacagauauuagugaaaugggugcuaacuucaaagcugaucgcgucauagauccaaggagauguuugaaaccuguuaucuuaacagacggcccagaacgagucauccuagcugggcccaugccuguuacagcugcuagcgcugcacaacggcgcggacggguaggaagaaauccucaaaaagaaaaugaccaauauauauuuaccggacaaccgcugaauaacgaugaagaccacgcccacuggacugaggcaaagauguugcuagacaacauaaauacccccgaggggaucauaccagcgcuauucgaaccagaaagagagaagucagcagccauagauggggaauacagguuaaaaggagaaucacguaaaacauuuguugaauugaugagacgcggugaucuaccaguauggcuugcacacaaaguagcaucagaaggaauuaaauauacugauaggaagugguguuucgacggucagcgaaacaaucagauacuugaagaaaacauggauguggagaucuggacaaaagaaggugagaagaaaaaguuacguccaagaugguuggaugcgaggacuuauucagauccauuagcauugaaagaguuuaaggacuucgcugcuggacguaaaucaaucgcacucgacuuaguaacugagauuggaagagugccgacacauuuagcgcaucguacgagaaaugcucucgauaaccuaguuaugcuucacacauccgaacauggcggaaaggcuuauagacaugcaguugaagaacuuccagaaacaauggaaacucuccuacuacuaggccugaugaucuuauuaacugguggugcaauguuguuccuuauaagcggaaaaggaauaggaaaaacuucaauaggauuaauuugcguaaucgccagcagcggaaugcuauggauggccgagauuccccuacaauggauugcgagugcaauagucuuagaguucuuuaugaugguguuauugaucccugagccugaaaaacagaggacuccacaagacaaucaauuggcauauguugugauaggaauauuaacacuagcagcuauuauagcagcaaacgaaaugggacuucuagaaacaacaaaacgugauuugggaaugagcaaggaaccuggcguagugucgccuacuucauaccuggauguagaucuacaucccgccagugcuuggacacucuaugcagucgcaacuacaguaauaaccccuauguuacgacacacuauagaaaauucaacggcuaauguaagccuggcagcgaucgcuaaccaagccguuguacuaauggguuuagacaagggauggccgauauccaaaauggaucugggugucccguuacuagcccuuggauguuacagucaaguaaauccacucacacuaaccgcugcaguauuacuauuaauaacacauuacgcgaucauaggcccaggacuacaagcaaaagcuacccgagaagcacaaaagagaaccgcugcagguaucaugaaaaauccaacaguggauggaauuaugacuauugacuuagauccugugauauaugauaguaaauuugaaaagcaacugggucagguuaugcuauuaguacugugcgccgugcaguuacuguuaaugagaaccaguugggcguuaugcgaagcacuuacauuagccacagguccaauuacgacucugugggagggaagcccagggaaauucuggaacacaaccauagccguaaguauggcuaauauauucagagguuccuacuuagcaggagcuggacucgccuuuaguaucaugaaaucagugggaacaggaaaaagaggcacagguucgcagggagaaacacuaggagaaaaguggaagaagaaguugaaucaauuaucgagaaaagaguucgaucuuuacaagaaaucaggaauaacggagguggauagaacugaagcuaaagaaggauugaagcgcggggaaauuacgcaccacgcugugaguagaggaagugcaaaauuacaaugguucguugaacgaaacaugguaauaccagaaggucgugugauagaccuaggauguggccgaggagguuggucguacuacugcgccggucucaagaaaguaacagaaguaaggggcuacaccaagggugguccugggcacgaagaaccaguaccaauguccacauaugguuggaauauaguaaaauuaaugagcgguaaagaugucuuuuaucuuccuccugaaaagugugauacgcuuuuaugcgacauaggcgaaaguuccccaagcccuacugucgaagaaagucguacaauuagaguacuuaagaugguagaaccauggcuuaaaaauaaucaguuuugcauaaaaguacuaaaucccuacaugcccacugucauagaacaucuagagcgucuucaacgaaaacacgggggcaugcuuguuaggaacccccugagccguaacucuacacaugaaauguauuggauauccaaugguaccggaaacauuguagccagugucaacaugguaaguagauuacugcucaauagauucaccaugacucacagaagacccacuauagaaaaagaugucgaccuaggcgcagguacuagacauguuaaugcagagccagaaacaccaaauauggacgugauaggagaaagaauaaaaagaauaaaagaagaacauaauucaacauggcauuacgaugaugaaaacccauacaagacaugggcuuaccacggaagcuaugaagucaaagccacugggucagcuuccucaaugauaaauggagugguaaaauuacuaacaaaaccaugggacguaguaccaaugguaacccagauggcuaugacagauaccacucccuucggacaacaaaggguauuuaaagaaaaagucgacacaagaacaccuagaucgaugccagggacccgacgaguuauggguaucacagcagaauggcuuuggcguaccuuggguagaaacaagaagccccgacucuguacaagagaggaauuuaccaagaaaguccgaaccaaugcagcaaugggagcagucuuuacagaagagaaccaaugggauucagccaaggcugcgguggaagaugaagauuuuuggaaacucguggacagagaacgagagcuacauaagcugggaaaauguggcagcuguguuuauaacaugaugggcaagagagagaagaaauuaggggaguuuggaaaggcaaagggaaguagagcgauuugguauauguggcugggagcaagauaucuugaguuugaagcucuuggauuucucaacgaagaucauugguuuucacgugaaaacucuuacucgggaguggaaggagaagguuuacauaaauuaggauacaucuuacgggauauuagcaaaauacccgguggggcgauguaugcagaugauacagcuggcugggacacuaggaucacggaggaugaccuucauaaugaagagaaaaucacacaacaaauggaccccgagcauagacaacuggcuaacgccauuuuuaaauugacauaucaaaauaaagucgucaaaguacaaagaccgacaccgacagggacaguuauggacauuaucucacguaaggaccaacgagguucaggucagguuggaacauacggacucaacacauuuacaaauauggaagcacaacuaauuaggcagauggaaggggaaggaguauuguccaaagccgaucuagagaauccacacuuaccugagaagaaaauuacgcaauggcuagaaacgaaggggguagaaagauuaaaaaggauggcuauaucuggagacgauugcguaguaaaaccaauagaugaucgauuugccaaugcgcuauuagcuuuaaaugauauggggaagguaagaaaagauauaccacaauggcaaccaucuaaaggauggcacgauuggcagcaaguuccuuuuuguucgcaccauuuccacgaauuaauaaugaaggaugggagaaaauuagugguuccauguaggccucaagaugaauuaauugguagagcuagaauuucucaaggagcaggauggagucuucgugaaacggcaugucuuggcaaagcauaugcucaaauguggagucugauguauuuucauaggagagacuuaagacuugccaguaaugcaauuugcagugcgguuccaguacacuggguuccaacgaguagaacaacguggaguauacaugcacaucaucaauggaugaccacagaagauaugcugacuguuuggaauaggguguggauagaagauaauccuuggauggaagauaagaccccuguuacaacaugggaaaauguuccguacuugggcaaacgggaagaucaauggugugguucauuaauuggucucacaucuagagccacgugggcacaaaacauacccacugcaauccaacaaguacguucguugauugggaaugaagaauuucuugacuacaugcccuccaugaaaagauuucgaaaggaagaagaaagcgaaggugccaucugguga

SEQ ID NO: 23410 - RNA, 9873 nt, Artificial Sequence
  derived and/or modified CDS sequence (opt6) from DENV-3__FJ639774__SS-prME
acaagucuuugccuaaugaugauauugccugcagcuuuggcauuccacuuaacaucaagagauggggaaccucgaaugauaguagguaaaaacgaaaggggaaagagcuuacuauucaaaacagcaaguggaaucaauaugugcacacuaauagcuauggacuugggugaaaugugcgaugauacuguuaccuauaaauguccgcauauaacagaaguagaaccagaagauauugauugcugguguaaucugacaaguacauggguaacauacgggacauguaaucaagcgggagaacaucggcgagacaaacguaguguagcuuuagcgccccacguaggcaugggacucgacaccaggacacaaaccuggaugucagcggaaggagcauggaggcaaguagaaaaaguagaaaccugggcacuaaggcaccccggauucacuauacuggcacucuuccucgcacacuacaucggaaccagccuaacccaaaaaguuguaaucuucauacuucuaaugcuuguaacaccaucuaugacuaugagauguguaggagucgguaauagagauuucgucgaaggucugagcggugcaaccuggguugaugugguacuagaacauggaggauguguaaccacaauggccaaaaauaaaccuacuuuagauauugaguuacagaaaaccgaagcaacacaacuagcaacuuuaaggaaacucugcauagagggaaaaauaaccaacaucaccacugauucacgauguccaacacaaggagaagcaguacuaccagaagaacaagaccaaaauuacguauguaaacauacauaugucgacagagguugggggaacggaugcggguuguucggaaaagguucacuuguaacaugugcaaaauuccaaugucuggaacccauugaaggcaaaguuguccaauacgaaaaccuuaaauauacuguaauaauaacgguucauacaggagaucaacaccaaguaggaaacgaaacacaaggaguaacagcagaaaucacaccacaagcaagcacaacugaagccauauuaccagaauauggaacuuuaggguuagaauguucaccucgaacagggcuugacuucaacgaaaugauccugcuaacuaugaaaaauaaagcguggaugguacacaggcaaugguucuuugaucuuccguuaccauggacauccggaacgacuacugaaaccccuacauggaaucggaaagagcuucuuguaacauucaaaaacgcucacgcgaagaaacaagagguagucguacuuggaucucaagaaggggcaaugcacaccgcauuaacaggagcuacagaaauccaaaauucaggaggaacaaguaucuucgcuggacaucuaaaaugcaggcuaaaaauggauaaauuagaacucaaaggaaugaguuaugcaaugugcaccaacacauuuguucuaaagaaagaagucagugaaacacaacauggaacaauacuuauuaaaguggaauauaaaggugaagauguuccaugcaagauaccuuuuuccacagaggacgggcaagggaaggcucauaacggucgucuaauaaccgcgaaccccguaguuacgaagaaagaggagcccguaaacauagaggcagaaccaccauuuggagagucuaauauuguaauugguauaggugacaaugccuuaaagauaaauugguauaagaaaggaagcucuaucgguaagauguuugaagcaacugcucguggggcuagaagaauggcaauauuaggagauacagcaugggauuuuggcagcguuggagggguauuaaacucauuggguaagaugguccaucaaaucuuuggcuccgcguacacggcguuauuuaguggaguuuccuggguaaugaaaauaggcauaggcguacuucucaccuggauaggccuaaacaguaaaaauaccucaauguccuuuucuugcauagccauaggaauaauuacauuauaucuaggagcaguaguacaagcggacaugggauguguuaucaauuggaaaggcaaagaguuaaaaugugggucugguauauucguuacaaacgagguccauacauggacagaacaguauaaauuucaagcagacucaccaaaacgauuagcuacugcuauagcuggggccugggaaaacgguguauguggcaucagaucaacaacaaggauggaaaaccuucuguggaaacagauagcuaaugaauuaaacuauauuuugugggaaaacaacauaaaauuaacuguaguaguaggagacauaauuggaguguuagagcaggguaagagaacgcucaccccgcaacccauggaauugaaauauuccuggaaaaccuggggcaaagcuaagauuguaacugcggaaacacaaaauuccucguuuauuauagacggucccaacacucccgaaugccccaacgcguccagagcauggaaugucugggaaguagaagauuauggauuuggaguuuuuacuacaaauaucugguuaaaacugagggaaguguacacccagcucugcgaucauagauugaugucugcugcagucaaagaugaacgggcuguacacgcagacaugggauacuggauugaaucucagaaaaacggaucuuggaaauuggagaaagcaagccuaauugagguaaaaacgugcacuuggccaaaaucacauacuuuguggucaaauggaguuuuggaauccgauaugauuauaccgaagagucuagcggguccaauaucucagcauaauuaucggccaggauaccacacacaaacagcuggaccuuggcaucuagggaaacucgaauuagacuuuaauuauugugaagggaccacagucgucauaacagagaacugugggacgagaggucccucacuacguaccacuacaguaucaggaaaguuaauucacgaguggugcugucguuccuguacguuaccaccgcuuagguauaugggggaagauggaugcugguacgggauggaaaucaggcccauuucagaaaaggaggagaauaugguuaagucccuaguauccgcugguagcggagaaguagacaacuuuacgaugggcguccugugucucgcaauccuguucgaggagguaaugcgcggaaaguucgggaagaaacauaugauugcaggaguauucuuuacauucguacucuugcuguccggccaaauaaccuggagagauauggcgcauacccuuauaaugauuggaucaaaugcaagcgacagaaugggcaugggcguuacuuauuuagcauugauugcaacuuucaaaauucagccguuucuagcucuuggauucuuucugcguaagcuaacaagccgagaaaauuuguuauuaggaguaggcuuagcuauggccaccacccuacaacuacccgaagauauugagcaaauggcuaauggaauagcacuuggauuaauggcguuaaaauuaauuacgcaauuugagaccuaucaauuauggaccgcucuaaucagcuuaacauguaguaauacaauauucacacuaaccguagcguggagaacugcuacucugauauuagcuggaguuuccuuauugccaguaugucaguccucaucaaugcgaaaaacugauuggcuaccaaugaccguugcugcuaugggaguaccuccucuaccgcuauuuauuuuuagccucaaagacacacugaaaaggaggucguggccauuaaaugaaggcguaauggcuguuggauuaguuucgauccuagcaucgucacucuuacgaaaugauguacccauggcuggaccucugguagcaggaggauuauuaauugcgugcuaugucaucacagguacgucugcagauuugaccguagaaaaggcagcagauguaacaugggaagaggaagcugaacaaacggggguaagucacaauuuaaugauuaccguggaugacgaugggacgaugagaaucaaagacgacgagacugaaaacauauuaacgguacuuuuaaaaaccgccuuguugauagucucagguauauuuccuuauaguauaccugcaacauuacuuguguggcacacuuggcagaagcagacucaacggaguggcguucugugggaugugccgagucccccagaaacgcaaaaagcugaacuugaagaaggcgucuaucgaaucaagcagcaggguauuuuugguaaaacccaaguuggcguuggagugcagaaagagggugucuuccauacgauguggcacguaaccaggggugcuguccugacauauaacggaaaacgacuagaaccaaauugggcaucggucaagaaagaucuaauaucuuauggaggaggauggcgguuauccgcacaauggcaaaaaggggaggagguacaagugauagcuguggaaccuggcaaaaacccuaaaaauuuccaaacaaugcccggcacguuccaaaccacaacuggugagaucggcgcuauagccuuagauuucaaaccuggcacaucuggcucacccaucauuaaucgggaaggaaaaguuguaggguuauacggcaacggagucguuacuaaaaaugguggguacgugucuggaauugcacaaacuaaugcugaaccagaugguccuacuccugaacuugaagaagaaauguucaaaaagagaaaucuuacgauuauggaucuacaucccggaagugggaaaacaagaaaguauuuaccagcuauaguacgggaagcgauaaagcgccgucuccguacucuaauauuggccccaacaagaguaguugcagcugaaauggaagaagcacuaaaaggucuuccaauacguuaucaaacaacagcuacaaaaucagagcauacaggcagagaaaucguagaccucaugugccacgcaacauuuacaaugagacuucuaucaccugugcguguaccaaauuacaaucuaauaauaauggacgaagcucauuucacagacccagcaaguauagccgcgcgaggguacauaaguacacgagucggcaugggcgaagcggcugcaauuuucaugaccgcgaccccaccuggaacagcagacgcguucccccaaucgaacgccccaauccaagacgaagaacgggauauaccugagcguaguuggaacucagggaaugaauggauaaccgauuuugcggguaaaacaguaugguuugugcccagcauuaaggccggcaacgacaucgcaaacuguuuacgcaagaauggcaagaaagucauacaacuaucacgaaaaacauucgacacggaauaucagaaaacuaaauugaacgauugggauuucgucguaacaacugauauuucggaaaugggagcaaauuuuaaagccgaucgcgucauagauccaagacguugccucaaaccaguaauauuaacagacgggccagagagagugauacuugccgguccaaugccagucacagcagccucugcugcacagaggagaggacgggucggucgcaacccccaaaaagaaaacgaucaguacauauucacaggacaaccucuaaacaaugaugaagaucaugcacacuggacugaagcuaaaauguugcuagauaacauaaacacgcccgagggcaucauacccgcccucuuugaaccugaacgagaaaaguccgcugcaaucgacggugaguacagauuaaagggugaaucucgaaaaacauuuguagagcuaaugcguagaggagacuugccaguguggcuugcacacaaaguugcaucugagggcaucaaauacacagauaggaaauggugcuuugacggacaacguaauaaccaaauccuagaagagaacauggauguugaaauauggacaaaagaaggggaacguaagaaacuaagaccaagaugguuggaugcucgcacuuauucagaucccuuagcacuaaaagaauuuaaagauuucgcugcaggccguaaaucaauugcauuggaucuaguaacagagauaggucguguacccacucaucuggcucacagaacccguaaugcccuggacaaucuuguaaugcuucacacaucugagcaugguggaaaggcuuaucgacaugccguugaggaacucccagagacaauggaaacacuucuucuguuaggacucaugauucuacuaaccggcggugcgauguuguuuuuaauauccggaaaagguauaggcaaaacaucaauaggccuaauuuguguaauagcaagcucaggaauguuguggauggcagagauuccuuuacaauggauugcuucagcuauuguccuagaauuuuucaugaugguguuauuaaucccugaaccggaaaaacagcgaacgccacaagauaaucaacuagcauacguaguuaucggaauuuuaacacuagccgcuauuauugcagcaaacgagauggguuuauuagagacgaccaaacgcgaucugggcauguccaaggaaccuggcguuguaaguccgacaagcuacuuagacguggacuuacacccugcuucagcauggacuuuguacgcagucgcuacaacagugauaacgccuauguuaagacauacuauagaaaacuccacagcaaacguaucacuggcggcaauagcuaaucaagcaguaguuuuaaugggucuagauaaaggauggccgauaaguaaaauggaucuaggagucccccugcuugcuuuagguuguuauucacagguuaacccccugacacugacugcagcuguguugcucuuaauuacacauuaugccauaauagguccaggcuugcaagccaaggcaacacgugaagcacagaaaagaacagcugcgggcauuaugaagaacccaaccguugaugggauaaugacuaucgauuuggacccaguuauauacgauucuaaauucgaaaaacagcuaggacaaguuaugcucuugguacucugcgcaguccaacuauuacuaaugagaacaaguugggcgcuaugcgaagcauuaaccuuagcgacuggucccauaacaacuuuaugggagggaagcccaggaaaauucuggaacacuaccauugccgugagcauggcuaauauuuuuagaggaucauacuuagccggugcaggcuuggcguuuucuauaaugaagucaguaggaacgggaaaacgcgggacagguagccaaggugaaacacuaggcgaaaaauggaagaagaaacuuaaccaacuuucccgaaaagaguuugauuuauauaagaaaucagguaucacggagguugauagaacagaagcaaaagagggccugaaacgaggagagauaacucaucaugcggucucaaggggaucugcaaaacuucaaugguuuguggagcgaaauaugguaaucccagaaggaagagugauagaucugggaugugggcgaggagguuggaguuauuacugcgcgggcuuaaagaaagucacagaaguacgugguuauacaaaaggggguccaggucaugaagaacccguaccuauguccacauauggcuggaacauaguaaaauuaaugagugguaaagauguauucuaccuuccaccagagaaaugugauacuuuacuuugugauaucggggagucuucuccgucaccaacagucgaagagucacgcacaauacgcguauugaaaaugguggaaccauggcucaaaaacaaccaguuuugcauaaaaguacuaaauccuuauaugccugcaguaauagaacaucuggaacggcugcaacguaaacauggagggauguuaguaagaaauccucuaaguaggaacagcacacacgagauguacuggaucuccaacggaaccggcaauauaguugccagugucaauaugguaagccggcuccuauugaaucgcuucacuaugacccaccgacgaccuacuauagaaaaagaugucgauuuaggagccggaacaaggcaugugaaugcugaacccgaaacuccaaacauggacguuauaggcgaaagaauuaaaagaaucaaagaggagcacaacucaacauggcauuacgaugacgaaaaccccuauaagacgugggccuaucauggcucauaugaaguaaaggcaacuggauccgcgaguucaaugauuaaugguguugugaaacuccuuacuaagccuugggauguaguaccaauggucacucaaauggcuaugacagacacuacuccguuuggucaacaacgcgucuuuaaagaaaaagucgauacuagaacuccaagauccaugccaggaacacguagaguuaugggcauaacugcugagugguuauggagaacacuaggcagaaacaaaaagccacgacuauguaccagagaagaguucaccaagaaaguccgaacuaaugccgcaaugggcgcgguauuuacagaggaaaaucaaugggauuccgcaaaagcggcaguggaagaugaagacuuuuggaagcuaguagacagagagagggaacuacauaaacuagggaaaugcggaucauguguauacaacaugaugggaaaaagggagaagaaacuaggggaguucggaaaagcuaaaggaucuagggcaauuugguauauguggcuaggagcgcgauaucuggaguuugaagcucuaggauucuuaaaugaagaccauugguuuucaagagaaaacucauauaguggcguugaaggagaaggacuucauaaauuagguuauaucuuacgagauauuagcaaaauaccuggaggagccauguaugcagaugauacagcgggaugggacacacguaucacagaagacgaccuacacaaugaagagaaaauaacacaacaaauggauccagagcauagacaauuagcaaacgccauauuuaaauugacauaucaaaauaaaguaguaaaaguucaacgacccacuccaacaggcacaguaauggacauuauaagucgaaaagaucaacgaggaucuggucagguaggcacuuacggauuaaauaccuuuacaaauauggaggcucaguuaauaagacaaauggagggcgaagggguacuuaguaaagcggaccuagaaaauccccaucuaccagagaagaaaauaacacagugguuggagacuaagggcguggagcgacuuaagagaauggccauaaguggggaugauuguguggucaaaccgauugacgaucgauucgcuaacgcgcuuuuagcccugaacgacaugggaaaaguuaggaaggauauaccacaguggcagccaagcaagggauggcacgauuggcaacaaguuccguucugcagccaucauuuccaugagcuaaucaugaaagacgguagaaaacuuguugugccaugucgaccacaagacgaacucauaggucgagcgcgcauaagucaaggagccggauggucauuacgagagaccgcuugcuuagguaaagcauacgcacaaauguggagcuuaauguauuuccaucgaagggaccuaagauuggcaagcaacgcaauuugcagcgcaguuccggugcauuggguaccuacgucacgcacaacuugguccauacaugcacaucaucaauggaugacuacagaagacauguuaaccguauggaacaggguguggauagaagacaauccauggauggaagauaaaacaccgguaacaacuugggaaaauguacccuacuuaggcaaacgagaagaucaauggugugguagccuuauaggacuaacgagccgugcaacuugggcccaaaauauacccacggcaauacagcaagugagaucgcuaauagguaacgaggaguuccuugauuacaugcccucaaugaaaagauuccguaaagaggaagaaucugaaggcgcaaucugguaa

SEQ ID NO: 23411 - RNA, 9873 nt, Artificial Sequence
  derived and/or modified CDS sequence (opt6) from DENV-3__FJ639775__SS-prME
acgagcuugugccuaaugaugauauugccagcagcguuggcuuuccaccuuacaucccgagauggagaaccgcguaugaucguaggcaaaaacgaaagagguaaaucccuacucuuuaaaaccgcaagugguauaaacauguguacuuugauugcuauggaucuuggugaaaugugcgacgauacaguaacauacaaauguccacauauaacagaaguagaaccagaagacauagauugcugguguaacuuaacuucaacuugggucacuuauggaaccugcaaucaagcgggagaacauagacgagacaaaaggucgguugcgcuagcgccacauguuggcaugggccuugauacuaggacgcaaacauggaugagugcggaaggggcauggaggcaaguagaaaaagucgaaacgugggcgcuccgccacccaggguucacaaucuuggcauuauuuuuagcacauuauauagguaccucacuuacacagaaaguaguaauuuuuaucuuacuuauguuaguaacaccuucuaugacuaugcgaugcgugggcguugguaacagagauuucguagaaggacuaucaggcgcuacauggguagacguaguauuggaacaugguggaugcgugacgacaauggcuaaaaacaaaccaacacuagauauagaacuucagaaaacagaagccacucaauuagcaaccuuacgcaaauuauguaucgaagguaaaaucaccaacauuacaacugacucgcggugucccacccagggagaagcuguguuaccggaggagcaagaccagaauuacgucuguaaacauacauauguugauagagguugggggaacgguugcggauuauucggaaaaggcaguuuaguuacgugcgcaaaauuccagugcuuggaaccuaucgagggcaaaguuguacaauacgagaaucuaaaauauacggucauuaucacaguucauacaggagaucagcaucagguaggcaaugaaacccagggugugacugcugaaauaacaccccaagcaaguaccacggaagccauacucccagaauaugguacuuugggauuagaauguaguccccgcacagggcuggauuuuaaugagaugauuuuacuaacaaugaaaaacaaagccuggaugguucauagacaaugguucuuugauuugccccuuccuuggacaucgggugcuacaacagaaacgccgacauggaaucggaaagagcuauuaguuacauuuaaaaaugcacacgccaagaaacaggagguaguaguguuaggcucacaggaaggugcuaugcacacagcccuuacaggagcgacagaaauacaaaauagcggggguacaucaauuuucgccggacauuuaaaaugucgcuuaaaaauggacaaauuggaacuaaaaggaaugucguacgcuauguguacuaauacauuuguauuaaagaaagaaguuucagaaacucaacauggcacaauccuaaucaaaguagaauacaaaggugaagacguaccuugcaaaaucccuuuuagcacggaggaugggcagggaaaagcacacaauggucgguuaauaaccgcaaauccugugguaacaaagaaagaagaaccggucaauauagaagcugaaccaccuuuuggagaauccaacauaguaaucggaauaggagauaaugcccucaaaaucaacugguauaagaaagggucgagcaucggcaaaauguucgaagcaacagcaaggggagccagaagaauggcaauacuaggagauaccgcaugggauuuuggguccguuggcggugucuuaaacagucuagggaaaaugguucaucaaauauucggaucggccuauacugcacuuuucucagguguaucauggguaaugaaaaucggaauugguguacuucuuacauggaucggucuuaauaguaaaaacaccucaaugaguuuuucguguauugcuauagguauuaucacauuauauuugggcgcuguuguacaggcggacaugggauguguaaucaacuggaaagguaaagaacuaaaauguggaaguggaauauuugugacaaacgaagugcacacauggacagaacaguacaaauuccaagcugauucacccaaacgccuggccacagccauagcuggugcuugggaaaacgguguaugcggaauacggagcacaacucgcauggaaaacuuauuauggaaacagaucgcaaaugaacucaacuauauauuaugggaaaacaauauaaaacuuacuguuguaguaggagacaucaucggugucuuagagcaagguaaacgaacauugacuccgcaaccuauggaacuaaaauauuccuggaagacauggggcaaggcgaaaauagugacugcggagacacaaaauucuucuuuuauaauagauggaccaaacacucccgaauguccaucggcuucacgagcuuggaauguaugggaagucgaagauuacgguuuuggcgucuucacaacuaauauauggcucaaacuuagagaaguguauacgcagcugugcgaucaccggcucaugagugcagcagugaaggaugaacgagccguacaugcggacaugggguacuggauagaaucacagaaaaacggaucauggaaacuggaaaaagccagucugauagaaguaaaaacauguacauggccaaaaagucauacacuauggaguaacgggguccuugaaagcgacaugaucaucccuaaaucuuuagcagguccaaucucucaacauaauuaccgccccggauaccauacccaaacggcuggaccauggcaucuugguaaauuagagcuugauuuuaauuauugcgaagguacgacgguaguuaucacugaaaacugugggacccgcggucccagcuuaaggacaacgacugugaguggaaaacugauucaugaauggugcugcaggagcugcacgcuaccuccacuacguuacaugggagaagacggcuguugguauggaauggaaauuaggccgaucucagagaaggaagaaaacaugguuaaguccuuaguaagugcaggcucaggugaagucgacaacuuuacgaugggagucuugugcuuagccauacuguuugaggaaguuaugcggggaaaauucgggaagaaacacaugaucgcggguguauucuuuacauuuguacuauuauuaagcggucagauaacauggcgagauauggcucauacuuugauuaugaucggcaguaaugccucagacagaauggguauggggguaacuuacuuagcauuaaucgcgacauucaagauacaaccauucuuagcauuaggauucuuucugagaaaauuaacaucgagagaaaaucucuuauuaggagucggccuggccauggcgacaacauuacaauugccugaggacauagaacaaauggccaacggaaucgcacucggacucauggcacuaaaacuaaucacucaauucgaaacauaucaauuauggaccgcuuuaauaucuuuaaccugcucuaacacaauauuuacucuaacgguugcguggagaacagccacucuaauacuagcaggaguaucauuauuaccuguaugucaaucauccucaaugaggaaaacggacuggcuacccaugacuguagccgcaaugggggucccaccacuaccauuguucauauucucccuaaaggauacauuaaaaaggagaucguggcccuuaaaugaaggcgugauggcagugggguuaguaucgauacuugcgagcucauuacuaagaaacgacgugccuauggccggaccucuaguagcaggagggcucuugauagcguguuauguuauaaccggaaccagcgcugaucucacuguugaaaaggcagcugauguaacaugggaagaagaagcagaacaaaccggaguaucacacaacuuaaugauaaccguggaugaugacggaaccaugagaauaaaggaugacgaaacggaaaacauauuaacaguuuuacuaaagacugcacuacucaucguuucgggaauuuuuccauacaguauaccagcuacauuauugguauggcauacauggcaaaaacagacccaaagaucaggagugcuaugggauguuccuaguccuccugaaacucaaaaagcggaguuagaggaaggggucuauaggauuaaacagcaaggaauauuuggaaagacgcaaguaggaguagguguacagaaagaagguguguuucacacaauguggcacgucacacguggugcaguucucacauauaacggaaagcgacuagaacccaauugggcuucuguuaagaaagaucuuauaucuuacggggguggcuggagacuaucagcccaauggcaaaaaggggaggaaguacaagucauagcuguugaaccuggcaaaaaccccaaaaacuuucaaacgaugcccgggacauuucaaacaacaacaggcgaaauaggcgccauagcuuuagauuuuaaaccuggaacaucugggagcccuauuaucaauagggaagguaaaguaguagggcuauauggaaacggcgucguuacuaaaaauggcggguacguaucuggaaucgcucaaacuaaugcagagccugacggaccgacuccggaacuagaagaagagauguuuaagaaacggaauuuaacgauaauggaccuacacccugguaguggcaagacgagaaaauaccuuccggcaaucgugcgagaagcgauuaaacggagauugcgcacucuaauucuugccccuacaagaguaguggcugcagagauggaagaagcacuuaaagguuuacccauccgauaucaaacaacggcgacaaaauccgaacauacuggacgugaaauaguagaccuuaugugucaugccacuuuuacuaugcgguugcuaagcccuguacgcguaccuaauuauaacuuaaucaucauggacgaagcucacuuuacugauccagccucaauagcagcccgaggauauaucaguacuagaguaggcaugggcgaggcagccgcaauuuuuaugacagcaacacccccaggaacugcagacgcauuuccucaaagcaaugcuccaauacaagacgaggaaagagauauuccagaaaggaguuggaauaguggaaaugaauggauuacugauuucgcaggcaaaacagucugguuuguuccaaguauaaaggcgggaaaugacauagcuaauugcuugagaaagaauggcaagaaaguaauacaacuuucaagaaagacauuugauaccgaauaucagaaaacuaaguuaaacgauugggacuuugucguaacaacagauaucucggagaugggugcuaauuuuaaggccgauaggguaauagacccacgccgcugcuugaaaccagucauauuaacugacggcccugagagaguaauauuagccggacccaugccagugacagcagcuagugcagcacaaagacgaggaagaguaggaagaaauccucagaaggaaaacgaccaauauaucuuuaccggucagcccuuaaauaaugaugaagaccaugcucauuggacagaagcgaaaaugcuauuggauaacauaaacacaccagaaggcauaaucccugcauuguuugaaccagaacgagaaaaaucagcagccaucgacggugaguaccgauuaaaaggagaaagucgcaaaacauuuguagaauugaugagaaggggagaucuaccuguuuggcuagcccauaaaguggcaucagaaggaauuaaauauacggaucgcaagugguguuucgauggccaacgaaacaaucaaauacuugaagaaaauauggaugucgaaauauggacaaaagaaggggagaagaagaaacuacguccacgauggcuagaugcaaggacauacucagacccucucgcacuuaaagaauuuaaagauuuugcagccggcaggaaaucgauugcauuagacuuaguuacagagauaggccgcguuccuucccacuuagcacauagaacgagaaaugcuuuggacaacuugguaauguuacauaccagcgagcacggaggaaaggcguaucgacacgcaguagaagaguuaccagaaacuauggagacgcuguuacugcuugggcuuaugauuuuauuaacagguggagcuaugcucuuucuaauuucgggaaaagggauuggaaagacgucgauagguuugauaugugugaucgcaucgagcggaauguuguggauggcugaaauuccccuacaauggauugcuucggccauaguauuagaauuuuucaugauggucuuacuaauacccgaaccugaaaaacaacgaacgccacaagauaaccagcuugcuuaugucguuauaggcauucuaacucuugcggcuauuaucgcggcgaaugaaauggggcuuuuggaaacaacaaagagagauuuagguaugagcaaagaaccagggguaguaucaccaaccaguuaucuggauguugaccuacauccggccucugcuuggacuuuauacgcaguugcgacaacggugaucacucccaugcugaggcacaccaucgaaaauaguacugcgaacguaagucuugcggccauugcaaaccaggccgucguauugaugggccuugauaaaggcuggccuaucucaaaaauggaccucgggguaccauugcuugcccuugguugcuacagucaaguaaauccauugacauugaccgcagcuguauuauuacuuauaacacauuaugcaauaauugguccaggccuccaggcuaaagccacaagggaggcucagaagagaacggcagcaggaauaaugaaaaaccccaccguagacgggauaaugacuauagauuuagaucccguaauauaugauaguaaauucgaaaaacaauuaggccaggucauguugcucguauuaugcgcgguacaauuauugcuaaugaggacauccugggcuuugugcgaagcauuaacauuggcgaccggaccgaucacaacucugugggaaggaagucccggaaaauuuuggaacacaacuauugccguuaguauggcaaauaucuuucgagguucauauuuggcgggagccggauuagcauucagcauaaugaaauccguagggacaggcaaaagaggaaccgguagucaaggagagacucuaggagaaaaguggaagaagaaacugaaucaguuaucucgcaaagaguuugaucuauacaaaaagucaggaauuacagaaguagauagaaccgaagcaaaagaaggccuuaaacgaggagaaauuacgcaccaugcagugucaaggggcuccgcaaaauuacaaugguuuguagaacgaaacaugguaauuccagaaggaaggguaauugaucuuggaugugguagggguggcuggagcuauuauugugcaggacugaagaaagugacagagguacgaggauacacgaagggaggcccaggccacgaagaacccgucccaauguccacauacggcuggaauauagugaaacucaugagugguaaggacguuuucuacuuaccaccugaaaaaugugauacucuguuaugcgauauuggagagucgucuccaucgcccacagucgaagaaagcagaaccauaagaguucugaaaaugguagaaccuugguugaaaaauaaucaauuuugcauaaaaguccuuaauccuuacaugccaaccguaauagagcauuuggaacgauugcaaagaaaacaugguggaaugcuggugcgaaauccgcuaucacgaaacagcacacacgaaauguacuggauaaguaacggaacgggaaacauaguugcuuccguuaauauggucucccgucugcuacuaaauagguuuaccaugacgcaucgacgcccaacgauagaaaaagacguggacuuaggcgcaggaacccgacacguaaacgcagaaccggaaacuccuaacauggauguaauuggagagcguauaaaaagaauaaaagaggagcauaauucaaccuggcacuacgaugacgaaaauccauacaagacaugggcauaccacggcaguuaugaaguuaaggcaacuggaucagcuucaucaaugauuaacgggguaguaaagcuauugacaaaaccaugggaugucguacccaugguaacucagauggcaaugaccgauacuacaccauucggucaacaacgcguuuuuaaggaaaaaguagauacgagaacaccucgaucuaugccugguacuagacgggcuaugggaauaaccgcggaauggcuguggcguacguuaggaagaaauaagaaaccacguuuaugcaccagagaagaauuuaccaagaaaguaagaacgaaugcagccaugggggcaguuuuuacggaagagaaucaaugggacucagcaaaagcagcagucgaggaugaagacuucuggaaguuaguugaccgagaacgugaacuucacaagcuaggaaaguguggguccugcgucuacaauaugaugggcaaaagagagaagaaacuaggugaguucgguaaagcuaaaggaucaagagcaauuugguauauguggcugggagcaagauaucuggaauuugaagcgcucggcuuuuuaaaugaagaucauugguucagccgagaaaacuccuacucaggagucgagggugagggauuacauaaauuaggauauaucuuaagagauauauccaaaauuccugggggcgcgauguacgcugaugacacagccggaugggauacgagaauuacagaagacgaucugcauaacgaagagaaaauaacacagcaaauggauccggaacaccgacagcuugcaaacgcaauauuuaaauuaacauaucaaaacaaaguaguuaaaguucagagaccuacuccaacagguacggugauggauauuaucucucgaaaggaccaacgugguucagggcaaguuggaacuuacggacuuaauacauuuacaaauauggaagcacaauugauacgacaaauggaaggagaaggagucuuaucgaaagcagauuuggaaaauccacaccucccagagaagaaaauuacucaauggcucgagacuaagggcguagagagacuuaaacggauggcaauuucaggggaugauuguguaguaaaaccaauugacgaccgauuugcuaaugcgcucuuagcauugaaugauauggggaaaguacgcaaagauauaccacaguggcaaccaucgaaagguuggcacgauuggcaacaaguaccuuuuuguagucaucauuuccacgaacuaaucaugaaagaugguaggaaacuuguuguaccuugcagaccucaagaugaacugaucggacgagcacgcauuucacaaggugccgguuggaguuuaagagaaacggcauguuugggaaaagccuaugcgcaaauguggucacuuauguauuuccaucgaagggacuugcgacuagccaguaacgcaauaugcucagccguaccaguacauuggguaccgaccucgaggacaacauggaguauacacgcacaccaucaauggaugacaacagaagauaugcucacuguauggaaucguguauggaucgaagauaauccguggauggaagacaaaacuccagugacgaccugggaaaacguaccauaucugggaaaaagagaagaccagugguguggauccuuaauuggauuaaccucgagggcgaccugggcgcaaaacaucccaacagcaauccaacagguucgcucacucaucggaaaugaggaauuucuggacuacaugccgucaaugaaaagauucagaaaggaagaagaauccgaaggagcuauaugguaa

SEQ ID NO: 23412 - RNA, 9873 nt, Artificial Sequence
  derived and/or modified CDS sequence (opt6) from DENV-3__FJ639777__SS-prME
accucguuauguuuaaugaugacauugcccgcagcguuagcauuccaucugaccucaagagauggugaaccacgaaugauaguagguaaaaaugaaagagggaaauccuuauuguuuaaaaccgcuucggggauuaacauguguacacuuauagcaauggauuuaggagaaaugugcgacgacacagugaccuauaaaugcccacacauuacugaaguugaaccggaagauauagauuguugguguaacuuaacuucgacauggguaacauauggaacauguaaucaagcaggagaacauagacgagauaaacguaguguagcccuggcaccacauguaggcaugggauuagauacgaggacacaaacuuggaugagcgcugaaggagccuggagacaagucgaaaagguggaaacaugggcgcuacgccacccuggauucacgaucuuagcccucuuccucgcacauuauauagggacuucucuaacgcaaaaaguagucauuuuuauacuucucauguuaguuacucccucuaugaccaugcguuguguuggaguaggaaauagagacuucguggaaggccuaucuggagcuacgugggucgacguugucuuggaacauggcggaugugugacuacuauggccaagaauaaaccaacucuagacauagaacuacagaaaacggaagcuacccaacucgcaacacugaggaaacuuuguauagaagguaaaaucacuaauauaacaacagauucgagaugucccacacaaggggaagcuguccuuccggaagaacaagaucaaaacuauguaugcaaacacacuuacguugaccgaggcuggggaaauggcugcggauuauucggcaaagggucauuaguaacuugugccaaauuucaauguuuagaaccuauugaagguaaggucgugcaauaugaaaauuuaaaauacaccguaaucauuaccguccauacaggagaccaacaucaagucggaaacgaaacacaaggaguaacugcggaaauuacuccucaagcaucaacaacggaagcaauauuaccagaguacgggacauuaggauuagaauguagcccaagaacaggacuugacuuuaaugaaaugauacuuuuaacaaugaagaauaaagccuggaugguccaucgacaaugguucuuugacuuaccccuaccauggaccaguggggcaacaacugaaaccccaacguggaaccggaaagaacuucuuguaacauucaaaaaugcacaugcuaaaaagcaagaagucgucgugcucgguucucaggaaggagcgaugcacacagcucuaacuggggcaacagaaauacaaaacagcgguggaacaaguauuuucgcaggucacuugaaaugccggcuaaaaauggacaaacuugaacucaaaggaaugucuuaugcaaugugcacgaacacauucgugcuaaagaaagagguuucagaaacccaacacgguacaauuuuaaucaaaguggaauacaaaggggaagacguuccaugcaaaauuccguuuaguaccgaagaugggcaagguaaagcacauaacggacgacucauaaccgcaaaucccguaguuacaaagaaagaggaaccaguaaacaucgaagcggaaccucccuuuggcgaaucaaacaucgugauagguauuggugauaacgcacuaaagauaaacugguauaaaaagggcucuagcauuggcaaaauguuugaagcuacugcgcgcggugcacgucgaauggcuauucuaggagauacagcuugggacuucgggaguguaggagguguauuaaauagccucggaaaaauggugcaucaaauauuugggagugccuauacugcccuauuuuccgguguaaguugggugaugaaaauagguauagguguccuacuaacuuggaucggauuaaauucgaaaaacacaucaaugaguuucagcugcaucgcaauaggcauaauaacccuauaucuaggugcugucguccaagccgauaugggcugugugauuaacuggaagggcaaggaauuaaagugcggcagcgguauuuuugugacuaacgagguucauaccuggacagagcaauacaaguuccaagcugauucucccaaaagacuagcuacggcaauagcaggagcaugggaaaauggcgugugcgguauuagaucaacgacucguauggaaaauuuacuauggaaacaaauugcgaacgagcugaacuauauccuaugggaaaauaauaucaaauuaaccguugugguaggagacaucauagguguacuugaacaaggaaaaagaacccuaacaccccaaccaauggaauuaaaauacucauggaaaacauggggcaaagcgaaaauaguggcagcagagacacagaacaguaguuuuauuauagauggaccuaauacacccgaaugccccucugcuucgcgcgcuuggaaugucugggaaguagaagauuaugguuuuggaguauucacuacaaauauauggcuaaaacugcgggaggucuauacacaauuaugugaucaucgguuaaugucugcagccguuaaggaugaacgagcaguucacgcagauauggguuauuggaucgagucucagaaaaauggaucauggaaauuagagaaggccucccuuaucgaagugaagacaugcacguggccaaaaucgcauacccucuggagcaauggcguucuugaaucagauaugauuauacccaagucauuggcagguccaauuagucagcauaauuauagaccaggauaucauacacaaacagcaggaccuuggcaccuagggaagcuagagcuagacuucaacuauugugaaggcacgaccguuguuauuacagaaaacugugggacgagagguccuaguuuaagaacuacuacagucucaggaaaauuaauacaugaaugguguugucgauccuguacucuaccuccgcuacgauauaugggcgaagacggauguugguaugggauggagauaaggccuauaucggagaaggaagaaaacaugguuaaaagccuaguuagugccggaucaggugagguagauaauuucacgauggggguguugugccuugccauauuauucgaagagguuaugagagguaaguuagguaagaaacauaugauugcggguguauucuuuacauuuguauuauuauuaucuggccaaauaacauggagggauauggcacacaccuuaauuaugauaggaagcaaugcaucagaucgcaugggcauggggguuacauaccuugcacuaauagcgacauuuaaaauccaaccauuccuugcacuaggguucuuccugcgcaaauuaaccagucgagagaauuuauuguuggguguuggauuggcuauggcaacuacauuacaauugccugaggauaucgaacaaauggcaaauggaaucgcucuaggccucauggcgcugaaauugauaacucaauucgagacguaucaauuguggacugcucuaauuagccugacauguuccaauacaaucuuuaccuuaacgguggcuuggaggaccgcaacauuaauuuuggcugguguaagucuuuuaccaguuugccaaagcucaaguaugcggaaaacagauuggcuaccaaugacgguagcagcgauggggguuccuccauuaccacuauuuaucuuuucauugaaagauacacucaaaagaaggaguuggccuuuaaaugaaggugucauggcaguaggauuaguuucuaucuuggcuaguucguuauugagaaacgauguuccaauggcgggaccacuuguagcuggcggacuuuuaauagcuuguuauguaauaacagggaccucugcugaucucacaguagaaaaagccgccgacgucacuugggaggaagaagccgaacaaacaggggugagccauaauuuaaugaucaccguagacgaugacgggacaaugcgaauaaaagacgaugaaacagagaauauccucacaguacugcucaaaacagcacuauuaauugucucaggcauauuuccauacaguaucccagccacguugcuugucuggcauacguggcaaaagcagacacaacgcaguggggugcuaugggacguccccaguccaccagaaacucaaaaagcagagcucgaggaaggaguauaucgaauaaagcaacagggaauauuuggaaagacacaaguagguguagggguacagaaagaaggagucuuucauacaauguggcaugugacuagaggugcgguucucacguauaauggaaaacgacuagaaccaaauugggcauccguuaaaaaggauuuaauuagcuauggcggaggauggaggcuaaacgcacaauggcaaaagggagaggaaguacaaguuauugcaguugaaccaggcaaaaaucccaaaaacuuccaaacgaugccaggaaccuuucaaacaacuacgggagaaauaggagcaauagcccuugacuuuaaaccugguacaaguggaagcccaaucauaaacagggaaggaaaaguaguagggcuauauggaaacggaguaguuacuaagaacggagguuacgucucgggaauugcacaaacaaaugcagaaccugauggaccaacuccagaguuggaagaagaaauguuuaaaaagcgaaacuugacaauuauggacuugcauccaggaucgggcaagacucgcaaauauuuacccgcaauaguaagggaagcaaucaaaaggagauuaagaacacugauauuagcuccaacgaggguuguagcagccgaaauggaggaagcauugaaaggauuaccaaucagauaccaaacuacagcaacaaaaagugaacauacaggcagagaaauaguagacuuaaugugucacgcgacauuuacaaugcguuugcuaucaccugucagaguaccaaauuauaaucuaauaauuauggacgaagcacauuuuacagacccugccucaauagccgcccgugguuauauuucaacacguguagggaugggugaggcagcagcaauuuuuaugacggcgacgccacccgguacggcggacgcauuuccucaaaguaaugccccuauucaagaugaagaaagggauaucccagaacgaucauggaacucaggaaaugaguggaucacggacuucgcagggaaaacuguaugguuuguaccaaguauaaaagcagguaacgauauugcuaauugccuaaggaaaaaugguaaaaagguaauucagcuaucuagaaaaacauuugacaccgaguaccagaaaacuaaauuaaaugacugggauuucgucguuacaacagauauuucugaaaugggagcaaacuuuaaagcugauaggguuauagauccacgaagaugcuuaaaacccgucauuuugacugacgguccggaacguguaauacuggcaggaccaaucccaguuacggcagcaucggcagcacaacggagaggacggguugguagaaacccucaaaaagaaaacgaucaauacauuuuuacuggccaaccauuaaauaaugacgaagaucaugcgcauuggacagaagcaaaaaugcuucuagauaauauaaauacuccggagggcaucauaccugcacuauuugaaccugaacgcgagaaaucugcugcuaucgacggugaauauaggcuaaagggagagucaaggaaaacauuuguagaacucaugcguagaggugacuuacccguauggcucgcgcauaaagucgcgagugaaggaauuaaguauacagaucgcaaaugguguuuugacggacaacgaaauaaccaaauauuagaagaaaacauggacguggaaauuuggacgaaggagggcgagaagaagaaauugcguccaagguggcuugacgcaagaacuuauagcgacccccuagcccucaaagaauuuaaagauuuugcggcuggacggaaaagcauagcucuagaucucguaaccgaaaucgguagaguaccgucucauuuggcgcacagaacacggaaugcauuagauaaucucguaauguugcauaccucagagcauggugguaaagcguacagacaugcagucgaagaguuacccgaaacaauggagacgcuguuacuauuagggcuuaugauauuacucacugguggcgcgaugcucuuuuuaauuaguggcaaaggcauaggaaagacuucaauuggguuaauaugcguaaucgcauccuccgguauguuguggauggcggaaaucccgcuacaauggauugcaucugcuaucguucuugaguucuuuaugaugguuuuacuaauuccugagccagaaaaacaacgaaccccgcaagauaaucaacuagcuuacguaguaauuggcauacuuacacucgcagcgaucauugcggccaacgaaaugggacugcuagaaaccacaaaacgcgaccuggggaugaguaaagagcccgguguggucucaccaacuucauaucuagauguagaucuucauccugcgucggcauggacuuuauacgcagucgccacaaccgucauuacuccaaugcucagacacacaauugaaaauucaacugcuaaugugagucuggcugccauagcaaaccaagcugugguauuaaugggucuagauaaggguuggccuauaucaaaaauggaucuuggcguacccuuauuagcgcuggguugcuacagccaaguaaacccauuaacacugacggcugcuguucucuuacuaauuacucauuaugcaauaauuggaccgggauuacaagcuaaagcaacaagagaagcucaaaaacgaacagcugcagggaucaugaaaaaccccacgguugacgguauuaugacaauugauuuggauccugugauauaugauucuaaguuugaaaaacaauuaggucaaguuauguuauuggugcuuugugccguacaguuguuauuaaugcggacaucuugggcacuuugugaagccuuaacauuagcuacaggcccuaucaccacuuuaugggaagguagucccggaaaauucuggaauacaaccaucgcuguuaguauggccaauaucuucaggggaucauacauagcaggagccggacuagcauucucgauaaugaagucugucggaaccggcaagagaggaacaggaucgcaaggagaaacacuaggagaaaaguggaagaagaaacuaaaucaacuuucgagaaaagaguucgaucuguauaagaagagugggauuacagagguggaucgaacugaagccaaggaaggacuaaaacgaggagaaaucacucaucaugcuguuucuagaggcucagcgaaacuacaaugguuuguugaacggaauauggugacacccgagggucguguaauugaucuuggaugcgggagaggagguuggaguuacuacugcgcuggcuugaagaaaguuacagaaguacgggguuacacgaaaggaggcccaggacaugaagaaccaguuccuauguccaccuauggauggaauaucgugaaacuaaugaguggaaaagaugucuucuauuuaccuccugaaaagugugacacuuuacuaugugauaucggcgagagcaguccaagucccacuguagaagaguccaggacaauacggguguugaagaugguggaacccuggcugaaaaauaaucaauucugcauuaaaguuuuaaauccuuauaugccgacuguaauagagcaccuagagcgccugcagcgaaaacacggugguaugcuuguucgauccccucuaucucgaaacucaacacacgaaauguacuggauuaguaauggcacugguaacauaguugcuucggucaauaugguaagcaggcuauuauuaaauagauucacuaugacacacagacgucccacgauagaaaaggacguugauuuaggggcagguacgcgucaugugaacgccgagccagagacaccaaauauggauguaaucggggaaagaauuaaaagaauaaaagaagaacauaauucaacauggcauuacgaugaugaaaauccuuacaaaacuugggcuuaccaugguucauaugaaguuaaagcaacagguucugcuucuucaaugauaaacggaguugugaaacuacugacgaaacccugggaugugguaccgaugguaacacagauggcuaugacagauacuaccccuuuuggacagcaacgaguuuuuaaggaaaaaguggauacccgaaccccacggucuaugccugguacaagacgggugauggguauaaccgccgaauggcucuggagaacauuaggacguaacaagaaaccuaggcucuguacuagagaagaguucaccaagaaaguaagaaccaaugcagcgaugggugcugucuuuacagaagagaaucaaugggauucagcuaaagcagcaguugaagaugaagauuucuggaaauuaguugauagggagagggaacugcacagauuagguaaaugcgggaguuguguuuauaauaugaugggaaaaagagagaagaaacuuggagaguucggaaaagcaaaaggaagucgggcgaucugguauaugugguugggagcucgguacuuggaguuugaggcgcuggguuuucuaaaugaagaccacugguuuucaagggagaacuccuauaguggaguugaaggugaaggcuuacauaaauugggauauauuuuacgugacauaucaaaaauacccgguggcgcuauguaugcggacgacaccgcaggaugggauacgcguaucacagaagacgaucuucacaacgaagaaaagaucacacaacaaauggacccagaacacagacaacucgcuaaugcuauauucaaacugacuuaucaaaauaaagugguuaaaguacaaaggcccacaccuacuggaacgguaauggacauaauaucgagaaaggaccaaagaggaaguggccagguuggcaccuauggacuaaauacauuuaccaauauggaagcucaacucauacgucaaauggaaggagaaggcguucucucaaaagcagauuuggaaaauccacauuuaccagaaaagaaaauaacacaaugguuagaaacgaaaggcguagaaagacuuaaacgaauggcgauaaguggugaugacugugugguuaaaccaaucgaugacagguuugcuaaugcguuacuugcccuaaaugauaugggcaaggugagaaaagacauaccucaauggcaaccuuccaaagguuggcaugacuggcaacaagucccuuucuguagucaucauuuccaugaauuaauuaugaaggacgguagaaaacuuguuguacccugucgaccacaagaugagcuaaucggccgugccaggaucucacaaggugcggguuggucguuaagagagaccgcuugccucggcaaagcauacgcgcaaauguggucauuaauguacuuucaucgaagggacuugcgccuagcaucaaacgcaaucuguagugcaguaccugugcauuggguaccuacaucuagaacaacguggagcauccacgcucaucaucaguggaugaccacugaggauauguuaacgguuuggaacagagucuggauugaagauaaucccuggauggaggauaaaacucccguaaccacuugggagaacgugccuuaucucggaaagagggaagaucagugguguggcucucucaucgguuuaacgagccgugccacaugggcucaaaauauaccuacggcaauacaacaaguacguagucuaauugggaacgaggaguucuuagacuauaugccaucgaugaaacgauuucguaaagaagaagaaucugaaggagcaauaugguaa

SEQ ID NO: 23413 - RNA, 9873 nt, Artificial Sequence
  derived and/or modified CDS sequence (opt6) from DENV-3__FJ639778__SS-prME
acgagcuuaugccuaaugaugauucuucccgcugcuuuagcauuccacuuaacaucgcgagauggagaaccucgcaugauaguagggaaaaacgaacgugggaaaaguuuacucuucaaaacugcuuccgggaucaacauguguacguuaauugcgauggacuuaggagaaaugugugaugauacugucaccuauaaauguccccauauuacggaaguagaaccugaagauauagacuguuggugcaaucuaacaaguacguggguuacuuaugggaccuguaaucaagcuggcgaacacaggagggauaaaagaagcguugcacuagccccucaugucggcaugggucuagauacacguacgcaaaccuggaugucagcagaaggugcauggaggcaagucgaaaaaguagaaacaugggcccuacgacacccaggauucaccaucuuagcguuguuucucgcacauuauauuggcacuucucugacccaaaaaguggugauauuuauacuacucaugcuaguuacaccaucaaugaccaugagaugcguaggagucggaaaccgagauuucguagaaggccuaagcggagccacguggguagacguuguacuugaacacggcgguugcgucacaaccauggcuaaaaacaaaccaacccucgacaucgaacuacagaaaacugaagcuacucaauuagcaacacucaggaaacuauguauugaaggcaggaucacgaauauaacgacagacaguagaugcccuacccaaggcgaagcaguauuaccagaggaacaagaucaaaauuauguaugcaaacauaccuaugucgauaggggauggggaaacggguguggacuuuucgggaaaggaucguuaguaacaugugcuaaauuucagugucuagaaccuauugaaggaaaagugguacaauacgaaaaccugaaauauacuguaauaaucacuguucauaccggagaucaacaucaagugggaaaugagacacagggggucaccgcugagauaaccccucaagccuccacaacugaagcaauccuacccgaguaugggacucuugggcucgaauguucaccccgaacuggucuagacuuuaacgaaaugauccuauuaacaaugaaaaacaaggcuuggaugguacaccgacaaugguuuuucgauuugccauuaccauggacgagcggagcuacaacugaaacuccaaccuggaaucguaaagaauuguuaguaacuuuuaaaaacgcacacgcaaagaaacaagagguuguaguucuagggagucaagagggagcuaugcacacugcgcuuacgggagcgacugagauucaaaacucaggugguacaucaauauucgccggacaucuaaaaugcagauuaaaaauggauaaauuagaacuaaaagggaugucauaugccauguguacuaauaccuuuguacuaaagaaagaagugucggaaacucaacauggaacaauauuaauaaaaguagaauacaaaggagaggauguaccuuguaaaauaccauucucaacggaagauggacagggaaaagcucauaauggaaggcuaauaacagcgaacccagucgugaccaagaaagaagaaccuguuaauauagaggccgaaccgccuuuuggggaaucuaauauggucauugguauuggagacaaugcacucaaaauaaacugguacaagaaaggcagcucgaucggaaaaauguuugaggcuacggcgagaggugcuaggcgaauggcaaucuuaggugacacggcgugggauuucggauccgucggugguguccugaacagucuugguaaaaugguacaucagaucuuuggaagugcguacacggccuuauucucuggagucucuuggguuaugaaaauuggaauaggaguacuauugacguggaucggacugaacaguaaaaacacaucaaugucuuuuucauguauugcaauugggauaauaacauuauauuuaggugcaguagugcaagcagacaugggaugcguuauaaacuggaaaggcaaagaacuuaaaugcgguucgggaauuuucguuaccaaugagguacacacuuggacagagcaguauaaauuucaagccgacaguccuaagagguuagcaacggcgaucgcuggagcaugggagaaugggguuugugguauucgaucuacuacacguauggaaaaccuacuauggaaacaaauugcuaaugaguugaauuacauuuugugggagaacaauauaaaacuaacugugguugugggggacauaauuggaguguuggaacaaggaaaacgaacauugacgccccaaccgauggaacucaaauauucuuggaaaacaugggggaaggcuaaaauugucaccgcagaaacacaaaauaguuccuuuauaaucgacgguccuaauacaccagaaugcccaucagcaucaagagcauggaacgugugggaaguagaagauuauggauuugguguuuuuacaacaaauauaugguuaaaacuaagagaaguauauacucaacuuugugaucaucgacuaaugucggccgcagucaaggaugaaagagcgguucacgcugacaugggauauuggauagaaagucagaaaaauggaagcuggaaauuagagaaagcaaguuuaauagaaguaaagacauguacuuggccaaaaagucacacauuaugguccaauggggugcuagaaucggauaugauuaucccaaagagucuagcagggccaauaagucaacauaauuaccggccaggcuaccacacucaaacugcuggaccauggcauuugggaaaacuugaauuagacuucaauuacugugagggaacaacaguaguaauuacagagaauugugggacaagaggucccucguuaagaaccacaacuguuucagggaaguuaauccaugaauggugcugucgaaguugcacuuuaccacccuuaagauacaugggggaagacggcugcugguacgguauggagauacgacccauaucagaaaaggaagaaaauauggucaagucgcuuguaagugccgguucuggcgagguagauaacuuuacuaugggugucuugugcuuagccauacuauuugaagaaguaaugaggggaaaauucgguaagaaacauaugauagcuggaguguucuucacguuuguauuauuguuaaguggccaaauuacguggagagauauggcacauacacuuauuaugauuggaaguaaugcuagugauagaaugggaaugggaguaaccuauuuagcuuuaauagcuacuuucaaaauucaaccuuuucuugcacuaggauucuuuuuaaggaaacucacaaguagggaaaacuuauuguuaggaguuggacuagccauggccaccaccuuacaauugccagaagauauagagcaaauggcaaauggcauagcacuagguuuaauggcuuugaaauuaaucacgcaauuugaaaccuaucaauuauggacggccuuaaucucuuuaacauguuccaacacgaucuucacccuuacaguagccuggcgcaccgccacccuuauacuggccggggucucucuacuacccguaugccaaagcaguucuaugagaaagacggauuggcugccgaugaccguugcagcuaugggaguuccgccauuaccacucuuuauauuuucauuaaaggauacuuuaaaaaggagaucuuggccucugaaugaaggagugauggcuguaggcuuaguuagcauauuagcuucuucacuacuaaagaaugauguaccaauggcagggccauuaguagcggguggucuucuaauagcaugcuauguaauaacaggaacgagugccgaucugacaguagagaaagcagcagacguaaccugggaggaagaggcagaacaaacggguguaagccauaaccugaugaucacuguggaugacgaugguacaaugagaauaaaagaugacgaaacagagaacauauuaacaguguugcuaaaaaccgccuuauugauuguuagcgguauauuccccuacaguauaccggcuacccuauuaguauggcauacuuggcaaaaacaaacacaaagaucuggcguauugugggauguuccaagcccaccagaaacacaaaaggcagagcuagaagaggguguauauaggaucaaacaacagggcauauuugguaagacgcagguaggugugggaguucagaaagagggggucuuucacacaauguggcauguuacuagaggugcaguucucacauauaaugggaaaagauuagaacccaauugggcaucagugaagaaagaccuuaucucguauggcgguggguggcguuuaucggcccaguggcagaagggagaagaaguacagguuauagcuguggaaccgggcaaaaauccuaaaaacuuucagacgaugcccggaacauuccagacaaccaccggagagauaggagcuauagcccuugacuuuaaaccugguaccuccgggucaccuaucauaaacagagaaggcaagguaguaggauuguacggaaauggaguagugacgaaaaauggaggauauguaucgggaauagcacagaccaaugcggagccggauggcccuaccccugaacuagaggaggaaauguuuaagaaaaggaaucugacuaucauggaccugcaccccggauccgguaagacaagaaaauaucuccccgcuauugucagggaagcaauaaaaagaagacuccgaacacugauuuuagcaccaacacggguaguugcugcugaaauggaagaagcucugaagggauuacccauucgauaccaaacuacggcaacaaagucugagcauacaggaagagaaauagucgauuugaugugccacgcgacauuuacaaugcgacuacuaucuccagucagagucccuaauuacaauuuaauuaucauggacgaagcccauuuuacagacccugcgucuauagcugcaagaggguacaucucuacgcgaguugggaugggagaagcagccgccauauuuaugacugccacuccuccugguacagcagaugcauucccucaaaguaaugcaccgauccaagacgaggagagagauauaccugaaagaaguuggaacucaggaaacgaauggaucacggauuucgcaggaaagacaguuugguuugugccuucgauuaaggcagggaacgauauugcaaacugcuuacggaaaaacggcaagaaaguaauacaauuaucgagaaagaccuuugauacagaguaucagaaaacgaaauuaaacgauugggauuuugugguuacaacugauauuucagaaaugggagcgaauuucaaagcugaucggguaauugauccucguagaugcuuaaaaccuguuauucuaacagauggucccgaacgcguaauucuagcggguccuaugccggucacugccgcuucggcagcacagcggagaggucguguaggacgaaacccucaaaaagagaaugaucaauauaucuuuacgggacaaccacuaaauaacgaugaggaccaugcacauuggacugaagccaagauguuauuagauaauauuaacacaccugaagguauaauuccugcgcuauucgaaccugaacgagagaaaagcgccgcgauagauggagaauaucgccuaaaaggagaaucuaggaagacuuuuguagaauugaugaggagaggugaccucccgguauggcuggcucacaaagucgccagugaaggcauaaaauauacagauaggaaaugguguuuugauggacaacgaaauaaccaaauacuagaagagaacauggauguagaaauuuggaccaaagaaggcgagaagaagaaacugcgccccagguggcuggaugcccgaacauacucggauccgcucgcuuuaaaggaauuuaaagauuuugcugcaggcagaaaaucgauugcuuuagaucuggugacagaaauaggaagaguuccgacgcauuuagcccacagaacgagaaacgcauuagauaaccuaguaaugcuucacacaucagaacauggaggaaaagcauauagacaugcgguagaagaauuaccugaaacaauggaaacauuacuacuacugggacuuaugauacucuuaacuggcggugccauguuauuucuaauuucaggcaagggaaucggaaaaaccagcauugguuuaauuuguguaauugcaucgagcgguaugcuauggauggcagaaaucccacuacaguggauugcgagcgcaauuguuuuggaguucuuuaugaugguccuccucauacccgaaccugaaaaacaaagaacgccacaagacaaucagcuugcuuaugucguuauuggaaucuugacucuagcagcgaucauugcagccaacgaaauggguuuacuagaaacuaccaaacgagaccuaggaaugucaaaagaacccggcgugguaucaccuacaagcuauuuagauguugaucuucacccagcaagcgcuuggaccuuauaugcagucgcuacaacggugauuacaccaaugcucagacacacuaucgaaaauaguacugcaaacgucucccuagcugcgauagcuaaucaagcagucguccuaaugggacuugauaagggauggcccauuaguaaaauggaucuuggggugccucuccuagcgcucgggugcuacucgcaagugaacccauuaacauuaacggcugcaguacuuuuacuaauaacccauuaugcaauaauuggacccggauuacaagcgaaagcuacacgugaggcacaaaaacgcacugcugcaggcaucaugaaaaauccaacaguugauggaauaaugacgauagaccuagauccuguuauuuacgauuccaaauucgagaagcagcuaggacaagucaugcuauuaguccuuugcgcggugcagcuacuauuaaugagaacaaguugggcgcugugugaagccuuaacguuagcaacuggacccauaacaacucucugggaagguucaccuggaaaauuuuggaauacaacuauagcaguauccauggccaauauauuccgugggaguuacuuagcaggcgcagggcuugcguuuagcauuaugaaaucggugggaacaggaaaacguggaaccggaucacagggagaaacguuaggugaaaaauggaagaagaaacugaaucaacuaucaagaaaagaauuugacuuauauaagaaaucuggcaucaccgaaguagacagaacagaagcgaaagaaggucugaggagaggagaaauaacacaccacgcaguaagcagaggaagugccaaacuucaaugguuuguugaacgaaacaugguuauaccugagggacgcguaauagaccuagguuguggaagagggggaugguccuacuauugcgccggacucaagaaaguaacugaaguaagaggcuauacuaaaggcggaccgggacaugaagaaccaguuccgaugaguacuuauggauggaacauuguuaaauugaugucuggcaaagauguauuuuaccugcccccagaaaaaugcgauacacuguuaugugacauaggcgaaucuucuccuucaccuacuguggaagaaucaaggacaauuagaguacuaaaaaugguagagccuuggcuaaagaauaaucaauuuugcauaaaaguuuuaaacccauacaugccaacgguaauugaacaucuugaacgauugcagcgaaaacaugguggaauguuagucagaaauccacucucccgcaacaguacacaugaaauguauuggauaucuaacggcacuggaaauauaguagcaucaguuaauaugguuagccgacuacuauuaaaccgauucacaaugacacaccguagaccgacgauagaaaaagauguagaccuaggugcuggaacucgucaugucaaugcagaaccagaaacuccuaauauggauguuaucggugaacguauaaaaagaauuaaagaggagcauaacucuacuuggcacuaugacgaugaaaacccuuauaaaacgugggcguaccauggaucuuacgagguuaaggcaacaggauccgcaucaaguaugaucaauggaguuguaaaacuuuuaacuaagccaugggaugugguaccaaugguuacacagauggccaugacugauacgacgccguuugggcaacagagggucuuuaaagaaaaaguagacacaagaacaccuaggagcaugccaggaacuaggagagugaugggaauaacagccgaaugguuguggagaaccuugggcagaaacaagaaacccagacugugcacaagggaagaauuuacuaaaaaggugagaacuaacgcagcaaugggcgcuguuuuuacugaagaaaaucagugggacagugcuaaagcagcaguugaagacgaggauuucuggaaacugguagacagggaaagagaacuacauaaacuuggcaaauguggcaguugcguguauaauaugaugggaaaacgagagaagaaacuuggagaguucgggaaagcaaaagggucaagggcaauaugguacaugugguuaggcgcacgauauuuggaauuugaagcccuggguuucuuaaacgaagaucacugguuuucuagagaaaauuccuacucgggcguugaaggagaaggguuacauaaauuaggcuacauucuuagggacauaagcaaaauccccgguggcgcaauguaugcggacgauacugcaggaugggauacgagaauaacagaggaugaucuacauaaugaagagaaaauaacucaacaaauggauccagagcauagacaacuggcaaacgcaaucuucaaacucaccuaccaaaacaaaguagucaagguucagcgcccaaccccgacaggcacggugauggauauaaucucgcgaaaagaucaacggggaagcggacaggugggaacauacggguuaaacaccuucacgaacauggaagcccaacuuauacgacaaauggagggugaaggagucuugucuaaggcggacuuggaaaauccacauuuaccggagaagaaaauaacucaauggcuagaaaccaaaggcgucgaacgacuaaaacgaauggccauaucaggggaugauugcguggucaaaccuaucgaugauagauuugcaaaugcuuugcuagcguugaaugacaugggaaagguuagaaaggauauaccacaauggcaacccucgaaaggauggcacgauuggcaacagguuccguuuugcagccaucauuuucacgaacuuauaaugaaagauggccgcaaauuaguagugccguguagaccacaggaugaacugauuggacgugcgagaauaagucaaggcgccggauggagccuacgugaaacagccugucuagguaaagccuaugcucaaauguggagucuuauguauuuccaucgacgagauuuacgacuugcgaguaaugcaauauguucagccguuccuguccacuggguuccgacgucaagaacuacguggucaauucaugcgcaucaucaauggaugacaacagaagacauguugacuguguggaauagaguauggauagaggauaauccauggauggaagacaagacuccgguuacuacgugggagaacguaccauacuuaggaaagcgggaggaucaauggugugguagccuaauuggguuaacaagucgugcgacaugggcacaaaauaucccuacggcaauacagcaaguaagaagucuaaucggaaacgaagaauuucuagauuacaugccaucgaugaaacguuuuaggaaggaagaagaauccgagggugcuaucugguag

SEQ ID NO: 23414 - RNA, 9873 nt, Artificial Sequence
  derived and/or modified CDS sequence (opt6) from DENV-3__FJ639779__SS-prME
acuucucuuugucuaaugaugauauuaccugcggcauuggcguuccaccuaaccucucgggacggagaaccucgaaugauuguggguaaaaaugaacggggaaaaagucuacuauuuaaaacggcuagcgguauuaacaugugcacacuuaucgcaauggaccuaggcgaaaugugcgaugauacgguuacauacaaaugcccacacauaacggaaguugaaccugaagauauagauuguuggugcaauuuaacaucuacaugggugacuuauggaacuuguaaccaggcaggagaacacaggagagauaaaagaucuguggcguuggcuccucacgugggcaugggccuagacacgaggacacaaacguggaugucugcagaaggagcuuggaggcagguagaaaaaguagaaacaugggcuuugcgacacccaggauucacuauauuggcauuauuucuugcgcacuauauugggacaucguuaacccaaaaagucguaauuuuuauauugcuuaugcuuguaacaccaaguaugacgaugcgaugcguagguguuggaaaccgagauuuugucgaaggcuuaagcggugcaacaugggucgacguaguauuggaacauggagggugcgugaccacaauggccaaaaacaaaccaacacuagauauagaauugcagaaaacugaagccacgcaacuagcgacguuaaggaaauuguguauugaagggaaaaucacuaacauaacaacagauagucggugcccaacacaaggagaagcuguauuaccugaagaacaggaccaaaauuaugucuguaaacauacuuaugucgaucgcggguggggaaacggcugugguuuauuugggaaaggaucguuaguaacuugcgcaaaauuucaaugucuagaaccuaucgaaggaaaagugguccaauaugaaaaucuaaaauauacgguaauuauaacgguacauaccggugaccaacaccaaguaggcaacgaaacgcaaggaguuacagcggaaauaacuccucaagcgagcacaacagaagcgauauuaccggaauaugggacguuaggguuagaauguucacccagaacuggacuugauuucaaugaaaugauacuuuuaaccaugaaaaauaaagcauggaugguucauagacagugguucuuugacuugcccuuacccuggaccaguggugcaacuacggaaacgccaacauggaaccgaaaagaacuccuuguaacauuuaaaaacgcucacgccaagaaacaagaaguggucguacuugguagccaagaaggcgcuaugcacacggcccugacaggagcaaccgaaauccaaaacuccgggggaacaaguauauuugcaggccaucugaaaugucgacuuaaaauggacaaauuagaauuaaagggaaugaguuacgccaugugcacaaauacauucgucuugaagaaagagguuuccgagacccaacauggaacaauacuuauaaaaguugaguauaaaggagaggacguuccgugcaaaauuccauucucaacagaagaugggcagcgaaaagcacacaacggaagauugauuacagcaaacccaguagucacuaagaaagaggagccagucaacauagaggccgagccacccuuuggagagagcaauauaguaauuggaaucggagacaaugcguuaaaaauaaacugguacaagaaagggagcuccauugguaaaauguuugaagcaacagccagaggcgcgcggaggauggcaaucuuaggagacaccgcaugggauuuuggcucugugggaggaguauugaacucuuuaggcaaaaugguacaccaaauuuucgggagcgcauauacggcucuuuucucggguguuucuugggucaugaagauaggcauugguguacucuuaacauggauaggacucaacucuaaaaauacauccaugaguuuuaguugcauagccauagggauaaucacacuuuaccuuggugcaguaguacaagccgauaugggaugcguaaucaauuggaaggguaaggaauuaaagugcgguuccggaauuuucguuaccaacgaagugcauacguggacagaacaguauaaauuccaagcagauaguccaaagaggcucgccacagcuauagcuggagcaugggaaaacggagucuguggaauuagaaguacgacgcgcauggaaaauuugcuuuggaaacagaucgccaacgaacucaauuacauccuuugggagaauaauauaaaauuaaccguagucgucggcgacaucauugguguauuagaacaaggcaaaagaacgcuaacgccacaaccaauggaacucaaauauucuuggaaaacgugggguaaagcaaaaauaguuacggcggagacucaaaauuccucuuucauaaucgauggcccaaauacaccagaaugccccuccgcgagucgugcauggaacguuugggaaguugaagacuauggauuuggcguauuuaccacgaauaucugguugaaacuucgagaaguauauacacagcuaugcgaucauagacuaauguccgcagcaguaaaagaugaaagagccguucaugcugauauggguuauuggauugaaagucagaaaaaugggaguuggaagcuagaaaaggcaagccuaauagaagucaaaacauguacuuggccuaaaucacacacauuguggucgaacggaguccuggaaucagacaugauaauaccgaagucauuggccggcccaauaagucaacauaauuauagaccuggauaccauacgcagacggcaggacccuggcaccuagggaaguuagaauuggauuuuaauuauugugaaggaaccacaguggucaucaccgagaauuguggaacacgcggaccaucacugaggacaacaacaguuagcggaaagcucauacaugaaugguguugucgcagcuguacuuugccaccauuaagauacaugggggaagacggguguugguauggaauggaaauuaggcccauauccgaaaaagaggaaaacauggucaaaagucucguuagugcugguaguggcgagguagauaacuuuacaauggguguauuaugucuugccauccuauucgaagaagugaugcgugguaaauucggcaagaaacauaugauagcugggguauucuuuacuuuuguacucuugcuguccggucagauaacuuggagggacauggcucacacacuaaucaugauagggaguaacgcaagugaccgaaugggcaugggaguaacauaccuugcacuuauagcgacuuuuaaaauucaacccuuuuuagcuuuaggcuuuuucuuacgaaaacuaacaagucgcgaaaaucuucuauugggagugggacuggcaauggcgacaaccuuacaacucccagaagauuucgaacaaauggcuaaugggauugcacucggacuuauggcccuaaaacuaauaacccaguucgagacuuaccaacuuuggacagcauuaaucucguuaaccugcuccaacaccauauucacucuaacugucgcauggcgaaccgcaacuuugauauuggccgguguuagccuacuaccaguaugucaaaguucaaguaugagaaaaaccgauugguuaccuaugacaguugcagcaaugggaguaccuccacugccccuguuuaucuucucuuuaaaagauacgcuuaaacgaaggaguuggccccuaaacgaaggagugauggcuguuggccuaguaucuauucuagcaucuagccugcugagaaaugauguaccgauggcgggaccucuaguggcugguggguuacuaaucgcauguuacguaaucacagggacaagugccgauuugacagucgaaaaagccgccgaugucacaugggaagaagaagccgaacaaacaggcguaucacauaacuugaugauuacaguagaugaugacggaacgaugcgaauuaaagacgacgaaacugaaaacauacucaccgucuuacuaaaaacugcauuguuaauaguuuccggcauauucccauacucaauuccagccacauuacucgucuggcauacuuggcagaagcaaacgcaacgcucugggguacuaugggauguuccaaguccaccugaaacacaaaaagcggaacuggaagaaggcguauauaggaucaaacaacaagggauuuuuggaaaaacccagguuggcgucgggguccagaaggaagguguauuucacacaauguggcauguuacaagaggagcgguuuuaacguauaaugguaaacgguuagaacccaacugggcuucgguuaagaaagaucuuauuaguuaugguggaggauggcgauuaagcgcucaauggcagaaaggagaagaagugcaaguaauagcuguagaaccaggcaaaaaccccaaaaacuuccaaacaaugccgggcacauuucaaacgacgaccggagaaauaggagcaauagcacuugacuucaagccaggcacuucaggaaguccaauaauaaauagagaagguaaagucguuggacucuaugguaaugguguagugacuaaaaacgggggcuacguaagcggcauagcgcagacaaacgccgaaccugaugggccugcacccgaguuagaagaagaaauguucaagaaacgcaacuuaacaaucauggaucuacaucccggaaguggaaaaacgagaaaauacuuaccagcuauuguucgcgaagcaauaaaaaggagacuacgaaccuuaauuuuagcaccaacucgcgugguagcagcggagauggaggaggcuuugaagggauuaccaauaagauaucaaaccacagccacuaaaucagaacauacuggacgagaaauaguggaucucaugugucacgcaaccuucacaaugcgccuacucagcccagugcgagugccgaacuacaauuuaaucauaauggaugaagcacacuuuacugacccugcauccauugccgcucggggauauauuucaacacguguaggaaugggagaagcagcagcuauauuuaugacagcaacaccacccggaacagccgaugcguuuccgcaaucaaacgcgccaauacaagaugaggagcgagauaucccugagagaucauggaauaguggcaaugaauggauaacggacuuugcuggaaaaacggucugguucgucccaagcauuaaagcugggaaugacauagcaaauugcuugaggaaaaauggcaagaaagucauacaauuaucacgaaaaacauuugauaccgaguaucaaaagacaaaacuaaacgacugggacuucguuguuacuacggacauaagugaaaugggagcgaacuuuaaagcagaucgaguuaucgauccgagaagaugccugaaaccgguaauacuaacggacggaccugagagagucauucucgcaggacccaugccugugacagcggcauccgccgcgcaaagaaggggacguguagguagaaauccacagaaagagaacgaucaauacaucuucaccggacaaccauuaaauaacgaugaggaccaugcccacuggacagaagcuaagaugcuacuagauaacauuaacacacccgaaggaauaauaccagcccucuucgagcccgaaagagagaaaagugcugcuauugauggagaguacaggcuaaaaggggaaagccggaaaacauucguggagcuuaugagaagaggugaccucccuguauggcucgcgcauaaaguugcgucagagggcauaaaguauaccgauaggaaaugguguuucgauggucaacggaauaaucagauacuugaagaaaauauggaugucgaaaucuggaccaaagaaggagagaaaaagaaauugagaccacguuggcuagacgcgagaacuuacagcgauccccuagcccugaaagaguucaaagauuuugcagcaggacgaaaaucaauugcgcuugaccucgugacugaaaucggucgagugccuacccaccucgcgcacagaacaaggaaugcacuagauaauuuggugauguuacauacgucagaacacggggguaaagcauaucgccaugcgguggaagaauugccugagacaauggaaaccuuacuuuuacuuggacucaugaucuuguuaacagguggagcaaugcuuuuccuuauaagcggcaaaggaauagguaaaaccagcauuggcuugauauguguuauugcgaguagcggaauguuguggauggcugaaauaccacuucaauggauugccucugcaauuguacuggaguucuuuaugaugguucuguugaucccagaaccugaaaaacaaagaacuccgcaagauaaccaacuagcguacguugucauagguauacuaacacuugcagcgaucaucgcugccaaugaaaugggucuucuggaaacuacaaagagagaccucgguaugagcaaagaacccggaguaguuucuccgacaagcuaucuggacgucgaucuucauccagcauccgccuggacauuauaugccguagcuaccacuguaaucaccccuaugcugagacauacgaucgaaaauagcacagcuaacguaucccuugcagcuaucgcaaaccaagcaguaguccucaugggauuagacaaagguuggcccauaagcaagauggaucuuggugucccucucuuggcucuuggaugcuauucucaagucaauccguugacauugacagcugcaguucuacuccuaauuacucauuaugcaaucauuggaccagguuuacaagcgaaagcuaccagagaagcacaaaagcgaacugcugccgguauuaugaaaaauccuacgguagacggaauaaugacuauagaccuagaucccguaaucuaugauaguaaguuugaaaaacagcuuggucaagugaugcuuuuaguccugugugcaguacagcuuuuauugaugcggaccagcugggcccuuugcgaagcgcugacccuugcaacaggacccaucacaacacuaugggaagguucucccgggaaguuuuggaacacuaccaucgccguaagcauggcaaauauauuucgaggaucuuaucucgcaggagcaggucuagcauucucaauuaugaaaucuguaggaacuggaaaacgcgguacggggucucaaggggaaacauugggggaaaaauggaagaagaaauuaaaccaacuaaguagaaaggaguucgaccuguacaagaaaucagguauaacggagguagaccgaacagaggcuaaagaaggucuuaaaagaggcgaaauuacucaccacgcgguuagucgagguagugccaagcuacaaugguuuguagaaagaaacaugguuauuccagaagggagaguuauagacuuagguugcgguagagguggauggaguuauuauugcgcuggucuuaagaaaguaacggaaguuagaggauauacaaaagggggucccggacaugaagaaccugucccaaugucgacguacggauggaauauuguaaaacuuaugaguggaaaagacguauuuuauuuaccaccggaaaaaugugauacauugcugugcgauauuggagaaagcagccccaguccaaccguagaagaaucuagaaccauucgaguauuaaaaaugguggagccuuggcuuaaaaacaaccaauuuugcauaaaaguacuuaacccuuauaugcccaccguaaucgaacaccuugaaaggcugcaaagaaaacauggaggaauguuaguccgaaauccucuaucucgaaauagcacccaugagauguacuggauaucaaacggaacaggcaacauuguugcaaguguaaauaugguaucacgacuauuacugaauagauuuacaaugacccauagacgcccaacaauugaaaaagacguagaccuaggugcaggcaccaggcacguaaaugcagaaccggagaccccaaacauggacguaaucggcgaacguauuaaacgcauaaaggaagaacauaacucaacauggcauuaugaugacgaaaacccauacaaaacuugggcauaucauggaaguuaugaaguuaaggcuacaggaagcgcuaguuccaugauaaacgggguggugaaacuacuuacaaagccuugggacguuguucccaugguuacccaaauggccaugacagauacaacuccuuuuggucaacaacgaguauuuaaggagaaaguagacacucggacucccagguccaugccuggcacacgacgaguaauggguauuacagcagaaugguuauggagaacacuuggacggaauaagaaaccucgucucuguacaagggaagaguucacaaagaaaguaagaacaaacgcggcgaugggggcugucuuuacggaagaaaaucaaugggauagugccaaagccgcuguugaagacgaggauuucuggaagcuaguagauagagaacgcgagcuacauaagcucggaaaaugcggaucuuguguauacaauaugauggguaagcgugaaaagaaauuaggagaauuugggaaagccaaagggaguagagcaauuugguauauguggcucggugcgagguaucuugaauuugaggcccuuggauuccuaaaugaggaccauugguucucuagggaaaauucauauucuggaguugaaggcgaaggauuacacaaauuaggcuauauacuccgggacauuuccaaaauaccgggcggagcaauguaugcggacgacaccgcugguugggauacaagaauaacagaagaugauuuacauaaugaagagaaaauaacacaacaaauggauccagaacaucgacaauuagcuaaugcgauauucaaacuuacuuaucaaaauaaagugguuaaaguccaacgcccaacuccaacugguacaguaauggacauaauaagcagaaaggaucaacgaggaucugggcaaguaggaacauacggucuaaauacauuuacgaacauggaagcgcagcuaauaagacaaauggaaggagaaggagucuuaagcaaggcggauuuagaaaacccccacuuacccgagaagaaaauaacacaauggcuugagacaaaggguguugaacgacuuaagcguauggcaauaucaggggaugauugugucguuaaaccaauagacgaccguuucgccaaugcccuacuugcucuaaacgauaugggcaaaguaaggaaagacauaccccaauggcaaccaaguaaggguuggcacgauuggcaacaaguuccguucuguagucaucauuuccaugaacuaauaaugaaagauggaagaaaacugguuguaccgugcaggccacaagacgaacugaucgguagagcaagaauuucucagggugcagguuggagucuucgagaaacagcauguuugggaaaggcuuacgcacaaauguggucuuuaauguacuuccauagaagagaccuaagacuagcauccaaugcgaucuguucagccgugccagugcauuggguuccaacaagccgaacaacuuggucgauccacgcccaccaucaauggaugacaaccgaagauauguugacaguguggaacagaguauggauagaggacaaccccuggauggaagacaaaacaccaguaaccacgugggaaaacguaccauaucucggaaaaagggaagaucaauggugcgguagucucauaggguuaacaaguagagcgaccugggcgcaaaauaucccuacagcaauacagcaaguacgauccuuaauagguaaugaggaguuccuagacuacaugccagccaugaagcgauucaggaaggaagaagaaucagaaggcgcaaucugguga

SEQ ID NO: 23415 - RNA, 9873 nt, Artificial Sequence
  derived and/or modified CDS sequence (opt6) from DENV-3__FJ639780__SS-prME
acauccuuaugcuuaaugaugauacuaccugcugcucuagcauuccauuugacaucucgggacggugaaccgcgcaugauuguaggcaaaaaugaacgcggaaaaaguuuauuauuuaaaacagccuccggaaucaacauguguacauuaauagcaauggaccuuggcgaaaugugugaugauacgguuacauauaaauguccucacauaacagaaguggagcccgaagacauagauugcugguguaacuuaacaucuacauggguaacguauggaacuugcaaucaagcgggagaacacagaagagauaaaagguccguagcacuggccccacaugugggaauggguuuagacacaaggacacaaacauggauguccgcugaaggugccuggagacaaguagagaaagucgaaacaugggcacuucgccacccgggauuuacaauucuggcuuuauucuuagcgcauuacauugguaccucacugacgcaaaaaguaguaauuuucauacugcuuauguuaguaacuccaucaaugacgaugaggugcgucgggguaggaaaucgagauuucguugaagguuuguccggagccacauggguggacguuguauuagaacacgguggaugcguaacuacaauggccaaaaauaaaccgacauuagacaucgaacuacagaaaacggaagcgacccaauuggcuacccuacgcaaacuuugcauagaagggaaaauuacaaacauaacuacagauucccguugcccaacacaaggagaagcaguucuccccgaagaacaagaucaaaauuacguaugcaaacauacauacguggaucgugguuggggaaaugggugcggcuuguucggaaaagggaguuuagucacgugcgcaaaauuccaaugccuggaaccaauagaaggcaaaguaguacaauaugaaaaccuaaaauacaccgugauuauuaccgugcauacaggcgaccaacaucaagugggcaacgaaacccagggaguaacugcggaaauaacgccgcaggcuucuacaacagaagcaauucuuccagaauacgguacacuaggccuggagugcuccccuagaaccgguuuagauuuuaacgaaaugauauuacugacaaugaagaauaaagccuggaugguucaucgacagugguucuuugaucuaccucuaccauggaccucgggcacaacuacggaaacuccuacauggaaccguaaggaacuccugguaacuuucaaaaaugcacaugcuaagaaacaagaaguaguuguacuuggaagccaagaaggagcaaugcacacagcgcugaccggggcuacggagauacaaaacaguggagggacauccauauuugcagggcaccuaaaaugcagacuaaaaauggauaaauuagagcuaaaaggaaugucuuaugcaaugugcacaaauaccuuuguauugaagaaagaagugagugagacccagcacgguaccauauugauaaaggucgaauacaaaggcgaggacgucccuuguaaaauaccguucucaacagaagauggacaggguaaagcacauaacggacgauugauaacugcaaacccaguuguaacuaagaaagaggaaccuguaaauaucgaagcagaaccucccuucggugaaucaaauaucgugaucggcauuggugacaacgcuuugaaaauaaacugguauaagaaagguucuucaauugggaaaauguuugaagcgacagcaaggggagcuagacgcauggcuauacucggugauacugcgugggauuucgguucaguggguggaguucucaauagucuagggaaaaugguccaccaaauauucggaagugcauauacggccuuauuuucuggaguaucaugggucaugaaaaucggaauaggaguguuauuaacguggauaggacuuaacagcaaaaauacaucuaugucuuucucauguaucgcgauuggaauaauaacauuauaucuuggcgcgguuguacaagcagauaugggcugcguaaucaauuggaagggcaaggaacuaaaaugcggaucuggaauauuuguuacaaaugaaguucauacauggacagaacaguauaaguuccaagccgacucaccaaaaaggcuugcaacugccauagccggcgcgugggaaaacggagugugcggaauaagaagcacgacgagaauggaaaaucuacuauggaaacaaauagcgaaugaauuaaacuauaucuuaugggaaaauaauauaaaguuaacaguugucguaggagacaucaucggagucuuagaacaaggaaagaggacauuaacaccucaaccaauggaauugaaauauuccuggaagacuuggggcaaagcgaaaaucguaacugcagaaacccaaaauucaaguuuuauuauagaugggccaaacacacccgaaugucccaaugccagccgagcauggaauguuugggaaguugaggacuauggauucggaguuuuuaccacaaauaucuggcuaaaacuaagagagguuuauacucagcucugugaucaccgucuuaugucagcagcugugaaagaugaacgagcggugcacgcugauaugggcuauuggauugaaagucagaaaaauggaaguuggaaacuugaaaaagcaucccuaaucgagguuaaaacauguacguggccaaaaucucacacauuauggaguaauggaguucuagaaucggauaugauuauuccuaaaucgcuagcgggaccgaucucucaacacaauuacagaccgggauaccacacacaaacugcuggaccauggcaucuggguaaguuagagcuagacuucaauuauugcgaggggacuacgguaguuauaaccgaaaacugugguacuaggggcccuagucugcgaacuacuaccguuucggguaaacuuauccaugaauggugcugcagaucuuguacauuaccaccauugagauacaugggugaggacggguguugguaugguauggaaauccgaccuauauccgagaaggaagaaaacauggucaaaagucuuguuucggcaggcucuggcgaaguggauaacuuuacaauggguguacuaugccuagccauuuuauuugaagaaguuaugagaggaaaauuuggcaaaaagcacaugaucgcaggaguauucuuuacauucguauuacuauuaucaggacaaauaacauggagagauauggcccauacauuaauaaugauuggaucgaacgcuucagauagaauggguaugggagucacauaucuagcuuuaaucgcgaccuucaagauccagccuuucuuggcauuaggauucuuucuccguaaacucacgucgagggaaaaccuacuauuaggugucggauuagcuauggcgaccacacugcaauugccagaagauaucgagcagauggccaauggaaucgcgcugggguuaauggcauuaaaacucauaacacaauuugaaaccuaucaacuguggacggcuuugaucaguuuaacaugcucaaacacaauauuuacacuaacugucgcauggaggacggccacuuuaauauuagcagggguauccuuguuaccuguaugccaaucuuccucaaugagaaaaaccgacugguugccuaugacugucgcagcaauggggauaccgccacucccacuuuucauauucucacuaaaagacacauugaagcgacgaaguuggccacuaaaugagggagucauggcaguuggcuuagugaguauucucgccuccucauuauuaagaaacgauguuccuauggcagguccacuuguggcaggcggauugcuaauugcuuguuacguuaucacaggcacgucugcagaucuuacgguagaaaaggcagcugacguuacuugggaggaagaagcagaacaaacaggcguuucucauaaccuuaugauuacgguagaugacgacgguaccaugcgcauaaaagacgaugaaacagaaaauauauugacaguauugcucaaaacggcuuuguuaauaguguccgguauuuuucccuauucuaucccggcaacacuauuaguuuggcauacguggcagaagcagacgcaacgaagugggguccuaugggauguuccaucacccccagagacacagaaagccgaacuagaagaagguguuuauaggauuaaacaacaaggaauauucgguaaaacacaagugggcguagguguccagaaagaagguguuuuucauacuauguggcauguaacucguggugccguguuaacguauaacggcaaaagauuagaaccaaauugggcaagcguuaagaaagauuuaauuucauauggcggaggauggaggcuuucagcucaguggcaaaaaggcgaggagguacaggugauagcaguugaaccggggaaaaaucccaagaauuuucagacaaugccuggaacuuuucaaaccacaacgggggaaauuggagcgaucgcgcucgauuuuaaaccagguacaaguggaucuccaauaauuaaccgagaaggaaagguuguagguuuauaugguaaugguguagugacaaagaacggaggcuacguuagugggauagcacaaacaaacgcugaacccgaugggcccacaccagaauuagaagaggaaauguuuaaaaagagaaaucuaacaaucauggacuugcauccggggucugggaaaacgcguaaauaucuuccagccauuguacgggaggcaauaaaaagacgcuuacgaacucuuauacuagcaccaacgagaguuguggcagcugaaauggaagaagcucuuaaagguuuaccaauuagguaucagacaacugccacuaaaucagaacacacgggacgcgagauuguggaccuaaugugccaugcaacguuuacgaugagacuauuauccccuguucgaguuccaaauuacaauuuaauuauuauggaugaagcacauuuuaccgaucccgcuagcaucgccgccaggggauauaucuccaccaggguuggcaugggugaagccgcagcgauauuuaugaccgcgacaccgcccgguacugcagaugcuuucccucaauccaaugcccccauacaagaugaagaaagagauauacccgaaagaagcuggaacucaggaaaugaauggauaacggauuuugcuggaaagacuguaugguuuguccccucaauuaaagcaggcaaugacauagcaaauuguuuacggaaaaauggaaagaagguuauccaauuaucaagaaagacuuucgauacggaguaccagaaaacaaaacuaaacgauugggacuuuguaguaacuacugauauaucugaaaugggcgcaaauuucaaggcagauagaguaauagacccccgcagauguuuaaaacccgucauuuuaacagacggaccagaaagaguaauuuuagcgggaccaaugccagugacugcagcuagcgccgcacagcguagagguagaguaggucgaaauccacagaaagaaaaugaucaauacauauucacugggcaaccgcuuaauaacgacgaagaucaugcacauuggacggaggcaaaaaugcuauuagacaauaucaauacaccugagggcauuauaccggcauuguuugaaccggaaagagagaaaagugcagcuauagacggagaguauagauuaaaaggggagucaaggaaaacuuuugucgaacuaaugagaaggggugacuuaccaguauggcuagcacauaaaguagcaucugaaggcauaaaauauacagauagaaaauggugcuuugauggacaaagaaacaaucagauucuagaagaaaacauggauguugaaauuuggaccaaggaaggcgaacgaaagaaacuaagaccacgcugguuggacgcacguacauacucagauccucucgccuugaaagaauuuaaagacuucgcagcgggaagaaagucgauagcacuagaucuugucacugaaauaggaaggguaccaacucaucuggcacacagaacgcgcaacgcauuggauaaucuuguaaugcuacacacauccgagcauggaggaaaagccuaccgacaugcuguagaagaacuaccugaaacgauggaaacgcuacuucuauuaggccuuaugauauugcugacagguggagcuaugcucuuuuugauuucuggaaaaggcaucggaaaaaccagcauagguuuaauaugugugaucgcaucaucaggaauguuguggauggccgaaauaccucuacaauggauagcaucggcuauaguuuuagaguuuuucaugaugguucuacuaauaccugaaccggaaaaacaaaggacaccacaagauaaucaacucgcauacguagucauagggauucucacauuagcggcaauaauagcugcgaacgagaugggucuacuagagacgacaaaaagggaccucggaaugagcaaggagccaggggucguuucuccuacaucauaucuagaugucgaucuacauccagcuucugcauggacacuguacgcaguagcaacuacuguuauaacuccuaugcuaagacauacaaucgaaaacucgacagccaauguaucauuagccgccauagcaaaccaagcggucguacucaugggguuagauaaaggauggccaaucucaaaaauggaccuaggugucccuuuauuagcucuaggaugcuauagccaaguuaauccacuaacgcuuacugcagcgguacuuuuguugauaacacacuacgcuauaauaggucccgguuugcaagcuaaagcaacgagggaggcccaaaaacgaacugcagcugguauaaugaaaaacccgacuguggacggaauaaugacuauagaccuagauccugucauuuaugauaguaaauucgagaagcaguuagggcaaguaauguuguuaguacuaugcgcggugcagcucuuguuaaugcgaacgaguugggcacuaugcgaggcacucacacucgcuacugguccaauaacuacacuuugggaaggaucucccggaaaguuuuggaauacaacgaucgccguuagcauggcaaauauauucagaggauccuaccuugccggagccggucuagcuuuuaguauaaugaaaaguguagguacuggcaaacgugggacugguucgcaaggggaaacauuaggagagaaguggaagaagaaauuaaaccaacucagcagaaaagaauuugaccuauauaagaaaagcggcaucaccgagguugauaggacugaagcaaaagaggggcugaaacgaggggaaauuacucaucacgcggugucaagaggcagugcuaaacuacagugguucguugaacgaaauauggucaucccagaaggccgcguaaucgaucuaggauguggaagaggagguugguccuauuauugugcgggcuuaaagaaaguuacggaagucagggguuauacuaaaggagguccaggccaugaagaaccugugcccaugucuacuuacgguuggaauauaguuaagcugauguccggaaaagacguauuuuaucuaccgccagaaaagugugacacacuccuaugcgacauaggagaaagcaguccaaguccaaccguugaggaaucccgaacaauaagaguuuugaaaaugguugaacccugguugaaaaauaaucaguucugcauaaaaguccuaaacccauauaugccugcaguuaucgaacauuuagagagacugcaacgaaagcauggaggcauguuagugcguaacccauugucuagaaacaguacacacgaaauguauuggauaaguaaugggacagggaauauaguggcuuccguuaauauggucaguagguuauuacuaaacagauuuacgaugacacacagaagaccaaccauagaaaaagacguagaucucggugcaggaacaagacauguaaacgcugaaccugagacuccgaacauggacgugaucggagagagaauuaaacguauaaaagaagaacauaauucaacauggcacuaugaugaugagaacccauauaaaacaugggcauaucauggaagcuaugaaguaaaagcaacgggcucagcuucuagcaugauuaauggaguugucaaacuguuaacuaaacccugggauguaguaccaaugguaacccaaauggccaugacagauacaaccccauuuggacaacaaaggguuuucaaagagaagguugacaccagaacuccccgaucgaugccgggaacgagacgaguuauggguauaacagcagaauggcucuggcguacguugggccguaauaagaaaccgagguuaugcaccagagaagaguuuaccaagaaaguuagaacuaacgcugcaaugggagcuguguuuacugaagaaaaucaaugggacagugcaaaagcugccguggaagaugaagauuucuggaaguuaguagaucgagaaagggaauuacauaaacuuggaaaaugcgguucuugugucuacaauaugauggguaaaagagagaagaaacuuggagaguucgguaaggccaaaggaucacgagccauaugguacaugugguuaggagccagguacuuagaauuugaggcacuaggauuccuaaaugaagaucacugguucagcagggaaaauaguuacucgggaguggaaggagaaggacuucacaaauugggauauauucuucgagauaucucaaaaauaccugggggagccauguacgcggacgauacggcaggaugggauacaagaauaacagaagaugauuugcacaaugaagagaaaauaacucaacaaauggacccugaacaucggcaacuagcaaaugcaauauucaaauuaaccuaucagaacaaggugguuaaaguacaaaggccuacacccacagguacuguaauggauauuauaucuaggaaagaucaaagaggaucuggacaagugggaaccuauggccugaacacguuuacgaauauggaggcacaguuaauccgucaaauggaaggugaagguguacucuccaaggcggauuuagaaaauccgcaccuacccgagaagaaaauaacgcaauggcuugagacuaaaggaguggaaagauuaaagagaauggccaucucuggagacgauugcgucguuaaacccaucgacgauagguuugcgaacgcacuacuggcuuuaaaugauaugggaaaggugaggaaagauauuccgcaguggcaaccgucaaagggauggcaugauuggcaacaaguuccguuuuguucucaucauuuccacgaacuaaucaugaaagauggaagaaaauuaguagugccuugccguccacaagaugaauuaauuggcagagcucguauaucacaaggagcaggauggagccugcgcgagaccgcauguuuggguaaggcuuacgcgcaaauguggagccuaauguacuuucaucgacgcgaccuaagauuagccucuaaugcaauauguuccgcagucccuguucacuggguuccaacuagccgcacaacauggagcauacaugcacaucaccaauggaugacaacggaagacauguuaacgguauggaaucgaguauggauagaagauaauccguggauggaagauaagacucccgucacgacgugggaaaacgucccauaucuagggaaacgagaagaucaaugguguggcucauuaauuggguuaaccucgagagccacaugggcccaaaacauuccaacagcgauacaacaaguucgaagucuaauaggaaacgaggaguuccuagauuauaugccaagcaugaagagauuuagaaaagaagaagaaagcgagggcgcaauuugguga

SEQ ID NO: 23416 - RNA, 9873 nt, Artificial Sequence
  derived and/or modified CDS sequence (opt6) from DENV-3__FJ639781__SS-prME
acuagcuuauguuuaaugaugauuuuaccagcugcuuuagccuuucauuuaacuucacgagauggugaaccucguaugauagucgguaaaaacgaaagaggaaaaaguuugcuauuuaaaacggccucaggaaucaauaugugcacucugauagccauggaucuuggagaaaugugcgacgacacuguuacuuauaaauguccucauauaaccgaaguagaaccagaagauauagacugcugguguaaccucacaaguacuuggguuacauacggcaccuguaaucaagcgggggaacacagacgagauaaaagaucgguagcuuuggcaccacauguugggaugggacuagauacgagaacucaaacguggaugagugcagaaggagcuuggaggcaaguggaaaaaguagaaacgugggcacucaggcaccccggcuuuaccauauuagcccuauucuuagcacaguauauaggcacgucccuaacacaaaaaguugugaucuuuaucuuauugaugcuuguaaccccauccaugacaaugcguuguguagguguuggaaaucgagacuuuguagaaggacuuuccggugccacuugggucgauguuguauuagaacaugguggcugugugacaacaauggccaaaaauaaaccaacccuagauauugaacuccagaaaacugaagccacacaauuagcgacacuaaggaaauuauguauagaagguaaaauaacuaauauuacgacagacucucguuguccuacccaaggugaggcugugcugccagaagaacaagaucaaaauuacguuugcaaacauacauauguggauaggggguggggcaauggauguggccuauucggcaaagggaguuugguaaccugugcaaaauuucaauguuuggaaccaauagaaggcaaaguuguucaauacgaaaaccuaaaauacaccguuauuauuacaguucauacuggggaucaacaucaagugggcaaugaaacgcaagguguaacggcggagauuacaccacaagcaagcacuacagaagcaauucugccugaauaugguacuuugggacuggagugcucuccacgaacaggccuagauuuuaaugagaugauucuucuuacaaugaaaaauaaagcauggauggugcaucggcaaugguucuucgacuuaccuuuaccuuggacaucgggugcaacaacugagacacccacuuggaauagaaaagaacuacucguaacguucaaaaacgcacacgcuaagaaacaagaggucguuguucuagggagucaagaaggagcuaugcacacggcgcuaacaggcgcgacugaaauacaaaacaguggagggacaucaauauuugcgggacaucuuaaaugucgauuaaaaauggacaaauuagagcuuaaaggcaugucuuaugcuauguguacaaauacauuuguacuaaagaaagaaguaagugagacacaacacggaaccauacuaaucaaagucgaauauaaaggugaagacgugccaugcaaaauaccauuuucaacagaagacgggcaaggaaaagcccauaauggucguuuaauaacggcuaaucccguagugacaaagaaagaagaaccuguaaauaucgaagcagaaccaccuuuuggagaaucuaacauaguuauagguauaggagauaaugcccucaaaauaaacugguacaagaaaggaucaucaauaggaaaaauguuugaggcgaccgcacggggcgcgcgaagaauggcuauacuaggggacacagcaugggauuuugguagcgucgggggaguacuuaacucauuagggaaaaugguucaccaaauauucggaagugcauacacggcauuguucagugguguuaguugggugaugaaaaucgguauugguguccuacucacauggauuggauuaaauaguaaaaauauaucaaugucuuuuuccuguaucgccauaggaauaauaacauuauaucugggggcaguaguucaggcugauaugggcuguguaauaaacuggaaaggaaaagagcugaaguguggcucaggaauauucguaacaaaugaaguucacacguggacggagcaauacaaauuccaggccgauucuccuaagcgacuggcaacggcuauugcgggugcaugggaaaauggagucugcggaauuagaucuacgacuaggauggaaaaccuauuauggaaacaaauugccaacgaacuaaauuauauuuuaugggaaaacaauauaaaacuaacaguuguagucggggauacaauuggaguacucgaacaggguaaacgaaccuuaaccccucagccaauggaacuuaaauacucguggaaaacaugggggaaagcaaaaauaguaacggcagagacacaaaacucuaguuuuauaauagauggcccgaauacgccugaauguccaucagcuucucgagccuggaauguaugggaaguagaagacuacgguuuuggaguuuucacgacuaacauuuggcuaaaacuuagggaagucuacacccaacucugugaucaccgccugauguccgcagcugucaaagacgaacgagcuguucacgcggauaugggauauuggauagagucacaaaagaauggaaguuggaaacuggaaaaggcuucacuuauagaagugaaaacaugcacauggccaaaaucacacacucuauggucgaaugguguacucgaaagcgauaugauuauccccaagaguuuagcaggaccuauaucucaacauaacuauaggccaggguaccauacacaaacagccgguccuuggcaccucgguaaacuagagcuagauuucaauuacugcgagggaacaacagucgucauuacagagaauuguggaacuagaggaccaucucuccgaaccacgacgguaucugggaaauugauacacgaaugguguugucguucguguacacuuccuccacuucgcuauaugggagaagauggaugcugguacggaauggaaauuaggccaauaagcgagaaagaagaaaacauggugaaaucguuagucagcgcuggcucaggagagguugauaauuucaccauggguguauugugucuagcaauacuauucgaggaggucaugcgaggaaaauuuggcaagaaacauaugauagcagggguauuuuucacguuugcgcucuugcuuuccgggcaaauuacuuggcgagauauggcacauaccuuaauuaugauagguucaaaugcuucagacaggauggguaugggggugaccuaucuagcauugauagcgacguuuaagauucaaccauuucuugcauuaggauucuucuuaaggaaacucacaucgcgagaaaauuuauugcuaggaguaggacuagcuauggcgaccacacuucaguuacccgaagauauugagcaaauggcaaauggaauagcacugggauuaauggcguuaaaguugauaacacaguuugagacauaucaauuauggaccgcacuaauuucucuuacauguaguaacacaauuuucacauugacaguagccuggcguacagcaacucuaauucuugcggguguaagucugcugccgguaugucagaguagcucaaugcggaaaacugacugguugcccaugaccguggcugcaauggguguaccgccucugccacuuuuuauauuuaguuugaaggauacuuuaaaaagacguaguuggccucucaaugaagggguaauggcuguaggacucgucucuauauuagcgucgaguuugcuaagaaacgauguacccauggcagggccuuuaguagccgguggacuguugauagcuuguuauguaauuaccggaacaagugcggauuuaacaguagagaaagcagcggauguaacgugggaagaagaagcggaacaaacaggaguuagucauaaccuuaugaucacuguagaugaugacgggaccaugcggauaaaagacgacgagacagaaaauauucuaaccgugcucuuaaagacagcgcuccugauugucucagggauauuucccuacaguauuccagccacuuuacuuguauggcauacauggcaaaaacaaacucaacguucaggaguacuuugggauguccccucuccuccagaaacucagaaagcagaguuagaggaagggguauauagaaucaaacaacaggggaucuuuggaaagacucaggugggcguaggaguacaaaaagaagguguuuuucacacaauguggcauguaacucguggggcaguucuuaccuauaacggaaaaagauuagaacccaauugggcaucggucaagaaagauuugauuucauacggggguggguggcgauuaucagcacaguggcaaaagggggaggaaguccaaguuaucgcgguggaacccggaaagaaccccaaaaauuuucaaaccaugccaggaacuuuucaaacaaccacuggggagaucggcgcgaucgcauuagauuuuaaacccggaacgagcggaaguccuauaauuaaccgagaagguaagguggugggauuguacggaaauggaguuguuacuaaaaaugggggcuauguaucagggauagcucaaacaaacgcagaaccugaugguccuacgccagaacuagaggaagaaauguucaagaaacgcaaucuaacaauaauggauuuacaccccggaucgggaaaaacccgcaaguauuuaccagcuauagugagagaagcuauuaaaagacgacugcgcacucucauacuagcuccaacuagaguagucgcugcagaaauggaggaagcucucaaagguuuaccaauacgguaccaaacaacagccacaaaaucggagcacacuggcagggaaaucguagauuuaaugugccaugcaacauuuacaaugagauuacuuucuccuguaagaguccccaacuauaacuugauaauaauggaugaagcacacuuuaccgauccagcgucuauagccgccagaggauauauaucaacaagggucggcaugggggaagcagcagcaauauucaugacugcuacaccaccaggcacagcugaugcguuuccgcaaucaaaugcaccuauacaggaugaggagagagauauuccugaacgauccuggaacucagguaacgaauggauaacagacuuugcaggcaagaccguaugguuuguuccaaguaucaaggcuggaaaugacauagcgaauugccuacguaaaaauggcaagaaaguaauacaacuaagcagaaaaacuuuugauacugaguaucagaaaacuaaguugaaugauugggacuuuguaguaacaaccgacauaucagaaaugggagcuaacuuuaaagcugaucgagugauugauccacgaagaugccugaaaccggugauuuuaacagauggcccagaaagggucauccucgcaggaccaaugccggugacagcagcuagcgcagcacaaagaaggggacgcguggguaggaacccccagaaagaaaaugaccaauauauauuuacugggcaaccccuaaacaaugacgaagaucacgcacauuggaccgaagcgaaaaugcuacuagauaauaucaacacuccagaaggaauaauaccggcacuguucgaaccggagagggagaagucagcugcaauugauggagaauaccgcuuaaaaggugaguccagaaaaacuuucguugaauugaugcgccgaggagauuuaccaguaugguuggcgcauaaaguggcgagcgagggaauuaaauacaccgaucgcaagugguguuucgauggccagcgcaacaaccaaauccucgaagaaaauauggauguggaaauauggacuaaagaaggagagaagaagaaacuuagaccgagguggcuagaugcgcgaacuuacucggacccccuagcccucaaagaauuuaaagacuucgccgccgggagaaaaucgauugcuuuagaucuaguuaccgaaauaggacguguaccaacacaucuagcacaccguacgcgcaaugcacuagacaaucuaguaaugcuccacaccagugaacauggcggcaaagccuauagacaugcaguugaagaacuaccugaaacaauggaaacgcuuuuacuacuaggucuaaugauacuacuaacuggaggagcuauguuauuuuuaaucagcgggaaaggaaucggaaagaccucaauaggauugauuugcguuauugcuaguucagggaugcuguggauggcugagauaccacuccaguggauagcaucugcgauaguucuagaauuuuucaugaugguacuacuuauaccagaaccagaaaaacaacgaacaccccaagauaaucaacuggcauauguuguaauagggauuuuaacacuagcggcaacgaucgcagcuaacgaaauggggcuucucgagacgacaaaacgggaccuuggaauguccaaagaaccagggguaguaucgccaacaaguuacuuagauguagacuuacacccugcaucggcuuggacacuguacgcuguagcgacgaccgucaucacgccuaugcuacgacauaccauagaaaacagcacagcuaaugugagcuuagcagcaauagcaaaccaggcuguaguacugaugggucuagauaaaggauggcccauuucaaagauggaucucggagucccucucuuggcacuuggguguuacucucaaguuaauccacuaacucuaaccgcagcuguacuucuacuaauuacacacuaugcgauaauaggucccggucuucaagccaaagcaacaagagaagcacaaaagagaacagcggccggaauuaugaaaaacccaacaguagaugguauaaugacuaucgaucuugauccuguaauauaugacuccaaauuugaaaagcaacuuggccaaguaauguuacuuguucugugcgcagugcaacuucuccuaaugcgcacuucaugggcauuaugcgaagcccuuacucuggcaacggguccaauaaccacuuuaugggaagggagucccggcaaauuuuggaacacaacuauugccguaaguauggcaaacauuuucagagguucuuaucuggcuggugcaggccuugcauuuagcauaaugaaaagcguuggcacaggcaaaagaggaacaggaagccaaggcgaaacauuaggagaaaaguggaagaaaaaguugaaccaacugagcagaaaagaauuugaccuuuauaagaaauccgguauuacugaaguugaucguacagaagcaaaagaaggacuaaaacgcggugaaauuacacaccaugcaguuaguagaggaagugcuaaauuacaaugguucguugaaagaaauaugguuauaccugaaggaagaguuauagaccuugggugcggucgcggaggcuggucauacuauugugcaggacuaaagaaaguuacagaggucagagguuacacuaaaggcgggccuggucaugaggagccaguaccuaugucgacuuauggguggaauauaguaaaacuaaugucaggaaaagacguauuuuauuuaccuccugagaaaugcgauacuuugcugugcgauauuggcgaaucuucuccuuccccgacgguugaagaaagucggaccauaagaguuuuaaaaaugguggagccguggcuuaaaaauaaucaauucuguauaaaaguccuaaauccguacaugccgaccguaauagaacaccuagaacgucuacaaagaaaacauggagguauguuaguucgaaauccccugaguagaaacucgacucaugaaauguauuggaucucgaacggaacagguaacaucguagcgucugugaauaugguaucgagacuauugcuaaaucgauuuacgaugacacacagaagaccaacuauagaaaaagauguagacuuaggagcuggcacaagacauguaaacgcagaaccggaaacuccaaauauggacguuauuggugagagaauuaaaaggauaaaagaagaacauaauucuacauggcauuaugacgacgaaaauccuuauaaaacaugggcauaccacgguagcuacgaaguaaaagcaacaggaagugcgagcucgaugaucaauggcguugucaaguuauugacgaaacccugggaugucguaccgaugguuacgcaaauggcuaugacugauacaacuccuuuuggacagcagcgaguauuuaaagaaaaggucgauacuagaacaccuagaucaaugccagguacgcgcagggugaugggaauuacagccgaaugguuauggagaacuuuaggaagaaauaagaagccuagguuauguacaagagaggaguucacaaagaaaguacgaaccaacgcagcuaugggagcaguguuuaccgaagaaaaucagugggauucggcaaaagccgcuguugaagaugaagauuucuggaaguuaguagauagagaacgagagcuccacaaacuaggcaaaugugggagcugcguguacaauaugaugggaaaacgcgagaaaaaguuaggagaguucgguaaagccaaaggaagcagggcaauaugguauauguggcugggagcucgauaucucgaauuugaggcuuuaggcuuucuaaaugaagaccacugguucucucgagaaaauucguacagugguguagaaggcgagggccuccauaaauuagguuauauacuuagagauauaagcaaaauaccaggaggugcgauguacgcagaugauacagcaggcugggauacgaggauaacugaagaugaucuacacaacgaggagaaaauaacacaacaaauggauccggaacaucggcaauuggcaaaugcuauuuuuaagcugaccuaccagaacaagguggucaaaguccaaagaccaaccccuaccggaacgguaauggauauaauuagccgcaaagaccaacgaggaagcgggcaaguuggcacuuauggauuaaauacauucacaaacauggaagcccaguuaauccgacagauggagggagaagguguuuuaucaaaagccgaccuggagaauccacaucuuccagagaagaaaauaacgcaaugguuagaaacgaaaggagucgaacgccucaaacgaauggccauuuccggggacgauugugucguaaaaccaauagaugauagauuugcaaaugcacuuuuagcccugaacgacauggguaaagucaggaaagauauaccucaauggcaaccuucaaaaggauggcaugauuggcaacagguccccuucugcucccaccacuuccacgaguuaauaaugaaagauggacguaaacuugucgucccaugucgaccacaggacgaauuaaucgguagagcaaggauuucccaaggugcgggauggucauuaagagaaacugcuugccucggaaaagcauacgcgcaaaugugguccuuaauguacuuucaucgacgggaccuacgacuugcuucaaacgcaauuugcagugcagugccugugcauuggguaccaacgucaaggaccacguggaguauacacgcacaucaucaauggaugacuacagaagauaugcuuacaguauggaaucggguuuggaucgaagauaauccuuggauggaggauaaaacuccaguaacuacuugggaaaaugucccguauuugggaaaaagagaagaucaaugguguggcucacuaauugguuuaacaaguagagcgaccugggcacaaaauauaccgaccgcuauucaacagguuagaaguuuaaucggaaacgaagaauuucucgauuauaugccaagcaugaaaagauuuagaaaagaagaagagucggaaggagcaauaugguag

SEQ ID NO: 23417 - RNA, 9873 nt, Artificial Sequence
  derived and/or modified CDS sequence (opt6) from DENV-3__FJ639782__SS-prME
acaagccugugucuaaugaugaucuuacccgcugcacuggcauuucaucuaacgucacgagacggggaaccucgcaugaucguuggcaaaaaugaacgugguaaaucauuauuauucaaaacggcgagcggaauaaauauguguacguuaauagcuauggauuuaggagaaaugugcgaugauacaguaacauauaaauguccucacauaaccgaaguugaaccugaagauaucgacuguuggugcaaccugacuucuaccuggguuacauauggcacuugcaaccaagcaggagaacauagaagagauaaacgaucgguugcucuggcuccacauguagguaugggauuagauacccgaacgcaaacguggaugagugcggagggugcguggaggcaaguugagaaaguugaaacuugggcauuaaggcacccgggguucaccauccuugcacucuuccuagcacacuauauaggaacuuccuugacacaaaaagucgugauuuuuauauuauuaaugcuggucacaccaaguaugacaaugcgcugugucggcguaggcaauagagacuuuguugagggauugucgggagcuacauggguugaugugguauuagaacauggugggugcgucaccacuauggccaaaaacaaaccaacguuagacauagagcuucagaaaacagaggcaacccaauuagcuacuuuacgaaaacugugcauagaaggcaaaauaacaaacaucaccacagauucucgaugcccaacgcaaggggaagcuguauuaccggaagaacaggaccagaacuacguauguaaacacaccuacguggauagagguuggggaaacgguuguggacuauuugguaaaggaucucuaguuaccugugcaaaauuccaaugucuagaacccauugaagguaaagucgugcaauacgaaaaucucaaauauacaguaauaauaacaguacauacuggggaucaacaucagguaggcaaugagacacaagguguaacugcugagaucacuccgcaggcuucuacgacagaagcaauauuaccagaauauggaacacuagguuuagaauguuccccucgcaccggccucgauuuuaacgagaugauuuugcucaccaugaaaaauaaagcauggaugguucauagacaaugguucuuugauuuaccguuaccauggacaucuggagcgacuacagaaacuccgacuuggaaccgcaaagagcugcucgucacauucaaaaacgcacacgccaagaaacaagaaguugucgucuuaggaagucaggaaggggcgaugcauaccgcacuaacgggugcaacagaaauacaaaauucagggggcacuuccaucuuugcugggcacuuaaaaugucgcuugaaaauggacaaauuagaacucaaagggauguccuacgcgauguguacaaauacauuuguacucaagaaagaaguaucugaaacgcaacacggcacaauucugauuaaagucgaguauaaaggagaagauguccccuguaaaaucccuuuuagcacagaagauggccaaggaaaagcucauaacggccguuuaauuacagcaaacccaguuguaacgaagaaagaagaaccuguaaauauagaagcagaaccaccauucggggaaaguaauauaguaauuggaauuggagauaaugcauuaaaaauuaauugguauaagaaagggucaucaauagguaaaauguuugaggcaacugcacguggagcgcgcaggauggcaauuuuaggugacacagcaugggauuuugguagcguaggaggggugcuuaacagccugggcaagaugguucaccaaauauuugggagcgcuuacacugcgcuauucagcggagugucuuggguaaugaaaauugguauaggcgucuugcuuacauggauugggcuaaacuccaagaauacaucuaugaguuuuuccugcauugcaaucggaauaauuacacuauauuuaggagcaguuguacaggcugacaugggcuguguaaucaacuggaaaggaaaagagcuuaaaugugguucagggauuuucguaacuaaugaaguacacacuuggaccgaacaauauaaauuccaagcagacucgccaaaaaggcuugcuacugcaauagcaggagccugggaaaauggcguuugcggaaucagaucaacaacgcgaauggaaaaucuucuguggaaacagauugcaaaugaacuuaacuauauacuuugggagaacaauauaaaauugacagugguagugggugacauaauugggguauuagagcaaggaaaacguaccuuaacaccacagccaauggaauugaaguacaguuggaaaaccugggguaaggcuaaaauagugacagcggaaacgcaaaacucaucuuuuauuaucgauggcccaaauacaccggaaugcccaucagcaucuagagccuggaaugugugggagguugaggacuauggcuucgguguauuuacuacgaacauauggcugaaacuaagagaaguguauacgcaacuuugcgaccaucgguuaaugucggcagcaguaaaagacgaaagagcaguacaugcugacauggguuacuggauugaaagccagaaaaauggcaguuggaaacuugaaaaagcaucacugauagaaguaaaaacauguacuuggccuaaaucacacacuuuauggucuaacggcguccuugaaagugacaugauuauaccuaaaaguuuggcugguccgauaucccaacauaauuaucgaccugguuaucauacucaaacagcugggccauggcaccugggcaaauuggaacuagacuucaauuacugcgaaggcacuacugucguaauaaccgaaaauugcggaacacgugguccaaguuugagaacgacaacaguaaguggaaaauuaauacaugagugguguugcagaucguguaccuugccaccccuuagauauaugggagaagauggguguugguauggaauggaaauccgaccuauuucugaaaaagaggagaacaugguuaaaucauuagucagcgcggguucaggugaggucgauaauuucacuaugggcguucuuugccuugcuauauuauucgaggaaguaaugagagggaaguucggcaagaaacacaugauagcaggaguuuucuucacauucguacugcuguuguccggacaaauaaccuggcgugauauggcacacacacuuaucaugauagguaguaaugcaagcgacagaauggggauggguguaacuuaucuugccuuaauugcgacguuuaaaauacagccauuuuuagcguuaggauucuuuuuaaggaaguuaaccucaagagaaaaccucuuacuugguguugguuuggcuauggcaacaacauuacaacuuccggaagauauugaacagauggcaaaugggauugcgcucggauuaauggcauuaaaacucaucacucaauuugaaacguaccaauuauggacagcuuuaauaucucuaacuuguaguaacaccaucuuuacacugacagucgcauggcgaacagcaacauuaaucuuagccggaguaucuuugcuuccaguaugccaaagcucaucaaugagaaagaccgauugguuaccgaugacaguagcugcaauggguguuccaccucuaccucuauuuauauucagccuuaaggauacccucaagcgacgcagcuggccacuaaacgaaggcguaauggcagugggcuuaguaucaauauuggccagcucacugcuuagaaaugacguuccgauggcagguccuuugguugccgguggguuauuaauagcguguuacguuauaacgggaacgucagcagacuuaaccguagaaaaagcagcggacguuacuugggaagaagaagcagaacaaacaggaguaagccauaauuuaaugaucacgguugaugacgauggaacuaugcguauuaaggaugaugaaacugaaaauauacugaccguauuacuaaaaacagcacuccuaauaguaaguggaauauuuccuuacagcauuccagcaacgcuguugguuuggcacaccuggcagaaacaaacgcagagaaguggagugcuaugggauguacccucaccaccagagacccaaaaagcggaauuagaggaaggcguauauagaauaaagcaacaagggauuuuugguaagacacagguggguguagguguacaaaaagagggaguauuccacaccauguggcacgugacaaggggugcuguucugacuuauaaugggaaaagacuggaaccuaauugggcgagugucaagaaagacuuaauuagcuacggaggugguuggcgacuaucugcccaauggcaaaagggugaagaaguccaggucauagcagucgagccagggaaaaaucccaaaaacuuccaaacgaugccagguacguuucaaacaacaacaggugaaauuggagcgauagccuuagauuucaaaccagguacauccgguaguccuauaauuaaucgagagggaaaaauuguagguuuauacgggaacgguguugucaccaaaaaugguggguauguaucggguauagcucaaacaaaugcugaaccagacggaccaacuccagaacucgaggaggaaauguuuaaaaagagaaauuuaaccauuauggacuugcauccuggaucugggaaaaccagaaaauauuugccagcuaucguacgcgaagccauaaaaaggcggcuaaggacucuaaucuuggcaccaacaaggguagucgccgcagaaauggaagaagcacucaagggacuaccaauuagauaucagacaacagcaaccaagucggaacacacaggcagagagauagucgauuugaugugucacgcaaccuuuacgaugagguugcugucaccugugcgagucccaaauuacaauuuaauaaucauggaugaagcacauuuuacagaucccgcuaguauagcggcccgugguuacauuucaacaagagucggcaugggugaagcagcggcaauauuuaugacggcaacaccaccugguacggcugaugcauuuccacagaguaaugcuccgauucaagaugaggaaagggauauaccugagagauccuggaacagugggaaugaauggauaaccgacuuugcaggaaaaacagucugguuugucccgucaauuaaggcuggaaacgauauagcuaacugucuccgaaagaaugguaagaaaguuauucagcuaucaaggaagacuuuugauaccgaauaucaaaagacgaaacuuaacgacugggacuucguugugacgacggauauaucagaaaugggggcuaacuucaaagcugacagaguaauugauccaagacguugucuaaaaccaguaauauugacagauggaccugaacgcguuauacuagcuggcccaaugccaguuacagcagcaagcgccgcucaacgacgggguagaguaggaagaaacccacaaaaagagaacgaucaauauaucuuuacaggucaaccacuaaauaaugacgaggaucacgcccauuggacggaagcaaaaaugcuuuuggacaacaucaacacaccggaagggauuauccccgcacuuuuugagccagaaagggagaaaagugcagccauugacggcgaguauagacucaaaggagaaagucgcaaaaccuucguugaguuaaugcgaaggggugauuuaccuguuuggcuugcgcauaaaguugcguccgaggguaucaaauacacagaccguaaguggugcuuugauggacagcgaaacaaucaaauacucgaagaaaauauggacguggaaaucuggacuaaggagggcgagaaaaagaaauuaagaccaagauggcuagaugcaagaacauauagcgauccucuugcuuugaaggaauuuaaagauuuugcggcaggacgaaagagcauagcguuagaucuuguaacagaaauaggaaggguuccuacacaccuagcacauaggacucgcaacgcauuagacaaucuagucaugcuucauacuucagaacacggaggcaaggcauauaggcaugcuguagaggaacugccagaaacaauggaaacacuacuauuacucggacuaaugauucuauuaacugguggagcaauguuauuuuuaaucaguggaaagggcauagggaagacgucuauaggauugauaugugucaucgccucaucaggcauguuauggauggcugagauaccguugcaguggauugcaucagcuauuguucuggaguuuuucaugaugguucugcuaauaccagagccagaaaaacagaggaccccacaagauaaccaacuggcuuauguagucauuggaauauuaacucuagccgcuacuauugcugccaaugagaugggacuguuagaaacuacaaaacgggaucugggaaugucaaaagaaccaggagugguaucacccacuucuuauuuagacguugaccuacauccugcguccgccuggacucucuaugcuguggcuacaaccgucauaaccccgauguuaagacacacaauagaaaauucaaccgcaaacgucagucuagcugccaucgcaaaccaagccgucguacuuaugggcuuagauaaaggcuggccgauuucgaaaauggaucuuggggugccacuauuggcguuggguuguuauucccaaguaaauccucuaacgcuuacggcugcaguacugcuauuaaucacacacuacgccauaauugguccuggacuacaagccaaagcgacaagagaggcgcagaaaaggacagcagcugguauaaugaaaaauccgacagucgauggaauaaugacgauugaccuagauccaguaaucuaugacucuaaguucgaaaaacaauuaggccaaguaaugcuacugguccuaugugcuguacaauugcucuugaugcguacuucaugggccuuaugcgaggcauuaacacucgccacugggcccauaacaacauuaugggaagguucgccaggaaaauuuuggaauacaacgauagcaguaucgauggcaaauauauuucgcggauccuauuuagcuggcgcuggauuagcguucagcaucaugaagaguguugggacaggaaaacgcgguacagggagucagggcgaaacacuaggggaaaaauggaagaagaaauuaaaucaacugagucgcaaagaauuugaccuauauaagaaaucaggaauuacagaaguagauaggacugaggcuaaagaaggauuaaaacgaggcgaaauuacccaucaugcgguaagcagaggaagcgcuaagcuccagugguucguagaacguaauaugguaauuccagaaggcaggguaauagauuuaggauguggaagaggagguuggucuuauuauugugcaggacucaagaaagugaccgaagucagaggauacacaaaaggaggccccggacaugaagaaccugugccuaugucaacguauggauggaauauaguuaaacuaaugaguggaaaagauguauuuuaccuucccccagaaaaaugugauacucuauuaugcgauauaggagaaucgagccccaguccuaccgucgaggaaucgcgaacuauuagaguccuaaaaaugguagaacccuggcuaaagaauaaucaguuuuguauuaaaguucuuaauccguauaugccaacagugaucgagcaccuagaacgauugcaaaggaaacauggcgguauguuaguuaggaauccgcuauccaggaacagcacccacgaaauguacuggauuucaaauggaacaggcaauaucguggcaaguguuaauaugguaucaagacucuuacuuaaucgauucacaaugacauaucgaagaccaacaauugagaaggauguggacuuaggagcuggaacccggcauguuaacgccgaaccugagacuccaaauauggauguaaucggugaaagaauaaagcgaauuaaagaagaacauaauucaaccuggcauuaugacgaugaaaacccuuauaagacaugggcuuaccacgguagcuacgaaguaaaagcuacaggaagugcaagcaguaugauaaaugguguuguuaaauuacugaccaaaccuugggacgugguucccaugguuacacaaauggcgaugacagauacaacucccuucggacaacagcgaguauucaaggagaaaguagauacucgaacuccgcggucuaugccaggaacgagacgagucauggggauaaccgccgaaugguuauggagaacccuugguagaaacaagaaaccacggcuaugcacgcgcgaagaauuuacgaagaaagugagaacaaacgcagccaugggggcuguauucaccgaagagaaucaaugggauagcgcaaaagcagcaguugaagaugaggacuucuggaaacuggucgauagggaaagagaauugcauaagcuggguaaguguggaaguuguguauauaauaugaugggcaagcgagaaaagaaauuaggagaauuuggcaaagcuaaagguaguagagcuauaugguacauguggcuaggcgcaagauaucucgaauuugaagcucuuggcuuccuaaaugaggaccauugguucucgagagagaacucauauaguggcguagaaggugaaggauuacacaaacuaggguacauucuacgggacauaucaaaaauaccugggggugcuauguacgcagaugauacggcuggcugggauacucggauaacagaggaugacuuacauaacgaggagaaaauuacgcaacaaauggacccugaacauagacaacuggcuaacgcgauuuucaaacuaacauaucaaaauaaaguggucaaaguacaaaggccgacaccaacaggaacgguuauggacauuauuagccgaaaggaucaaagaggcucaggucaaguuggaaccuauggguuaaauacauucacuaauauggaagcccaacuaauacgccaaauggaaggagaggggguauugucgaaagcugaccucgaaaacccacauuuaccagagaagaaaauaacgcaaugguuggagaccaaaggaguagaaagguugaaacgaauggcuaucucgggugaugacugcguaguuaaaccaauugacgauagauuugcaaaugcccuuuuagcucugaacgauaugggaaagguaagaaaggauauaccccaauggcaaccaaguaagggcuggcacgauuggcaacaaguaccuuuuugcagucaccauuuucacgaauuaauaaugaaagacgguagaaaauuaguugugccaugcagaccucaagaugaacuaauuggucgagcacgaauaucucaaggagcuggauggagccuucgagaaacagcaugcuuaggcaaagccuaugcacaaauguggucgcucauguacuuucaucgacgugaccuacgucuugccaguaaugcgauauguagcgcuguucccguacauugggugccuacaucuagaacaacguggaguauacacgcacaccaucaguggaugacaaccgaagauauguugacugucuggaaucgaguuuggaucgaagacaacccauggauggaagauaaaacuccgguaacuacgugggaaaacgucccauauuuagggaagcgugaagaccaauggugcgguagcuuaauaggauugaccucgagagcuacuugggcacaaaauauacccaccgccauucagcaaguaagaaguuugauugggaacgaagaguucuuggauuauaugccgaguaugaaacgauuuagaaaagaagaagagucggaaggcgcgauaugguaa

SEQ ID NO: 23418 - RNA, 9873 nt, Artificial Sequence
  derived and/or modified CDS sequence (opt6) from DENV-3__FJ639785__SS-prME
accucauuguguuuaaugaugauacucccugcagcuuuagccuuucacuugacgucaagagauggagaacccagaaugaucguagguaaaaacgaacgcggaaaaucauuacuguuuaaaacugcaucuggaauuaauaugugcacucuuauagcaauggaucuaggagaaaugugugacgauacaguaacguauaaaugcccucacaucacugaaguagaaccugaagacauagacuguuggugcaaucucacuagcaccuggguuacguacgggacauguaaucaagcaggagaacauagaagagacaaacgcagcguugcauuagcaccccauguaggaauggguuuggacacuagaacacaaacauggaugucagcggaaggggcguggagacaaguugagaaaguggaaacaugggcuuugagacauccgggauucacgauacucgcauuauuccucgcccauuauaucggcacuucauuaacacaaaaagugguaauauuuauucugcuuaugcucguaacuccuaguaugacgaugagaugcguuggagugggaaauagagauuucguugagggacuaucgggagcaacauggguugauguuguucuugagcacggugggugcguaacgaccauggcuaaaaacaaaccaacucuugauauagaauuacagaaaacugaggcaacacaacucgccacuuugcguaaacuauguauagaggguaaaauaacaaauauaacaacugacaguagaugccccacacaaggcgaggcagucuugccggaagaacaagaccaaaauuauguauguaaacauacauauguagaucgagguuggggaaaugguugcggauuguuugguaaagguagucuuguuaccugugcaaaauuccaaugucuugaaccaauagaaggcaaaguaguucaguacgaaaaccugaaauauacuguuauaauaacgguucacacgggggaucagcaucaggugggcaaugaaacgcaaggugugaccgcagagauaacgccacaagcaucaacgacggaggcgauauuaccugaguacggcacacuagguuuagaguguucuccucgaacaggacuagacuuuaaugaaaugauacuacugacaaugaaaaauaaagccuggaugguacaccgucaaugguuuuucgaccugccacuaccguggacuucuggggcaacaacagaaacaccgacguggaauagaaaagaacuauuaguaacauuuaaaaaugcucaugcgaagaaacaagaaguuguuguacuugguucucaagaaggcgcgaugcacacagcauugaccggcgccacagaaauacaaaauaguggugguaccagcauuuuugccggacaucucaaaugucgacuaaaaauggauaaacucgaauuaaaagguaugucuuacgccauguguacuaauacauucguacuuaaaaaggagguaagugagacacaacacggaacgauuuugauaaagguugaauacaagggcgaagacguaccauguaaaauaccauuuucaacagaagacggacaaggaaaagcacauaauggacgauuaaucaccgcaaaucccguaguaacgaagaaagaggaaccagucaacauagaagcugagccacccuucggagagucuaacauuguaauuggaauuggugauaaugcauugaaaauaaauugguacaagaaaggcuccucaauagguaagauguuugaagcaaccgcaagaggugcgagacguauggccauauuaggagauacggccugggacuucggaagcgucggagggguauuaaauucauuaggaaaaaugguucaccaaauauucggaucagcuuacacugcacuauuuucuggcgugagcugggucaugaagauaggaauuggcguacuauuaacauggauaggacucaauuccaaaaacacguccaugucguucagcugcauugcgauuggcauuauaacccuuuaucuuggagccguaguacaagcagauaugggcugugugauuaacuggaaaggcaaagaacugaaauguggaaguggaauauucgugacaaaugagguccauacauggacugagcaauauaaauuucaggcagauucaccgaaaagacuagcaacagccauugcaggagcaugggaaaauggaguauguggcauacgaucaacgacuagaauggaaaacuuauuauggaagcagauagccaaugagcuaaacuacauuuugugggaaaacaauauaaaacuuaccguugucguaggagauacaauaggcguacuugaacaggguaagcguacucucacuccacaaccgauggaauuaaaauauucauggaaaacguggggaaaagcuaaaauaguaaccgcagaaacccagaacaguaguuuuauaauagauggaccuaauacaccugaaugcccaucagcgucuagggcuuggaacgucugggaaguagaggacuacggauucggagucuuuacaaccaauauuuggcuuaaguuacgugaaguguacacucaacuaugcgaucacagacuaaugucagccgcuguaaaagacgaaagagcuguucaugcggauauggguuacuggaucgaaucacagaagaauggaucuuggaaacuugaaaaagccucgcuuauagaagucaaaacuuguacuuggccaaagagucauacauuauggucaaacgguguacuagaaagcgauaugauuauaccaaaaucucuagcagguccgaucucgcagcauaauuacagaccgggauaucacacacaaacugcugguccauggcauuuagggaaacuugaacuagacuucaauuacugugaagguacaacggucgucauaacagaaaauuguggaacuagaggaccaucgcugagaacaacuacuguaucaggaaaacucauacacgaguggugcugcagaaguugcacccugccaccccuucgauauaugggcgaagaugggugcugguacggaauggaaauuagaccaaucuccgaaaaagaagaaaauaugguaaaaucacucguauccgccggaagcggggaaguagacaauuucacgauggguguacuuugucucgcuauauuguucgaagaaguuaugcgagguaaauuugggaagaaacacaugauagcuggaguauucuuuaccuuuguucuauuacuaucaggucagauuacguggagagauauggcucauacauugauuaugauaggaaguaaugcuucagaucguaugggcaugggggucaccuaucuagcuuuaauagcaacuuuuaaaauacaaccuuuucuugcacuaggguucuuucucagaaaauugacaucacgagagaaccuguuauugggcguaggauuagcaauggcgacuacacuacaacuuccagaagacauagaacaaauggcaaacgggauagcccuaggcuuaauggcuuuaaaacuuaucacacaauuugaaaccuaccaguuauggaccgcacuaauuagucuaacuugcagcaacaccauuuucacguuaacggucgccuggaggacagcuaccuuaauauuggcaggagucagcuuacuuccaguuugccaaucaaguucaaugcgaaaaacagauuggcuucccaugacaguagcugcuauggggguaccgccauugccacuguucaucuucagucucaaagauacauuaaaacgacgaagcuggcccuuaaaugaaggaguaauggcuguuggguuaguuaguauucucgcgucaucacuuuugcguaaugacguaccgauggcugguccacuuguugcgggagguuuacuaauugcauguuauguuauuacugguacaagcgcagauuugacaguagaaaaggcagcagacguuacaugggaagaagaagcggaacaaacaggagugagucauaaccuaaugauuacaguugaugacgaugguacaaugagaaucaaagaugaugaaacugaaaauauuuugaccguccugcugaaaacagcacuccugaucguuucugggauauuucccuauucaaucccggcaaccuuguugguuuggcacacauggcaaaaacaaacccaacgcucaggaguauugugggacguuccaucaccaccugaaacacaaaaagcggaauuagaggaaggaguauaccgaauuaaacaacaagguauuuuuggcaaaacgcagguagggguugguguacaaaaagagggaguuuuucacacaauguggcauguaacacggggagcaguccuaacguacaaugggaagcgccucgaaccaaacugggcaucagucaagaaagaucuuaucucauacggcggagguuggagguuauccgcgcaguggcagaaaggugaagaggugcaaguaauagcuguagaaccagguaaaaauccuaaaaauuuccaaacuaugccagguacauuucagacaacuacaggcgagauaggcgcuauugcuuuagauuuuaagccaggaacaagcgguagcccuauaauaaaccgagaaggcaagguggucggucuuuauggaaacggagucgucacuaaaaacggcggauauguaagugguauagcacagacgaacgcggaaccggacggaccuaccccagaguuagaagaagaaauguucaagaaaagaaacuuaacaauaauggauuugcauccugguucgggaaaaacgaggaaguauuuaccugcuauuguaagggaagccauaaaacgcagguuaagaacacuaauauuagcaccaacuagagugguggcagccgaaauggaggaagcauuaaaaggcuuacccauacgcuaucagaccacagcgacgaaaucugaacacacaggaagggagauaguugacuuaaugugucaugcgacuuucacuaugcguuuauuaucaccaguuagagucccaaauuauaauuuaaucauaauggaugaagcacacuucacugaccccgcuaguauagcugcacgaggauacauaagcacgcggguggggaugggggaggccgcagcgaucuucaugacggccacacccccgggaacagcugaugcguuuccccaaagcaaugcaccgauacaagaugaagagagggauauacccgaacgcucauggaacagcggaaaugaauggaucacggauuuugcuggaaaaacuguaugguuugugccgagcaucaaagcaggcaaugauauugcaaauugucuaaggaaaaauggcaagaaaguuauucaacuuucaagaaaaacauucgauacagaauaucagaaaacaaaacugaaugauugggauuuuguagugacuaccgauauuucagagaugggggcuaauuuuaaagcagauaggguaauagacccaagacgauguuuaaaaccaguaauccuaacagacggcccagaaagagucauauuagccgggcccaugccagugacagcagcaagcgcugcccaaaggagaggaagaguuggacgaaauccacaaaaagaaaaugaucaauacaucuuuaccgggcaaccacuaaauaacgaugaagaccacgcacacuggacugaagcaaaaaugcuacucgacaauauuaauacaccagaaggaauuauucccgcccuauucgaaccugaaagagagaagucggcagccauugacggggaauaccgacuaaagggggaaucuagaaaaacguuugucgaguuaaugagaagaggugaucugccggucuggcuggcccacaaaguugcaucggaaggcauuaaauauaccgaccguaagugguguuucgacggccagagaaauaaucaaauccuagaagaaaauauggaugucgagauauggaccaaagaaggggaaaagaagaaguuaagaccacgcuggcuagaugccagaacuuacagugauccauuagcauugaaagaauuuaaagauuuugcagcaggucgaaaaucaauugcccuugauuugguaacugaaauugggagaguaccuacucaucuggcgcaucgaacccguaacgccuuagauaauuuagucauguugcacacuagcgaacauggaggaaaggcuuaccgucaugcuguugaagaacuaccugagacaauggagacguuguugcuauuaggguuaaugaucuugcuuacaggaggagcuauguuguucuuaauaucgggaaaggggauaggaaaaacaagcauaggacuuauuuguguaauugccaguagugggaugcuauggauggcagagauacccuuacaauggauagcaagcgcuaucgucuuagaauuuuucaugaugguacuuuugauuccggaaccagagaagcaacgaacgccacaagauaaucaacucgcguacguaguaaucgguauauuaacacuggcugcgacaauagcagcaaaugaaauggggcuguuggaaacaacaaaaagagauuuagggaugucaaaagaaccaggaguaguuucccccacaagcuauuuagacgucgaucuucaucccgcgucugcuuggacccuuuacgcgguagcuaccacgguuauaacuccaaugcuacgacacaccauagaaaacaguacagcuaacguuagucuugcagcgauagcuaaccaagcagucgugcuaaugggucuagacaaaggguggcccauaucuaagauggacuugggcgugccacuauuagcuuugggcugcuauucucagguaaauccauuaacacuuacugcggcaguauuacuccuaaucacucacuaugcaauuauagguccuggcuuacaagccaaagcuacacgugaagcgcaaaagagaacagcggcggguauaaugaaaaacccaaccguagaugguauaaugaccauugauuuagacccuguuaucuacgacagcaaauucgaaaagcagcugggacaagucauguuauuggugcucugugccguucaacuucucuuaaugcguacaaguugggcccuuugcgaagcccuaacacucgcuacaggcccuauuacaacguuaugggaagggaguccaggaaaauucuggaauacuacuauugccguuucuauggcaaauauuuuuagggguucguauuuggccggcgcugguuuagccuucucaauuaugaaaagcguuggcacagggaaaaggggaacgggcagccagggcgagacauuaggugaaaaauggaagaagaaauugaaucagcuaucacgaaaggaguuugaccuguauaagaaaucugguauaacagaagucgaucguacagaagcgaaagaaggacucaaacgaggcgaaauuacucaccaugccgugucgcguggaagugcaaaacuucaaugguuuguugaaagaaauaugguaauaccugagggcagaguuauugaucuaggcugugggcggggaggauggaguuauuacugugcagggcucaagaagguaacugagguaagaggauauacuaaagggggaccuggccaugaagaaccaguuccaaugagcaccuacggauggaacauaguaaaacugaugagugguaaagauguuuucuaccuuccgccagaaaagugcgauacuuuguuaugugauaucggagagucgucaccuucuccuacaguagaggaaucuagaacuauaaggguacuuaaaauggucgagccaugguugaaaaauaaccaauucugcauuaaagugcuaaauccauauaugccaacuguaauagaacaucuagaaagguugcaaagaaaacacgggggaauguugguuagaaauccccuaucgagaaacucuacgcaugaaauguacuggauaucuaauggcaccggaaauauaguggcaucaguuaauaugguaucaagguuauugcucaacagauuuacuaugacccauagacgaccgacaaucgaaaaagacguagacuuaggagcagggacgagacauguaaacgccgaaccagaaacaccgaacauggacgugauaggagagcgcauuaaacggauaaaggaggaacauaauuccacguggcauuaugaugacgagaauccauauaagacaugggcauaucacgggucauaugaaguuaaagcuacgggaagugcaucaaguaugauuaauggaguggucaaacuccuuacuaaacccugggauguuguaccgauggucacccaaauggcuaugaccgauacaacaccauucgggcaacaacggguuuuuaaagagaaaguagauacaaggaccccaagaagcaugccaggcacgaggcgcguaaugggcauuacagcagaaugguuauggaggacauuaggccguaauaaaaagccucggcuuuguacucgagaagaauuuaccaaaaagguccgaaccaaugcagcuaugggcgcuguauucacggaagaaaaucaaugggauagcgcaaaagcugcaguugaagaugaagauuucuggaagcucguagaucgagaaagagaauuacauaaacuagguaagugugguucaugcguauauaacaugauggguaagagggaaaagaaacuuggcgaguucggaaaagcuaaaggaagccgugcuauuugguauauguggcuaggcgccagguauuuagaguucgaagcacugggauuccugaacgaagaccauugguucucaagggaaaauucuuauagcggugucgaaggugagggccuccauaaauuaggauacauacugcgugauauaucaaaaaucccuggcggggcaauguacgcugacgauacagcagguugggacacacgcauaacugaagaugaucuacauaacgaagagaaaauuacacaacagauggacccagaacaucggcaauuagcgaacgcuauuuuuaaacucacuuaccagaauaaagugguaaaaguacaacgcccaacgccgacaggaacaguuauggacauaaucucaagaaaggaucagagaggaucaggccaagucggaacauacggcuuaaauacuuuuacaaauauggaagcacaacuaauccgccaaauggaaggugaagguguccuuuccaaagcagaucuagaaaacccacaucucccggagaagaaaaucacacaaugguuagagaccaaaggagucgagagauuaaaacgaauggccaucaguggagacgauuguguaguaaagccuauugaugaucgguucgcaaaugcccuucuagcgcuaaacgauaugggaaaggugagaaaagacauuccgcaauggcaaccaagcaaaggauggcacgacuggcaacagguuccguucugcagccaucauuuccaugagcuaauaaugaaagauggaagaaagcuaguagucccaugccguccccaagacgaauugauagguagagccagaauuagccaaggagcuggguggucacuuagagaaacugccugcuuaggaaaagccuaugcgcagauguggucccuaauguacuuccaucgcagggaucucagguuggcaucaaaugcgauauguucagcaguaccgguacauuggguaccaacaucaaggacaacauggucaauucaugcgcaccaucaguggaugaccacugaggacaugcuaaccgucuggaaucgcguuuggauagaagacaauccguggauggaggacaaaacaccuguaacaacuugggagaaugucccuuaucucgguaagagagaggaucaaugguguggaucacuaauaggauuaacgaguagagcaaccugggcucaaaacauucccacggcaauccaacaaguacggucacuuauuggcaacgaagaguuuuuagacuauaugccaucuaugaaaagauuccgaaaagaggaagaaucugaaggagcaauuugguag

SEQ ID NO: 23419 - RNA, 9873 nt, Artificial Sequence
  derived and/or modified CDS sequence (opt6) from DENV-3__FJ639786__SS-prME
acaucccuguguuuaaugaugauccuaccugcugcucucgcauuucauuuaacaagcagggacggugaaccccgaaugaucgucgguaaaaaugaacggggaaaaucuuugcuguucaaaacagcaucugggauaaacaugugcacauuaauagcaauggaucucggagaaaugugcgaugacaccguaaccuauaaauguccacauauaaccgaaguagaaccggaagauauugacugcugguguaacuuaacuucgacgugggugacauacgggacgugcaaccaagcuggagaacaccgaagagauaaaaggucuguggcgcuagcaccccacguaggaaugggacuggauacaagaacacaaacguggaugagugcagaaggcgcuuggcggcaaguagaaaaaguggaaacgugggcauugagacacccgggauucaccauucuagcgcuguuuuuggcacauuauauagggacaucacuaacucaaaaaguugugaucuucauacuucugauguuagugacaccaagcaugacaaugaggugcguaggaguaggaaaucgcgauuuugucgaaggacuaucaggagcaacaugggucgauguaguacuagaacaugguggaugcguaacaacaauggccaaaaauaaaccuaccuuagacauugaauugcagaaaacggaagcgacacaauuagcuacauugaggaaacuuuguauugaaggcaaaauuacuaacauuacaacugacucacgauguccaacacagggugaagcuguacuccccgaagaacaagaccagaauuacguaugcaaacacacuuaugucgauagagguuggggaaaugggugcggacuauucgggaaagggucgcugguuacuugcgcaaaauuccagugcuuagaaccuauugaggggaaaguugugcaauacgaaaaucuuaaauacacuguaauaauuacagugcauacaggagaucagcaccagguagguaacgaaacacaaggaguaacugcagagauuacaccacaagcuaguaccaccgaggcuauacuuccagaauauggaacuuuggggcucgaguguucuccaagaaccggauuagauuuuaaugaaaugauauugcuaacgaugaaaaacaaagcauggaugguacaccgacagugguucuuugauuugccucuaccaugggcgucaggagcaacaacagaaacucccaccuggaauagaaaagaauuguuggugacauucaaaaaugcgcaugccaaaaagcaagagguaguagugcuaggaucucaagaaggcgcaaugcauacugcacuaaccggggcaacagaaauacagaacuccggaggcaccucuauauuugcaggucauuuaaagugucgucuuaaaauggacaaauuagaguugaaaggcaugucauaugcaauguguacgaacacuuucguacuuaagaaagaggucucagagacucagcacggaacuauacuaauaaagguagaguauaaaggagaggacguaccguguaaaaucccauuuucuacagaagacgggcaaggcaaagcucauaauggacggcuaauuacagcaaauccaguaguuacgaagaaagaagaaccuguaaauauagaagcagagccuccauuuggugagagcaacauuguuauugggauuggagauaacgcuuuaaagauaaacugguauaagaaaggcaguuccaucgggaaaauguuugaagcuacugcacgaggcgcaagacguauggcaauauuaggagacacggcaugggacuuuggcucagucggugguguuuuaaacucguugggaaaaaugguacaccaaaucuuugguucagcauauacagcguuauucaguggcgucuccuggguaaugaagauaggaauagggguuuuauuaaccuggaucggauuaaauuccaaaaauacaucaaugucuuucuccuguauagcaauaggaauuauuacuuuauaucucggugcgguaguacaagcugauaugggaugcgucauaaauuggaaaggaaaggaacugaaaugcgguaguggcauuuuuguuaccaacgagguacauacauggacugaacaguacaaauuucaagcagacucucccaagcgccuggcgacagcaauugcaggggccugggaaaacgguguauguggaauaagguccacaacaaggauggagaauuuacucuggaagcagaucgccaaugaacuaaacuacauacucugggagaacaacauaaaacuuaccguuguaguaggugauauaauagguguguuagaacaagggaaaagaacacucacaccgcaaccaauggaguuaaaauacucuuggaaaacguggggcaaagccaaaauaguaaccgcagaaacacaaaauagcuccuucauaauagauggaccaaauacuccagagugcccgucagcuucaagggcguggaacgucugggaaguugaagauuauggauucggcgucuucacaaccaacauuugguuaaaacuaagagaagucuauacccaacucugugaccaccgauugaugagcgcugcugugaaggacgaaagagcgguacaugcugauaugggguauuggauagaaagucaaaagaauggauccuggaaacucgaaaaggcuucgcuaauagaagugaaaacaugcacauggccaaaaucacacacauuguggucuaacgggguguuagaaagugacaugaucaucccgaaaucucuagcugguccaauaagucaacacaauuaccgaccagguuaucauacucaaaccgcaggacccuggcaccucggaaaauuagaauuggauuuuaacuauugcgagggaacgaccgucguuaucacagagaauuguggcacaagaggacccuccuugcgaacaacaacagucucagguaaguugauucaugaauggugcuguagaucaugcacuuugccgccucuacgcuacaugggagaggaugggugcugguacggaauggaaauccgaccgauaucagagaaagaagaaaacaugguuaagucucuaguaucagccggaucuggagaaguagauaacuucacuaugggcguccuauguuuagcaauccuauuugaggaagugaugagagggaaguuuggcaagaaacacaugauagcugguguauucuuuacauucguccuacuucuaaguggucagaucacuuggagggacauggcacauacguuaauuaugauugguuccaaugcuucugauagaaugggaaugggcguaaccuacuuggcacuuauagccacguuuaaaauacagcccuuuuuggccuuaggauuuuuccuuaggaaauuaacuagccgagagaacuugcuuuuaggagucggguuagcaauggcuaccacauugcaauuaccugaggauauugagcaaauggcuaauggaauugcucuaggucucauggcccuuaaauuaauaacucaauuugaaacauaccagcuauggacagcucuaauaagucuuacuugcagcaacacaauauuuacacuuacaguggcauggcgcacggcgacuuugauccuagcuggugucagcuuacuuccuguaugucaaagcaguucaaugaggaagacagauuggcuaccaaugacaguagcagcuaugggagugccaccccuucccuuguuuaucuuuucacuaaaagauacacugaaaagaagaagcuggccauuaaaugaaggugugauggcaguuggacugguauccauucuggccaguucacuuuugagaaacgaugucccuauggcagguccauuaguggccgguggucuguuaaucgcuugcuaugucauaacggguacaagcgcagaucuuacgguagagaaagcagcagacguaaccugggaggaagaggcagaacaaaccggaguaucccauaacuugaugauaacgguagaugaugauggaacgaugagaaucaaggaugaugaaacugaaaauauacuuacaguucuauugaagacggcgcuacuuauagugagugguauauuuccauacagcauaccugcaacacuacucguauggcacacauggcaaaagcagacgcaaagaagcgguguacuuugggacguaccgagcccacccgagacacaaaaagcagaacuagaagaaggugucuacagaauuaaacaacaaggaaucuucgguaagacacaagucgguguagggguacaaaaggaaggaguuuuucacacaauguggcauguaacccggggcgcuguuuuaacauauaauggcaaacgucuagaacccaauugggcaaguguuaagaaagauuuaauauccuaugguggcggguggaggcuaucagcacaguggcaaaaaggcgaagaagugcaaguuauagcuguagaaccuggcaaaaauccgaaaaauuuucaaaccaugccagguacuuuucaaacaaccacaggcgaaaucggagcgauagcacuugauuucaaaccagggacgagcggcucaccaauaauaaaucgugaaggaaaagucguaggacuauacggcaauggaguaguaacuaagaauggggguuaugucaguggaauugcacaaaccaacgcagaaccagaugguccgacacccgaacuugaagaagaaauguucaagaagcgcaaccuuacaauuauggacuuacauccagggagcgguaagaccaggaaauacuuaccagcaaucguaagagaagcaauuaagcgcagacuaagaacauugauacuagcacccacgagaguuguagcagcagagauggaagaggcuuuaaaaggacuuccaaucagguaccagacaacagcuacgaagucugaacacacagggcgugaaauaguagaccuaaugugucacgccacauuuacgaugcguuuacuuaguccagugagaguaccgaacuauaauuugaucauaauggaugaagcccauuuuacagauccggcuaguauagcagcgagaggauauaucuccacgagggugggcaugggggaagcagccgccaucuucaugacagcgaccccuccaggcacggccgaugccuuuccgcagagcaaugcaccuauacaagaugaagaaagagacauaccugagaggucauggaacucagguaacgaauggauuacugauuucgccggcaaaacagugugguuuguucccucuauaaaagcagguaaugauauagccaauugccugaggaaaaacggcaagaaagucauccaauuaucucgcaaaacauucgacacagaguaccaaaagacaaaacuuaaugacugggacuuuguagucacgacagacauauccgaaaugggagcuaauuucaaaacagacaggguaauagaccccagacguugccucaagccgguaauucuuaccgauggaccagagcgagugauucuagcagggccgaugccuguuacagcagcaucagcggcgcaaagaagggguagaguaggaagaaacccccaaaaggaaaaugaccaauauauauuuacgggacaaccuuuaaauaacgacgaggaccaugcacacuggacagaagcaaaaauguuguuagauaauauuaauacuccugaaggaauaauuccagcuuuauucgaaccggagcgagagaaaagugcagcaaucgacggggaauaucgacuaaagggggaaucucggaaaacauuuguugaacuaaugagaagaggagaucuuccagucugguuggcccauaaaguagcaucagagggaauaaaguauaccgauagaaaaugguguuucgacggacaacggaauaaccagauccuggaggagaauauggauguugaaauuuggacuaaagaaggggagaagaagaaauuacgaccucgauggcuugaugcacguacuuauagcgacccacuagcacuaaaagaauuuaaggacuuugccgcaggaaggaaaucaauugcuuuagauuuagugacugaaauuggccggguaccgacacaucuagcgcaccggaccagaaacgcccuugacaauuuaguuauguuacacacuucagaacacggcgggaaggcauaucgacacgccguagaggaacuaccugaaacuauggaaacauugcucuugcucggccuaaugauucuucuuacuggaggugcuaugcuauuucuaauuagugguaaagggaucggaaaaacgucaauaggauuaauuuguguaauagcaucuagcggaaugcuuuggauggcagaaaucccauuacaauggauugcaucugcgauaguuuuagaauuuuucaugaugguauuguuaauuccugaaccugagaaacaacgaaccccgcaggauaaucaacuugcguauguugucauagggaucuugacacuugcagcaauuauugcggcuaacgaaaugggccuucuugagacuacuaaaagagaucuggggaugaguaaagaaccaggcguuguaaguccuacuagcuaucuugauguggacuuacacccagcuucugcuuggacauuguaugcuguugcaacuacugugauuacuccuauguugcgacauaccauagagaacuccacugcgaauguaucacuugccgcaaucgccaaucaagccgucgucuugauggguuuagauaaaggguggccgauaucaaaaauggacuuggguguaccacuuuuagcucuugguuguuauagccaaguuaacccacucacgcuaaccgcggcgguacuacuguuaauaacgcauuacgcgauaauugggccaggcuugcaagcaaaagcaacaagagaagcccaaaaacgaacggcagcagggauuaugaaaaacccgacuguggauggaauaaugacuauugaucuagauccaguuauauacgauucuaaguuugaaaaacaacuugggcaaguaaugcuauuaguauuaugcgcuguacaauuacucuuaaugagaaccaguugggcccuaugugaggcuuuaacccucgcuacaggaccaauuacuacacuaugggagggcucaccugggaaauucuggaauacuacuauagcgguaucaauggccaauauuuucagaggaagcuaucuggcaggggcagggcuagcuuucagcauaaugaaaagugugggcacaggaaagagaggaacuggaucccaaggcgaaacuuugggagaaaaauggaaaaagaaacuaaaccagcucagcagacgcgaguuugacuuguauaaaaagaguggaauaacugaaguagaccggacggaggcgaaagaaggacuaaaaagaggugaaauaacacaccaugcagucucaagaggcucagcaaaacuucaaugguucguggagcgaaauaugguaaucccagaaggcagagugauugacuuggguuguggacgaggagguuggagcuauuauugugcaggcuugaagaaaguuacugaaguacgaggcuacacuaaaggggguccagggcaugaggaaccugugccgaugagcaccuauggauggaauauaguaaaacucaugucagggaaggacguauucuauuuaccaccugaaaaaugugauacauugcuaugugacauuggugaaucaucaccuucucccacaguagaggaaucacgaacaauaaggguccuuaaaauggucgaaccaugguugaaaaauaaucaguuuuguauuaaaguuuuaaacccauauaugccaaccgugaucgagcaccuagaaagacuucaaaggaaacacggaggaaugcuuguuagaaauccucuaagcaggaauaguacucaugaaauguacuggauaucgaacggaaccgguaacaucguugcaagcguaaauaugguaagccgucuauuauuaaaucgauuuacuaugacacaccgacggccuacaauagaaaaagacguugacuuaggugcgggcaccagacacguaaaugcagaaccagagaccccaaauauggauguuauuggcgaaagaaucaagaggauuaaagaagaacacaauucaacuuggcauuaugaugaugaaaauccuuauaaaacaugggcauaccauggaaguuacgaaguuaaagcuacaggcuccgcaucuucuaugauuaacggaguaguuaaacuucucaccaaaccaugggauguaguacccaugguaacccagauggcgaugacagacacgaccccauucggacaacaacgggucuuuaaggaaaagguggauacuagaacuccccgaccaaugccagguacucguagaguaauggggauaacagcagaaugguuauggagaacgcuaggacguaauaagaaaccaagauugugcacgcgggaagaauuuaccaagaaaguuagaaccaacgcggcaaugggagcaguuuuuacugaggagaaccaaugggacuccgcaaaagccgcugucgaggaugaagauuuuuggaaauuaguagacagggaacgggaacuccauaaacuuggaaaaugcggcagcugugucuacaacaugauggggaagagggagaagaaacuaggagaauuugggaaagcgaaagggucacgggccauaugguauaugugguugggggcaagauacuuagaauuugaagcauuaggauuuuuaaaugaagaucacugguuuaguagagaaaauaguuauagcggaguagaaggggagggguuacacaaacuuggauacauucucagagauaucaguaaaauccccgggggugcaauguaugccgaugauacggcagguugggauacgagaauaacagaagaugaccuacauaaugaagagaaaauaacacagcaaauggaucccgaacauagacaauuagcgaacgcuauuuuuaaacugacauaccaaaacaaggucguaaaaguccaacgaccaacuccaacaggaacagugauggauauaauaagccgcaaagaucaaagaggguccgggcaaguagguacuuaugggcucaauacguucacgaacauggaagcccagcuuaucagacaaauggaaggugaagguguuuuaucgaaggcugaccuggaaaauccgcaucugccagagaagaaaaucacacaaugguuagaaacgaaaggcguagaaagacuaaaacgaauggcaauaucaggagacgauuguguaguaaaacccauugacgacagauuugcaaaugcucugcuggcucuaaacgacauggguaaagugcgaaaagacauuccacaauggcaacccaguaaaggguggcacgacuggcaacaaguuccuuuuuguucucaucauuuucacgagcuaauaaugaaagacggaagaaagcuagucguaccaugccguccucaagaugaacuaauaggucgggcccgaaucucucaaggggcaggcuggagucuuagggaaacagcuugcuuaggcaaagcguacgcucaaauguggucacuaauguauuuccacaggagagacuugcgauuagcuaguaaugcaaucugcucggccguuccaguacauuggguuccaaccucgagaacaacguggucgauacacgcacaucaccaauggaugacaacagaagauauguuaacaguguggaacagaguuuggaucgaagauaacccguggauggaggacaagacuccaguaacuacgugggagaacguuccauacuuaggaaaacgugaggaucagugguguggcucacuaauuggucuaaccagcagagccacaugggcgcaaaacauuaguacagcuauucaacaagucagaaguuuaaucgggaacgaagaauuucuugacuacaugccgaguaugaaacgauuuagaaaagaagaagagucggaaggagcgauaugguaa

SEQ ID NO: 23420 - RNA, 9873 nt, Artificial Sequence
  derived and/or modified CDS sequence (opt6) from DENV-3__FJ639787__SS-prME
acaucacucuguuuaaugaugauauuacccgcagcgcuagccuuucaucuuacuucaagagauggagaaccuaggaugauugucgggaaaaaugaacgaggaaaaucccuuuuauucaaaacugccucagguauuaauaugugcacgcucauagccauggacuugggagaaaugugcgaugacacggugacauauaaaugcccacacauuacugaagucgaaccugaagacauugauuguugguguaaccuuacaucuacguggguaaccuauggaacuuguaaucaggcgggagaacauagaagagacaaaagaucaguagcacuagcaccccauguuggaaugggucuugauacccgcacucagacuugguuaucggcagaaggagcuuggcgucaaguggaaaaaguagaaacuugggcgcuuagacauccgggauuuacuauauuagcucuauuccuggcucacuacauugggacuucguuaacgcaaaaaguagucauauucauauuacugauguuaguaacuccuucaaugacuaugagaugugucggaguaggaaacagggacuuuguagaaggauuaagcggagcaacguggguggacguaguccuugaacauggaggaugcguaacuacgauggcuaaaaacaaaccuacacucgauauugaauugcagaaaacagaagcgacucaacuagcgacucuacguaaauuauguauagaagggaaaauaacaaauauaacgacugacucucguugcccaacacaaggagaagcaguucuaccagaagaacaagaucagaacuauguguguaaacauacguacguagaucgcggguggggaaauggguguggacuauucggaaaagggagcuuagucacaugugccaaauuucaaugccuggaaccuauugaagguaaaguugugcaauacgaaaaucuaaaauacacuguaauaauaacgguacacaccggcgaucaacaccaagucgguaacgagacacaaggcguuacugcugaaauaacgccgcaagcuaguacaacugaagccauuuuaccugaauacgguaccuugggauuagaauguaguccacgaacaggacuagauuucaaugagaugauauugcuaacgaugaaaaacaaagccuggaugguucaucgacaaugguucuuugauuugccccuaccauggacaagcggagcuacaacagaaacaccuacauggaauaggaaagaauugcuaguaacauuuaaaaaugcucaugcuaagaaacaagagguggugguacuagggucucaggagggagcaaugcauacugccuuaacgggugccaccgaaauucaaaauagcggagggacauccaucuucgcaggucauuuaaaaugucguuuaaaaauggacaaauuagaauuaaaaggaaugagcuaugcgauguguacaaauacauuugugcuaaagaaagaaguuucagaaacucaacaugguacuauacuaauuaaagucgaauauaaaggggaggauguccccuguaaaauuccuuuuucaacagaagacggucaggggaaagcgcacaauggacguuuaauaacagccaauccagugguuacgaaaaaggaggaaccuguaaauauugaagcagaaccaccguuuggcgagagcaauauugucauugguauuggagauaaugcuuuaaaaauaaauugguauaagaaaggcuccaguaucgguaaaauguuugaggcaacggcaaggggugcccgacgcauggcaauccuaggcgauacagccugggacuucggguccguuggaggaguccugaauaguuuggggaaaaugguccaucaaauauuugggucugccuauacagcacuauuuucaggaguuaguugggucaugaaaauuggaauuggaguacuuuuaacuuggauugguuuaaauuccaaaaauacaaguauguccuuuucuugcauagcaaucgguauaauaacucucuauuugggugcagucguacaggcagauaugggauguguaauuaacuggaaaggcaaggaacucaaaugcgguaguggcauauuugucacaaacgaaguacacacguggacagaacaauauaaauuccaggcagauucaccaaaaagauuagcuacagcuaucgcgggagcgugggaaaauggggucugugggauccguagcacuacuaggauggaaaacuuauuauggaaacagauugcaaaugaacuaaauuauauacuaugggagaacaacaucaaguuaacaguaguuguaggagauacuauugguguucuagaacaaggcaaaagaacuuuaaccccacaacccauggaacucaaauacagcuggaagacauggggcaaagccaagauuguuacggcagagacccaaaauucaaguuuuauuauagacgggccaaauacaccugaaugcccuagugcaagccgugccuggaauguuugggaaguagaagauuauggcuuuggcguauucacaacgaauauuuggcuaaaauugagggaaguauauacacagcucugcgaccaucguuugaugucggcagcagucaaagacgagcgcgcaguacaugcggauaugggauacuggauagaaagucagaagaacgguaguuggaaacuagaaaaggccucacuuauagaaguuaaaacaugcaccuggccuaaaucacacacucuauggucgaacggaguacuagaguccgauaugauaauacccaagucacuugcaggcccuauuagucaacauaauuauaggccugguuaucacacacaaacagcaggcccauggcaccugggaaaauuagaguuagauuuuaauuauugugaggguaccacugucguuauaacugaaaauugugggacaaggggaccgagccugagaacaacaacgguuucugguaaacuaauccaugaaugguguugucgaucauguaccuuaccuccucugcgguacaugggugaagaugggugcugguaugggauggaaauucggccaaucucggagaaagaagaaaacauggucaaaucucuagucucagcggguucuggagagguagauaauuucacaaugggaguacuaugucuagcgauacuuuucgaagaaguaaugagaggaaaguucggcaagaaacauaugauagcuggggucuucuuuacauucguauuacuuuuauccgggcagaucacauggcgggacauggcacacacucucauuaugauaggaucuaaugcgagugauaggaugggcauggguguaacuuacuuagccuugauagcgaccuucaagauacaaccauuucuagcauugggcuucuuucucaggaaguuaacaucaagagaaaauuuguugcuaggcgugggacucgcaauggccacaacguuacagcuaccugaagacaucgagcaaauggccaaugggauagcguuaggcuuaauggcucugaaacuaauaacccaguuugagaccuaccaguuauggaccgcguuaauauccuuaacgugcucuaauacaauuuuuaccuugaccguggcuuggagaacugcuacauuaaucuuagcaggagugucuuuacuaccgguaugccagaguaguuccaugagaaaaacggauuggcuuccaaugacuguggcagcgauggguguaccaccccuacccuuauuuauauuuucauugaaagacaccuuaaaaagacgaucauggcccuugaaugaagguguuauggcgguugggcucgucucgaucuuagcuucaucacucuuacgaaaugaugugccaauggcagguccccuuguagcgggcggacuccuaaucgcaugcuacguaaucacagguacgagugcagaucuaaccguugaaaaagcagccgacgugacaugggaagaagaagcggaacaaacaggugugagucacaaccuaaugauaacgguugacgacgauggaacaaugagaauaaaagacgaugaaaccgaaaauauuuuaacuguacuacucaaaacagcauuguugauuguuucaggcauuuucccauauucuauaccagcaacucuccuuguuuggcacacauggcagaaacaaacacagaggagcgguguuuugugggauguaccaucaccaccugaaacucagaaggcagaacuagaagaagguguauauaggaucaaacaacaaggaauauuugguaaaacacaaguaggagucggaguucaaaaggagggaguauuccacaccauguggcacguaacaagaggggccguauuaacauauaauggcaaaagacuugaaccuaacugggccuccguuaagaaagauuuaaucucuuauggaggugguuggagacuuuccgcgcaauggcaaaaaggugaagaaguccagguaauugccguugagccuggcaaaaauccgaaaaauuuucaaacaaugccuggcacuuuucaaacaacgacaggcgaaauaggagcgauagcacuagauuucaaaccugggacaucggguucgccuauaauuaacagagaaggaaaagucguagguuuauacggaaacggcgucgugacgaaaaaugggggauauguaagcgguauugcucaaacgaaugcagaaccagauggcccuacgcccgaauuagaggaagaaauguuuaagaaacggaaucuaacaauaauggauuuacacccgggaucggggaaaaccagaaaauacuuaccagcuauagucagggaagcgauuaaacgcagauuaagaaccuuaauccuagcaccgacaagaguuguagcagcagaaauggaagaggcacuaaagggacuccccauuagguaucagacgacagcuaccaaaagugaacauacaggaagagagauaguagacuugaugugucaugcaacuuucacaaugcgacuacuaagcccaguccgaguaccaaauuauaauuuaauaauaauggacgaagcgcauuucacggauccagcguccauugccgcacguggcuacauaagcacucgcguggguaugggugaagcggccgccauauucaugacugcaacgccaccggguacugcggaugcauuuccccaaaguaacgcuccaauacaagacgaggaacgagauauacccgagcgcaguuggaacaguggcaacgaauggauuacugacuuugcaggcaaaaccguaugguuuguuccuagcauuaaggcugguaaugauauagccaauugucuacgaaagaauggcaagaaagucauacaguugagucguaaaacauuugauacggaauaucagaaaacaaaauuaaacgauugggacuucgucguaacuacagacauuagugaaaugggagcgaauuucaaggcagauagaguaauagauccacgccgaugucucaagccugucauauuaacagaugggcccgagcgagucauucuugcaggaccaaugccuguuacagcagcuagcgcugcgcaaagacgaggucgcgucggcagaaacccucagaaagagaacgaccaauauauauucaccggacaaccacuaaacaacgacgaggaccacgcgcauuggaccgaagcaaaaaugcugcucgauaauaucaauacaccugaggggauuauuccagcuuuguuugaaccagaaagggagaaaagugccgcaauagauggugaguaccgucucaaaggagagagucguaaaacauucguugaacuaaugagacggggcgacuugccaguuugguuggcccauaaaguugcuucugagggaaucaaauauacagaccgaaaguggugcuucgacggacaaagaaauaaccaaauuuuagaagagaauauggacguagagauuuggacaaaagaaggagagaagaagaaacuucgaccacggugguuagaugcaagaacauauagcgauccacucgcuuugaaagaauuuaaagauuucgccgccggaaggaaauccauugcacuagaucuagugacugaaauaggucgagugccuacgcauuuagcgcaccgaacuaggaacgcccuagacaauuuaguaaugcuucacacaagcgaacaugggggaaaagcauacagacaugcaguagaagaauugccagagacuauggaaaccuuacugcucuugggauugaugauauugcuuacuggaggugcgauguuauuucucauaaguggcaagggcauagggaaaaccagcaucggauuaaucugcgucauagcauccucaggaauguuauggauggccgagaucccgcuccaauggauagcuagcgcgaucguucuggaauuuuucaugaugguauuguuaauccccgaaccugagaaacaaagaaccccucaggacaaccaacuagcauacguagugauagguauucucacauuagcugcuacuauagcagcaaacgaaaugggccuacucgagacaacuaaacgggauuugggaaugaguaaagaacccggaguaguaagucccacaagcuaccuggacguagauuuacacccagcaucugcauggacuuuguacgcuguagcuacuacggugauuacuccgauguuaagacacacaauugaaaauuccacugccaacgucagcuuagcggccauagcuaaucaagcaguaguccuaaugggacuagauaaaggauggccaauuaguaaaauggauuuaggcgucccccuucuggcacuuggauguuacucacaagugaauccuuugacacuaacugcagcuguccuacugcucauuacacauuaugcuauuaucgguccgggacuacaagcuaaagcuacgcgagaagcucagaagcguacagcugccggaauuaugaaaaauccuacuguggauggcauaaugacaauagaccucgacccaguaauuuaugauucaaaauuugaaaaacagcucggacaggucaugcuccuagugcuuugcgcaguacaacugcuacuaaugcgaacuucuugggcauuaugugaggcuuuaacuuuggcaacagggccuauaacaacuuuaugggaaggcaguccuggaaaguuuuggaauacaacgaucgcgguuucgauggcaaauauauuuaggggcuccuaucuagcaggggcaggacuggcuuucuccauaaugaagaguguggguaccggaaagagagggacaggaagucaaggcgaaacguuaggugagaaguggaaaaagaaacuaaaucaauuaucucggaaagaauuugaucucuacaagaaaaguggaauuacugaaguagauagaaccgaggcaaaagaaggacuaaaacguggagaaauaacacaucaugcuguuucgcguggaucagcuaaauugcagugguuuguggaaagaaacaugguuaucccagaaggacgcguaauagaucuuggauguggaagaggcggcuggucuuauuauugcgcaggguugaagaaaguuaccgagguaagagguuauacaaaggguggucccggacacgaggaaccaguaccaaugucaacuuacggauggaauauaguaaaauuaaugucaggcaaggauguauuuuacuuaccacccgaaaaaugugacacacuacuuugugacauuggagaaucuaguccaucaccaacaguagaggagaguaggacgauaagaguuuuaaaaaugguugaaccauggcucaaaaauaaucaauuuuguauuaaaguacucaauccauacaugccaacagugauagaacaucuagaaagacuacaacgcaaacauggcgggauguuaguucgaaauccacuaucuaggaacaguacccaugaaauguacuggauuaguaaugguacagguaauauaguagccaguguaaauauggucagucguuuauuacuaaaccgguucaccaugacucauagacgacccacaauagagaaggauguugaucuaggugccggcacuagacacguaaacgcagagccagagacccccaauauggacguaauuggugaacguaucaagcgaaucaaagaagaacacaauuccacauggcacuaugaugacgaaaaucccuauaaaacuugggcauaucaugggucuuacgaaguuaaagccacuggaagugcaucaucuaugauaaauggugugguuaaacuucuaacaaagccuugggacgucguaccaauggucacgcaaauggccaugacugauacuacuccuuucggacagcaaagaguguuuaaagagaagguugacacaagaacgccacguagcaugccaggaacuagaagagucauggggauuaccgccgaaugguuguggagaacuuuggggagaaauaagaaaccaagacuauguacaagggaagaauuuacaaagaaaguaagaacaaaugccgcaaugggggccguauucacagaggaaaaucaaugggacagugcuaaagcagcaguggaggacgaggauuucuggaaacucguggaccgagaacgagagcuccacaaacuugguaaauguggaucuuguguuuauaacaugaugggcaaacgagagaagaaacucggggaauuugggaaagcaaaagguaguagagcuauaugguauaugugguuaggcgcaagauauuuagaguuugaagcacuuggguuccuaaacgaagaccauugguucaguagagaaaacucguacucaggagucgagggagaaggcuuacacaaauugggauacauacuaagggauauuuccaaaauuccuggcggugcaauguacgcggaugauacugcugguugggauaccaggauaacagaagaugauuuacauaacgaagagaaaauuacucaacaaauggauccggagcaucgucaauuagcuaacgcaauauucaaauugacuuaucaaaacaaaguuguuaaaguucaaagaccaacaccuacaggcacugucauggacauaauaucccguaaagaccaacgugguucaggacagguuggaacuuauggacucaacacauucacgaacauggaagcccagcuaauccgacaaauggagggcgaagggguauuauccaaggcagaccuugaaaacccucacuuaccugagaagaaaauaacucaauggcuagaaacgaaaggaguugaaagauuaaaacguauggcgauaucuggugacgauugcguuguaaagccuauagaugacagauuugccaacgcacuucuggcucuaaaugacaugggcaaaguuagaaaagacauuccgcaauggcaaccuucaaaaggauggcaugauuggcagcaagugcccuuuugcucgcaucauuuucaugaacuaauuaugaaagacggucguaaauuagugguuccuugucgaccacaggaugaauuaauaggacgggcgcgcauaucgcaaggugcaggauggucgcuucgugaaacggcuugcuuaggcaaagccuaugcgcaaauguggagucuuauguacuuucaucgacgugaucuacgacuugcgucaaaugcuauauguuccgcaguaccgguucauuggguacccacuucgcguacaacaugguccauccacgcgcaucaccaguggaugacgaccgaagauaugcugacugucuggaauaggguuuggauagaagacaauccauggauggaggacaagacgccaguaaccacuugggagaacguacccuaucuaggcaaacgugaagaucagugguguggaucauuaauaggauuaaccucaagggcaacaugggcacaaaauauucccacagcuauacaacaaguaagaucucuaauugguaacgaggaauuucuugacuauaugccgucaaugaaacgcuuucggaaggaagaagaaucagagggagcaaucugguaa

SEQ ID NO: 23421 - RNA, 9873 nt, Artificial Sequence
  derived and/or modified CDS sequence (opt6) from DENV-3__FJ639790__SS-prME
accucacucugucuuaugaugauuuugccagcagcauuggcuuuccacuuaacgagucgggauggagaaccucgaaugauagugggcaaaaacgaacgaggaaaaucacuuuuauuuaaaacagcgaguggaauaaauauguguaccuugauagcaauggaccuuggagaaaugugcgacgauacggucacguacaaauguccgcacauaacugaaguugaaccugaagauauagauuguugguguaaccucacuucgacaugggugacauacgguacuuguaaccaagcgggcgaacaccgacgggauaaacgcaguguagcuuuggcgccacauguaggcaugggccuggauaccagaacacaaaccuggaugagcgcugaaggggcuuggaggcaaguggaaaaaguagaaacgugggcauuacgucauccuggauuuacgauauuagcucuguuuuuggcucauuacauaggaacuucgcuuacucaaaagguugugauauucauacuguugaugcucgucacaccuucgaugacuaugagaugcguagguguggguaaucgcgauuuuguugaaggccuuucaggggcaacguggguugauguaguuuuagagcacggaggauguguaacaaccauggccaaaaacaaaccaacacuagacaucgagcuccaaaagacagaagcuacacaauuggccacguuaagaaaauuaugcauugaggguaaaauaacuaauaucaccacggauucuagaugcccgacgcagggagaagccguucucccggaagaacaggaccaaaauuauguauguaaacauacauacguagauaggggguggggaaacgguugcggacuuuuuggcaaaggcucuuuggucacgugcgcaaaauuccaaugccuggaaccgauagaagguaaagugguucaauaugaaaaucuuaaauauaccgucauuaucacaguacacacaggagaccaacaucaagucggcaacgaaacccaaggaguuacggcagaaauaaccccacaagcaucgacuacagaggcaaucuuacccgaauaugguacucugggcuuagaauguucuccuagaacgggacuagauuuuaacgagaugauccuucuaacaaugaaaaauaaagccuggauggugcaccgccagugguucuuugaccucccccuaccauggacgucuggugcaacuacggaaacgcccacauggaaucgcaaagaauuacuuguuacguuuaaaaaugcacaugccaagaaacaggaaguaguuguacugggaagccaagagggggcaaugcacacagcacugacuggugcaaccgaaauucaaaauuccgguggcacgucaauuuuugcuggacaucuaaaaugcaggcucaaaauggauaaauuagaacucaaaggaaugaguuacgcuauguguacaaacacauuuguucugaagaaagaaguuucagaaacccaacaugguacaaucuuaauaaaaguagaauacaaaggagaagacgucccauguaaaauuccuuuuaguacggaagauggacagggcaaagcucacaacgguaggcuuauaacagcuaaucccguaguaacuaagaaagaagaaccaguaaauauugaggcugaaccuccauucggagagaguaauauuguaauugggauuggggauaacgcccucaaaauuaauugguauaagaagggaaguaguauugguaaaauguuugaggcgacugcgagaggggcacgacggauggcaauacuaggagauacagccugggauuuugguagcguaggggguguauuaaauaguuugggaaaaauggugcaucaaauauuuggaagcgcguauacggcauuauuuaguggagugaguuggguuaugaaaaucggcauugggguuuuacucaccuggauaggauugaauagcaaaaacacaaguaugucuuucucaugcauagcaauagguauaauaaccuuauauuuaggagccgugguucaagcagauaugggaugcguaaucaauuggaaaggaaaagagcugaaauguggaucaggaauauuuguaacaaaugaaguacacaccuggacagaacaguacaaauuucaagccgauucaccuaaaaggcuagcaacagccaucgccggugcaugggaaaacggcguaugugggauucgaucaacgacccgcauggaaaaccuucuuuggaagcaaauagcuaacgaacuaaauuauauacuaugggaaaacaauauaaaauugacagucguagugggagacauuaucggaguauuagaacaaggcaagcggacuuugacuccccaaccaauggaacucaaauauagcuggaagacaugggguaaagcaaaaauaguaacagcagagacgcaaaauuccucuuucauaauugauggaccaaauacuccugaauguccaagugcgucaagagcuuggaacguaugggaagucgaagauuaugguuucgguguuuucacaacuaauauaugguuaaaauuaagagaaguuuacacacaauuaugugaccauagacuaaugucagcagcaguuaaagaugagcgcgcuguacacgcggauauggguuacuggauagaaagccagaaaaacggaucauggaaguuagaaaaagccagcuuaauagaagugaaaacaugcacauggccuaaaucacauacacucuggaguaacggcguuuuagagagcgacaugauaauuccaaaaucacuagcagggccaauaucccaacacaacuacaggcccggguaucauacacagacagcgggcccauggcaucugggaaagcuagaauuagauuuuaauuauugcgagggaacaacagugguaauuacugagaauuguggaacacgaggucccucgcugagaacgacaaccguauccggaaaauuaauucaugaauggugcuguagaucauguacucuaccaccacuucgauacaugggagaagacggaugcugguaugguauggagauacgaccgauaucagagaaagaagaaaacaugguaaaaagccucgucagugcaggguccggagagguugauaacuuuacaaugggcguacucuguuuggccaucuuauucgaagaggucaugagggguaaauucggaaagaaacacaugauugccgguguauuccucacuuuuguucuacuuuuaagugggcagauuacauggagggacauggcucauacucuaauaaugaucggaaguaacgcuucagacagaauggguaugggggucacguauuuggcacuaauugcaacauuuaaaauucagccauuuuuagcucuaggauucuuucuaagaaaauuaacaagcagagagaaccuacugcuagguguuggccuugcaauggcaacaacucuccagcuaccugaggauauugaacaaauggcaaaugggauugcacuaggacuuauggcccugaaacugaucacacaguuugaaacauaucaacuauggacagcacucauaagucugacgugcaguaauacuauauuuacacuaacuguagcauggcgaacagcaacuuuaauacuagcaggcguaucacuccucccuguaugucagucgaguucaaugagaaaaacugacuggcucccgaugacagucgcggccauggggguaccaccauugccacucuuuauuuucaauuugaaagauacacuaaaaagacgauccuggcccuugaaugaaggugucauggcaguaggguugguaucaauauuggcaucuagucuucuacggaacgauguuccaauggccgguccguuaguugcgggaggacuccuaauugcuuguuauguuaucacagguacuucagcagacuuaaccguagaaaaagcggcagacguuacaugggaggaggaagcggaacaaacuggcguaucucacaacuuaaugaucacaguggaugaugacgguacgaugcgaauaaaagacgacgaaacggaaaacauauugacaguacugcuaaaaacggcgcuauuaauaguguccgggauuuucccauauagcauaccugcgaccuuauuagucuggcauacguggcagaaacaaacacaacgaucaggcguauuaugggauguaccauccccuccugaaacgcaaaaagcagaacuggaagaagggguguauagaauaaaacagcaagguauauucggaaaaacacaaguuggcguugguguucagaaagaaggcguuuuucacacgauguggcacguuaccagaggagcugugcuaacguauaaugggaaaaggcuagaaccgaacugggccaguguuaagaaagauuugaucucauacggaggaggcuggagguuaucugcucaguggcagaaaggagaagaagugcaaguaaucgccguggaaccugggaaaaaucccaaaaauuuccaaacgaugccaggaaccuuucaaaccacaacaggagaaauaggcgcaauagcuuuagauuucaaaccgggaacaaguggaucaccaauuauaaaucgagaagguaagguaguaggccuauauggaaaugguguaguuacaaagaauggugguuauguauccgggauagcacagacuaacgcggaaccagacgguccaaccccggaauuagaagaagaaauguuuaagaaacgaaauuuaacgauuauggauuuacauccuggaucgggaaagaccagaaaauacuuacccgcuauuguaagagaagcuauaaaaaggagauuaagaacguugauauuagcgccaacucgagugguagcugcagaaauggaagaggcccucaaaggucugccuauacguuaucaaacuacagcuacaaaaagcgagcauacagggagagagauaguugaccuaaugugccacgcaaccuucacuaugcgauuacucucaccgguaagaguaccgaacuauaauuuaauaaucauggacgaagcgcacuucacugauccugcgaguauagccgcgagaggauacaucuccacacgggugggaaugggagaggcggccgcaauauuuaugacugccacgccuccuggaacagcagaugcguucccccaaucuaaugccccuauccaggacgaagaacgugauaucccagaacgcucguggaacaguggaaaugaguggaucacugacuucgccgguaaaacuguaugguuuguuccaagcauuaaggccgguaacgacaucgcuaauugcuugaggaaaaauggaaagaaaguuauacaacuuagcagaaaaaccuuugacacagaauaucagaaaacgaaacucaacgacugggacuuuguagugacaacagauauaucggaaaugggggcaaauuucaaagcugauagagucauagacccaaggagaugucuaaaacccguuauauuaacggaugggccagagcgcgucauacuugcuggaccaaugccaguaacugccgcaagugcagcacagagaaggggacgaguaggucguaauccccaaaaggaaaaugaccaauauauuuuuacuggacagcccuuaaacaaugacgaggaccacgcucauuggacugaggcgaaaaugcuacuugauaauaucaacacaccggaagguauuauaccagccuuauuugaaccagaaagagagaaaagugccgcaauagauggcgaauaucgcuuaaaaggagagucacgaaaaaccuucguagaacugaugaggcgaggagaucucccagugugguuagcccacaagguugcaucagaagguauaaaguauaccgauagaaaaugguguuucgacggccaaagaaacaaucaaauacuugaggaaaauauggacguagaaauuuggacuaaagaaggagagaaaaagaaguugagaccgcguuggcuugaugcucguaccuauucagaccccuuagccuuaaaagaauuuaaagauuuugcggcaggacgaaaaagcauagcuuuagaccuaguuacggaaauuggaagagucccaacacauuuagcucacagaacacgcaacgcacuugacaacuuaguaauguuacauacaucagaacacggagggaaggcuuaucgacacgcgguagaggaacuuccagaaacuauggaaacacugcuacuucucggacugaugauucucuugacagggggagcuaugcuauuuuugauaaguggaaagggaaucggcaagaccucaauaggacuaauaugugugauugccucaucagguaugcuuuggauggcagaaauaccauuacaguggauugcauccgcaaucguauuagaguuuuucaugaugguacucuuaauucccgaaccagaaaaacaacggacuccccaggauaaucaacuagcauauguagucauagguauucugacacuagccgcuauuauugcagcgaacgaaaugggacuauuagaaacuacaaaaagagaucugggaaugucaaaagagccagguguaguuucaccuacuagcuaucuugauguugaccuccauccagccucagcuuggacuuuguaugcuguugccacgacaguaauuacaccaaugcuccgacauaccauugagaacagcacugcaaauguaucacucgcagcaauugcaaaccaagcugucguacuaaugggacuagauaagggcuggccaauuucaaagauggauuuaggaguaccauuacuugcacuuggcuguuauucgcaaguaaacccuuuaacucucacggcugcugugcuuuuauugauaacccacuaugcuauaauagguccaggauugcaggcaaaagcaacgcgcgaagcacagaaaagaacggcugccgguaucaugaaaaaucccaccguagaugguaucaugacaauagaccuggauccaguuauauaugacucaaaguucgaaaaacaguuaggccaagugauguuguuagugcuaugcgcuguucaguuauuacucaugcgcacaucaugggcacuuugcgaagcccuaacacuagcaacgggacccaucacaacgcuuugggaagguuccccuggcaaauuuuggaauacaacaaucgcggugucgauggccaacauauuccgaggaucauaccucgccggagcuggguuagcuuucucaaucaugaagaguguugggaccgggaaacgcggaacaggcagccaaggcgaaacccuaggugaaaaauggaaaaagaaacuaaaccaacuaaguaggaaagaauuugacuuauauaagaaaucaggcauaacagaaguggauagaacggaagcgaaagaaggauuaaaacguggagaaauaacgcaucacgcaguauccagggguuccgcaaaauuacaaugguuuguugaacggaauaugguaauaccggaagguagaguaauagaucuagguugcggacgaggcgguuggucguauuauugugcugguuuaaagaaaguaaccgaagugagaggcuauacaaaagguggaccuggucacgaagaaccugucccaaugucaaccuauggcuggaacauugucaaacuaaugagcgguaaagaugucuucuaucuuccgccagaaaaaugugacacacuucucugugauauuggagaauccaguccaaguccuacaguugaagaaucccgaacgauaaggguguuaaaaaugguagaaccauggcucaaaaacaaucaguuuuguauuaaaguacuuaacccuuacaugccuacaguaaucgaacacuuggaaagauugcaaaggaaacacggaggaaugcuaguaaggaacccuuuguccagaaauucuacccaugaaauguacuggauaaguaacggaacgggcaauauuguugccagugucaacaugguuucucgcuuguuguuaaaucgguuuacaaugacccaucguaggccaacaauagaaaaagaugucgauuuaggggcgggcacucgacauguaaacgcagaaccugagaccccuaauauggauguaauuggagaaagaauuaaaagaaucaaagaggaacauaauuccacauggcacuaugaugaugaaaacccuuauaaaacuugggccuaucaugguucauaugaagugaaggcaacagguagugccaguucaaugauaaaugggguugugaaacuccuaacaaaaccaugggauguaguaccaauggucacucaaauggcuaugacggauacgacaccauucggacagcaacgaguauucaaagaaaaaguugacacacgaacaccucggucaaugcccggcacuagaagaguaauggggauaacagcugaaugguuguggagaacccucggccggaauaagaaacccagacucuguacccgggaagaauuuaccaagaaaguaagaaccaaugcagcaaugggugccguauuuacagaagaaaaucagugggacucugcaaaagcggcuguagaggaugaagauuucuggaaacuuguagaucgugaacgagaacuccacaagcuaggcaaaugcgggaguuguguauauaacaugaugggaaaaagagagaagaaacugggcgaauuugguaaagcuaaaggcagucgugcgauaugguacaugugguuaggggccagauaucuagaguucgaggcuuuaggcuucuuaaacgaagaucacugguucucaagggaaaacucauauaguggcguugaaggagagggacuucacaagcugggauauauauugcgggacauuaguaaaauaccgggcggagcaauguacgcagaugacaccgcgggaugggauacacguauaacugaggaugaucuucacaacgaagagaaaauuacgcaacagauggacccugagcauaggcaauuggcaaaugcaauuuucaaacuuacuuaccaaaacaaagucgugaaaguacaaagaccaaccccugcaggaacgguuauggauauaauaaguagaaaagaccaaaggggaagcggucaaguugguacuuacggauugaauacauuuacuaauauggaagcacaauuaauacgccaaauggaaggugaaggaguacucucuaaggcagaucuugaaaacccacacuuacccgaaaagaaaauaacccaguggcuggaaacuaaaggaguugaacgccuaaaacgaauggcaauaucgggugaugacugugucguaaaaccuauagaugaucguuuugcaaaugcgcuauuagcacuuaaugacauggguaaagucagaaaagauauaccccaauggcaaccaucgaaaggcuggcacgauuggcaacaaguccccuuuugcagccaccauuuucacgagcuaauuaugaaagacgguaggaaauuagucguaccuugcagaccacaagaugagcucauaggacgcgcacgcauuucccaaggagcugguuggucucuacgagaaacagcuugucuugguaaagcauaugcgcaaauguggucccucauguauuuccacagaagagauuugcgccuagcaucaaaugcaauuuguucagcaguuccaguacacuggguuccaacaagucguacuaccugguccauccaugcacaccaucaguggaugacuacggaagacaugcuaacaguauggaaccguguguggauugaagauaacccauggauggaagacaagacgccaguaacaacuugggagaauguaccguaccuuggcaaaagggaggaucaauggugcgggaguuuaaucggcuugacaaguagggccacaugggcucaaaauauacccacugccauacaacaagucaggagcuuaaucggaaaugaggaauuucuugauuauaugccuucaaugaaaagauucagaaaagaagaagaaucugaaggagccauuugguga

SEQ ID NO: 23422 - RNA, 9873 nt, Artificial Sequence
  derived and/or modified CDS sequence (opt6) from DENV-3__FJ639791__SS-prME
acauccuuauguuuaaugaugauucuuccagcggcacuggcguuucaucugacaucaagagauggagaaccccgaaugaucguaggcaaaaacgaacgcggaaaaagucuauuauuuaaaacagcuagugggaucaauauguguacgcugauugcgauggaucugggugagaugugcgacgacacgguaacauacaaauguccgcauauaacggagguagaaccugaagauauagauuguugguguaauuugacaaguaccuggguaacauacggaacaugcaaucaggcgggagagcacagacgggauaaaagaucgguggcguuagcaccacacguaggaaugggacuagauacuagaacgcaaacuuggaugagcgcggagggagcauggcggcaaguagaaaaaguagaaacgugggcgcuuagacauccuggauuuacaauacuagcccuauuuuuggcccauuauauagguacaucccuaacucaaaaaguuguaaucuucauauugcuaaugcugguuacgccuuccaugacaaugcguugcgucggugucgggaauagagauuucgucgaaggacuaucgggggcuacauggguagaugugguacuagagcauggagggugcgugacuaccauggccaaaaauaagccaacacuagacauugaguuacaaaagacggaggcaacucaguuggcuaccuuacggaaacuaugcauugaggguaagauuacaaacauuaccacagauucucgauguccaacgcaaggggaggcagugcugccggaagaacaggaucagaacuacgucuguaaacauaccuauguugacaggggaugggggaacggaugcgguuuauuuggaaaagguaguuuagugacgugcgcaaaauuucaaugcuuagaaccaguggaagggaaaguaguacaauaugaaaaccuaaaauacacaguuaucauuacaguucacacgggugaucaacaccagguaggcaaugaaacacaagguguuacagcugaaaucacgccgcaagcauccacaacagaagcaauauuaccggaauauggcacauuagggcuagaaugcaguccaagaacuggauuggauuuuaaugaaaugauucuauuaacaaugaaaaacaaagccuggaugguucauagacaaugguucuuugacuuaccauuaccuuggacgucuggugcuacaacugaaaccccaacuuggaacagaaaagaacuccuagucacuuuuaagaacgcccacgccaaaaagcaagagguuguuguucuagguagccaagaaggcgcuaugcacaccgcucuaacaggcgcaacugaaauccaaaauagcggagggacuucuauuuucgcagggcaccuaaaaugucgauugaagauggauaaacuugagcucaaagggaugagcuaugcgaugugcaccaauaccuucguucugaagaaagaggucucagaaacucagcacggaacgauauuaauaaaagucgaauacaaaggagaggaugugcccuguaaaauccccuucaguaccgaagacggacaagguaaagcgcacaauggacgucuaauaaccgccaacccugugguuacuaagaaagaggaaccaguuaacauugaagcugaaccaccuuuuggagaaucuaauauuguaauuggcauaggagauaacgcucuaaaaauaaauugguauaaaaaggguagcucaauugguaaaauguucgaagccacugcucguggugcacgaagaauggcuauccuaggagauacugccugggacuucggaucaguaggagguguguuaaacagucuggguaagaugguacaccagauauuuggaagcgcuuacacugcacuauuuucgggagucucauggguaaugaaaauaggcauugguguacucuuaacguggauagguuuaaauucuaaaaauaccucuaugaguuuuaguugcaucgcaauagguaucauaacccuuuauuuaggagcagucguacaagcagacaugggaugcguuauaaauuggaagggaaaagaauuaaaauguggaucaggcauuuuuguaaccaacgaaguucauacauggacggaacaauauaaguuucaggcagacucacccaaaagauuagcuaccgcuauagcgggugccugggaaaauggcguauguggcaucagaaguacaacaagaauggaaaaucuacucuggaaacaaauagcaaacgaauuaaauuacaucuuaugggaaaauaacauuaaacuaacaguaguagucggagauauaauugggguguuagaacagggaaaaagaacucuuacaccccagcccauggaauuaaaguacagcuggaagacauggggaaaagcuaaaauugugacggccgaaacucaaaauuccuccuuuaucauagaugggccaaacacacccgaauguccaucagccucaagagcauggaacgucugggaaguugaagauuacgguuucggagucuuuacaacuaauaucugguuaaaauugagagaagucuacacacaauuaugugaccaucggcugaugucagcugcagucaaagaugaaagggccguucaugcagauaugggauacuggauagaaucccagaaaaauggcucuuggaaauuagaaaaagcuagccuuauugagguaaagacuugcacuuggccaaagagucauacucuuuggucuaaugguguccuagaaucagauaugauuauaccaaaaucacucgcagggccaaucucacaacauaacuauaggcccggauaccauacucaaacagccggcccauggcaccugggaaaguuggaacuugauuucaacuacugugaaggaacuacaguugucaucacugagaauugcggaacaagagguccaucacugcgcacaacgacagucagcggaaaauuaauacacgaaugguguuguagauccuguacacuaccuccuuuaagauacaugggggaagaugggugcugguauggaauggaaauuaggcccauuagcgagaaagaagaaaacauggucaagucguugguaagcgcggguagcggagaagucgacaacuuuacuaugggggugcuauguuuagcaauacucuucgaagaaguaaugcguggcaaauucgggaagaaacauaugauugccgguguauucuuuacauuuguuuuauuauugagcgggcagaucaccuggcgagauauggcucacacacuuaucaugaucgggaguaacgcaucagaucggauggggaugggggugacauauuuagcauuaauagcaacauucaaaauacaaccauuuuuagcauuagguuucuuucuuagaaaguuaacaucgagagagaaccuucuauuaggaguuggauuagcuauggccacuacauugcaacucccagaagacauugaacaaauggcaaacggaauagcccugggucucauggcguugaaacuuaucacacaauuugaaaucuaccaacucuggacugcacuaauaagccugacuugcagcaacacaauauuuacucuuacagucgccuggaggacagccacacugauauuagcugguguuagccuucuuccaguuugucaaucuaguucuaugagaaaaacagauuggcuaccaaugacaguagcggcuaugggugucccgccguugccucuauucauuuuuaauuuaaaagauacguuaaagcgacgaucuuggccacugaaugaagguguaauggcaguugguuuaguuaguauccucgcaagcagccuacuucgcaaugauguaccgauggcaggaccauugguagccggaggccuauuaauagcauguuacguaaucacaggaacuucggccgauuuaacaguagaaaaagcagcagaugugacuugggaagaagaagcugagcagacaggaguaagccauaaucuaaugauuacuguggaugacgacggaacaaugcgaauaaaagaugaugaaacugaaaacauccuuacaguucucuuaaaaacugcucuuuuaauaguaagcggaauauuccccuauaguauuccggcuacgcuauuaguauggcauaccuggcagaagcaaacgcagaggagcggaguacucugggacgugccaagucccccagaaacacaaaaggcagaacuagaggagggaguguaccgaauaaaacagcaaggaaucuucgggaaaacacagguuggaguugguguacagaaagaaggcgucuuccauacaauguggcauguaaccaggggagcuguacuuacauacaacggaaaaagauuagaaccaaacugggcauccgucaagaaagaccuaauaagcuauggcgggggauggcgacuuuccgcucaauggcaaaaaggggaagaaguacagguaauagcuguugaaccgggcaaaaaucccaaaaacuuucaaacaaugccgggcacauuucaaacaacaacgggagaaauaggagcgauagcauuagauuuuaaacccgggacgaguggauccccuauaauaaauagagaagguaaagucguaggguuauacggaaacggggugguuaccaaaaauggggguuacguuuccggaauagcacaaacaaaugcagaaccggauggaccaaccccagaauuagaagaagaaauguuuaagaagagaaacuugacaauuauggaccuccauccugguucgggaaaaacacguaaauauuugcccgccauagugcgcgaggcgauuaaacguaggcuaaggacuuuaauacuagcacccacaagggugguagcugcagaaauggaagaagccuugaaaggacucccuauuagauaccagacgacugcgacaaaaucagaacauacuggccgggaaauaguugauuuaaugugccacgcgacguuuacuaugcgacuauuaucaccagugcggguuccaaacuauaauuugauaauuauggaugaagcucauuuuacagauccugcuucgaucgcugcgaggggcuauauuaguacacgcguaggaaugggagaggccgcugcaauauuuaugacugcuacacccccugggacagcugacgcauucccacagaguaaugcuccuauacaagaugaggaacgcgacauacccgaaagaucuuggaauagcggaaaugaauggaucacggacuuugcuggcaagacuguuugguuuguacccuccaucaaagcaggcaaugauauagccaauuguuuaagaaagaaugguaagaagguuauucaauuaagccggaaaacauucgauacugaguaccagaaaaccaaacucaacgauugggauuuuguugucaccacggacauuagugaaaugggagcgaauuucaaagcagaccgcgucauugauccacgucgauguuuaaaaccuguaauauuaacugaugggccagagcguguaauacuagcaggcccaaugccaguaacugcggcgagcgcggcucagaggcguggucgggugggaagaaauccccaaaaagagaaugaucaauauauauucacgggucagccuuuaaauaaugaugaggaccacgcacauuggaccgaggcaaaaauguuacuggauaauauaaauacaccagaaggaaucauaccugcauuauucgaaccugaacgagagaaaagugcggcaauagauggcgaguauagauugaaaggggagucaagaaaaaccuucguugaauuaaugcgaagaggagaucuaccuguuuggcuugcacauaagguagcaucugaaggaauuaaauauacagacagaaaaugguguuucgauggucagcggaacaaucaaauacucgaggagaauauggauguugagaucuggacuaaggaaggagagaaaaagaaacuuaggccacgaugguuagaugcgcguacguauagugacccgcuugcacugaaagaauuuaaagacuucgcugcagggagaaagagcauagcccucgaucuagucacugaaauaggaaggguaccaacacaccuggcacaucguacaagaaacgcauuagauaaucuagucaugcuacacacuucugagcaugggggaaaggcuuaccgucacgcugucgaggaauuaccugaaacuauggagaccuuauugcuucuuggucuuaugauauuacugacuggcggugcuauguuauuucugauuucuggcaaaggaauugggaaaacuucaaucggccuaauauguguaauugccuccagcggaaugcucuggauggcugagaucccacuacaauggauagcgucagcgauaguuuuagaguucuuuaugaugguacuacucauccccgaaccagagaaacaaagaacuccacaagauaaucaguuagccuacguggugauuggaauauugacacuagcggcgauaaucgcugccaaugaaaugggacuacuggaaacuaccaagcgugaucuuggaaugagcaaagaaccggguguaguuucuccaacaucuuauuuagauguggaccuucaucccgccagugcuuggacccuuuaugcggucgcaacuacaguuauaacuccgaugcuaagacacacuauagaaaauagcacugcaaauguaucgcuagcagcuauagcuaaccaagcaguggugcucaugggccuugauaaaggauggccaauuaguaaaauggaccuugguguuccacuucucgcgcucgguugcuacucacaaguaaauccccugacgcucacagccgcggugcugcuacuaauaacucacuacgccauuaucggacccggacuccaggcaaaagcgacaagagaggcacagaaaaggacagccgcagguauuaugaaaaauccaacgguggauggaauaaugacaauagaucuagacccaguaauauacgauucuaaauuugagaagcaacuuggacaagucaugcuuuuaguauuaugcgccguccaacuuuugcuuaugaggacaagcugggcuuuaugugaagcauuaacacucgccacugggccaauaacaacauugugggaaggaucaccagggaaauuuuggaauaccaccauagcugugucgauggcaaauaucuuuagaggaagcuauuuggcaggagcaggauuagcuuuuagcauaaugaaguccguuggcacagguaaaagagggacggguagucagggagaaacacuuggagaaaaauggaagaagaaacuaaaccaguugucgagaaaagaauuugaucucuauaagaaaucaggcauaacagaaguagacagaaccgaagcgaaagagggcuugaaaagaggagagauuacgcaccaugcagucucacgagguucggcaaaauuacaaugguucguagagcggaauaugguaauuccugaagggaggguuauugacuuagguugcggaagaggagguuggucguacuauugugcuggacucaagaaaguuacagaaguuaggggauauacuaaaggcgguccuggucaugaggagccgguaccuaugucuacuuacgguuggaauauaguaaaguuaaucagcggaaaagaugucuuuuacuugcccccagaaaagugugauacuuuacuuugcgacauuggggaauccagcccaucucccacaguugaagaaucuagaacaauaaggguuuuaaaaaugguugaaccauggcucaaaaauaaucaauucuguaucaagguguuaaacccguauaugccaacaguaaucgaacaccuagaacgacuucagagaaaacauggaggcauguuaguucggaauccauuaucaagaaacucaacucacgagauguauuggauauccaacggaagugggaacaucguugccucuguaaacaugguaucaagauuacucuugaaucgguuuacuaugacccaccgacgacccacaauugaaaaagauguggaucuuggagcuggaacacggcauguaaacgcugaaccagaaacacccaacauggacguuauaggagaacgaauuaaaaggauaaaagaagaacacaauucaacauggcauuacgaugacgagaacccuuauaaaacgugggcguaccauggguccuaugagguaaaagcaacaggauccgcuucaucaaugauaaacggaguuguuaaauuacuaaccaaaccaugggauguaguaccaaugguuacucaaauggcgaugaccgauaccacaccauucggacaacaaaggguauuuaaagaaaaaguagacacgagaacaccgaggucuaugccuggaacgagaaggguaauggggauaacagcagaauggcuuuggagaacguuaggaagaaacaagaaaccaagauuguguacucgagaagaguuuaccaagaaaguuagaaccaacgcagcaaugggagccguauuuacugaagagaaucaaugggauucggcaaaagccgcgguagaagacgaggauuuuuggaagcuaguagaucgugagcgagagcuacauaaacucggaaaaugugguucgugcguguauaacaugaugggaaagcgggaaaagaaauuaggugaauuugguaaagcaaaagggucgagggcaaucugguauaugugguuaggagcaagguauuuagaauuugaggcccugggauuuuugaaugaagaucauugguucucacgagagaauaguuauucaggcguugagggggagggauuacacaaguuaggauauauucuuagagauauuuccaaaauaccaggaggagcaauguacgcugaugauacggcaggaugggacacuagaauuacagaggaugaucuacacaacgaggaaaagauaacacagcaaauggacccagaacacagacaauuagcaaacgccauauuuaaauugacauaccaaaauaagguagugaaagugcaacgaccaacaccuacugguacaguuauggauauaauaucacgcaaagaucaaaggggcaguggucagguagguaccuauggauuaaauacauuuacaaauauggaggcgcaauuaauccgccaaauggaaggagaaggcguacucaguaaagcggacuuagaaaauccacaccuaccugagaagaagauaacucaguggcucgaaacuaaaggaguagaaagacuaaagaggauggccaucucgggagacgauuguguuguaaaaccaauugaugauagauuugcuaacgcauuguuagcgcuaaacgacauggggaaaguaaggaaggauauuccccaauggcaaccuucgaaaggguggcacgauuggcaacaagucccauucuguagucaucacuuccaugaacuuaucaugaaagacggacguaagcucguaguaccauguagaccucaagaugagcuaaucggucgagcucgaauuucccaaggugcaggcuggucgcuacgagaaacugcgugcuuagggaaagccuacgcacaaauguggucuuugauguauuuucacagaagagaccuucgauuggcuagcaaugcaauuuguucugcagugccaguacauuggguuccaacuucccgaaccacauggagcauacaugcacaucaccaauggaugacaacugaagauauguuaacuguauggaauagaguauggauagaggacaacccuuggauggaagauaaaaccccaguaacuacaugggaaaauguuccauaucugggaaaaagagaggaucagugguguggcucacugaucggccucaccagucgcgcaacgugggcacagaauauaccuacggcaauacaacagguaaggagcuugauuggcaacgaggaguuuuuagacuacaugccaagcaugaaaagauuucguaaggaagaggagagcgagggagcaauaugguaa

SEQ ID NO: 23423 - RNA, 9873 nt, Artificial Sequence
  derived and/or modified CDS sequence (opt6) from DENV-3__FJ639792__SS-prME
acgaguuuauguuuaaugaugauacuccccgcugcacucgcauuccaccuaacuagccgagauggagaaccuagaaugauaguugguaaaaacgaacgagggaaaagccuucuuuuuaaaacugcaagugggaucaauauguguacuuugaucgcgauggaccuaggagaaaugugugaugacacuguaacuuacaaaugcccacauauaacggaaguagaaccugaagauauagacugcugguguaauuugacaagcacuugggucacuuauggcaccuguaaucaggcuggagaacaucguagagauaaaagaucuguggcuuuagcaccucaugucgguauggguuuagauacacgaacucaaacuuggaugucagcggaaggugcuuggcgacaagucgaaaaaguagaaacaugggccuugcgccacccuggauuuacaauacuugcguuguuuuuagcacacuauauagguacaucgcuaacucaaaaaguagugauuuuuauauuauuaauguugguaacuccgagcaugacuaugcguugcgucggcguggguaacagggauuucguagaaggcuuaaguggugcaacauggguugaugucguguuggaacacggaggcugcguuacaacaauggccaaaaacaaaccuacuuuggauauagaauuacagaaaacugaagcuacacaacuugccacuuuaaggaaauuauguauagaagguaaaauaaccaacauaaccacggauagccgguguccuacacaaggcgaagcaguguuacccgaagaacaagaccaaaacuacguaugcaaacacacguacgucgaccgggguuggggcaacggauguggacuauuugguaaagguuccuugguaacaugugccaaauuucaaugucuggaaccgauagaaggaaaagucguccaauaugaaaaucuuaaauacaccgucaucauaacggugcacaccggagaccaacaccaaguaggaaacgaaacacaagguguaacugcugaaauaacaccacaagcaagcacuacagaagcaaucuuaccagaguacgguacauuaggccuagaaugcaguccacggacgggccuagacuuuaacgagaugauacuuuugacaaugaaaaauaaagcauggaugguacacaggcaaugguucuucgacuuaccauuaccauggacuagcggcgccacuacugagacgccuacuuggaauagaaaagaacuucuagucacauuuaaaaacgcgcaugcgaagaaacaggagguaguuguccucggcucacaagaaggugcaaugcacacggcucuuacgggagcuacagaaauacaaaauucgggagggacaaguauauucgcuggccauuuaaaaugccgucuuaaaauggauaaacuugaauuaaaaggaaugucuuaugcuauguguacgaauacauucgucuugaagaaagaaguaucagagacacaacacggcacaauccuaauaaaaguagaguacaaaggcgaagauguaccguguaaaauuccauucucaacagaggacggucaagguaaagcacauaacggaagauuaauaaccgcgaaccccgucguaaccaagaaagaagaacccguaaauauagaagccgaacccccuuucggagagucgaacauagucaucggcaucggagacaacgcacucaaaauuaauugguacaagaaagggucaucaauagguaaaauguuugaagcaacagcuagaggagcgagaagaauggcgauauuaggagauacagcaugggacuuugguucagugggagguguccugaauagccuggguaaaaugguacaccagauuuuugggucagcuuacacugccuuauucucaggcguaagcugggucaugaaaauugguaucgguguccuacuaaccuggauuggacuaaauuccaaaaauacaucaaugagcuucucaugcauagccauagguauuauaacauuguauuugggugcaguaguccaagcagauaugggcugugugauuaacuggaaagguaaagagcuuaaaugugguucuggaauuuuugugaccaacgaaguucacacuuggacggaacaauauaaauuucaagcugauucaccaaagcgucuggcuacggcgaucgcgggagccugggagaauggaguuugcgggauacgaagcacgacccggauggaaaacuuacuauggaaacagaucgcaaaugaauugaauuauauucuaugggaaaauaauauaaaacuaacgguaguuguuggagacauaauaggcguacucgaacagggaaagagaacucuuacaccacaacccauggaacugaaauacucauggaaaacauggggaaaagccaaaaucgugacagcggaaacacagaauaguaguuucauaauagacggacccaacacgccggaaugcccuucggcuucgagagcauggaaugugugggaaguggaagauuauggcuuugggguauucacuacgaauauuuggcuuaaguuacgugaaguauacacacaacuaugugaccaucgauuaaugucagcugcaguaaaggaugaaagggcagugcacgcagauaugggauauuggauagagucucagaaaaauggaucguggaaauuggaaaaagcaucuuuaaucgagguuaaaacaugcacuuggccaaaaucucacacguuauggaguaacggaguacucgaaucagauaugauaauaccaaaaaguuuggccggcccaauaagccaacauaauuaucgucccgguuaccauacacaaacggcuggaccauggcauuuaggcaagcucgaacuagauuucaauuacugcgaaggcacuacaguagucauuacagaaaauuguggaaccagaggaccauccuugagaacuacaaccguaucgggaaaauuaauacaugaauggugcuguagauccuguacacugccucccuugagauauaugggcgaggaugguuguugguauggaauggaaauuagaccaauuucggaaaaggaggaaaacaugguaaaaucacuuguaucggcggguuccggugaaguagauaacuuuacaaugggaguacugugccuagcaauccucuuugaggaaguaaugaggggaaaauuuggcaagaaacauaugauugcugguguuuucuuuacguucguguuacuucuuucaggccaaauaacauggagagacauggcacauacauuaaucaugauugguucuaacgcuucagaccggaugggcaugggaguaacauauuuagcacuaauagcaacauuuaaaauacaaccguuucuagcguuaggauucuuucuuagaaaauuaacuucacgagaaaaucuacugcuaggcguggggcuagcgauggcgaccacucuacaacuaccugaggauauugaacaaauggcaaauggaauugcacugggacuaauggcuuugaaauuaauuacgcaauuugagacauaucaacuguggacagcguuaauaaguuugacuuguucaaauacaauuuuuacacuaacuguugcguggagaaccgcaaccuugauacuggcuggaguaucauuauuaccaguaugccagaguucuucaaugcgaaagacggauuggcuaccaaugacaguagcagcuaugggaguuccaccacucccguuguucauauuuucucuaaaggauacccuuaaaaggaggagcuggccguuaaaugaaggcgucauggcuguuggcuuaguuaguauauuagcgucaucgcuuuuaaggaaugacguacccauggcugggccuuugguugccggaggauuacucauagccuguuauguaauaacagguacaucagcggaucucaccguagagaaggcugcugacguaaccugggaagaggaagcugaacagaccgguguaucacauaaucuaaugaucacaguagaugacgacggcacaaugcguaucaaagacgaugaaacugaaaauauuuuaacaguccuuuuaaaaacugcauuauuaauaguaucugguauuuuuccauauucgauuccugcgacuuugcuaguauggcacaccuggcaaaaacaaacucagagaucgggcgugcugugggaugucccaucaccgccagagacucaaaaagcagaauuagaagagggaguuuaccgaauaaagcagcaagguauauuuggaaaaacccaaguaggcgucggaguacagaaagagggagucuuucauaccauguggcacgugacucgaggcgcgguguuaacacacaauggcaagaggcucgaaccuaauugggcuaguguuaaaagagauuuaauaaguuacgggggcggauggcggcuuucugcucaguggcaaaagggggaagagguacaaguaauagcaguagaaccgggcaaaaaucccaaaaauuuucaaaccaugccaggcacauuccaaacuaccacaggagaaaucggagcuauagcacucgauuuuaaacccgggaccucaggaucgccuauaauaaacagagaaggaaaaguagucggacuuuacggcaacggaguagucacuaaaaacgggggauaugugagcggaauugcacagaccaaugcggagccugaugguccgacaccagaauuggaagaagaaauguucaagaaacgaaacuuaaccauaauggauuuacauccaggaagcggaaaaacuaggaaauaucuaccugcuauaguaagagaagcaauuaagagaagauuaagaacccugauucuagcaccgacaagaguuguggcugccgaaauggaggaagcauuaaagggauuaccuauacguuaucaaacuacugcaacaaaaucugaacacacuggaagagaaauuguugaccucaugugccacgcuaccuucaccaugaggcugcuaucaccugugcgugugcccaauuacaaucugauaauuauggaugaagcccacuuuacagacccggcuucuauugcugcaagaggauauaucaguacacguguugguaugggggaagccgccgccauuuucaugacugcaacacccccugguacggccgaugcguuuccacagucuaaugcuccgauucaagacgaggaaagagauauacccgaaagaucauggaacucaggcaaugaguggaucacggacuuugcagguaaaaccgugugguuuguuccaaguauaaaagcagguaacgauauagcaaauugucuaagaaagaacgguaaaaaggugauacaacuauccagaaaaacguucgauaccgaguaccagaaaacuaaacuaaacgauugggauuucguuguaacuacugacauaucugaaaugggcgcgaacuuuaaagcugauagggucauugauccaagaagaugcuuaaaaccaguaauacugacugauggaccagaaagaguaaucuuagcgggcccuaugcccguaaccgcggcaagcgcugcacaacgacgcggaagagucggacgaaauccccaaaaagagaacgaucaauacauuuucacaggucaaccucugaauaaugacgaagaucacgcgcauuggaccgaagcaaaaaugcuuuuggacaacauaaacacgccagaaggcauaauuccugcauuguucgaacccgagcgagagaaaagcgcggcuauagauggggaauauagguuaaagggagaaagcagaaagacuuuugucgaacuaaugcggcgaggugaccuucccguuuggcuagcguacaagguagcaucugaagggauaaaguacacagacagaaaaugguguuucgauggacaaagaaacaaucaaaucuuggaggaaaacauggacguggagauauggacaaaggaaggugagaagaagaaacuaaggccucgguggcuagaugcucguaccuauagugauccucuggcauuaaaagaguucaaggauuuugcagcaggacgaaagucuauagccuuggaccuuguaacagaaauaggaaggguuccaacccaucuagcccaccgaacacgaaaugcauuagauaauuuaguaauguuacauacaagugagcauggugggaaagcauauagacaugccguugaagaacuuccugaaaccauggaaacuuuacuauuacuaggacuaaugauacuccuaacugguggggcaaugcuauuucuuauaucggguaagggaauagguaaaacuucaaucggccuaauuuguguuauagcuagcucaggaauguuauggauggcagagauaccacuucaauggauugcgucggccaucguauuagaguucuuuaugaugguacuuuuaauaccagaaccggaaaaacagcgaaccccacaagacaaccaacuugcauacguuguaauaggaauuuuaacacuggcggcaauuauagcggcuaaugaaaugggacuccuagaaacuacaaaaagggaucuugggaugucuaaagaaccaggaguuguuaguccaacaucauaucucgacguagaccuccacccggcaagcgcguggacuuuauaugcaguagcaacaacaguaauaacaccaauguuacgacauacuauugaaaauucaacagcaaacguuucucuggcugcuaucgcuaaucaagcgguaguuuuaaugggauuagauaaaggcuggcccauuucaaaaauggauuuggguguaccacuuuuggcccuagguugcuauucacagguuaauccauuaacauuaaccgcagccguauuacuccucauaacccauuaugcaauuaucggaccuggauugcaagcaaaagcuacgagggaagcucaaaagcgcacagcugccgguauuaugaaaaacccaacaguugauggaaucaugacgauugauuuagauccugugauauacgacucaaaauucgaaaaacaguuaggacaaguuaugcuuuuaguauuaugcgccguccaacuacuacucaugcgaaccucgugggcauuaugcgaagcccuaacucucgcgacgggaccaauaacuacacucugggaagguuccccggguaaauucuggaauacuacaauugcaguaucgauggcuaauauauucagagggaguuaccuagcuggagcaggacuugcauuuucuaucaugaaaagcguagguacagguaaacgugguacugguucccaaggugaaacacuaggggaaaaauggaagaagaaacuuaaccaauuaagccguaaagaguuugaccuuuauaagaaaaguggaauaacugaaguagaccgcacagaagccaaagaaggucugaaaagaggagaaauuacucaucaugcuguaagucgagggucagcaaaauuacaaugguucgucgagcgcaacaugguaauacccgaaggcagagugauagaccuaggauguggucgcgguggcuggagcuauuacugcgccggacuaaagaaaguaacugaagucagagguuacacuaaagguggaccaggacaugaagaaccagugcccaugucuacuuaugguuggaauauuguaaaacuuaugagugguaaagacgucuuuuaucuaccgccagaaaaaugugacacguuauugugugacauuggugaaucaucucccucuccaaccguagaagagucuagaaccaucaggguacuaaagaugguggaaccuuggcugaaaaacaaccaauuuugcaucaaaguucuuaauccguauaugccuacggucauagaacaucuagagagauugcagagaaaacauggagguaugcugguaagaaauccacuuucacgaaacucuacccaugagauguauuggauuucaaacgggacgggaaacaucguugcuucgguaaacaugguuucgcgauuguuacucaacagguuuacuaugacacacagacgaccuacaauagaaaaagacguggaccuaggugccggaaccagacauguaaacgccgaacccgagacccccaacauggaugucauuggagagagaauaaagcggaucaaagaagaacacaacucaacuuggcacuacgacgaugaaaauccauauaaaacgugggcuuaucaugguucauacgagguaaaggcuaccggaagugcuucaaguaugauuaauggcgugguuaaauuacuaacaaagcccugggacguuguaccuauggugacccagauggcaaugacagauacaaccccauucggacaacagaggguauuuaaagaaaagguugacacuaggacgccccguucaaugcccggaacucgaaggguaaugggaauaacagcagaauggcucuggagaacauugggaagaaacaaaaagccaagguuaugcacaagggaagaguucaccaagaaaguacggacuaaugccgcaaugggugcagucuuuaccgaggaaaaccaaugggacuccgccaaagccgcaguagaagaugaagacuuuuggaaguugguugaccgagaaagagaauuacacaaauuagguaaguguggaucaugcguauauaacaugaugggaaagcgagagaagaaauuaggggaauuugggaaagccaagggaucucgcgcaauaugguauaugugguuaggagccagauauuuggaguucgaagcacuuggcuuucuaaacgaagaucacugguuuagcagagaaaacucuuacagcgggguggaaggugagggauuacacaaauuaggauauaucuuaagggacauuucaaaaaucccagguggagcgauguacgcugacgauaccgcaggaugggacacacgaauaacagaagaugauuuacauaacgaagagaaaaucacacagcaaauggauccugagcacagacaauuagcuaaugcuauuuuuaagcugacauaccaaaauaagguaguuaaaguacaacgaccaacaccaaccggcaccguuauggauauaauuucaaggaaagaccagcgaggauccggacaagucggaaccuauggacucaacacguuuacaaauauggaagcucaauuaauaagacaaauggaaggggaagguguacucucuaaagccgacuuagaaaacccacauuugccagagaagaaaauuacucaaugguuagaaacaaaaggaguugaaagauugaaacguauggcaauuucuggcgaugacugugucguuaaaccuauagaugaucgguuugcaaaugcucuacuagcccuaaaugacaugggaaaaguccgaaaggauaucccgcaauggcaaccaucgaaaggauggcacgauuggcaacaggucccauuuugcucacaucacuuucaugaauuaaucaugaaggauggacggaaguugguuguaccuugcagaccucaagacgaacuuauagguagagcucggaucucacagggugccggauggagccuucgugaaacagccugccucggaaaggcuuacgcacaaauguggucguuaauguauuuccauagacgagacuuaagacuugccuccaacgcgauaugcucugcuguaccgguacauuggguaccaacaagucgaacaacguggucaauccacgcacaucaccaguggaugacaacggaagacauguuaacaguauggaacagaguauggauugaagauaauccauggauggaggauaaaacccccguuacuacgugggaaaacguaccuuaccuagggaaacgggaggaucagugguguggaucacuuauuggucuaacaagucgugcuacaugggcacagaauauuccaacagcuauacaacaaguaaggaguuuaauaggcaacgaggaguucuuggauuacaugccgagcaugaaacgcuuucggaaagaagaagaaucagaaggagcaauaugguag

SEQ ID NO: 23424 - RNA, 9873 nt, Artificial Sequence
  derived and/or modified CDS sequence (opt6) from DENV-3__FJ639793__SS-prME
acaagccuuugucuaaugaugauacuaccagcaacacuggcauuucaccuuacgucacgcgauggagaaccacggaugaucguagggaaaaacgaaagaggaaaaucccuucuauucaaaacugcgucaggaauaaauaugugcacauugauagcgauggauuuaggugaaaugugugaugauaccguuacauauaaauguccgcacauaacagaaguggaaccggaagauauagauugcugguguaaucuaacaucuacauggguuacauauggcacaugcaaucaagccggugaacaucggcgagauaaacggucuguagcguuagcaccccauguagggaugggacucgacacacggacucaaacauggaugucagcagaaggagcuuggcgacaaguggaaaaaguggaaaccugggcucuacgccaccccggauucaccauucuagcuuuguuucuggcgcauuauauugguacaucauugacccaaaaaguaguaauauucauacuauuaauguuaguaacuccgaguaugacuaugcgguguguugguguuggaaauagagauuucguugaaggguuaucaggggcaacuuggguagacguaguccuugaacacgguggauguguaacaaccauggccaaaaacaaacccacacucgacaucgaauuacagaaaacugaagcuacccaguuagcaacccuacguaaacuaugcauagaaggaaaaauaacaaacaucaccacugauucaagaugucccacccaaggugaagcuguacucccagaagaacaagaccaaaauuacguuugcaaacauaccuacgucgacagagguuggggcaaugguugugguuuguuugguaaagggucauuagucacaugugcuaaauuucaaugccuugaaccuauagaagggaaaguaguacaauacgaaaaucucaaauauacaguaauaauaacagugcacaccggagaccaacaucagguaggaaaugagacacaaggcguuacugcagagauuacgccacaagcaaguacuacggaagcaauccucccagaauauggaacuuuagguuuggaguguagcccuaggaccggacuagauuuuaacgaaaugauauugcugacaaugaaaaauaaagcguggaugguucaucgccaaugguucuuugacuuaccauuaccguggacaagcggcgcuacuaccgaaacaccgacauggaaucgaaaagaacugcuaguuacauuuaaaaacgcacaugcgaagaaacaagaaguuguggugcuagggucucaagaaggcgcgaugcauaccgcacuaacaggagccacugaaauacaaaauucgggcggaacuucgauauuugccggacacuugaaaugucgccugaaaauggacaaacucgaauugaaaggaaugucauaugcaauguguaccaauacauucguacucaagaaagaaguuagcgaaacacagcauggcaccauacuuauaaaaguggaguauaaaggagaggauguaccauguaaaauaccguucucuacugaggauggacaaggaaaagcacauaaugguagauuaauuacggccaacccaguagucacgaagaaagaagaacccgugaauauugaagcugaaccaccauuuggcgaaaguaauauuguaauaggaauaggugauaacgcauuaaaaauaaacugguacaagaaaggaucaucaauaggaaaaauguucgaagcgacagcccguggggcacggaggauggcgauucucggugauacagcgugggauuuuggcucaguggguggaguccuuaauagccuaggaaaaaugguacaccagauauuuggcagcgcuuauacggcacuauuuucugguguuucguggguaaugaaaauaggcauuggcguccuucuaacguggauaggguuaaauagcaaaaauacuucaaugucauucucuugcauagcuauuggaauaaucacauuauauuuaggcgcaguggugcaggcggauaugggauguguuaucaauuggaaagggaaagaacugaaaugugguagcgguauauuuguaacgaacgagguucauacguggacugaacaauauaaauuccaagcugauucgccgaaaagguuagcaacagcuauagcuggagccugggaaaacggagucugugguauaagaucuacaacgcgaauggaaaauuuauuauggaaacaaauagcaaacgaacuuaauuauauccuuugggaaaauaauaucaaauuaacaguaguugugggagacauaauugggguguuagaacaaggaaaacgaaccuuaacuccgcagccaauggaauuaaaauauucauggaaaacuuggggcaaagcuaaaauagugacugcagaaacucaaaauucaaguuucauaauagauggcccuaacacgccagaauguccgucggcaagucgugcauggaaugucugggaaguagaagauuaugguuuuggaguauuuaccacaaacauuuggcuuaaacuucgugaaguguacacgcaguuaugugaccauagacuuaugagcgcagcgguaaaggacgaacgggcaguucacgcggauaugggauacuggauugaaagccagaaaaauggcagcuggaaacuagagaaagcaucacuuaucgaaguuaagacauguaccuggccgaaaagccauacacuauggagcaauggaguauuggaaucagacaugaucauaccaaagagcuuagcaggaccaauaagccagcauaacuaucggccuggauaucauacacagaccgcaggucccuggcauuuagggaaacuggaauuagauuucaacuacugcgaaggaacaacuguaguaauaacagaaaauuguggaacgcgcggcccaagccuaagaacaacuacaguaucuggcaaguuaauacaugaaugguguugucgcucaugcacauuaccacccuugagguacaugggagaagaugguuguugguacggcauggaaauacguccaacuucagaaaaagaagaaaauauggucaaaagucugguguccgcuggcagcggcgaaguagacaacuuuaccauggguguucuuuguuuagcaauauuguuugaggaaguaaugcgcggaaaguuugggaagaaacauaugauagccgguguguuuuucacauuuguauugcuuuuaucuggacaaauaacauggcgagacauggcacacacacucauaaugauagguaguaaugcaagugauagaauggggaugggcgugaccuaucucgccuuaauugcuacuuuuaaaauucagcccuuccucgcguugggauucuuccuccggaaauuaacaucgcgggagaaccuauuacuuggugucggauuggcuauggcaacaacguuacaauugccugaggacaucgaacaaauggcuaauggaauugcucuaggacuuauggcauuaaagcuaaucacacaauuugaaaccuaucaauuauggacugcccuuauuucucuuacauguagcaauacuauauucaccuugacaguagcuuggagaacagcaaccuuaauucuagcaggaguuaguuuacucccggucugucagucaucgucaaugcguaaaacggauuggcuuccaaugaccguagcagcgaugggcguuccaccacucccauuauucauauucucacuuaaggacacccuuaaaaggcgcucuuggccccuaaacgagggugucauggcggucgggcuuguuaguauacucgcgucuaguuuauugcgaaaugacguaccaauggcugggccucuaguggcuggaggguuacuuaucgcuuguuacgucauaacggggaccucagccgauuugacagucgaaaaggcagccgaugucacgugggaagaagaagcagaacaaaccggaguaagccauaauuuaaugauaacaguagaugacgauggaacgaugcggauuaaagaugaugaaacugaaaacaucuugacaguucuucugaaaaccgcuuuguugauaguaagcggaauuuuuccauauucgauuccggcaacucuauuaguauggcauacguggcaaaaacagacacaacguucaggugucuugugggauguuccaagucccccugaaacacaaaaggccgaauuagaggagggcguuuauagaauaaaacaacaaggcaucuuuggaaagacacaagugggaguuggugugcaaaaagaaggggucuuucauacuauguggcaugucacaaggggagccguucuuacauacaacgguaaaagauuagaaccaaauugggcuagugugaagaaagauuuaaucucuuacggaggcggguggaggcuaucugcacaguggcaaaaaggugaagaaguucaaguuauagcgguggaaccgggcaaaaaucccaaaaauuuucaaacuaugccaggaacauuucaaaccacaaccggggagaucggugccauugcucuugacuucaaacccggaaccaguggguccccaauaauaaacagagaagggaagauaguaggauuguacggaaacgguguaguaaccaaaaaugggggauacgucucgggaauugcucaaaccaaugcagagccugacggaccuacaccugaauuagaagaagaaauguucaagaaacguaauuuaacaauaauggacuugcauccagguucuggaaaaacacgaaaauauuugccagccaucguacgcgaagcaauaaaaagaagacucagaacuuuaauccucgcgccuacaagaguaguggcagcagagauggaagaagcguuaaaaggacucccgauaagauaccaaaccacagcaacuaagagugaacauacaggcagagaaauaguagaccuuaugugucaugcuaccuuuacaaugagauugcuaaguccaguucgagugccuaauuacaacuuaauaauaauggacgaagcacauuucacagacccagcuaguauugcagccaggggauacauuucaacgcgaguaggcaugggagaagcagcagcuauauucaugacagcaaccccaccgggaacagcagaugcguucccccagucaaaugcgcccauacaggaugaggaacgagauauaccugaaagaucguggaauagcgguaacgaauggauaacagauuuugcaggaaaaacuguaugguuugucccgucuaucaaagcuggcaacgauaucgcuaauuguuuaaggaaaaauggcaagaaaguaauccaguugucuagaaaaacauuugacaccgaauaccaaaagaccaaacuaaaugauugggauuucguugugaccacugacauaucggagaugggcgcuaauuuuaaagcggaucgaguuauagacccacgcagaugucucaagcccguaauacuuacugacggaccugagcgcguuauucuugcaggucccaugccuguuacagcggcuagcgcugcucaaagaagagggaggguuggacguaacccacagaaagagaacgaccaauacauauuuacaggacaaccucuaaauaaugaugaagaucaugcccacuggacggaagcgaaaaugcuacuugacaacauaaacacaccagaggguauuauucccgcuuuauucgaaccagaacgcgaaaagucagcagccauugacggcgaauaucgacuaaaaggcgaaucacggaaaacauucguggaacuaaugaggagaggugaucuacccguuugguuagcacauaaaguggcuagugaggguauuaaguauaccgaucgaaagugguguuuugauggucaaagaaauaaucagauuuuggaagagaacauggacguagagauauggacaaaagaaggggagaaaaagaaauugcgaccgagauggcuggaugcucgcaccuacagcgacccauuggcuuugaaagaguuuaaggauuuugccgcuggucggaaaucuauugcucuugauuuagucacugaaauugguagagucccaacucaccuggcccaccgaacaagaaacgcacuagacaaccuggucaugcugcauacaucugagcauggagggaaagcauauagacaugcuguggaagaacugccagaaacuauggagacucuucugcuucugggauuaaugauucuauugacugggggagcgauguuauuuuugauuucgggaaaaggaauugguaaaaccaguauuggccuuauaugcgugauagcaucaagcgguauguuauggauggcugaaauaccccuccaauggaucgccagugcuauaguccuugaauuuuucaugaugguacuacuaauaccagaacccgaaaaacaaaggacaccacaggauaaucaguuagccuaugucguaauaggaaucuuaacauuagcggcaauaauagccgcuaacgaaaugggacuuuuggagaccacaaaacgagaucugggaaugucaaaggaaccuggaguugugagucccacaucauauuuagauguagauuugcauccugcaagugcauggacuuuauaugcaguugccacaacagugauaacuccuaugcuaagacauacuauugagaacucgacggcaaacguuagcuuggcagcaauugcaaaucaagcaguaguauuaaugggacuugauaagggauggccgauuucuaaaauggauuuaggaguuccuuuacuagcucugggcuguuacucccagguaaacccucuaacguuaacggcggcaguauuacuacuuaucacacacuacgcuauaauaggucccggccuccaagcuaaagcaacacgagaagcccagaaaagaacagcagcagguauaaugaaaaauccuacaguugauggaauuaugacuauagaccuagacccaguaauauaugauucuaaauuugaaaaacaacuaggccaaguaauguuguuagugcucugugcaguacaauuauuacuuaugcgaacaaguugggcacugugugaggcucuaacacuagcgacuggacccauuaccaccuugugggaaggaaguccugguaaauuuuggaauaccacuauagccguaucaauggcaaauauuuuucgaggaaguuauuuggcuggugcuggauuagcauucagugugaugaaaucugucgggaccggcaagcguggcacaggaucacagggcgagacgcugggugaaaaauggaagaagaaauuaaaccaauuaucuagaaaagaguucgacuuauacaagaaaagcggaauuacggaaguagaccguacggaagcuaaggagggacuaaaaagaggagagauaacgcaccaugccguaagccgaggaagugcuaaacuucaaugguuuguagaacgaaacaugguuauuccugagggacgaguaauagauuuaggaugcggacgaggaggauggucauauuauugcgccggacucaaaaaggugacagaaguacgcggauauacuaaagguggaccgggucacgaggaaccaguaccaaugagcacuuacggguggaauauagugaaacuaaugaguggaaaagaugucuuuuaccugccucccgaaaagugugauacauuacuaugugacaucggagaaaguucgcccucaccaacugucgaagaaagcaggacaauucguguauuaaaaaugguugaaccauggcucaaaaauaaccaauucuguaucaaaguuuuaaacccauacaugccaaccguuauagaacaucuugagagguugcagaggaaacauggugguaugcuugugcgaaacccucuaagucgaaauucuacccacgagauguacuggauuucaaauggaacugguaacauaguagcuagcguaaauauggucucacggcuauuguuaaaucgcuuuacgaugacacaccgaagaccuacuauugaaaaagaugucgaucuaggagcaggaacuagacauguuaaugccgagcccgaaacgccaaacauggacguaauaggggaacgaauaaaacguauuaaggaagaacacaacaguacuuggcauuacgacgacgaaaauccauacaaaaccugggcauaccacgguucauacgaagucaaagcuacgggcucagcaaguuccaugaucaauggugucguaaaacuccuaacaaaaccuugggaugugguacccauggugacacaaauggcaaugacggauacaacaccauuuggacaacaaagggucuuuaaggaaaaaguugauacaaggacccccagauccaugccaggcacacgaagagucaugggcauaacugcugaauggcuauggaggacacuaggaaggaauaagaaaccucgcuuauguacacgagaagaauuuacaaagaaaguccguaccaaugcagccaugggggcuguuuucacugaagagaaccaaugggacagugcgaaagcggcaguagaagacgaagauuuuuggaagcuaguagaccgagaaagggagcuucauaaauuggggaaauguggaucuuguguuuauaacaugaugggcaagcgagagaagaaacuaggugaguuugguaaggcaaaaggcucacgugcaauaugguauauguggcuuggcgcacguuauuuagaauuugaagccuuggguuucuugaacgaggaccacugguucaguagagaaaauagcuacagcgguguugagggagagggacuacauaaacuaggauacauacugagagauauaucgaaaaucccagggggagccauguacgcugaugacaccgcugguugggacacgcguauaacagaagaugauuugcauaaugaagagaaaauaacucaacagauggacccagaacacaggcagcucgcuaaugcaaucuuuaaacuuacauaccagaacaaaguuguuaaaguacaaaggccaacaccuacgggaacggucauggauauuauaagucgaaaagaccagcgugguucuggucaagugggcacguauggauuaaacacauucacaaacauggaagcacagcuaauacgccaaauggaaggggaaggaguacucaguaaagcagaccuugagaauccucaccuaccggaaaagaagauaacacaauggcuggaaacaaaaggagucgaacggcucaagcgcauggcuauaagcggcgacgauugcguaguaaaacccaucgaugaucgauucgcaaaugccuugcuggcucucaaugauauggggaaaguucgcaaggacauaccgcaauggcaaccuaguaagggauggcaugauuggcaacaaguaccauucugcucccaccauuuccaugaacugaucaugaaagacggaagaaaacuuguuguaccaugccgcccccaagaugaauugauagggagagcucgaaucucucaaggggcuggguggagccucagagaaacugcaugcuugggcaaggcauaugcucaaauguggagcuugauguacuuucaccgaagggaucugcgucuugcaucaaaugcgauauguagugccgugccuguacacugggugcccacaucacgcacgaccuggaguauacacgcccaucaccaauggaugacuacagaggacauguuaacuguguggaaccggguauggauugaggauaauccuuggauggaagauaaaacuccgguaacaaccugggaaaauguaccuuaucuugguaagcgagaagaucaaugguguggcagccucauaggucucacaucucgagcaaccugggcacaaaauauuccgacagcaauucagcagguaagaaguuugaucgguaacgaagaauuuuuagauuauaugccgucuaugaaaagauucagaaaggaagaggaaagcgaaggagccauaugguaa

SEQ ID NO: 23425 - RNA, 9873 nt, Artificial Sequence
  derived and/or modified CDS sequence (opt6) from DENV-3__FJ639795__SS-prME
acgucucuuugccugaugaugauccuaccagcagcacucgcuuuccaucucacgucaagggauggagaaccacgaaugaucguggggaaaaaugaaaggggaaaaucauuacuauuuaaaacugcaaguggaauaaauauguguacauuaaucgcaauggacuuaggagaaaugugugacgauacugugacauacaaaugcccacauauaacugaaguugaaccagaagauauagauugcuggugcaaccuuaccucaacauggguuacuuacggaacgugcaaccaagcgggugaacauagaagggacaaacgaaguguagcauuggcaccacauguagguaugggacuagauacacgaacacaaacguggaugagugcugaaggagcauggcgccaaguagaaaaaguagaaacaugggcgcuaagacacccgggauuuacgauauuagcacucuuccuagcacacuauauaggcacaucacuaacucaaaaagugguaauauucauucugcugauguuaguaacgccaagcaugacgaugcgaugcgucgggguaggcaacagagauuuugucgaagguuuaagcggugcaacguggguagacgucguuuuagaacauggaggauguguuacgacuauggccaaaaacaaaccaacauuggacauagaacuacagaaaacagaagcgacgcaacuugcuaccuuaagaaaauuauguauagaaggaaaaauaacaaacauuacgacagacuccaggugcccgacucaaggagaggcgguucugccagaggaacaagaucaaaauuauguuuguaaacauacauacgucgaucgaggaugggguaacggauguggguuauuugguaaaggcucguuggucacaugugcuaaauuucagugucuagaaccaaucgaaggaaaagucguacaauacgaaaacuuaaaauacacaguaaucauaacuguccacaccggugaccagcaccaagucggcaacgaaacacaaggagugacagcggaaaucacuccacaagcaucgaccacggaagccaucuuaccggaauaugggacacuaggucuagaauguagcccgcguacgggguuggacuucaaugaaaugauuuuacucaccaugaaaaacaaagccuggauggugcauagacaaugguucuuugaccuucccuuacccuggacuucaggcgcuacuacggagacaccaacauggaauagaaaggaacuccuagugacguuuaaaaaugcccacgccaagaaacaggaaguagugguuuuaggcagucaagaaggugcuaugcauacugcgcuaacuggagcuacagaaauacaaaauucuggaggaacaagcauauucgcgggacaucucaaauguagacuaaaaauggauaaacuugaauuaaagggcaugaguuacgcgaugugcaccaauacguuuguacucaagaaagaaguaucggagacccaacacgggaccauuuuaauaaaaguggaguauaaaggcgaggacgucccaugcaaaaucccauuuaguacggaagacgggcaaggaaaagcacacaacggucgccuaauaacagcuaauccggugguaacuaagaaagaggaaccuguuaacauagaagcagaaccuccuuuuggcgaaucaaauauuguuauuggaaucggagacaacgcauuaaaaauuaauugguacaaaaaggguagcucuauaggaaagauguucgaggcaacagcacgaggagcaagacgaauggcaauuuuaggggacacugcgugggacuuuggcagugucggugggguuuuaaacaguuugggaaaaaugguacaccaaauauucgguagcgcauauacugccuuauuuagcggagugucuuggguuaugaagauaggaauuggaguauuguugacguggauaggucugaauaguaaaaauacuucaaugaguuucaguuguauugcaauaggcauaauuacauuauaucuaggugcgguagugcaagccgacaugggaugcguaauaaacuggaaaggaaaagaacuuaaaugcgguucugggauauuugucacaaaugaaguacauacguggacagagcaguauaaauuucaagccgacucaccuaaacgucuggcaaccgcuaucgcuggcgcuugggaaaacgguguuuguggaauacggaguacuacuaggauggaaaaccuucuauggaagcaaauagccaaugaauuaaauuacauuuugugggagaacaauauuaagcugacaguaguaguaggcgacacuaucgguguauuagaacaggguaaaagaacucucacuccucaaccuauggaauuaaaauauucauggaagacauggggaaaagcaaaaauaguaacugcugaaacacaaaacaguaguuuuauuauagauggaccuaacacgccugaaugccccucugcaaguagagcauggaacguaugggaggucgaagauuauggcuucggugucuuuacaacaaauauauggcugaagcuaagagaaguuuauacucaacucugugaccacagauuaaugagugcagcagucaaagaugaaagggcgguacaugcagauaugggcuauuggauagaaucacagaaaaaugguagcuggaaguuagaaaaggccagcuuaauugaagucaaaacguguacauggccaaaaucccauacauuauggucgaaugguguucuagaaucagauaugauaauaccgaagaguuuagcaggacccauuagccaacauaacuaucguccgggauaccacacccagacggcagguccauggcaucucggaaaacuugaacuggauuucaauuauugugaaggaacuacgguaguuauaacggaaaauuguggcacgcgaggucccucgcuaagaacaacuaccgucagcggcaaacuuauacaugaauggugcugcagaucaugcacgcuacccccuuuaagauauaugggcgaagacggaugcugguaugguauggaaauucgaccuauuucagaaaaagaagagaacaugguaaaaagccucguuuccgcuggaaguggagaaguagauaauuuuacaaugggaguacuuuguuuagcaauauuguuugaagaagucaugagaggaaaauuuggaaagaaacauaugauagcuggaguauucuuuacauucguauuauuacuaaguggucagauuacuuggcgugauauggcucauacacuaaucaugauuggaucgaaugcuagugauaggauggguauggggauaacguaccucgcauuaauagcuacauucaaaauucaacccuuucucgcccuaggauucuuuuuaaggaaguugacaaguagagaaaauuuauuacuuggagucgguuuggcgauggcaacaacauuacaacuaccggaagacaucgaacaaauggccaacgguauagcgcucggccuaauggcuuugaaacuaauaacgcaguucgaaacauaccaauuauggacggcguugauuucacuuacauguagcaacaccauauuuaccuuaacuguugcguggcggacagcaacucugauucuugcgggaguaagucuucuuccaguuugucaaucaucuagcaugcgaaaaacagauuggcugcccaugacgguugcggcuauggguguuccuccauuaccuuuauucauauucagcuuaaaagacacacuaaagcgccggagcuggccacuaaaugaaggaguaauggcgguaggccuaguuaguauccuagcaucaagucuucuaagaaaugauguaccgauggcuggucccuuggucgcuggugggcugcuaaucgccugcuauguaaucacgggcacgagcgccgauuugacgguagagaaagcggcugaugugaccugggaagaagaggcagaacaaacgggaguaucgcauaacuuaaugaucacuguagacgaugauggaacaaugagaauaaaagacgaugagacggagaacauucuuacaguccuacucaaaaccgccuuauuaauagucaguggaauauuuccauacuccauacccgcaacacuacuuguauggcauacauggcagaagcaaacgcaacgcagcggcguguuaugggacguaccuucaccaccagagacacaaaaggcagaacuugaagaagguguauaucgcauuaaacaacaaggaauauuuggaaaaacacaaguugguguagggguccaaaaagaggguguuuuucacacaauguggcacgugacaagaggggcuguuuuaaccuacaacgguaaacgguuagagccuaauugggcaagugugaagaaagaccuaauaaguuacgggggaggauggagacuaagcgcccaguggcaaaaaggcgaagaaguacaaguuauugccguggaacccggcaaaaauccgaaaaauuuucaaacaaugcccggaaccuuccaaacuaccacaggagaaauaggcgcaauagcauuagauuucaaaccugguacaaguggcucaccaaucauuaacagggaaggaaaaguugucggucuuuacgguaacggaguaguaacgaaaaacgggggauauguguccggcaucgcccaaacaaaugcagagccggacggcccuacaccugaacuugaagaagaaauguucaagaaacgaaaccuaacuauaauggauuuacauccaggcucggggaaaacucgcaaauauuugccggcaauaguucgagaggcaauuaagagaagguuaagaacauugauacuugcaccaacucgaguuguugcagcagagauggaagaagcguugaagggauugccaauccguuaucaaaccacugccaccaaauccgagcauacagguagggagaucguggauuuaaugugucacgcuacguuuacaaugagacuauugucuccuguacgaguuccaaauuauaaucugauaaucauggaugaagcucacuuuacugacccugccucgauagccgccagaggauauauaaguaccagaguggggaugggugaggcggcagccaucuuuaugacugcgacgccacccggaacagcugacgcauuuccgcaguccaaugcaccaauacaggacgaagaacgagauauaccagaacgcaguuggaauaguggcaaugaauggauaacagacuuugcaggcaagacugucugguuugugccaucaauaaaagcagguaacgauauagcgaauugccuacggaaaaacgggaagaaagucauacaauuaucaagaaaaacauuugauacugaguaucagaaaacaaaacuuaacgauugggacuucguuguaacaacugacauuucugaaaugggagcuaauuucaaggccgauagaguaaucgacccgagacguuguuugaaaccaguaauuuuaacagacggaccugaacgaguaauauuagcgggcccaaugccgguaacagcggcaagcgcugcacaacgaagaggaaggguagggcgaaacccacagaaagaaaaugaucaauacauauucacggggcaaccccugaacaaugacgaagaucaugcccacuggacagaagcaaaaauguugcuugacaacauaaacacaccugaggguauaaucccggcacuauuugagccggaaagggaaaaaucagcagcaauugauggugaguaucgcuuaaaaggcgaaaguagaaagacguuuguggagcuaaugagaagaggugaucugccuguguggcucgcgcauaaagucgccagugaagguauaaaguacacagaccggaaauggugcuuugauggacaaaggaauaaucagauauuggaagagaauauggauguggaaauauggacuaaggaaggggagaagaagaaauugagaccaagaugguuagacgcgcggacauauagcgacccacuagcacuaaaagaauuuaaagacuucgcagcuggucgaaaaucaauugcuuuggacuuagugacagaaauaggcagagugccgacacaucucgcacacaggacccgaaacgcucuggacaaucuugucaugcuacacacgucugaacauggcgguaaagccuauagacaugcuguggaagaauugccagagacaauggaaacgcuacugcugcucggacuuaugauucuauuaacugggggcgcuaugcuauuuuuaauuaguggaaaagguauaggaaaaacgagcaucggauuaauaugcgugauagcaaguucaggcauguuguggauggcagaaaucccccuacaauggauagccucugcuauuguccuugaauuuuucaugaugguacuacuuauacccgaaccagaaaaacaacguacaccccaagauaaucaacuagcauauguggugauagguauacuuacacuugcggcuacuauagccgcaaaugaaaugggguugcucgaaacuacaaagagagaucucggaaugaguaaggaaccuggaguagucucgcccacaucguaccuggacguagacuuacauccagcauccgcauggacucucuacgcagucgccacaaccguuauuaccccaauguuaagacacacgauagagaacucaacagccaauguuaguuuagcugcaauagcaaaccaggcaguaguuuuaauggggcuagacaaaggcuggccgauaucgaagauggaccucggaguaccucuccuagcuuuaggauguuacucucaaguaaauccacucacauuaacagcagccguacucuuauugauaacucauuaugcuauuaucggaccuggacuacaggcuaaagcaacuagggaagcacaaaaacggacggcagcugguauaaugaagaaccccacaguggauggaauaaugacaauagauuuagacccuguaauauaugauuccaaguuugagaaacaacuaggucaaguuaugcuccucguccuuugugcuguucagcuccuacucaugagaacaaguugggcgcuaugugaagccuuaacucuagcgacaggaccuauaacaacauuaugggaaggcagucccggaaaauucuggaacacgacgauagcgguaucaauggcuaacauauucagaggaucguacuuagcgggcgcagguuuagcauucagcauaaugaaaaguguugggaccggcaaaagaggaacgggcagucaaggcgaaacguuaggagagaaauggaagaagaaauuaaaccaacugagccggaaggaguuugauuuauauaagaaaaguggaauuacggaaguagauagaaccgaggcaaaagaaggacugaaaaggggagaaaucacgcaccaugccguuucgaggggcucggcuaaacuucagugguucguugagcggaauauggugauaccagaagguagggugauagaucuaggaugcgggagagguggaugguccuacuacugcgcgggucuaaagaaaguaacagaaguuagaggcuauacuaaaggaggaccgggacaugaagaaccgguaccgaugagcacguaugguuggaacauaguaaaacuaaugucgggaaaagacgucuuuuacuugccaccggaaaaaugugauaccuuauuaugugacauaggagagucguccccgaguccuacuguagaagaaucucgaacuauacgagucuuaaaaaugguggaaccgugguugaaaaauaaccaauuuuguauaaagguuuuaaaucccuauaugcccacaguaauugaacaucuagaaagacugcaaagaaaacacggugggaugcuaguaaggaauccucuaucaagaaacaguacccaugaaauguacuggauaaguaacggaacaggaaauauaguagcuucugucaacauggucucuagacuauuauugaaccgauucacuaugacacauagaagaccaacuauugagaaagauguugauuugggagcaggaaccaggcacgucaacgcugaaccagaaacuccuaacauggaugugauaggagaaagaauuaaaagaauuaaagaagaacauaauaguacuuggcauuacgacgacgaaaauccuuacaaaacuugggcguaucauggaucuuaugaagucaaagcuacagguucagcaucaaguaugauuaacggaguagucaaacugcuaacuaagccaugggauguggucccaauggugacccaaauggcuaugacugauacuacuccauucggccaacaacggguauucaaagaaaaaguggauacuagaacaccaagauccaugccaggaacacgucgcguuaugggaauaacugcggaauggcuauggagaacacuaggcagaaauaagaaaccacguuuaugcaccagagaggaauuuacuaagaaaguucgcacaaacgcugccaugggugccguauucacagaagaaaaucaaugggacucagcaaaagcagcagucgaagaugaggauuuuuggaagcuaguugacagagaaagagaacuacauaaacuugguaaaugugguagcuguguuuauaauaugaugggaaaacgagagaagaaacuuggggaguucgguaaggcaaaaggaucucgagcuauaugguauaugugguuaggagcacgguaucucgaauuugaggcuuuaggguuccuaaaugaagaucauugguuuucucgcgaaaacaguuauucaggaguugaaggagaaggguugcauaaauuaggguauauacuuagagauauuaguaaaauaccugggggugccauguacgccgaugauacggcuggcugggauacuagaauaacugaagacgaucuccauaacgaagagaaaauuacgcaacaaauggaccccgaacacaggcaacuugcgaaugcgauauuuaaauuaacauaccagaacaaagugguaaaagugcaaaggccuacuccuacaggcacuguuauggauauuauaucuagaaaagaccagcgcgguucuggacagguggguacuuauggacucaauacauucaccaauauggaagcacagcuaauccgacaaauggagggugagggaguauuguuaaaggcugaccuugaaaauccucauuuaccggagaagaaaauaacacaauggcuugagaccaaaggaguugaacgacucaaaagaauggcaauaucaggagacgauugcgugguaaaaccgauagaugaccgguucgccaaugcccuucuggccuugaacgacauggguaaaguaaggaaagacauaccacaauggcagccaucaaaaggcuggcaugauuggcaacagguucccuuuuguucucaucauuuucacgagcucauaaugaaggauggaagaaaacuuguuguuccuugucgcccacaagaugaacuuauaggccgggcaagaauaagucaaggugcgggcuggucacuccgagaaaccgcgugcuuagggaaggcguacgcucaaauguggucauuaauguacuuccauagaagggaucuaagacuugcuagcaacgccauauguagugcagugccuguacauugggucccaaccucacguaccacauggaguauacacgcacaccaccaauggaugacaacggaagauauguuaaccguguggaauaggguguggauugaagacaauccuuggauggaagauaaaacuccaguaacuacuugggaaaacguaccguauuuaggaaagcgcgaagaccaaugguguggaucucugauaggauuaacgucgcgagcaacaugggcucaaaauaucccuacagccauccaacaaguuaggucauugauaggcaacgaagaguuccuugauuauaugccuucaaugaagagguucaggaaagaagaggaaucggaaggggcuauaugguaa

SEQ ID NO: 23426 - RNA, 9873 nt, Artificial Sequence
  derived and/or modified CDS sequence (opt6) from DENV-3__FJ639798__SS-prME
acaagucuuugccugaugaugauccugccagcagcauuagcauuucaccugacuucuagagauggggaaccacguaugauaguagguaaaaacgaaagaggaaaaucauuacuuuuuaaaacagcguccgggauaaacaugugcacacuaauagcuauggaccuuggagaaaugugugacgacacaguuacauacaaauguccacauauuacagaaguagaaccggaagacauagauugcuggugcaauuuaacaucaacuugggucacauaugguacauguaaucaagcaggagaacauagacgugauaaacgaaguguagcguuagcaccccacguaggaaugggauuagauacucgaacacaaacauggaugagugcagaaggagcauggcggcaaguagaaaaaguugaaacaugggcucuaagacauccagguuuuaccauacucgcucuauuuuuggcgcacuacauagguaccagcuuaacacaaaaaguaguuauuuuuauucuacuuaugcucguaaccccaucgaugacuaugagaugcguagguguagguaaccgcgacuucguagaaggguugucgggagcgacauggguagauguuguucuagaacaugguggauguguuacuacuauggccaaaaauaaaccuacucuugauaucgaacugcagaaaacagaggcuacacaacucgcuacucugaggaaacuuugcauagaagguaaaauuacgaauauaacuacagacaguagauguccaacccaaggcgaagcagugcuaccugaagaacaagaucaaaacuauguuuguaaacauaccuauguggauagaggauggggcaauggaugcgguuuauucggaaaagggagccuaguaacgugugcgaaauuccaaugucuagagccaguggaaggcaaaguaguacaauacgagaacuuaaaauauacaguuauaauuacuguucauacgggcgaucaacaucaaguagggaacgagacacaaggcguaaccgcggaaauaaccccacaggcuucaacuaccgaagcaauacugccugaauacggcacacuuggccuugaguguaguccacguacagggcucgauuucaaugaaaugauacuauuaacgaugaaaaauaaggcuuggaugguacauagacaaugguucuucgacuuaccacuaccuuggacgucgggagcgacgaccgaaacgccaacauggaacaggaaagaguugcuaguuacauucaaaaaugcacaugccaagaaacaggagguggugguccuuggaagccaagagggagcaaugcacacugcucugacuggugccacagagauucagaacucuggagguacuucuauauucgcaggacaucucaaauguagauuaaaaauggauaaauuggaauuaaaagggaugucauaugcgauguguacaaacacauucgucuugaagaaagagguuuccgaaacucaacaugggacuaucuuaaucaaagucgaauacaaaggagaagauguaccauguaaaaucccauuuaguacagaagacggucaaggcaaagcucacaacggacgauuaauaacggcaaacccaguuguuacgaagaaagaagaaccggugaauauugaagccgaaccucccuucggggaaagcaauauagugauuggcauuggagacaaugcacugaaaauaaauugguauaagaaaggcaguagcauugguaaaauguucgaagccaccgcuagaggagcaagaagaauggcaauacuuggagacacagcaugggacuucgguucaguggguggagugcuuaacucacuuggaaaaaugguucaucagauauucggcucugcguacacugcgcuauuuucgggcguuucauggguuaugaaaauaggcauaggaguauuacugaccuggauaggauuaaauucuaaaaacacaucuaugucauucaguuguauugcuauugguaucaucacacuguaccugggagccguaguacaagcggauauggggugcgucauaaacuggaaagggaaagaacucaaaugcggcagugguaucuuugucaccaacgaaguccauacuuggacggaacaguauaaauuucaggcagacaguccuaaacguuuagccacggccauugccggugcaugggaaaauggaguuuguggaauaagaucuacaacuagaauggaaaauuuacuguggaaacaaauugcaaaugaauuaaauuacauauugugggaaaauaacauaaaacuuacuguugucguaggagauauuauagggguuuuggaacaagguaaaagaacauuaaccccucaaccaauggaacugaaauauagcuggaaaacuuggggaaaagcuaaaauaguaacggcggagacucaaaacaguaguuuuauaauagauggcccgaauacccccgaaugccccucagcaagccgugcuuggaacgucugggaaguugaagacuaugguuuuggcguauuuacaaccaauaucuggcuuaaacuaagggagguguauacgcaauuaugugaucaccgacuaaugucagccgccguaaaagacgaaagagcaguacaugcagauaugggauacuggauugagagccagaaaaauggaucauggaaauuggaaaaagcauccuuaauagaaguuaaaacaugcaccuggccgaaaagucacacccuauggucgaauggcgucuuggaaagcgacaugauaauaccuaaaagccuugcuggaccuauaucgcaacauaacuaucguccgggcuaccauacucagacagcugguccauggcacuuaggaaaacuagaguuggacuucaauuacugcgaagggacgaccguugucaucacugaaaacugcgguacucgugguccuucacucagaacgacuacuguaucaggaaaacuaauucaugaauggugcugucggucguguacuuuaccacccuuacgcuacaugggagaagauggauguugguacggcauggagauaagaccuauuuccgagaaagaagaaaauaugguaaaaucccuuguaagugcaggaucaggagagguggauaauuuuacgaugggaguauugugccuagcaaucuuguuugaagaaguaaugaggggaaaauuuggcaagaaacacaugaucgccggugucuuuuucacauucguacugcuacuaucuggccaaauaacauggcgugauauggcacauaccuuaauaaugauagggagcaaugcaagugauagaaugggaaugggcguuaccuaucuagcccuaauagcaacauucaaaauacagcccuuucuggccuuaggauuuuuccuacgcaagcucacaucacgagaaaaccuacuacuaggcguaggacucgcaauggccacaacguuacaauuaccugaggacauugaacagauggccaacgguaucgcccuugguuugauggcuuuaaaauuaauaacacaauucgaaacauaucaacucuggacggcuuugaucagucuaaccuguagcaauacuaucuucacauuaacaguagcauggcgaacggcaacauuaauauuggcuggagugucauuacuacccguaugucaguccucaucuaugcggaaaacagauuggcuacccaugacgguagcugcgaugggagucccaccccuaccucuauuuauauuuuccuugaaggacacauuaaaacgucgcucuuggcccuuaaacgaaggagugauggcgguugguuuagugaguauucuagccaguagcuuacuacggaaugaugucccaauggcagguccauuaguagcgggcggcuuacucauugcuugcuauguuauaacaggaacgucagcugauuugacuguagaaaaggcggcagauguaacaugggaagaagaagcugagcaaacgggaguuucccauaaccucaugauaacaguagaugaugauggcacaaugagaauaaaggaugaugaaacugaaaacauuuuaacaguccuauuaaagacugcauuacuuauugugucuggcaucuuucccuacaguauuccugccacgcucuuaguuuggcauacuuggcagaagcagacacaaagguccggcguacuaugggaugucccaagcccaccagagacucaaaaagcagaguuggaagaaggggucuacagaauaaaacagcaagguaucuucggaaagacacagguagguguaggcguacaaaaagagggaguauuucauacgauguggcacgucacacgcggugcggugcuaacauauaaugguaaaagacuagaaccaaauugggcgucagucaagaaagaccuaauaucauacggaggaggguggagauuguccgcucaauggcagaagggggaagagguccaaguaaucgccgucgagccaggaaagaaucccaaaaauuuucagacaaugccagguacauuucaaacuacuacaggagagaucggggccauagcgcuagauuuuaaacccggaacuucaggaaguccgauaaucaaccgggaaggaaagguaguaggucuguacggcaacgguguagugaccaaaaauggugguuacguaaguggaaucgcccaaacuaaugccgaacccgauggcccaacucccgaauuagaagaagaaauguucaagaagagaaacuuaacaauaauggaucuacauccgggaaguggcaagacaaggaaauaucugccggcuauaguccgugaggcaauaaaaaggaggcuaagaacacucaucuuggcaccaacuagggucguagcggcugaaauggaagaggccuuaaaaggccuacccauaagauaccaaacaaccgcuacaaaguccgagcacacaggaagagaaauuguggaccuaaugugccaugcuacauuuacgaugagacuacucucacccguccgaguacccaacuauaaucucauaauaauggaugaagcucauuucaccgaucccgcaucaauagccgcgagagguuauauaagcacccgagugggaaugggcgaagcggcugcaauauuuaugacagcuacuccgccuggaacggcugaugcauuuccacaaagcaacgcuccaauacaagaugaagaaagagauauacccgaaagauccuggaacucagggaacgaauggauaaccgacuuugcagggaaaacagucugguuuguacccaguauaaaagcaggcaaugauauagcuaauugucugcguaaaaauggaaagaaagugauacagcuaucacggaagacguucgauacugaguaccagaagacuaagcucaaugacugggauuucguaguaacgacagauauuagugaaaugggagcgaauuucaaagcggaucgaguaauagacccucgucgcugucuuaaaccuguuauucucacagacggacccgaacgaguuauuuuggcaggaccgaugccugucacugccgcgagcgcugcucagcgacguggacgaguugguagaaauccucaaaaagaaaaugaucaauacauauuuacugggcaaccccuaaacaaugaugaagaccaugcacacuggaccgaagccaagaugcugcuugauaacaucaacaccccugaagguauuaucccugcgcuauuugagccggaaagagagaaaagcgccgcaauagauggggaauaucgcuuaaaaggagaaucccgaaagacauucguagaacuaaugagaagaggugaccuuccuguauggcuagcgcauaaaguagcgagugaaggcaucaaauauaccgauagaaaaugguguuucgauggccaaagaaacaaucaaauacucgaggaaaauauggaugucgaaaucuggacaaaagagggugagaagaagaaacuaaggccaagaugguuagacgcacgaacauacagugauccucuggcauugaaagaguuuaaggauuuugcugcugggagaaaaucuauagcauuagauuuggucacugaaauaggucgaguacccacccaucuugcacacagaacaagaaacgcauuagauaauuuaguuauguuacauacaucugaacauggagguaaagccuaccgacaugcaguugaagaacucccagaaacaauggaaacacuacuccuuuugggccugaugauacuauuaacgggcggugcuaugcuauuucuuaucucagguaagggcauugguaaaacgucuauaggucuuauauguguaauagcgagcucaggaaugcucuggauggcagagauaccccuucaguggaucgcaucugcgaucguauuagaauuuuucaugaugguccucuuaauaccagaacccgagaaacaacguacaccgcaagauaaccaacuugccuaugucgugauaggaauuuuaacauuagcagccaccauagcugcgaaugaaaugggacugcuagaaacaacaaagagagaccuagguaugaguaaagaaccaggaguaguuagcccuacaucauauuuggacguagaucugcacccugcaucagcguggacauuauaugcaguugcaacaacuguaauuacaccaaugcuuagacauacgauagaaaacucaacagcgaauguuucacuagccgccauugcaaaccaagcagucguccugaugggcuuagacaagggauggcccauaaguaaaauggacuuaggugugccgcuauuagcuuugggaugcuacagccaagucaacccucuaacacuuacagcggcaguccuacuauuaauuacucacuaugcgaucauagguccagguuuacaggcaaaagcuacgagagaggcucaaaaacgaaccgccgcggguauaaugaaaaauccaaccgucgacgguaucaugacaauagacuuagaccccgucauuuaugacucaaaauucgaaaaacaacuuggucaaguaaugcuccuaguacuaugugcaguccaacugcugcucaugcguacaucaugggcauugugugaagcauuaacauuagcaacaggaccgauuaccaccuuaugggaaggguccccuggaaaauuuuggaauacaacaauagccguaucuauggccaacauuuuccgaggaucauauuuagcaggagccgggcuagcuuucaguauuaugaaaaguguaggaacaggcaaaagaggaacagguagccaaggagaaacucuaggagaaaaauggaagaagaaauuaaaccaacugucccgaagagaguucgauuuauacaagaaaucugggauaaccgaaguagaccggacggaagcuaaggaaggcuuaaaacgaggcgaaaucacacaccaugcaguuagucgcggcucggcgaaacugcagugguuugucgagcguaauaugguaaucccagagggaagggucauugaucucgguugcgggcgaggaggguggucguauuauugcgccggcuugaagaaaguaaccgagguacguggauauaccaaaggcggccccggacacgaagaaccaguccccaugaguacauauggguggaauauuguaaaguuaaugagcggcaaagacguauuuuauuuaccuccagaaaagugugacacccucuuaugcgauauaggcgagaguucuccuagucccacaguagaagagucccguaccauccggguacugaaaaugguugagcccuggcuuaaaaacaaucaauuuuguauaaaaguacugaauccauacaugccaacuguaauagaacaucuugagcgguuacaacggaaacacgggggaaugcuuguucgcaauccacugucucggaauaguacacaugaaauguacuggauuaguaaugggaccgggaacauaguagccucaguaaauauggugucccgacuucuucuuaaccgauuuacaaugacacauagacgaccaacaauugaaaaagacgucgaccuaggcgccggaacccggcauauaaaugcugaaccagaaaccccaaacauggauguaauaggugagagaaucaagcguauaaaagaggaacauaauuccacauggcauuaugacgaagagaauccauacaagaccugggcuuaucacggaucauacgagguaaaggcuacaggcucagcaagcaguaugauaaacggcgucguaaaacuacugacuaagccgugggauguugucccuaugguuacacaaauggcaaugacugacacaacaccauucggucagcagagaguuuucaaagagaaagucgauacacggaccccgcgacccaugccuggaacgcguagaguuauggggaucacagcggagugguuguggagaacucuagggagaaacaagaaaccgagauuaugcaccagagaagaguuuacaaagaaaguaagaacuaaugcugcaaugggggcugucuuuacugaggagaaucaaugggacagcgcuaaagccgccguagaagaugaagauuuuuggaaacuuguugaccgugaaagggaauugcacaaauuaggaaaaugcgguucuuguguguauaauaugauggguaaacgagagaagaaacucggagaauuuggaaaagcaaaagguucacgugcaauaugguauauguggcucggagcucgauaccuagaauuugaggcacuuggauuuuugaaugaagaccacugguuuaguagagaaaauucauauucuggaguugaaggcgagggauuacacaaauuaggauauauuuuacgugauaucucgaaaauuccagguggagcaauguacgcagaugacaccgcagguugggauacgaggaucacugaagaugauuuacauaacgaagaaaagauaacacagcaaauggacccagaacaccgucaacuagccaacgcuauauuuaaauuaacuuaccaaaauaaaguaguaaaggugcaaagaccaacuccuacagggacgguaauggacauuauaagccgcaaagaucagcgaggaucgggccagguggguacauauggguugaauacuuuuacaaauauggaagcacaacugauaagacaaauggaaggugaaggaguacuaaguaaagccgaucucgagaacccacaucuuccggagaagaaaauuacacaauggcuggaaacuaaagguguagaaaggcucaaacggauggccaucaguggugacgauugcguaguaaaaccaauagacgauagguuugcaaaugcguuacuagcacuuaaugauaugggcaaggugcgaaaagauauuccucaauggcaacccucuaaagguuggcaugauuggcaacaagugccguuuuguucacaccauuuucacgaacuaauaaugaaagacgggagaaaauugguuguuccuuguagaccacaagaugagcucauaggacgggcgcggauaagccaaggagcaggaugguccuuaagagagacggcaugucuagguaaggcauaugcucaaauguggagccuaauguauuuccacaggagagaccucagacuugcuaguaaugcaaucuguagugcaguucccguacacugggucccaacaucacgaacuacauggucaauacaugcacaucaucaguggaugacaacugaagacaugcuaacagucuggaauagaguguggauagaagauaaucccuggauggaagauaaaacaccuguaacuacaugggaaaauguacccuaucuaggaaaacgagaagaccagugguguggaucguuaaucgguuugacgucacgugcaacaugggcccagaacauaccaacagcuauucagcaaguaagaagucucauagguaaugaagaauuuuuggauuacaugccaagcaugaaacgcuucagaaaagaagaagaaucagaaggagccauuugguaa

SEQ ID NO: 23427 - RNA, 9873 nt, Artificial Sequence
  derived and/or modified CDS sequence (opt6) from DENV-3__FJ639799__SS-prME
accagcuuaugucuaaugaugauacucccagcagcgcucgcauuccaucugacaucgcgcgacggagaaccacgcaugauaguaggcaaaaaugaaagggggaaaagucuacuauucaaaacagccucaggcauaaauauguguacauuaauagcuauggaccuuggagaaaugugugaugauacugugacuuacaaauguccccauaucacggaaguagaaccagaagauaucgauugcuggugcaaccuaaccaguacauggguaacauacgguacaugcaaucaagccggggaacaucgacgugauaaaagaucuguagcgcucgcgccccacguagggauggggcucgauacuagaacacaaacauggaugagugcugaaggagcauggagacaaguagagaaaguggaaacaugggccuuaagacacccaggauuuacuauccucgcauuauuuuuagcgcauuauauaggcacaucauugacucaaaaagugguuauauucauauugcuaauguugguaaccccaucaaugacaaugaggugugucggaguuggaaaccgagacuuuguggaaggguuaucaggagcuacguggguagacguugucuuagaacacggaggcugugugacgacuauggccaaaaauaaaccaacacuugacauagaauuacagaaaacugaggcaacacaacuugcaacacucagaaaauuaugcauugagggaaaaauuacaaauguaacaacagauucacgauguccaacacaaggagaagcagugcuaccggaagaacaagaucaaaauuauguuuguaaacauacuuauguugaucgggguugggguaauggcugugguuuauuugguaaagggucauuaguuacaugugcaaaauuucaaugucuagaaccgauagaaggaaaaguaguucaauaugaaaacuuaaaauauacuguaauaauaacuguccauaccggcgaccaacaccaagugggaaacgaaacacaaggaguuaccgcagaaauaacaccacaagcgagcaccaccgaagcgauacuaccggaauauggaacguugggcuuggaaugcucaccgcguacgggauuagacuucaacgaaaugauccuacuaacuaugaaaaacaaagcauggaugguucauagacaaugguucuuugaucuaccgcuuccuuggacaucgggggccacaaccgagacgccuaccuggaauagaaaagaauugcuaguaacuuuuaagaaugcacacgccaagaaacaggaaguaguaguccuaggcucccaggaaggggcaaugcacacagcccuuacgggggcaacagagauacaaaauucuggaggaacuucaauuuuugcaggucauuuaaaauguagauuaaaaauggauaaacuggaauuaaaagguaugagcuacgccaugugcacaaauacuuucgugcucaagaaagaaguaagugaaacacagcaugggacuauuuuaaucaaaguagaauacaaaggcgaagauguuccauguaagauuccauucagcacugaggacggacaagguaaagcacauaacggcagacuaaucacggcuaaccccgucgugaccaagaaagaagaaccaguuaauauagaggcagagccuccauuuggagaaaguaacauuguaaucgguaucggagauaacgccuuaaagaucaauugguacaagaaagggucaaguauaggaaaaauguuugaagcgacggcacgaggggcuagaaggauggcgauucuaggcgacacggcaugggacuucggcagcguagggggaguucugaacucgcuagguaaaaugguucaucaaaucuuugggagugcauacacggcuuuauucagcggugugucauggguaaugaaaauaggaauagggguacuacugacauggauaggguuaaauucuaaaaauacgucaaugucguuuucuuguauagcaauagguauuauuacccuuuaucuuggagccgugguccaagcugacaugggauguguaaucaauuggaaagguaaggagcuaaaaugugggucugguauauuuguaacaaacgaaguucauacauggacggagcaauacaaauuccaagccgauucacccaaaagauuagccacagcaauagccggcgccugggagaacggcguuugcggaauacguagcacaacaagaauggaaaacuuguuguggaaacaaauugcuaaugaauuaaauuacauacuuugggaaaauaauauaaaguugacaguaguagugggagauauaauaggcgucuuggaacaagguaaacgaaccuuaacuccacaaccaauggaacugaaauauucauggaaaacaugggggaaagcaaaaaucguaacagcggaaacacaaaauucauccuuuauuauugacggaccaaacacacccgaguguccgagugcaucgagagcuuggaacguuugggaagucgaagauuauggauuuggaguauuuaccacaaacauauggcuaaaauuaagagaagucuacacacaacuuugugaccauagacuaaugagcgcggccguaaaagaugagagggcagugcaugcagauaugggauacuggauagaaucgcagaaaaauggaucguggaaauuggaaaaggcaucguuaauagaagugaaaacauguacauggcccaaaucucauacacuauggaguaaugggguacucgagagugacaugauuauaccaaaaaguuuagcgggacccauaucacagcauaauuauaggccgggauaucacacucagaccgcgggccccuggcauuuaggaaaacuagaacuagauuuuaacuauugcgaggguaccaccguugucauaacggaaaacuguggcacaaggggucccagucugagaacaacgacuguaagugggaaauugauccacgaaugguguugcagaucaugcacucucccaccauugcgauacaugggagaagacgguugcugguaugggauggaaauacgaccgauuucagagaaagaagaaaacaugguaaaaaguuuaguaagugccggaaguggugaagucgauaacuuuaccaugggaguccuaugucuggcaauacuuuuugaagaaguaaugagaggaaaguuuggaaagaagcauaugauagcugggguauucuucacauucgugcuuuuacuaucaggucaaauaacauggcgcgacauggcccacacauuaauuaugaucggaucuaacgcaagcgacagaauggguauggguguaacuuaccuagcauuaauagcaaccuuuaaaauccaaccauuuuuagcauuagguuucuuuuugagaaaauuaacaucucgcgaaaaucuacuuuuagggguuggacuagcuauggcaacaacgcuucaauuaccagaagacauagaacaaauggccaacggaauagcgcucggauuaauggcauugaaauuaaucacgcaauuugaaacguaucaacuauggacggcacuaaucagcuuaacauguagcaauacaauauucacuuuaacaguagcguggcgaacugcuacuuuaauauuagcgggggugagccuacuuccagucugucagagcucaucaaugcgaaagacugauugguuaccuaugacaguagcugcaaugggaguuccgccucuaccucucuucaucuucagccuaaaagauacauugaaaagacgcagcuggccguugaacgagggagucauggcaguggggcucgucucaauccuagcgagcucauuauuacgaaaugacguucccauggcagguccguuaguagcugggggucuguuaauagccuguuaugugauaacugguacaucagcggaccuaacugucgaaaaagcugcagaugugaccugggaggaagaagccgaacaaacagguguuucccacaaucugaugauaacaguagaugaugacggaacaaugcguauaaaagaugaugagacagagaauauauuaacaguacuacuaaaaacugccuuacuuauuguuagcggaauauucccguauaguauuccagcgacacuacuggucuggcauacauggcaaaagcaaacgcaaagaagugguguacuuugggauguuccuucgccgcccgaaacacagaaagcugaguuagaagaaggcguuuacagaauaaagcaacaaggcauauuuggaaaaacacagguaggagucggcguacagaaagaagguguguuccacacgauguggcauguaacaagaggagcaguucuaacauacaaugggaaacgucucgaaccgaacugggccucaguaaagaaagauuuaauaucauacgggggcgguuggagacuuagcgcgcaguggcaaaaaggugaagaggugcaaguaauagcaguggaaccgggaaagaaccccaaaaauuuucagacuaugccggguacauuucaaacaacuacaggggagauaggugcuauagccuuggacuucaaacccggcacaagugguucacccauaauaaacagagagggaaaaguaguaggguuguacggaaacggagucgugaccaaaaauggcggguauguaagcggaauagcacagaccaacgccgaaccagacggaccaacacccgaacuggaggaagagauguuuaagaaaaggaauuugacuauaauggacuuacauccuggaaguggaaaaacaaggaaauacuuaccggccauagugcgagaagcaauaaaaagaagguuacguacuuuaauacucgcacccaccagagugguggcagcagagauggaagaagcgcuuaaaggauuaccaaucagguaccaaacaacugcuaccaaaagugagcacaccggccgcgaaauaguggaucuaaugugccaugcaaccuuuacuaugcgacuauuaucaccaguacgcgucccaaacuauaaccuaaucauuauggaugaagcacacuuuacagacccugccucaaucgcugcaagaggcuauauuucaacccggguuggaaugggcgaagcggcagcaauauucaugacagcaacuccaccuggcaccgccgaugcguuuccacaaagcaaugcccccauucaagacgaagagagagacauucccgagagaucguggaacuccgggaacgaguggaucacagauuucgcaggaaaaaccguaugguuuguccccucuauuaaagcugguaacgauaucgcaaauuguuugaggaaaaacggcaagaaagugauacaguuaucaagaaaaacauucgauaccgaguaccagaaaacgaaacuuaacgacugggauuuuguugucaccacggauaucagugaaaugggagcaaacuucaaagccgacaggguuauugauccacggaggugucuaaagcccgugauacuuacugacggucccgaacgaguaauacuagcagguccaaugccuguuacagcagcuucugcugcacagagacgcggucguguuggaagaaauccucaaaaggaaaacgaucaauacauauucacagggcaaccgcuuaauaacgacgaggaccacgcacauuggacagaggcaaagaugcuacuugauaacauaaacacgccagaagggauaauaccggccuuauucgaaccagaacgagaaaaaucggcagcaauugauggagaauaucgacucaaaggagaaucuagaaaaacuuuuguugaacucaugagaagaggggaucuuccuguguggcuugcacauaaaguggcgagugaggguaucaaauacacagaccggaaauggugcuuugacgggcaacggaacaaucaaauacuugaggaaaacauggauguagaaaucuggacaaaagaaggugagaagaagaaacuuagaccgagguggcuagaugcucguacguacucggauccucuugcacucaaggaguuuaaagauuuugccgcugguagaaaaaguaucgcauuagaucuaguaaccgaaaucgggcguguuccaacucaccuugcacauagaaccagaaaugcauuagacaaccucgugauguugcacacuucagaacacggaggaaaggcuuauagacacgcgguugaagaauuaccugaaacuauggagacucugcuuuuacucggauuaaugauuuuauuaacgggaggggcaaugcuauucuuaauaagugggaaaggaaucggcaaaacgucaaucgggcuaaucugcguaauugcgaguagugguauguuauggauggcugaaauaccgcuucaauggauugcaucugcgauuguccuagaauuuuucaugaugguucucuuaauaccugaaccugaaaaacagagaacuccacaagauaaucaauuagcguacguggugauagguauucuuaccuuagcagccauaauagcagccaaugaaaugggcuugcuugaaacgacuaagcgugaccuagguaugucccgggagccgggaguggucaguccuacuuccuaucuugauguagauuugcauccugccagugcauggacuuuauacgcgguggccacaacgguuaucacgccaaugcugcggcacacaauugaaaacucaacagccaaugugucacuggcagcuauagcuaaucaggcgguuguacugauggguuuagauaagggcuggccaaucaguaaaauggauuuagggguaccccuuuuagcucuggguugcuacucucaagucaacccuuugacacuuacggcugcuguccuuuuacuuauuacucacuaugcuauaauugguccuggacugcaagcaaaggcuacaagagaagcacaaaaacgaacagccgcagguauaaugaagaauccaacagucgauggcauuaugacaauagauuuagauccagucaucuaugauagcaaguucgaaaaacaauuaggacaaguuauguuacuggugcugugcgcgguucaauuacuauuaaugcgaacaagcugggcucuaugcgaggcauuaacauuagcaaccggacccauaacuacgcucugggaggguucaccaggcaaauuuuggaauacgacgaucgcaguaucgauggcgaauauauuccgagggaguuaucuugccggugcaggauuagccuuuucaaucaugaaaagugucgguacggggaaacgagguacaggaucgcaaggugaaacgcuuggcgaaaaauggaagaagaaauugaaucaauugucacguaaagaguucgaccuauacaagaaaucggguauaaccgaaguagauagaacagaagccaaagagggauugaaaaggggugaaauuacacaucacgcaguaucccgaggaucugcgaaacuccaaugguuuguagaacgaaacauggucauuccagagggacgggucauagacuugggauguggacgugguggguggagcuauuauugcgcgggucuaaagaaaguuacugagguaagaggcuauacaaaaggagguccaggacacgaggaaccuguacccaugaguacauauggauggaauauuguaaaacuaaugucugguaaagacguauucuacuugccaccagaaaaaugugauaccuugcuuugcgacauuggugaauccucccccucgccaacaguugaagaaagucgaacuauaagaguauuaaagaugguggaaccuugguugaagaauaaccaauuuugcauuaagguacuaaauccguacaugccugcuguaauugagcauuuagaacgauuacagcguaaacacgggggaauguuggugagaaauccgcuuuccagaaauaguacgcaugaaauguacuggauaucuaauggcacagguaauauaguagccaguguuaacaugguaagccgucuacuacugaacagauuuacuaugacgcauaggagaccaacuauagaaaaagacgucgauuugggcgcaggaacacgacacgugaaugcagaaccugaaacucccaacauggauguaauaggagaaaggaucaagaggaucaaagaggagcacaauaguacguggcauuacgacgacgaaaauccauauaaaacuugggccuaucauggcuccuacgaaguaaaggcgacagguucugcaucgucuaugauuaauggcguaguaaaacuucuuacgaaaccaugggauguaguacccaugguaacacaaauggcgaugacagacacuacaccguucggccagcagagaguauucaaggagaaaguagauacgcggacuccgcgauccaugccggguacgcgacgagucaugggcauuacugcugaaugguuauggagaacauugggucgaaauaagaagccgagacuaugcacacgagaagaguucaccaagaaaguucgaacgaacgccgcaaugggcgcggucuucaccgaagaaaaucaaugggauucugcuaaagcagccguagaggaugaagauuuuuggaaacuuguagaccgggagagggaacuacacaagcucggaaaaugugguucgugcguauauaacaugaugggaaaaagggagaagaaacuaggcgaguucggcaaagcgaaagggagucgagcaauaugguauaugugguugggugcacgauaccuugaguucgaagcauuaggauuuuuaaaugaagaucacugguuuucccgggaaaauaguuauucgggaguggaaggcgaaggacuacauaaguuagguuacauccuaagggacauaucuaaaauuccgggaggugcaauguaugcagaugauaccgcaggcugggacacaagaauaacggaggaugauuugcacaaugaggagaaaauaacacaacaaauggauccagaacauagacagcuagcuaacgcaaucuuuaagcuaacauaucagaacaaaguaguaaaaguacaacgaccuacaccgacaggcacuguaauggauauuauaucacgcaaagaucaaagaggaaguggucagguggggacauacggcuuaaauaccuuuacaaacauggaagcacagcuaauaagacaaauggagggagagggugugcuaucaaaagccgaucuagaaaauccacaccuuccagagaagaaaauaacccaauggcuagaaacaaaagguguggaaagacuuaaaaggauggcaauaucaggugacgauugcguaguuaaaccaauagaugaccguuuugcaaacgcuuuauuggcauuaaacgauaugggaaagguuagaaaagauaucccacaguggcaaccuucuaaggguuggcaugauuggcaacaaguaccauuuuguucucaucacuuucaugagcucaucaugaaggauggacguaaacuugugguuccguguagaccacaggaugaacuuauaggucgagcacguauuucucagggggccggcuggucguuaagagaaacagccuguuugggaaaagcguacgcacaaauguggaguuuaauguauuuccaccgaagggacuuacgauuagcaucaaaugcaauaugcuccgcuguaccuguacauuggguaccuacuucaagaacuacauggaguauacaugcacaccaccaauggaugacuacagaagacauguugacuguuuggaacagagucuggauagaggauaaccccuggauggaagacaaaaccccggucaccacgugggagaauguaccuuaucuuggaaaaagagaagaucaauggugcgguagucuuauaggucuaacaaguagagccacuugggcucaaaacauacccacggcaauucaacaaguccgcagcuugauuggcaacgaggaauuuuuagauuauaugccaucaaugaaacgauuuagaaaagaagaagaaucggaaggggcuaucugguaa

SEQ ID NO: 23428 - RNA, 9873 nt, Artificial Sequence
  derived and/or modified CDS sequence (opt6) from DENV-3__FJ639800__SS-prME
acuucucuuugucuaaugaugauacuaccagcagcccuagcguuccaccuuacaucacgugacggcgaacccagaaugauagugggcaaaaaugaaagggguaaauccuuacuauucaaaacggcuucuggaauaaauauguguacauuaaucgcuauggaccuuggggaaaugugugaugacacuguaacauacaaaugcccacauauaacugaaguugaaccagaagauauagauugcugguguaaccugaccaguacguggguuaccuacgguacaugcaaccaagcaggcgaacaccggagggauaaacgaucuguggccuuagccccacauguagguaugggcuuagauacaagaacacaaacguggaugagugcagaaggggccuggaggcaagucgaaaaaguagaaacuugggcauugaggcauccaggauuuacaauuuuagcucuauuucuagcacauuauauaggcacgucucugacacaaaaaguggugauauuuauuuuacucaugcuagucacaccuagcaugaccaugcgaugcgugggaguggggaaucgagacuuuguggaaggccuaaguggcgccacauggguagacguaguccuugaacacggugguugugucacgacuauggcgaaaaauaaacccacauuagauaucgaacuccagaaaacugaagcaacucaauuagcuacauugaggaaauuauguauagaaggaaaaauaaccaauauaaccacagacucgagaugucccacacaaggagaagcgguguuaccagaagaacaagaucaaaauuacguauguaaacacacauacguagacagagguuggggaaacgggugcggccucuuuggaaagggaagccuaguaaccugugccaaauuccaaugcuuagaaccgauugaaggaaaaguuguacaauaugaaaauuuaaaguacacaguuauuauaacgguacauacaggugaccaacaccaaguaggaaaugaaacucagggaguuaccgcugaaauaacaccucaagcaagcacgacagaagcaauacugcccgaauacggaacccuaggauuggaaugcaguccgcgcaccggacuugauuuuaacgaaaugauacugcuuaccaugaaaaauaaagcauggauggugcaccgccaaugguucuuugaucuuccauuaccuuggacaaguggggcaacaaccgaaacccccacauggaacagaaaggaacuauuggugacguuuaaaaacgcccaugcuaaaaagcaggaagugguaguccuaggaucccaggagggagcaaugcacacagcauuaacaggagcaacugagguacagaacaguggugggacaucaauuuuugcuggucaucuaaaaugcaggcuaaaaauggauaaacuagagcuaaaaggaaugaguuaugccauguguacuaauacauuuguguugaagaaagaaguaucugaaacucaacacggcacaauuuuaauuaagguugaauauaaaggggaagauguaccauguaaaauaccguuuucgacagaagauggccagggaaaagcucacaauggacgccucauuaccgcaaacccuguaguaacgaagaaggaggagccaguaaacauagaagcggaaccaccguuuggagaaucaaauauagucaucgguauaggugauaacgcgcuacguauuaauugguacaaaaagggauccaguauugguaaaauguucgaggcgacugcccgaggugcaagaagaauggcuauacuaggagauacagcuugggauuucggaagugucgggggagugcucaacucauuagguaagaugguacaccagauauuugggucagccuacaccgcguuguuuucugggguaagcuggguuaugaaaauuggcauaggaguccuucuaacguggauaggccuaaacucgaaaaauacgucaaugaguuucucguguauagcgaucggaaucaucacacuauaucuaggagccguaguccaagcagauaugggcuguguaauaaacuggaaggggaaagagcuuaaauguggcuccggaauauucguaacaaacgaaguacacacauggacugaacaauauaaguuccaagccgauucaccaaaaagacuagcaacggcuauagcuggagcuugggaaaaugguguuuguggaauaagaagcacaacgcgcauggagaacuuacuuuggaaacaaauagccaacgagcuaaacuauauccugugggaaaacaauauaaaacuuacaguaguagucggugauacaauaggaguacuugaacaagguaaacgaacacugacaccacagccuauggaguuaaaguacaguuggaaaacaugggguaaagcuaaaauaguaaccgcggaaacgcaaaauuccucauuuauaauagacgguccuaauacuccagaauguccuagugccagucgagcauggaauguaugggagguagaagacuauggcuucgggguauucacuacaaacaucuggcuuaagcuacgcgaaguauacacucagcucugcgaucaucgacucaugucugcagcugugaaagacgaaagagcaguacacgcagacaugggauacuggaucgaaucccagaaaaauggaucuuggaaauuggaaaaagcaagccuuauugagguuaaaacauguacauggccuaaaagucauacuuuauggucaaauggcgugcucgaaucagauaugauaauuccaaagucccuugcuggcccuaucagccaacacaauuacagaccggguuaucauacacaaaccgccgguccauggcaucucggcaaacucgagcuagauuuuaacuauugugagggaaccaccguggugauaacagagaauugcgguacacgcgguccuucauuacggacgaccacuguaucaggaaaguuaauacacgaaugguguugucgaagcuguacacuuccaccacuaagauacaugggagaagaugguuguugguauggaauggaaauccgaccaauaagugaaaaagaggaaaacaugguuaaauccuuaguaucagcaggaucuggggagguugacaauuucaccauggggguucuauguuuagcaauccucuucgaagagguaaugaggggaaaguuuggcaagaaacauaugauagccgguguguuuuucacuuuuguucuucuguuaagcggccagauuacauggcgugauauggcgcacacauuaauaaugauagguuccaaugcuagcgacagaauggguaugggcguaacauauuuagcacugauagcaacuuucaaaauucaaccauucuuagcuuuagguuucuuuuugagaaaacuuacgagccgagaaaaccuacuacuuggcguggguuuagcgauggcgacgacacuacaauuaccagaagauauagagcagauggccaacggaauagcccuuggacuaauggcuuugaaacucauuacccaguuugaaacauaucaacuuuggacagcauuaaucucguuaacaugcucaaauacgauauuuacucucacgguagcauggagaacugcaacacucauucuagcaggagucucacuauugcccgucugucaaagcaguaguaugcgaaaaacagauuggcuacccaugacaguagcagcuaugggagucccaccacuaccuuuguuuauuuuuaaucuaaaagauacauuaaaaagaagaagcuggccacuaaaugaagggguaauggcugucggccuagucucaauauuggcauccaguuuguuacguaacgacguuccuauggcggguccgcuaguagcaggaggguugcucauagcauguuacguuaucacaggaaccagcgcugauuuaacaguugaaaaggcagcggacguuacuugggaagaggaagccgaacaaacugggguuucacacaacuugaugaucacaguugaugaugacggcaccaugagaauaaaggaugaugagacagagaauauauuaacuguuuugcuuaaaacagcauuacuuauaguuuccggaaucuucccauauaguauaccugccacucucuugguuuggcacacauggcaaaagcaaacacaaagaucaggaguucucugggacguaccaagcccaccagagacucaaaaagccgagcuggaagaaggugucuacagaauaaaacaacaggggauauucggcaaaacucaaguugggguaggaguccaaaaagaaggagucuuccauaccauguggcauguuacaagaggugcuguucuaaccuacaacggaaaacgacuugaaccuaacugggccaguguaaagaaggacuugauuuccuacggaggagguuggcguuuaagugcacaauggcaaaagggggaggagguccaaguaauagcagucgaaccuggcaagaauccuaaaaauuuccagacuaugcccggaacguuccaaacgacgacaggagaaaucggcgcgauagcccuggacuuuaaaccaggcacaucuggauccccaauaauaaauagggagggaaagguuguaggauuauauggcaacgggguaguuaccaaaaauggaggauacguaaguggaauagcacaaacuaaugcagaaccagauggaccaacgccagagcucgaagaagagauguucaagaaaagaaauuugacgaucauggaccuacacccgggcagugguaaaacacgcaaauauuugccagcaauuguccgugaagccauaaaaagacggcuacgcaccuuaauucuagcgccgacuaggguaguugcugccgaaauggaggaagcauuaaaaggauuaccuauuagauaccaaacuacagcgacuaagucagaacauacagguagagaaauaguggaucuaaugugucacgccacuuucacuaugagguuacuaucacccgucaggguaccaaauuacaauuugauaauuauggaugaagcacauuuuaccgauccggcaucaauagcagcgagaggguauaucucaaccagagugggaaugggggaagcagcugcgaucuuuaugacugcgacgccaccaggcacagcagacgcuuuuccccaaucuaacgcaccgauacaagaugaggaacgagacauuccagaaagaucuuggaacucuggcaaugaauggaucacagauuucgcggggaaaacgguaugguuuguucccucuauaaaagccgguaaugauauagccaauugccugaggaagaaugguaagaaagugauucaauuaucuagaaaaacauuugauacagaauaucagaaaacgaaauuaaaugauugggauuuugugguuacuaccgauauaucagaaaugggggcuaauuuuaaagcggauaggguaaucgauccgaggaggugcuuaaaaccugucauucuaacggacggaccggaacgaguaauucucgcagggccuaugccggucaccgcagcaagugcugcucaaagacgugggcgaguagguaggaauccacagaaggagaaugaucaauacaucuucacaggacagcccuuaaauaaugaugaagaucaugcacauuggacggaagcaaaaaugcuucuugacaacauaaauaccccugaagguauaauaccugcacucuuugaaccagagcgagaaaagucggcugcaauagauggagaauauagauuaaaaggagaaaguaggaagacuuuuguagaauuaaugagaagaggugauuuaccaguaugguuagcgcacaaaguagcaucagaagguaucaaauacaccgauagaaaauggugcuuugauggccaaagaaauaaucaaaucuuagaagagaauauggacgucgagauauggacuaaagagggugaaaagaagaaacuccgccccagauggcucgacgcacgcacuuauucagacccacuugcccucaaagaauuuaaagacuuugcggccggacggaaaaguaucgcccucgacuuggucacugagauuggacgcguuccgacucaucuggcacauagaacuaggaaugcacuagauaauuugguuaugcuccauacaagugaacauggagguaaggcauauaggcaugccgucgaagaacuaccagaaaccauggagacgcuucuacuccuuggacuuaugauauugcugacgggaggugcuauguuguuccuaauaucagguaaaggcauuggaaaaaccaguauaggauuaauuugcgugauagccucuaguggcaugcuauggauggcugagauaccucuacaauggauugcuucggccauuguacuggaauuuuucaugaugguccuucucauaccagaaccggagaaacagaggacuccacaagacaaucaauuagccuauguuguuaucgguauacuuacacucgcugcaauaauugccgcaaaugaaauggguuuacuagagacaacaaaacgagaccuagggaugagcaaagaacccggaguuguuucgccaacauccuaccuugaugucgauuuacaucccgcaagugccuggacccuauaugccguugcgacaacggugauaaccccaauguuaagacacacaauugaaaauuccaccgcaaacgucucgcuagccgcaauagcgaaucaagccguuguacugaugggacuagacaagggauggcccauuucaaaaauggauuuaggaguaccuuugcuggcgcuaggguguuacagucaaguaaauccguuaacacucacugcagccguauuacuacuaauuacacacuaugcgauaauaggcccggguuuacaggcaaaggcaacacgcgaggcccagaaaagaaccgcagcuggcauaaugaagaacccaaccguugaugggauuaugacuauugacuuagaccccgucauauaugauaguaaauuugaaaaacagcucggccaagugauguugcuuguuuuaugcgccguucagcuacuuuuaaugcguacuuccugggcucuaugugaagcauugacacuagccacgggaccuauaacuacauuaugggagggaucuccugguaaguuuuggaauacaacuauagcuguuucaauggcaaauauauuucggggaaguuacuuagcuggagcgggauuagcuuucaguaucaugaaaucugugggaaccgggaaaagagguacagguucacagggcgaaacgcuaggcgaaaaauggaaaaagaaauuaaaccaacugucuagaaaagaguucgaccuauauaagaaaucaggaauaacggaagucgaucgcacagaggccaaagaaggucugaaaagaggugaaauaacucaucacgcagucucacgcgggucggcaaaacuucaaugguuuguugaaaggaauaugguuauaccagaagggagggucauagaucuaggauguggacgaggcggauggaguuauuauugugcagguuuaaagaaaguuacggaagugcgcggauauaccaaaggcggacccggacacgaagaacccguaccgaugaguaccuacggguggaacaucguuaaauuaaugucuggcaaagaugucuuuuaucuucccccagagaaaugcgacacacuacuaugugacauaggugaaucuucaccuagcccgacuguagaagaaagucgaacuauaagaguauuaaaaaugguagaacccuggcucaaaaauaaccaauuuugcauuaaaguccuaaacccauacaugcccacaguuaucgaacaucucgaaagauuacaaagaaaacauggaggaauguuagugagaaacccgcucucaaggaacagcacacacgagauguauuggauuucaaauggaaguggaaauauagucgcgucggucaacaugguaucaagacugcuuuugaauagauucacuaugacgcaucgccggccgacaauugaaaaagacguggacuuaggagcaggcaccagacauguaaacgcagaaccggagacuccaaacauggacguaauaggcgagagaaucaaacguaucaaggaagaacauaacaguacguggcauuaugacgacgaaaacccguauaaaacaugggcauaucauggaagcuaugaagucaaggccacgggguccgcaucuagcaugauuaacgguguaguaaaacuauuaaccaaaccaugggacguaguaccaauggugacccaaauggcaaugaccgacacuacuccguuugggcaacaaagaguuuucaaagaaaagguagauacuagaacucccaggagcaugccgggaaccaggaggguuaugggcauaacagcagaaugguuauggcggacucuuggacgaaacaagaaacccagauuguguacuagagaggaguucaccaagaaaguucguacaaaugcagcuaugggagcggucuucacagaagaaaaucaaugggauucggcuaaagcagcaguagaagacgaagacuucuggaaauuaguggauagagagagggaauuacauaaacuugguaaaugcggaucauguguauauaauaugaugggaaaaagagaaaagaaauugggcgaauuuggaaaggcaaaaggaagcagagcaauuugguacauguggcugggugcucguuaucuugaguucgaagcgcuaggguuuuuaaaugaggaucauugguuuucacgugagaacucauauucaggaguugagggcgaagggcuccacaaacuaggauacauacugagggacaucucuaaaauaccagggggagcaauguacgccgaugauaccgccgguugggacacucgaauaaccgaggaugaccuucacaaugaagagaagauuacacaacagauggauccggaacaccgacaguuagcgaacgccaucuucaaacuuacuuaccaaaauaaaguugugaaaguacaaagaccgacaccuacagggaccguaauggacauuaucucccgaaaagaccaacgaggaucaggucaaguggguacguaugguuuaaacacuuucaccaauauggaagcgcaauuaauacgacaaauggaaggagaaggcguauuaaguaaagccgaucuagaaaacccucauuuaccagagaagaaaauaacacaauggcuagaaaccaaagguguagagcgauugaaacgaauggcuaucaguggagacgacugcgucguuaaaccaauagacgaucgguuugccaaugcucuauuagcacuuaaugauaugggaaaaguucgaaaagacauaccucaauggcaaccuucgaaaggcuggcaugauuggcagcaaguuccguucugcagccaucauuuucaugaguuaauaaugaaagacggucgaaaacuuguuguaccgugucguccacaggaugaacugauagggcgagccaggauaucacaaggagcagguuggagucucagagaaacggcaugucuaggaaaagcguacgcccagauguggucacuaauguacuuccauaggagagaucuaagacuugcaaguaaugcgauaugcagugccguaccaguacacuggguaccaacguccagaacgacauggagcauacaugcucaucaucaauggaugacgacugaggacaugcuuacaguauggaacagaguuuggaucgaagauaauccauggauggaagacaagaccccaguaaccacgugggaaaaugugcccuacuuaggaaagagagaagaucaaugguguggaaguuugaucggacugacaagccgagcuacaugggcucaaaauauaccaacugcaauacagcaagugagaucauuaauagguaacgaagaguucuuagauuacaugccauccaugaagagauuuaggaaagaagaagaaucagaaggggcgauuugguaa

SEQ ID NO: 23429 - RNA, 9873 nt, Artificial Sequence
  derived and/or modified CDS sequence (opt6) from DENV-3__FJ639801__SS-prME
acuagccuaugccuaaugaugauucuaccggcagcucuugcauuccaccuuacaucacgcgauggugaaccgaggaugauugucgguaaaaaugaacggggaaaaucauuacuauucaaaaccgcgucggggauuaacaugugcacacuaauugcaauggaucuuggugaaaugugugaugauacaguuaccuacaaauguccucauauuacagagguugagccugaggacauagauuguuggugcaauuuaacgaguacauggguuacguauggaacguguaaucaagcaggagagcauaggagagacaaacguaguguagcacuugcaccacaugucggaauggguuuagauaccagaacacaaacuuggaugagcgcggaaggcgcuuggcgccaaguagagaaagucgaaacaugggcucuacgacauccugguuucacgauauuagcacuuuucuuggcacauuauaucgggacgucauuaacgcaaaaaguagugauauuuauauuauuaauguuaguaacaccaucgaugacuaugaggugcguuggaguugggaauagggacuuuguagagggucuaucgggcgcaacauggguugacgucguacucgaacaugguggcuguguaaccacaauggcuaaaaacaaaccuacauuagauauagaauuacagaaaaccgaagcaacccaauuagccacccuuagaaaacuauguauagaagguaaaauaacuaauaucacgaccgauucaaggugccccacucaaggagaagccguguuaccagaagaacaagaucaaaacuaugugugcaaacauacuuauguagaccgagggugggguaauggaugcggguuauuuggcaaaggaucacugguaacuugugcaaaauuucaauguuuagaaccuauagaagggaaaguugugcaauacgaaaacuuaaaauacacgguaauaauaacgguacauacuggggaucaacaucaaguugggaaugaaacccaaggagucacagccgaaauaaccccacaagcgaguacaacagaagcaauacuaccagaguacgguaccuugggcuuagagugcucaccacgaacgggauuagacuuuaaugagaugaucuuacugacuaugaaaaauaaagcauggaugguacacagacaaugguuuuucgaucuuccuuuacccuggaccucaggggcuacuacagaaacaccaacauggaacaggaaagaacuccuuguaacauuuaaaaaugcucacgcgaagaaacaagagguugugguuuuggggagccaagaaggagcuaugcacacagcauuaacuggugcuaccgaaauccaaaacucuggagggacaagcauauuugccggccacuugaaaugccgccuuaaaauggauaaguuggaauugaaaggaaugucauaugcgaugugcacaaauacuuuuguacuaaagaaagagguaucagagacacagcacggaacaauuuugaucaaaguagaauacaaaggagaggacguacccugcaaaauaccauucucuaccgaagacggucaaggaaaagcacauaacggucguuuaauaacggcuaauccaguaguaacuaagaaagaagaaccuguuaacauagaagccgaaccaccuuuuggugaaucaaauaucguaauaggcaucggugauaacgcacuaaaaauaaauugguacaagaaagguucuuccauagguaagauguucgaagcuaccgcccgaggcgcaaggagaauggccauuuugggggauacggccugggacuucgggucgguuggagguguauuaaauagccuagguaagaugguucaucagauuuuugguagcgcguacacggcauuauuuucaggggucaguuggguuaugaagauaggaauaggagugcuacuaaccuggauagggcuaaacaguaagaacacaagcauguccuucagcugcaucgcuauagggaucauaacucuguacuugggugcaguagugcaggcugacaugggauguguuauaaauuggaaaggcaaagaacuaaaaugugggucuggcauuuucgucacuaaugaaguacauaccuggacggagcaguauaaguuucaagccgauaguccuaaacgguuagcuacugcgauagccggugcaugggaaaacgguguauguggcaucagaucaacuacaaggauggagaaucuucuguggaagcaaauagcaaaugaacugaauuacauuuuaugggagaacaacauuaaacuaacuguaguugucggugacacuauagggguucucgagcaagggaaaaggacauuaacgccacagccgauggaacugaaauauaguuggaagaccuggggaaaagcaaaaauaguaacggcagagacacagaauaguucauuuauaauugauggacccaauacaccggagugcccuucugcguccagagcuuggaacgugugggaaguugaggauuacggcuucggaguguucacaaccaauauuugguuaaaacuccgagaagucuauacacaacuuugugaucaucgcuuaaugucagcagcaguaaaggaugaacgggccguccacgcagacaugggauauuggauugaaagccagaaaaaugggaguuggaaauuagagaaagcaucucuaauagaaguaaaaacuuguacuuggccuaaaucacauacauuauggucgaacggaguucuagaaucugauaugauaauaccaaagaguuuagcagggccaauaagccaacacaacuaucgaccuggauaucacacucagacugcagggccguggcauuugggaaagcuagaacuagauuuuaacuacugugaaggaacaacagucgugauaacugagaacuguggcacgagaggaccgagucuaaggacuacaacaguuucuggcaaacuaauucaugaaugguguugcagaagcugcacuuuaccaccuuuaagauacaugggagaggauggaugcugguaugguauggaaauccguccaauaagcgaaaaggaggaaaacaugguaaagagucuugucagugcgggaucgggagagguggauaacuuuacaauggggguacuuugccuagcuauauuauuugaagagguuaugcgcgggaaguucgguaagaaacauaugauagcuggaguauuuuucacuuuuguccuacuauuauccggacaaaucacauggagagauauggcucacacucucauaaugauagguaguaacgcuagcgauagaaugggaaugggcgucacguacuuggcucuuauagcaacuuucaaaauccaaccauuuuuagcacuaggauuuuucuuacguaaguugacgucuagagaaaaucuguugcuaggaguagguuuggcuauggcuacuacguugcaacuaccagaagauauugagcaaauggcaaacggaauagcucucggacuaauggcuuuaaaacucauaacgcaauucgaaaccuaccaacuuuggaccgcauuaauaucauuaaccuguucuaacacuaucuuuacuuuaacgguggcuuggagaacagcuacguuaauacucgccgguguuucucuauuaccagugugucaauccucuucuaugagaaagacagacuggcucccaaugacaguagcagcuaugggaguuccaccccuuccauuauucauauuuucacucaaagauacuuuaaagaggagaaguuggccacuuaaugaaggagugauggcaguaggcuuaguaucaauucuugccaguucauuauuaagaaaugaugucccaauggcaggaccgcucguagcgggaggauuauugaucgcuuguuacgucaucacugguacaagugcggaucucacagucgaaaaagccgcagauguaacaugggaagaagaagcagaacaaacaggagugucacacaaccuaaugaucacaguagaugaugacggaacuaugagaaucaaagaugacgaaacugaaaacauacuuacgguacuuuugaaaacagcccuacuuauaguuucaggaauauucccuuauucgauaccggcgacacuccuaguuuggcacaccuggcaaaaacagacgcaacgaagcggcgugcugugggacgucccaucaccacccgaaacccaaaaagcagaacuagaagaaggaguguaccgaauuaaacagcaggggaucuucgguaaaacucaaguagguguaggcguacaaaaagaagggguauuucauacaauguggcauguaaccaggggagccguauuaacauguaauggaaaaagacuagaaccaaacugggcgucagugaagaaagauuugaucucguauggggguggauggagauuguccgcacaguggcaaaaaggggaagaaguucaaguaaucgcaguggaaccuggcaaaaauccaaagaacuuccaaaccaugccaggaacauuccaaacuaccacgggagaaaucggagcuauagccuuggauuuuaaaccuggcacgucugguaguccuaucaucaauagagaaggaaaaguuguagguuuauacggcaauggaguggugaccaagaauggcggauacgugagcgggauugcucaaacaaaugcugaaccugauggaccaaccccagagcucgaagaagaaauguucaagaaaaggaacuugacaauaauggauuuacacccaggcucggguaaaacccgaaaguaucuccccgcgaucguucgcgaagcaauuaaacguagauuacgaacguugauauuagccccuacaagagucguggcggcagagauggaagaagcauugaaagggcuaccuauacgauaccaaacaacugcaaccaaaagugaacauacuggacgugaaauaguagauuuaaugugucacgcuacauucaccaugcgauugcuauccccuguaaggguccccaauuauaaucuaauuauaauggaugaggcacauuuuacagauccagcauccauagcagcaagaggcuacauaaguaccagaguaggcaugggugaagcggcagcaaucuucaugacagcuacaccacccgguaccgcagacgcauuuccacaaagcaaugcuccuauucaagaugaagaacgcgauauaccggaacgaucuuggaacaguggaaaugaguggauaacggacuucgccgguaaaacagucugguuugugcccaguaucaaggcaggcaaugauaucgcgaauugccugcgcaaaaacgguaaaaagguaauucaauugucaaggaaaacguuugauacagaauaucagaaaacuaaacuaaaugauugggacuuuguggugacgacagauaucucugaaaugggagcuaauuucaaagcagauagaguuaucgauccaaggcgauguuuaaaaccaguaauauugacugaugguccugaacgcguaauacuugcuggucccaugccuguuacggcugcguccgcagcgcaaagacguggaagagucggucgaaauccccagaaagaaaaugaccaauauauauuuacgggacaaccccucaacaacgacgaggaucaugcccauuggaccgaagcgaaaauguuauuggauaauaucaauacaccugaaggcauaaucccugcacuauucgaaccagaacgugagaagucagcugcuaucgacggcgaguauagauugaaaggggaaucgcgaaagaccuuugucgaacuaaugagacgaggagauuugccaguuugguuagcacacaagguagcaucagaaggcauaaaauauacagaccgcaaaugguguuuugauggucaaaggaauaaucaaauauuagaagaaaacauggauguugaaauauggaccaaagaaggugaaaagaaaaagcucagaccaagaugguuagacgcucguacauacucagacccccucgcacugaaagaauuuaaggauuuugcagcaggaagaaaaucaauagcguuggaccuuguaaccgaaauaggaagaguuccaacacaucucgcacaucgcacacgaaaugcauuagacaauuuaguaaugcuucacacuagcgaacauggcggcaaagcauaccgccaugcaguagaagaauugccugagacaauggagaccuuacuccuuuuaggauuaaugaucuuacuuaccgguggagcuauguuauucuuaauaucggggaaagguauaggcaaaacuucgauaggucuaaucugugucaucgcuagcagcggaaugcucuggauggcggaaauuccauuacaauggauagcaucagccaucguuuuagaguucuuuaugaugguucuacuuauuccggaaccggaaaaacaacgaacgccucaagauaaucaacuugcguauguaguaauagggauccuaacucucgcagcuaccauugcggcaaacgaaaugggccugcuagagacaacaaaacgcgaucucgguaugucgaaagaaccaggugucguauccccaacaucuuauuuggaugucgaucuucauccagcuucggcauggaccuuguacgcaguugcaaccaccguaaucacuccuaugcuaaggcauaccauugaaaauaguacugcaaauguaucguuggcugccauagcaaaucaggcagugguccugaugggucuagacaaaggguggccuauaucaaagauggacuuaggugugccguugcuagcauuagguuguuacucucaaguaaacccacuuacacuaacagcggcgguauugcuauuaaucacacacuacgcaauaauagguccaggucuacaggcaaaagcaacgcgagaggcucaaaaacgcacagcggcgggaauaaugaaaaauccuaccgucgauggaaucaugacaauagaccuagauccgguuaucuaugacucaaaauuugaaaaacaacuaggucaaguuauguuguuaguccuuugugcuguacaacuucuucuuaugagaacuagcugggcguuaugugaagcucuuacacuugcaaccggucccauaacuacguuaugggaagguucuccaggaaaauuuuggaauacuaccauagcuguuagcauggcaaacauuuuuaggggcaguuacuuggcaggagcaggauuagcauucucuauaaugaaaagugugggaacagguaagagaggaacugguucacaaggagagacuuugggugagaaauggaagaaacgccuuaaccaacuaucacguaaagaauuugauuuauacaagaaaagcggaauaacugaaguggauaggaccgaagcuaaagaagguuuaaaaagaggggaaauaacgcaucaugccguaucucgugggucugcgaaguuacaaugguuuguugaaaggaauauggucaucccugaagguagaguuauagaucucggaugugggaggggcggauggaguuacuacugugcggggcuaaagaaaguaacagagguaagaggguauacaaaaggaggaccgggccaugaagaacccgugccaaugucuacauauggauggaauauaguaaaacuaaugucggguaaagauguauuuuauuuacccccagaaaaaugcgauacacuucugugcgacauuggagagagcucaccaucccccacaguagaagaaaguaggacaaucagaguuuuaaagaugguugaacccuggcuuaaaaacaaccaauucugcaucaaaguuuugaacccauauaugccgaccgucauagaacauuuggaacgccuacaaaggaaacauggaggaauguuagucagaaauccauugucccgcaauaguacacacgagauguauuggauaucuaacggaacggggaauaucguggcuuccguuaacauggucucacgucuacugcuaaacagguucacaaugacacacagacgaccuacaauugagaaggauguagacuugggugcuggaacgagacacguuaacgcggaaccagaaacaccgaauauggaugucaucggagagagaauaaagcgcauaaaagaagaacauaauucaaccuggcacuacgaugacgaaaauccuuacaaaacgugggcuuaucacgggagcuaugaaguuaaagcuacagguagugcuucaagcaugauuaacggagugguuaaauugcuaacaaagccaugggauguaguaccaauggugacacaaauggcgaugacggacacaacuccauucggacaacagaggguuuuuaaggaaaaaguagacacacgaaccccuagaucgaugccaggcacuagaaggguuauggguauaacugcugaauggcuauggagaacucucgguaggaauaagaaaccuagguugugcacccgagaagaguucacuaagaaaguacggacgaaugcagcaaugggcgcaguauucacagaggagaaccaaugggauuccgcgaaagccgcagucgaagacgaagacuucuggaagcuaguugaccgggaacgugaacuucacaagcugggcaaaugcgguuccugugucuauaacaugauggguaaaagagagaagaaacuaggugaauuuggcaaagccaaaggaucaagggcgauuugguacaugugguugggugcgcgcuaccuagaauuugaagcacuaggcuucuuaaacgaagaccauugguucuccagagaaaacucauauuccggagucgaaggcgaaggguuacauaaauuaggguacaucuuacgagacauaaguaaaauuccaggaggggcuauguaugcggaugauacugccggaugggacacaagaauaacugaagacgauuuacacaaugaggagaaaauaacucaacaaauggauccagaacaucgucaacuugcaaacgcuauauuuaaauuaaccuaucagaacaaaguuguuaagguacagagaccgacacccacugguacaguuauggacauaauaucaagaaaagaccaaagaggcucaggucagguaggaaccuacgggcuuaauacguucacaaauauggaagcacaacuaauuagacagauggagggagaaggaguuuugaguaaggcagacuuggaaaacccucaccuaccugagaagaaaaucacccaguggcuagaaacaaagggcguagaacgguugaaacgcauggcaaucucuggagacgauuguguaguuaaaccaauagaugaucguuucgcgaaugcuuuauuggcccucaaugauauggggaaaguaagaaaggauauuccacaguggcaaccgagcaaaggauggcacgauuggcaacaaguaccauucuguagccaucacuuccacgagcuuauuaugaaggacgggagaaaacucgucguaccuugucggccucaagacgagcugauaggccgagcacguauaagccaaggugccgguuggucguuaagagaaaccgccuguuuaggaaaagcguacgcacaaauguggaguuuaauguacuuccauagacgagaccuccgccucgcaaguaaugcaauauguagugcggucccgguacauugggugccaacuucaagaacuacaugguccauacaugcucaccaccaauggaugaccacagaagauaugcucacaguuuggaauagaguauggauagaagacaaccccuggauggaagauaaaacuccaguuacaacaugggaaaaugucccauauuugggaaaacgugaagaccaauggugugguagccucauaggucuuacaagucgggcaaccugggcacaaaauauuccgacagccauucaacagguucgcaguuuaauaggcaaugaagaguucuuagacuauaugccaaguaugaaaagauuucgaaaagaggaggagucagagggggcaauaugguga

SEQ ID NO: 23430 - RNA, 9873 nt, Artificial Sequence
  derived and/or modified CDS sequence (opt6) from DENV-3__KF955471__SS-prME
accagucucugccugaugaugauacucccagcggcucuagcuuuucaucugacuucaagagauggagaaccaagaaugauuguagguaaaaaugaaagagguaaaaguuuacuauuuaaaacugcaucugguauuaacauguguacucucaucgcaauggauuuaggugaaaugugcgacgauaccguaaccuauaaauguccucacauaacagaagucgaaccagaagauauagauugcugguguaaccugacaagcacuuggguaacauaugggacaugcaaucaagcaggagaacaucguagagauaaaaggucaguagcacuagcgccucacguaggaaugggauuagacacgcgcacacaaacauggaugucagcagaaggagcuuggcgacaaguggaaaaaguagaaacaugggcuuuaagacaccccgguuucacuauauuagcacuuuucuuggcccauuacauaggaacaucgcuaacucaaaaagucguaaucuuuauucuauuaauguuggucacuccuucuaugacaaugcgguguguggguguagguaaccgagacuucgucgaagguuugucaggagccacguggguggauguaguucuagaacauggcgggugcgucacaacaauggccaaaaauaaaccaacauuagacauagaacuacagaaaaccgaagcaacucaacucgccacucuacguaaauugugcauugagggaaaaauuacgaauauaacaacagauagccgaugcccgacucaaggagaagcaguauugccggaagaacaagaucaaaacuauguguguaaacauaccuauguugaucgggguugggguaacgggugcggacuuuucggaaaaggcagucuagugacuugcgcaaaauuccaaugcuuagaacccauugaagggaaaguaguccaauaugaaaacuuaaaauauacagucaucauaacgguucacacuggagaucaacaucaaguagggaaugagacgcaaggugugacugccgaaauaacaccacaagcguccacaacagaagcaauauuaccggaauacggaacauuaggcuuggaauguagcccucguacaggacuggacuuuaaugaaaugauacuucuaacaaugaaaaacaaagcauggauggugcaccgacaaugguucuuugaucuccccuuaccguggacaucuggagcaaccacggaaacuccaacauggaauagaaaagagcuauuaguaacauuuaaaaacgcccacgcaaagaaacaagaaguaguaguccuggguucgcaagaaggagcaaugcauacugcccucacaggagcaacagagauucaaaacuccggaggaacaucgauauuugcgggacacuuaaaauguagacuaaaaauggauaaauuggaacucaaaggaaugucguaugcuauguguacgaacacguucguacucaagaaagaaguaucagagacucaacauggaacaauauuaaucaagguugaauauaaaggugaagaugugccgugcaaaauaccuuuuucaacagaagacggccagggaaaagcccauaacggaagauuaauaacugccaauccgguaguaacgaagaaagaagaaccuguuaauauagaagcagaaccuccguucggagaaaguaauaucguaauaggaauaggagauaacgcucugaagauaaacugguauaagaaagguaguaguauugguaagauguuugaagcaacagcacgaggcgcccgaagaauggcaauacucggggacaccgcaugggauuuuggcagcguaggagguguuuuaaauucgcuagguaaaaugguccaccagauauuuggaucggcauauaccgcacuuuucucgggaguaaguugggugaugaagauuggaauagguguauuguuaacuuggaucggccuaaauaguaagaauacaucuaugagcuuuucauguauagcaauuggcaucaucacauuauaucucggugcaguagugcaagcggacauggguugcgucauuaauuggaaaggaaaagaauuaaaauguggaucgggaauauucguaacuaacgaagugcauaccuggacagaacaauacaaauuucaagcagacaguccuaaaagacucgccacggccaucgcaggcgcuugggaaaauggaguauguggaauccguagcacuacaaggauggagaaccugcuauggaagcaaauugcgaacgaguugaacuauauuuuaugggaaaacaauauuaaacuaacgguaguaguuggagauaucauaggcgugcuagaacaaggaaaaagaacucuaacuccgcaaccuauggaauugaaauauuccuggaaaacuuggggaaaagcuaaaaucguaaccgccgagacgcaaaacaguucauucauuauagacgguccuaacacacccgaauguccuucagccucucgugcuuggaaugugugggagguagaggauuacgguuucggcguguuuacgacuaauauauggcuaaaacuucgagaaguauacacccaacuaugugaucaucgacuaaugagugcugcuguaaaagacgaaagagcuguacacgccgauauggguuacuggauagagucacagaaaaacggaaguuggaaguuagaaaaggcaucuuuaauagaaguuaaaaccugcacauggccgaaaagucauacucuguggucaaacgggguucuugaaucggacaugauaauacccaaaucauuagcagggccaaucagucaacauaacuauagaccaggcuaccacacucaaacugcaggaccauggcacuuaggcaaauuagaguuagauuucaauuauugcgaaggaacuacggucgucaucacugaaaauuguggaaccagagguccgagccugagaacaacaacaguaaguggaaaguuaauucacgaauggugcugucgcucauguacauugccaccacuaagauacaugggagaagauggauguugguacggaauggagauucgaccuauaagugaaaaggaagaaaauauggugaagucauugguaucggcaggcucaggugagguugacaacuucacaaugggaguucuaugcuuggcaauacuguuugaagaaguuaugcgaggaaaguuugggaagaaacacaugauagcgggcgucuucuucacauuuguauuacuauuguccgggcaaauaacuuggcgugacauggcucauacgcucauuaugauuggaaguaacgcuucggaccguaugggaaugggaguaacguaccuagcacuaauugcaacauuuaaaauacaaccauuccuugcguuagguuucuucuugcgaaaguuaacuucacgugagaaccuauuacuaggagugggucuagcaauggcuacuaccuugcaauuaccagaagauauagaacaaauggccaacggaauagcuuuaggacuaauggcucuaaaauuaauuacucaguucgaaacauaucaacuuuggacugcacuaauaucguuaacuuguaguaauaccauauuuacacuuacuguagcguggcguacagcaacacuuauucuagccggcguaucccuacugccuguuugucaaagcuccuccaugcgcaaaacagauugguugccuaugacgguugccgcaaugggugucccaccacucccguuauucauauuuaaucuuaaagauacucuaaaacgaaggagcuggcccuuaaacgagggggucauggcgguuggauuaguaaguauccuagcuucgucauuacuuagaaacgauguaccaauggcaggacccuugguugcugggggacuauuaauagcauguuauguaauuaccggcacaagugcagauuuaacaguggaaaaagcagcagacguuacuugggaggaagaggcagaacaaacaggugucucacauaaucuuaugauaacaguggaugacgacgguacuaugcggauaaaagacgacgaaacagaaaacauauuaaccguucucuuaaagacagcgcuauugauaguaucuggaauuuuccccuauaguauuccugcaacucuauuaguguggcacacauggcaaaaacagacccagagaucggguguacuaugggacgugccgaguccuccagagacacaaaaagcagaacuggaagaaggcguuuaucgcauaaaacaacaggggauauuuggaaaaacucaaguaggcguaggugugcaaaaggagggaguuuuucacacaauguggcacguaacaagaggugcuguucuuacuuacaauggcaaacgauuggaaccgaauugggcuaguguuaagaaagauuuaauaaguuauggaggaggcuggagguugucagcacaauggcaaaaaggugaagagguacaagucauagccguggaaccuggcaaaaauccuaagaauuuccaaacuaugcccggaacguuucaaacaacuacaggcgaaaucggugcuaucgcgcucgauuuuaaaccuggaacaagcgguagcccaauaauuaaucgugagggaaaaguuguuggauuauaugggaauggaguugugacuaaaaauggagguuauguauccgguauagcccaaacuaacgcagagccagaugguccuacuccugaguuagaagaagagauguuuaagaaacgaaacuuaaccauaauggaucugcacccagguucagggaagacuagaaaauaucuaccagcuaucguuagggaagccauaaaaagaagguuaagaacauugauacucgcaccaacaaggguagucgcggccgaaauggaagaggcuuuaaaaggacuaccaauaagauaccagacaacugcuacaaagucagagcacacagguagggaaaucguagaccuaaugugucacgcaacuuuuacaaugagauuauugucacccguaagaguacccaacuauaaucuaauaauuauggaugaggcccacuucacggacccagcaucgaucgcagcccgugguuacauaaguacaagagucggcaugggagaggccgcggcaauauuuaugacagcaaccccgccggguaccgcagacgcauucccucaauccaaugcaccaauacaggaugaggagcgggauaucccggagagaucauggaacuccgggaacgaauggauaacagauuuugcuggaaaaacugucugguucgugccaucuauaaaggccggaaacgauauugcuaauugucuucgcaaaaaugguaagaaagucauacaauugucacgaaaaacuuuugauacggaguaccagaaaacgaaauuaaacgauugggacuuuguagucacgacugauauaucagaaaugggcgcuaauuucaaagcggauagagugauagacccacguagaugcuuaaaaccugucauauuaacagauggaccagagcgaguaauauuagcuggaccaaugccaguaacugcggcaucugcugcacaacggagaggacgagucgggagaaauccccaaaaagaaaaugaccaauauauauuuacuggacagccacuaaacaacgaugaagaccaugcacauuggacagaggccaaaaugcuucuugauaauauuaauacuccagaaggcaucauaccagcucuguuugagccugaacgggagaaaagugccgcuauagacggagaauacaggcuaaaaggagaaaguagaaagacuuuuguagagcugaugcguagaggggauuuaccgguuuggcuggcacacaaagucgcaagugaagguauaaaauacacggauagaaaaugguguuucgauggacaacgaaauaaucagauacuagaagaaaauauggauguagaaaucuggacaaaggaaggagagaagaagaaacuccgaccaagauggcuagaugcucgcacauacucagauccacuggcauugaaagaauuuaaagauuuugcugcuggacguaagucuauugcccuugauuuaguaacagagaucggcagagugccgacacauuuggcccaccgaacacgaaacgcguuagauaaucuaguaaugcuacacaccagugaacaugguggaaaagcauauagacaugcaguugaagaacugccagaaacuauggaaacucuacuacuacucggcuuaaugauccuucuaacggguggagcgauguuauucuuaauuagcgggaagggaauuggaaaaacuucaauuggccuuaucugugugauagccaguucaggcauguuauggauggccgaaauaccccuucaguggauagcuucugccauaguucuugaguucuucaugaugguccuucuaauuccugaaccugaaaagcaacgaacaccacaggacaaucaacuugcguaugugguaauaggcauucugacauuagcagcuauuauugcagcuaacgagaugggauuacuugagaccacgaaaagagaccuggggaugagcaaagaacccggugucgucaguccaacaucauacuuagauguagacuuacauccugcaucugccuggacuuuguaugcuguggcgacgacaguuauuacuccaaugcuuagacauacuauagaaaauaguacagcuaauguaagucucgcagccauugcaaaucaggcaguuguauuaaugggucuagauaaaggauggccaauaaguaagauggaccuaggggugccacuacuagcgcuagguuguuauucgcaagucaauccucuuacuuuaacugcugcaguucuacucuugaucacucauuaugccaucauaggaccagguuuacaggcgaaagcaacaagagaagcucagaaaagaaccgcagcaggaaucaugaaaaacccaacgguagacgguauaaugaccauagauuuggauccgguuauauacgauucaaaauucgaaaaacaacugggacaaguaauguugcuuguauuaugugcaguucaauuauugcuuaugagaacaagcugggcucuaugugaagcccucacacuugcuacuggaccaaucacgacguuaugggagggcucaccagggaaguuuuggaauaccaccauugccguuagcauggcaaauauauuucgggguaguuaucuagccggugcagguuuagcauuuucuauaaugaagucuguugggacugggaagcgaggaacaggcucgcagggagagacauuaggcgaaaaauggaagaagaaauuaaaccaauuaucaagaaaggaauuugauuuguauaagaaaucaggcauaacagaagucgacaggacggaagcuaaagaaggacuuaagagaggggaaauuacacaucacgcuguuaguaggggaucagcgaaacuacagugguuugucgaaaggaauaugguaauuccugagggccgagucauugaucugggauguggccgcggagguuggucuuacuacugcgcuggcuugaagaaaguaaccgaggucaggggguacacaaaaggagguccaggacacgaggaaccuguaccgauguccacuuauggguggaauauuguuaaauugaugagcggcaaggauguauuuuacuuaccaccggagaaaugugauacucucuuaugugacauuggcgaaucgucaccaaguccaacaguagaagaaagcagaacuauaaggguacugaaaaugguugaacccuggcuaaagaauaaucaauuuuguauuaaaguacuuaacccauauaugcccacaguuauugaacaccuagaacgauuacaaagaaaacacggagggaugcugguacguaacccccuuucuagaaauagcacacacgaaauguauuggaucaguaauggcucggggaacauuguagccagcguaaauaugguuagucgccugcuucuuaacagauuuacaaugacucaccguagaccgacaauugaaaaagacguagaucucggagcuggaacaagacauguuaaugcugaaccugaaacgccaaacauggauguaauuggggaaagaaucaagcgaauaaaagaagaacauaacucgacauggcauuaugaugaugaaaauccuuauaaaacuugggccuaucacgggucauacgagguaaaggccaccgguucagcuuccucaaugauaaauggaguugugaaacuucuuaccaaaccaugggauguagugcccaugguuacucaaauggccaugacagacacuacaccauucgggcagcaaagaguuuuuaaagagaagguugacacccguacuccgcgaucaaugccagggacccguaggguaaugggcauaacugcugaguggcuauggcgaacuuugggucgaaauaagaaaccgagacuauguacgcgagaagaauuuacaaagaaaguucgcacaaaugcagccaugggggcgguuuuuacagaagagaaccaaugggauucagcuaaagcagcaguugaggacgaagauuuuuggaaacuuguugacagagagcgugaacuacauaaauuagguaagugcgguucauguguuuauaauaugauggguaagcgcgaaaagaaauuaggugaauuuggcaaagcaaaagguaguagagcuauuugguacauguggcucggagcacgauaucuggaauuugaagcacuuggauuuuuaaaugaagaccacugguuuucgagagaaaauucauauucaggcguugaaggggaaggacuccacaaauugggauacauauuacgugauauaucaaaaauacccgggggagcaauguacgcagaugauacagcaggcugggacacaagaaucacggaggacgaccuucauaacgaggagaaaauuacccagcaaauggauccggaacacaggcaacuagcaaaugccauauuuaaacuaacguaucaaaacaaaguuguaaagguacaaagaccgacuccaacagggacgguuauggauaucauaaguagaaaagaccaaagaggaaguggacaaguugguacauauggguugaauaccuuuacaaacauggaagcgcaauuaauacgucaaauggagggagaaggaguauuguccaaggcugacuuagaaaauccacaccuaccugaaaagaaaauuacccaguggcuagaaacaaagggaguugaacggcuuaaaaggauggcaauaucuggagacgacugcguugugaagccuauagaugacagauuugcgaaugcacuuuuggcguuaaaugauaugggcaaaguaagaaaggauauaccucaguggcaaccuucaaaggguuggcaugacuggcaacaaguuccuuucugcucucaucacuuccaugaacucauaaugaaagauggccgaaagcuaguaguuccuuguaggccgcaagacgaauuaauagguagagcacgaaucucacagggagcgggauggagccuucgggaaaccgccuguuuagguaaggcuuaugcucaaauguggagcuugauguacuuccauaggagagaccuacgguuagcguccaacgcgaucuguucagccguuccaguccacuggguaccaaccagucgcacaacguggucgauucaugcacaucaccaauggaugacaacugaagauaugcuaacaguauggaaccggguauggauugaagacaauccuuggauggaagacaaaacaccuguaacaacaugggagaaugucccauacuuaggaaagagagaagaccagugguguggcucauugauaggucucacaucgagagcaacgugggcgcaaaauauaccuaccgccauacagcaagucagaagccucaucggaaaugaagaguuccucgacuacaugcccucgaugaaacguuucaggaaggaagaagaaucugaaggggcaauuugguaa

SEQ ID NO: 23431 - RNA, 9873 nt, Artificial Sequence
  derived and/or modified CDS sequence (opt6) from DENV-3__FJ639803__SS-prME
acuucuuuaugcuuaaugaugauacuuccugcagcacuagcauuccacuugacaagucgugacggggaaccgagaaugauugugggcaaaaacgaaagaggaaaauccuuacucuuuaaaacugcgucaggaaucaauaugugcacguuaauagcuauggacuuaggagaaaugugugaugauacugucacguauaaaugcccccauaucacugaaguugaaccugaagauaucgauugcugguguaaccugacauccacauggguaacguauggaacaugcaaucaagcaggggaacacagaagagauaaaagaucuguagcuuuagcaccccacguaggaaugggucuugauacucguacgcaaacguggaugagugcugaaggagcauggagacaaguggaaaaaguggaaaccugggcacugcgacacccugguuucacaauuuuggcacuauuuuuagcucacuacauaggaacaucacuaacacaaaaaguaguuauuuucauuuuacucauguugguaacgccaaguaugacgaugcgaugcgucggaguaggaaaccgagauuuuguggaaggauuguccggggcuacauggguagacgugguucuggaacacggaggguguguaacuacaauggcgaaaaauaaaccuacccucgauauagaacuacagaaaacugaagcaacgcaacuugcuacacucagaaaauuaugcauugaaggcaaaauuacgaacauaacuacggauagucgcugucccacccagggggaagcagucuugccagaagaacaagaucagaauuauguuugcaaacauacauacguggacagagguugggggaaugguugcgguuuauucggaaaaggaucuuuagucacuugcgcgaaauuccaaugucuagaaccuauagaaggcaaagucgugcaauacgaaaauuuaaaauauacugugaucauaacaguacauaccggagaucaacaucaaguugguaacgaaacacaaggaguaacagcagaaaucacaccacaagcaucuacuacagaagcuauuuuaccugaauacgggacacuaggacuugaaugcaguccucgaaccgggcucgauuuuaaugaaaugauauuacuaacaaugaaaaauaaagcguggauggugcauagacaaugguucuuugacuuaccacuuccuuggaccucgggugccaccacugaaacaccaaccuggaaucgcaaagaauugcuaguaacauuuaaaaaugcccacgcuaagaaacaggaaguaguaguacucgggucccaagaaggagcuaugcacacugcuuuaaccggcgcuaccgaaauucaaaauagugguggaacaucgauauucgcaggacauuuaaaaugccgacuuaaaauggauaaauuagaacuaaaagguaugucuuaugcaaugugcacaaauacuuucgucuuaaagaaagaagugucagaaacacagcaugguaccauacugauaaagguggaauauaagggugaagauguaccauguaaaauaccauuuucuacagaggacggacaagggaaggcucacaaugguagauuaaucacagcaaacccgguuguaacgaagaaagaagaacccgugaacaucgaagcggaaccuccauucggcgaaaguaacauuguuauaggaauaggugacaaugcacucaaaauaaauugguauaagaaaggcuccaguaucgggaaaauguuugaggcaacagcaagaggugccaggcggauggcaauucugggcgacacugcaugggauuucgguuccguaggggguguacuuaauagucuuggaaaaaugguccaucagauauucgguagugccuacacggcuuuguucucggguguaucaugggugaugaaaauagggauaggaguucuccugacuuggauaggucuaaauagcaaaaacacgucaaugaguuucucauguaucgcgauaggcauuauaacauuguacuugggugcaguaguacaagcagauaugggcugcguaaucaauuggaagggcaaagagcuuaaaugcggaucugggaucuuuguaacaaacgaaguacauacuuggaccgaacaguauaaguuucaagcggacucaccgaaaaggcuggcuaccgcuauagcuggggcgugggaaaauggcguaugcggaauaaggaguaccacgcguauggagaaucuauuauggaagcaaauugcaaacgaguuaaauuauauucuaugggagaacaauaucaaacuaacaguaguagugggcgauauuauaggaguauuggagcaagggaaaagaacguuaaccccacaaccuauggaacuaaaauauaguuggaaaacauggggaaaagccaaaauuguuacagcagaaacacagaacagcagcuucauaauagauggaccuaauacaccagagugcccaucagccuccagggcauggaauguaugggaagucgaagacuauggauuuggaguuuucacaaccaacauuugguuaaaacuaagggaaguauacacacaguuaugugaucaccgacuuaugagcgcagcuguaaaagaugaacgagcaguucacgcagauaugggcuacuggaucgaaagccagaaaaauggcucauggaaguuagagaaggcuucacuuaucgaaguuaaaacauguacauggccuaaaucccauacuuuguggucaaacggagugcuagagagugacaugauuaucccuaaaucacuagcugguccuauaucccagcacaauuacagaccgggauaucauacacaaacagcaggucccuggcacuuaggcaaguuggaguuagauuuuaauuauugugaaggcacuacugucgugauaacagaaaauugcggaacuagaggcccgucccucaggacuacuaccgucucaggcaaacuuauacaugaguggugcuguagaucuugcacgcuucccccuuugcguuauaugggcgaagaugggugcugguauggcauggaaauaagaccaauaucagaaaaggaagaaaacaugguuaaaucucuugucucagcuggcaguggugaggucgauaauuuuaccauggguguacuguguuuggcuaucuuauuugaagaaguaaugagaggaaaauucggaaagaaacauaugaucgcaggaguauucuucaccuuuguuuuauuacuuuccggccaaaucacauggagggauauggcacauacacuaauaaugauaggcucaaaugcaagcgacagaauggggaugggagugacauaccuugccuuaaucgcaacauuuaaaauacagcccuuucuugcauuaggguucuuucuacgaaaauugacaagucgugagaauuuacuacucggggucggacuagcaauggcaacaacgcuacaauugccagaagacauagaacagauggcaaauggaaucgcacucggacugauggcguuaaaauuaauaacacaguuugaaacauaucaauuauggacggcucugaucaguuugacauguagcaauacgauuuuuacgcuuacaguggcuuggagaacagcuacuuuaauacuagcaggaguaagccuccuaccuguaugccaaagcagcucuaugcguaaaacugauugguuacccaugacaguagcagcaaugggugugccuccauuaccucuuuucauauuuaauuuaaaagauaccuugaaaagaagaaguuggccuuuaaacgaaggcguaauggcaguagguuuaguuagcauauuagccaguagcuuauuaaggaacgacgucccgauggccggaccucuaguugccgguggguugcuuauagcauguuacgugaucacaggaaccagugcugaucugacaguagaaaaagcagccgaugugacaugggaagaagaagccgaacagacuggcguuagccauaaucuaaugauuaccguagacgaugacggcacuaugagaauaaaagaugacgaaacggaaaauauacuuaccguccucuuaaaaaccgcauugcuaauagugucuggaaucuucccuuacaguauuccagcaacccuccuggucuggcauacuuggcaaaaacaaacucaacggaguggaguacuaugggacguccccagcccacccgaaacacagaaagcggaauuagaagagggugucuauagaaucaaacaacaaggcaucuuuggaaaaacacaaguagggguaggcguucaaaaagagggcguguuucacacuauguggcaugugacaagaggagcaguccucacguacaauggaaaaagauuagaaccgaauugggcgagugucaaaaaggauuugauuucauauggaggugguuggagacuauccgcacaauggcaaaaaggagaagagguucaaguaauagcagucgaaccaggcaaaaaccccaaaaacuuccaaacgaugccagggacguuccaaacaacaacaggagaaauaggagccauagcacuagacuuuaaaccaggcacaagcggaucaccaauaauaaacagagaaggaaaagucgucggauuauacggcaacggaguaguuacuaaaaacgguggauacguauccggaauagcacaaacgaaugcugaaccagacgguccaacaccagaauuagaagaagagauguucaagaaaaggaaucuaacaauaauggaucuacauccggguucuggaaagacacgaaaguaucuaccggcgauugucagagaagcaauaaaaaggcgauuaagaacacuaauucuugcuccuaccagaguaguagcugccgaaauggaggaggccuugaaaggauuaccaauacgauaucagacgacagccacaaaaucugaacacacaggaagagaaaucguagaccuaaugugccaugcaacuuucaccaugagguuacugucuccugugcgagucccaaauuauaaccuuauaauaauggacgaggcgcacuuuacagauccagccaguaucgcagcgcguggauacauuaguacaagaguugggaugggagaagcugcagcuaucuucaugacagcuacuccaccugguacggcggaugcauuuccccaaaguaaugccccuauacaagacgaggaacgggauaucccagagagaagcuggaacagcgggaaugaauggauaacagacuuugcgggaaagacgguaugguucgugccgucgauuaaggcagguaacgauauugccaacugccugaggaaaaacggaaagaaaguuauacaacuaagccgaaaaacuuuugauacugaauaccagaaaacaaaacuaaacgauugggauuucguagucacaaccgauauaucggaaaugggagcuaauuuuaaagcugaccgaguaaucgauccacgacguugucucaaaccagugauccugaccgauggaccagaaagggugauucuggcaggaccuaugccugucaccgcugcgucagcugcacaaagaagaggccgagucgguaggaauccgcaaaaagaaaacgaucaauacauauucaccggacaaccacuaaauaaugacgaagaccacgcucacuggaccgaagcuaaaaugcuccuagauaauauaaauacuccagaagguaucauaccugcauuguuugaaccagaaagagaaaaaucugcagcuauagauggcgaauacaggcucaaaggugaaucaagaaaaacuuuugucgaguuaaugagaaggggugaccuuccuguuugguuggcucauaaaguagcuucagaagguauuaaauauacagaucgcaaaugguguuuugacggccagcggaauaaccaaauauuggaggaaaauauggacgucgagauuuggacuaaagaaggcgagaagaagaaacuuaggccacgaugguuagaugcaagaaccuauucagacccucuagcgcuaaaggaauuuaaggacuuugcagcuggaagaaagucgauugcacuugauuuagucacagaaauuggucgaguacccacacaucuagcgcaucgcacaagaaacgcucuagauaauuuggugaugcuccacacgucagaacauggaggaaaggcuuaucggcacgcaguagaagaacugccggagacgauggaaacguugcuucuuuugggauuaaugauacuccuuaccgguggggccaugcuauuuuuaauuagugguaaaggaauagggaagacaucaaucggauuaauaugcgucauagucucaucagggaugcuauggauggcagaaauaccauugcaauggaucgccucagccaucguauuagaguucuuuaugaugguacuacuaaucccugaaccagagaaacaacggacaccacaagacaaccagcuugcuuacguagucauagggauauuaaccuuggcugcaauuauugccgcaaacgaaaugggccuucuagagacaacuaagagagacuuaggaaugucaaaggagcccgguguaguuagccccacaaguuaccuagauguugacuugcauccugcaagugcauggacuuuauaugcaguggcgacaacagugauuacuccaaugcuacggcauacaauagagaacagcacugcgaacguaagccucgcggcuaucgcuaaccaggccguuguccucaugggguuagacaaaggauggccaauaaguaaaauggaucuuggaguaccuuugcuagccuugggguguuauucacaagugaauccauuaacacucacagcggcgguucuguuacuuauaacacacuaugcuauuauugguccaggauugcaggcuaaagccacacgcgaagcgcagaaaagaacagccgcaggcauuaugaaaaauccaacaguagaugguaucaugacaaucgacuuagauccagugauuuacgacucuaaauucgaaaaacaacucggucagguaaugcuuuuaguacugugcgcgguacaacuguugcuuaugagaacgaguugggcucugugugaggccuugacccuagcgacaggaccgauaaccacucucugggaaggguccccggguaaauuuuggaauacaacaauagcugugaguauggccaacauauuucgagggagcuaccuugcuggggcagggcuagcauucaguauaaugaaaucgguuggaacagguaagagggguacuggaagccagggagaaacauuaggcgaaaaauggaagaagaaacugaaccaacuaucaagaaaggaguucgaccuauacaaaaagagcgguaucacagagguggaucguacagaagccaaagaggguuuaaagagaggcgaaauuacacaucaugcagucucacggggaagugcaaaguugcagugguucguugaacgaaacaugguaauccccgaaggaagggugauugauuugggaugcggaaggggagguugguccuauuauugcgccgggcucaaaaagguaacggaaguaagaggcuauacuaaaggcggaccaggacacgaggagccaguaccaaugagcacuuauggauggaauauaguuaaauuaaugaguggaaaggacguguuuuauuuaccaccggaaaaaugcgauacacuacuaugcgauauuggagagucaucgccuuccccgacuguggaggaaucaagaacaauccguguuuuaaaaaugguagaaccguggcuuaaaaauaaucaauuuuguauaaaaguacuaaaucccuauaugccaacaguaauugaacaucuggaacggcuccagcggaaacauggcgggaugcuagucaggaauccacuaagcaggaacucgacacacgaaauguauuggauaaguaacgguagcggcaacauaguagcaaguguaaacaugguaucgcgucuauuacucaaccgauucacuaugacucacaggagaccaacuauagagaaagacgucgaucuaggagcaggaacgagacacguaaaugcggaaccagaaacaccaaacauggauguaauaggagaacguauaaaacgcauuaaggaagaacacaacuccacuuggcauuaugacgacgaaaaucccuauaaaaccugggccuaucacgggagcuaugaggugaaagcaacaggcagugcuucaagcaugauaaacggcguaguaaaacuauuaacaaaaccaugggauguuguacccaugguaacucaaauggcaaugaccgacacgacaccauucgggcagcaaagaguguucaaggaaaaggucgauacgagaacaccgaggucgaugccgggaacgagacgugucauggggauaaccgcagaauggcuauggcgaacgcuuggaagaaauaagaaaccacgacuaugcacgagagaggaguucacuaagaaagucagaaccaaugcugcaaugggugcaguauucacagaagaaaaucagugggauagugccaaagccgcgguugaagaugaagauuuuuggaaauuaguagacagagaacgagaacuccauaaacuaggaaaaugugguucgugcgucuacaacaugauggggaaacgggaaaagaaauuaggugaauuuggaaaagcaaaagguaguagagcgauuugguauaugugguugggugcucgguacuuggaguucgaagcgcuuggguuucuaaaugaagaucauugguuuagucgugaaaauucguacagcggaguagaaggugaaggcuuacauaaacucggcuauauuuugagagauaucaguaaaauaccagguggagcaauguacgcggaugauacggcagguugggacacgcgcauaacagaggacgaucugcauaacgaagagaaaauuacucaacagauggaccccgagcacagacaacuggcaaacgcaauauuuaaguuaacauaucaaaacaagguaguuaaagugcaacguccaacuccaacggguacaguaauggauauuauuagucggaaagaccaacgaggaaguggacaaguagguacauauggacucaacaccuucacuaacauggaggcccaacuuauaagacaaauggaaggcgaaggcguucucuccaaagcagacuuagaaaauccucauuuaccagagaagaaaaucacucaauggcuagagacaaaaggaguugaacgguuaaagagaauggcaauuucaggugacgacuguguugugaaacccauagaugacagauucgcaaacgcauuacuugcgcuuaacgacaugggaaaaguaaggaaagauauuccacaauggcaaccuuccaaaggcuggcaugauuggcaacaagugccuuuuugcagucaucacuuucaugaguuaauuaugaaagaugggagaaaauuaguaguaccaugucguccccaagaugaacugaucggucgagcucgaauuucucaaggugcaggguggagucugcgagaaacugcaugccucgguaaagcauaugcucaaauguggagcuugauguauuuucauaggcgagauuugcggcuugcaucgaacgccauaugcucugcaguaccaguucauuggguaccaacgagucgcacgacuuggucgauacaugcccaccaccaauggaugacgacagaagauauguuaacugucuggaaucgaguguggauugaagauaauccauggauggaagauaaaacuccagucaccacgugggaaaauguuccauaccucgggaaacgcgaagaccaaugguguggaucucuuauaggauuaacuucucgcgcuacuugggcccaaaauauuccuacagcaauucaacaggucaggucccugauaggaaacgaagaguuccuugauuauaugccaaguaugaaaagauuucggaaggaagaggagagugaaggagcaauaugguag

SEQ ID NO: 23432 - RNA, 9873 nt, Artificial Sequence
  derived and/or modified CDS sequence (opt6) from DENV-3__FJ639804__SS-prME
acuucuuuaugucucaugaugaucuuaccggcagcucuugcguuucaucucacaucuagagacggagaaccacgaaugauuguaggcaaaaaugaaaggggcaaaucauuauuguuuaaaacagcuucaggaauaaacaugugcacauugauagcuauggaucucggagagaugugcgacgauaccguuacauacaaaugcccacacauaacagaaguugaaccugaagauauagauugcuggugcaaccuuacuucuacauggguaacauaugggacgugcaaccaagcuggugaacauagaagagacaaacgaucaguagcauuagcaccccauguugguaugggacuggacaccaggacgcaaacauggaugucugcagaaggggcauggaggcaaguugaaaaagucgaaacuugggcacuuagacauccaggcuuuacaauauuagcacuguuuuuggcucauuacauuggcacaucacugacccaaaaaguaguaauauuuauacucuuaauguuaguaacaccaaguaugacgaugagauguguagguguuggcaauagagauuuuguagaaggguugucaggagcaacuuggguugauguaguucuggaacacggcggaugcguaaccacaauggccaaaaauaaaccuacgcuagacauugaacuacagaaaaccgaggcaacucaacuagcaacacuaagaaaacuaugcauagagggcaaaauaaccaacauaacuacugacucccgaugcccaacucaaggagaagcgguuuuacccgaagaacaagaucaaaacuauguauguaaacacacauacguggaucgaggcuggggaaauggcugcggauuauuuggaaaaggaaguuugguaacaugugccaaauuucaaugccuugaaccaauagaaggcaaaguaguacaauaugaaaaccucaaauauacgguaauaauuacugugcacacaggagaccagcaucaaguaggaaacgaaacacaaggaguuacagcugagaucacgccacaagcuaguaccacagaagcaauucuaccagaauacgggacacuagguuuggagugcagucccaggacaggauuggauuuuaaugaaaugaucuugcugacgaugaaaaauaaagcauggauggugcaccgacaaugguucuuugaucuaccacugcccuggaccaguggagcgaccacggagacccccaccuggaauaggaaagaauuguuaguaaccuuuaaaaaugcucacgcgaagaaacaggaagucguuguacugggaagccaggagggagcgaugcauacggcacuuacaggcgcuacggagauacaaaauagcggcggaacuucgaucuucgccggucaccuaaaaugcagauuaaaaauggacaaauuagaacuaaaaggcaugucuuaugcuaugugcaccaacacguucguacuaaagaaagagguaucugaaacacaacacggaacuauauugauaaaaguugaguauaaaggagaagauguaccaugcaaaauacccuucucgacagaggacggacaaggaaaagcacacaauggacgacucauaacagcaaacccaguagucacaaagaaagaagaaccaguaaacauugaagcagaacccccauucggggaaucuaacauaguaaucggaauaggggauaacgcucuaaaaauaaauugguauaagaaaggaucuaguauagguaagauguucgaagcaacagcgaggggagcacguagaauggcuauauugggagacacagccugggauuuuggaucagucggaggaguuuuaaauucacuagguaaaaugguacaucaaauuuucggaucagcguauacugcacuauucucaggaguaucuuggguuaugaaaauuggaauagggguccuauugacuuggaucggccuuaacaguaaaaauacuuccaugaguuucagcuguauugcgauuggaauaaucacacuauacuuaggagccguuguacaagcggauauggguugcguaauaaauuggaaaggaaaggaauugaaaugcgggaguggaaucuucgugacaaacgagguccacacauggacagaacaguacaaauuccaggcagacucgccaaaaagguuggcaacagcgauugcaggagccugggaaaacggugugugcggaauaaggucaacuacuagaauggaaaaccuucuuuggaaacaaauugcaaaugaguuaaacuacauauuaugggagaauaauauaaaacuuaccguugugguaggggacauaaucggaguccuagaacaagguaaaagaacguuaaccccacaacccauggaacuaaaauacaguuggaagacguggggaaaagcaaagaucgucacugcagaaacacaaaacagcucauuuauaauugacgggccaaacacaccugagugcccaucagccaguagggcauggaacgucugggaagucgaagauuauggauucggagucuucacgacaaauauuuggcuaaaguuacgagaaguauauacgcaacuaugcgaccauagacuuaugagugcagccguaaaagaugaaagagcaguacaugcugauaugggauauuggaucgagagccagaaaaacgguucuuggaaauuggaaaaggccagcuuaauagagguaaagacuugcacauggccaaaaagccauacguuauggagcaacgguguucuugagucggacaugauuauuccuaaaagucuagcagggccgauaucacaacauaauuaucgaccugguuaccacacacaaacggcaggcccuuggcauuuagguaagcucgaauuggauuuuaauuacugugaagguacaacggucguaauaaccgaaaauugugguacuagagguccaucccuaagaaccacaaccguuucagggaaacuaauacacgaaugguguuguagaucaugcacccuuccaccacugagguauaugggcgaggaugguuguugguaugguauggagauuagaccaauaagugaaaaagaggaaaacauggugaaguccuuaguuagugcgggaucaggugaagucgauaauuuuacgaugggcguacuauguuuggcgauucuauuugaggaagugaugcgagguaaguuugguaaaaagcauaugaucgcaggcguauucuuuacuuucguucuauuacuaucaggacagauaacuuggcgagauauggcccauacuuuaaucaugauuggaucaaaugccagugaucguaugggcaugggagugacguaucuugcucuaauagcaacauucaaaauccaaccguuucuagcucugggauucuuucucaggaaacuuacaucucgugaaaaccugcuacuaggcgucgguuuagcaauggcuacaacacuucaacugccggaagauauagaacaaauggcaaaugguauugcacucggucugauggcucucaaacuaauaacccaauuugaaacguaucaauuauggacggcucugauaucauugacauguucaaauaccauauuuacauuaacuguugcuuggagaacggcaacucuuauucuagccggaguaucauuacuacccgugugucagucaucuuccaugagaaaaacagacugguuaccgaugacaguagcugcgaugggggucccaccacuuccccuguucauauuuucacuuaaggacaccuuaaaacgaagaagcuggccauuaaacgagggcguaauggccguaggacuuguuucuauauuagcaucuucauuauuaaggaacgaugucccuauggcgggaccucugguugcugguggucuucuaaucgcauguuauguuaucacaggaacaucugcagauuuaacaguugagaaagcggcagaugucacuugggaggaagaagccgaacaaacuggaguuagccauaaccuaaugauuaccguggaugacgacgggaccaugcggaucaaggacgaugagaccgaaaacaucuuaacaguauuauugaaaacagcauuacuuauagucucagguauauuuccauauuccaucccggcuacuuugcuaguauggcacacuuggcaaaagcaaacccagcguagcggggucuugugggaugucccgagcccaccugagacgcaaaaagcugaauuagaggaaggcgucuauagaaucaaacaacagggcauauuuggcaagagucagguuggaguaggcguccaaaaagaaggaguguuccacaccauguggcacguaacgcgaggagccguccugaccuacaacgggaagagacuagaaccuaauugggcaagcguaaagaaagacuugaucaguuauggagguggguggagauugucugcacaauggcaaaaaggugaagaggugcagguaauagccguggaacccgguaagaaucccaaaaauuuucagacgaugccugggaccuuucagacaaccacuggugaaauuggagcgauagcauuggauuucaaacccgggacuucgggcaguccaaucauaaauagagaagggaaaauuguaggacuuuaugguaacggaguagucacgaagaacgguggguaugugagcgguaucgcccaaacaaacgcggaacccgaugggccaacacccgaacuagaagaagagauguucaaaaagagaaacuuaacgaucauggaccuacauccgggcagcggcaaaacucgcaaguacuugccagcaauaguucgagaggcaauuaaacguaggcuaagaacucucauuuuagcaccuacucgagugguagccgcggagauggaagaggcccucaagggccucccgauuagguaccaaacaacugcuacaaaaucagaacacacuggaagagagauaguagauuuaaugugucaugcaacuuucacuaugagauuauuaaguccgguaagaguucccaauuauaauuuaauuauaauggacgaagcacauuuuacagauccugcuaguauagcagcgcgaggauauauaucuacucgagucgguaugggcgaagcagcagcuauauuuaugacagccacuccuccagguacagcugacgcuuuuccgcagaguaacgcuccaauucaagacgaagaaagagauauaccagaacgaagcuggaacucaggcaaugaauggauaacagauuucgcuggaaaaaccguuugguuugugccaucgaucaaggcagggaaugauauagcuaacuguuugaggaaaaaugguaagaaaguuauccaacuaaguaggaaaaccuuugauaccgaauaucagaaaacaaaauugaacgauugggauuuuguagugacuacagacaucucugaaaugggagcuaacuucaaagcagaucgaguaauagauccaagaaggugucugaagcccgugaucuuaaccgauggaccagaaagaguaauucuggccggaccuaugccugucacagcggcuucggcagcccagagaaggggaagaguggggagaaacccucaaaaagaaaaugaucaauauaucuuuacaggacagccacuuaauaaugacgaagaccaugcacauuggaccgaggcgaaaaugcuuuuagacaacauuaauacucccgaaggcauuauacccgcucuuuuugaaccugaaagagaaaagucagcagcaaucgauggugaguaccgacuaaaaggugaaaguaggaaaacguuuguagagcuaaugcgcagaggugaucuuccagugugguuagcacauaaaguagcgucggagggcaucaaauauacagaucggaaaugguguuuugaugggcaacgcaacaaccagauacuagaagagaauauggauguugaaauuuggacgaaagagggugagaaaaagaaacugaggccacgauggcucgaugcccgaacuuacucagauccauuggcacuuaaagaauuuaaagauuucgcggcaggaagaaaaaguauugcauuagaucuaguuacggaaaucgguagaguccccacgcauuuggcgcaccgcacucguaacgccuuagauaaucucguaauguugcauacaagcgagcaugguggcaaagcauauagacaugcaguagaagaacuucccgagaccauggagaccuuacuuuuacuuggcuugaugauacuguuaacaggaggcgcaaugcuauucuugaucaguggaaaagggauagggaaaacaucuaucggucuuauauguguaauagcaaguuccgguaugcuuuggauggcugaaauaccauuacaauggauagcuagugcuaucguauuggaguucuuuaugaugguucuucuuauaccugaaccugaaaaacaaagaaccccacaagauaaccaguuggcauacguugucauagggauauuaacacucgcagcaacgaucgcggccaaugaaaugggguuguuagaaacuacgaaaagggacuugggaaugucgaaagagcccggagucgucuccccuacgucguaucuagacgucgaucuacacccagccuccgcauggacucuuuaugcgguugcuacgacaguaauaacacccauguuacgucauacaaucgaaaauucgaccgcaaauguaucacuagcugcuauagcaaaucaagcggucgucuuaauggguuuagacaagggauggccaaucucaaagauggauuuaggagucccacuucucgcacuaggcuguuauucgcaaguuaauccccuaacuuugacagcggcgguauuauuacucauaacacacuacgcuauaaucgguccuggccugcaagcuaaagcgacaagagaagcgcagaaaaggacagccgcuggaauaaugaaaaacccaacuguugacgggauaaugacuauagaccuugaucccguuauauacgauucgaaauuugaaaaacaacuaggacagguaaugcuauugguacuuugcgcaguucaauuauugcuaaugagaacuagcugggcguuaugugaagcacuuacucuagcaacaggccccauaacaaccuuaugggaagguaguccaggaaaauucuggaauacaaccauagcagugagcauggcuaauauuuuucgggggaguuauuuggccggggcaggacuggcauuuaguaucaugaagucaguaggaacggguaaaagagguacggggucucaaggggaaacgcuaggagaaaaauggaagaagaaauuaaaccaguuaaguaggaaagaauuugauuuauauaaaaagucgggcauaacggaaguugaccguaccgaggccaaagaggggcuuaaaagaggcgaaauuacucaucaugcuguuucacgcggcucugcgaaauuacagugguuuguggaaagaaacauggucauaccggaaggaaggguaauagacuuaggauguggacgagggggauggucguacuauugcgcuggacuuaagaaaguaacagaagucagaggauacacaaaagguggaccuggucacgaggaaccuguaccaaugucgacauauggcuggaauauaguaaaauuaaugucgggaaaggauguuuucuaucuucccccggagaaaugcgacacacuucuaugugauauuggcgagagcucaccaucaccaacagucgaagagucaaggacuaucagaguacuuaagauggucgaaccuuggcuuaaaaacaaccaauuuuguauaaagguauuaaauccauauaugcccacugucaucgaacauuuagaacgacuccaacguaaacauggagggaugcuagugagaaauccauugagcagaaauuccacccacgaaauguauuggauuuccaacggaaccggcaacauaguagcauccgucaauaugguaagcagauuacuuuuaaaccgauuuaccaugacguauagaaggcccacuauagaaaaagauguugaucucggugcaggaacaagacacgucaaugccgagccggaaacuccaaauauggauguuauuggagaaaggaucgaaagaauaaaagaggaacacaauagcaccuggcauuaugaugaugaaaauccauacaagacuugggccuaucacgguagcuacgaggucaaagcaacugguucagcaucgucuaugauuaacggggugguuaaauuacugacaaaaccuugggacguuguccccaugguaacacaaauggcaaugacagauaccacccccuuugggcagcagcggguauucaaagaaaaaguagauacuagaaucccgcgaucaaugccggggacuagaagaguuaugggcaucacugccgaauggcuguggagaacacuugguagaaauaagaaaccacgccuauguacucgggaggaguucacgaagaaaguucggacaaacgccgcaaugggggcagucuucacagaggaaaaccaaugggacagcgccaaagcagcagucgaagaugaagacuuuuggaaacucguggaucgagaaagggaauuacauaaacuaggcaagugugggucaugcguuuacaauaugaugggcaaacgggagaagaaauugggcgaauuugguaaagccaaaggauccagagccauaugguauauguggcucggcgcacgauauuuagaauuugaagcauuaggguuccuaaaugaagaccauugguuuagucgagaaaauucuuauuccggaguugaaggcgagggauuacauaagcucgguuacauccuaagagauauaagcaaaauaccaggaggagcaauguacgccgaugauacagcugggugggauacuagaauuacagaagaugauuuacauaaugaggagaaaaucacucaacaaauggauccugagcaucgucaacucgcgaaugcaaucuuuaaacuaacuuaucaaaauaaaguuguaaaaguacagagaccaacaccgacuggaacaguuauggacauaauuucaaggaaggaccaaagggguucaggacaaguaggcacuuauggacuaaauaccuuuacaaacauggaggcacaauugauaagacaaauggaaggagaagguguucucucgaaagcagaucucgaaaauccacaccuacccgagaagaaaauuacacaauggcucgaaacgaaagggguagagcgacucagaagaauggccauauccggagacgauugcgucguuaagccgauagacgauagauucgcgaaugcuuuguuggccuuaaaugauaugggcaagguacgaaaagauaucccccaguggcaaccgucuaaagguuggcacgacuggcaacagguuccauuuuguucacaccacuuccacgagcuuauuaugaaagaugggcgaaaacucguuguaccauguagaccacaagaugaauugauuggcagagcccgaauaucacagggagcagguuggucacuacgagaaacagcuugccuaggcaaggcauacgcacaaauguggagcuugauguauuuucauagacgugauuuaaggcuagcaaguaacgcaauaugcagugcaguaccuguacauuggguacccacgagcagaacuacuuggaguauucaugcccaccaccaauggaugaccaccgaggauauguuaacaguauggaauagaguuuggauagaagacaacccuuggauggaggauaaaacgcccguuaccacaugggaaaaugugcccuaccuaggaaaaagagaagaucaauggugcgguagccucaucggacugacaucucgagcgacuugggcucaaaacauaccuacggcaauucaacaagugagaaguuuaauaggaaaugaagaguuucuugauuauaugcccucuaugaagagauuucgaaaagaggaggaaagugaaggagcuauuugguaa

SEQ ID NO: 23433 - RNA, 9873 nt, Artificial Sequence
  derived and/or modified CDS sequence (opt6) from DENV-3__FJ639805__SS-prME
acaagccuuugccuuaugaugauauuaccugccgcauuagccuuucacuuaaccucacgugacggagaaccaagaaugauagugggaaaaaaugaacggggaaaaucauuguuauuuaaaacagccucugggaucaacauguguacucucauugcgauggauuugggcgagaugugugaugauacaguaacauauaaaugcccacacauuacagaaguagagccugaagauauagauuguugguguaauuugacaucgacuuggguuacguauggaacauguaaccaagccggagaacauagaagagauaagcguuccguggccuuagcuccacacguggguaugggacuggauacccgcacucaaacauggaugucagcagaaggagcauggcgccaaguagaaaaaguagaaacaugggcuuuaaggcacccuggcuuuaccauauuagcacuuuuuuuggcacauuacaucgggaccucuuuaacacaaaaaguagucauauuuauauuacucaugcuagugacuccaagcaugaccaugcguugugucgguguaggcaauagggauuucguugagggacuuagcggugcaaccuggguggaugugguauuagagcauggcggaugugucaccacuauggcgaagaacaagccuacgcuagauaucgagcuacaaaagacagaggcaacccaacucgccacauugaggaaauuauguaucgaggggaaaauaaccaacaucacuacggacucccgcuguccuacacagggagaagccguacuaccagaagaacaggaucaaaacuauguauguaaacauacuuacguagaccgcggauggggaaacggcuguggauuauuugggaagggaagcuuagucacuugugcgaaguuucaaugcuuagagccgauagaaggaaaaguaguacaauacgagaauuugaaauauacagucauuauaaccguacauacaggagaucaacaccaaguggggaaugaaacucaaggcguaaccgcagaaauuacaccucaagcuagcaccacggaagcuauucuaccagaauacgguacacugggacuagagugcagcccaaggacuggucuagacuuuaacgaaaugauucugcuaacuaugaaaaauaaagcauggauggugcauagacaaugguucuucgaucuaccacuucccuggacgagcggagccacgacugaaacaccaacauggaaucgaaaagagcuauuagugacuuuuaaaaaugcacacgcuaaaaaacaagaaguaguggugcuuggaucacaagaaggcgcaaugcauacagcucuaacaggcgccacagagauucaaaauagugggggaacuucuauauucgcagggcaucuaaaguguagauuaaaaauggauaaacuagagcuuaagggaaugucguaugcaauguguacuaacacuuucguuuugaagaaagaaguguccgaaacacaacaugggacgauacuuauaaagguagaauauaaaggugaggaugucccuuguaagauuccauuuucaacugaagacggucaggggaaggcacacaaugggagguuaaucacugcuaacccugucguuacgaagaaagaggaaccgguuaacauagaggcagaaccgccauucggggaauccaacauaguaauugggauaggggauaacgcauuaaaaauaaauugguacaaaaaagggucaaguauagggaaaauguucgaagcuacagcaagaggugcgcgucgaauggcuauuuuaggcgauaccgccugggacuucggaucgguuggaggaguacuaaauagccuuggaaaaauggugcaucagaucuuuggaucugcuuauacugcauuauucagugguguaaguuggguaaugaaaauagguauaggcgugcuuuuaacuuggauaggcuugaauucaaagaauacuucaaugaguuucucaugcauugcuauaggaauaauuacauuauauuugggagcagucguacaggccgauaugggauguguaauaaauuggaaagggaaagaauuaaaauguggaucagguaucuucgugacuaacgaagugcauacauggacagaacaauauaaguuccaggccgauagucccaaaaggcuagcaacagcgauugcaggcgcgugggaaaacggagucuguggaauuagaaguacaacucguauggaaaaucuacuauggaaacaaauagcuaaugaacuaaauuacauucugugggaaaacaauaucaaauuaacaguuguaguaggugauauaauugguguucuagaacagggaaaacgcacacucacuccgcaaccuauggaacucaaauauucauggaagacaugggggaaagcaaaaaucguaaccgcagaaacccagaauagcuccuuuauuauagacgguccaaacaccccagagugucccagugcuagcagagcauggaauguaugggaaguagaagacuauggcuuuggcguguucacuacaaauauauggcucaaauugagagaagucuauacucaacuaugugaucaucgucucaugucagcagcaguuaaagacgaaagagccguucacgcugauaugggguauuggauagaaagucaaaaaaauggaagcuggaaacucgagaaagcauccuuaaucgaaguaaaaacgugcacauggcccaaaagccacacauuauggucuaauggaguccuggagucagauaugauuaucccaaaaaguuuagcuggcccaaucucacaacauaacuaccgaccuggauaucauacccaaacagcgggcccauggcaccuaggcaaauuagaacuagauuuuaauuacugcgaaggaacuacgguuguaauaacugaaaacugugguacucgagguccuagucuacggaccacgacagucagcggaaaacuaauacacgaaugguguugccguaguuguaccuuaccccccuuacgcuacaugggcgaagacggaugcugguacggcauggaaauucgaccgauuucagaaaaggaggaaaacaugguuaagucgcuaguuucugcugguucaggggaaguugauaacuucacuaugggaguacuuugucucgcgauauuauuugaagaggugaugagaggcaaauucggcaaaaaacacaugauagcagguguauuuuuaaccuucguacuuuugcuuucaggacaaauuacguggcgcgauauggcgcacaccuuaauuaugauagguaguaacgcaucagaccgaaugggaaugggaguaacuuaucuggcccuuauagcaaccuuuaagauacaacccuuccucgcuuuagguuuuuuuuuaaggaaacuaacgagucgagaaaaccuucuucuggguguaggucuagcaauggcuacaacccuucagcuacccgaggauaucgagcaaauggcuaaugguauagcacugggauuaauggcucuaaaguuaauuacccaauucgaaacguaccagcuauggacggcucuaauaucgcucacguguucuaauacuauauucacauugacugucgccuggagaacagcaacauuaauauuggccggaguaucacuauuaccgguaugccaguccucgagcaugaggaagacugauugguugcccaugaccguggcggcuaugggggucccuccauuaccacuuuuuaucuuuaaucucaaagauacccuuagaaggcgaaguuggccuuuaaaugaaggaguaauggcaguaggacuuguaucuauauuagcauccagcuugcuuagaaaugauguuccaauggcagguccucuuguugcaggaggacuucuaauugcuugcuauguaauuacaggaacaucggcagaccugaccguugaaaaagcggcggauguaacgugggaggaagaagcggaacagacaggaguaagccauaacuuaaugauuacgguagaugaugacggaacaaugcgaauaaaggacgaugagaccgaaaauauacuaacaguuuuacuaaaaacugcacucuuaauugucuccggaauuuuuccauauucgauacccgcuacuuuacugguauggcauacauggcaaaaacaaacacaaagauccggaguacuuugggauguaccaagcccaccugaaacucaaaaagcugaacuagaggaaggaguuuaccgcauaaaacagcagggaaucuucgguaaaacccaaguggggguaggcgugcaaaaagaaggcguauuccauaccauguggcacguuacacgaggagccguuuuaacuuauaacggcaaaagauuagaacccaacugggcaagcguaaaaaaagaucuaauuucguacggagguggcuggagauuaucugcucaauggcagaaaggagaagaaguacaaguuauagcaguggaacccgguaagaauccaaagaauuuucaaacaaugcccgggacguuucaaacuacaacuggugagauuggcgcuauagcauuagacuuuaaaccuggcacuagugguucaccuauuauaaaccgagaagguaaaguaguggguuuauauggcaacggaguagugacaaagaaugguggauauguuagugggauagcacaaacaaaugcagaaccagaugguccaacaccagaacuggaagaggagauguucaaaaaacgaaacuuaacaaucauggauuugcauccuggcuccgggaaaacccgcaaguacuuaccagccauuguacgcgaagcaauaaaacgaagacuuagaacuuuaaucuuagcaccaacacgaguuguagcagcagaaauggaagaagcccuaaaaggacugccuauacgcuaucagacaaccgcuacaaaaagugaacauacaggaagggagauaguggauuuaaugugucaugcaaccuuuacgaugagacuauuaagcccaguacgaguucccaauuauaauuugaucauaauggaugaagcgcacuucaccgaucccgcuaguauagcugcacggggcuacaucagcacacgagucgggaugggggaagcagccgcgauauuuaugacagccacaccaccuggaacugccgacgcauucccccaaucaaaugccccuauccaagaugaagaaagagauauucccgaaagaucauggaacucugguaacgaauggauaacggauuuugcggguaaaacaguaugguucguuccuucaauaaaagcugggaacgauauagcaaauugcuuacgaaaaaauggaaaaaaagucauucaauuaaguagaaagacauuugacacugaauaucaaaaaacgaaauuaaacgauugggacuuuguaguaaccacagauauuucagaaaugggagcuaauuucaaagcagaucgagucauugaccccagacggugucugaaaccagugauacuuacugauggcccugaacgugucauacuugccggaccuaugccagugacugccgcgucagcagcacaacguaggggucgaguagguagaaacccucaaaaggaaaacgaucaguacauuuuuacaggucagccgcuaaauaacgaugaagaucaugcccauuggaccgaagccaaaauguuacucgauaacauaaauacuccggaggggauuauacccgcacuguuugaacccgaacgugaaaaaucggcugccauagacggcgaguauagauugaaaggugaaagcagaaaaacauucgucgaacugaugcgccgaggagaucugccuguaugguuagcccacaaaguagccucggaagguauuaaauauacugaucgaaaguggugcuucgaugggcaacgaaauaaucaaauuuuagaggaaaacauggauguugaaauauggacgaaagagggugagaaaaaaaaacuccguccuagaugguuagaugcgagaacuuacucugacccauuggcucuaaaagaauuuaaagauuuugcagcuggcaggaaguccauugcuuuagacuuagucacagaaauagguaggguacccacucauuuagcacaucgcacaagaaaugcacuagauaaucuaguaaugcuucauacaagugagcacgguggaaaggcauaucgccacgccguugaagaacuaccugagacaauggaaacacuucuauuguuaggucuuaugauucuacuaaccggaggggccauguuauuccugauaagugguaaaggucuugguaagacuucuauuggacugauauguguaauugcuucaucuggcaugcucuggauggcggaaaucccucuacaauggauagcuucugcaauaguuuuagaauucuuuaugaugguauuacuuaucccggaacccgaaaaacaacgaaccccucaagauaaccagcuugcuuaugucguaauaggcauucucaccuuagccgcuauaauugcagcaaaugaaaugggauuauuagaaacaacuaaacgcgaccuaggaaugaguaaagaacccggcguugucagccccacaaguuaucuagauguagaucuucacccggccucugcauggacuuuauaugcaguagcaacaacgguaauaacaccgaugcuccgacacacuauagaaaauucgacggcaaacguuaguuuggcagcgaucgccaaccaggccguagugcuuaugggucuugauaaaggguggccaauuucaaaaauggaucuaggugucccacuucucgcacuugguuguuauagccaaguuaacccucuuacgcucacagcagccguguuguuauuaauuacccauuaugcaaucauaggaccuggauugcaggccaaagccacaagagaagcacaaaagcgcaccgcagcagggauuaugaaaaauccaacagucgauggaauaaugacaauugaucuagacccaguaauauacgauaguaaauuugaaaagcaacucggucaaguaaugcucuuaguacucugugcuguacaauuacuucuuaugcgaaccucaugggcucuaugugaggcauuaacuuuagccaccgguccaauaaccacacuaugggagggaagcccagguaaauucuggaauacuacuauagcuguuaguauggccaauaucuuucgaggaucuuaucuugcaggcgccggccuagccuucucaauuaugaaaucaguuggaacuggaaaaagagguacaggaucucaaggagaaacauugggugaaaaauggaaaaaaaaauuaaaucaacugagccgaaaagaauuugaccucuacaaaaagagcgggauaacugaggucgauagaacugaagccaaagaagggcugaaaagaggcgaaauuacccaucaugcggugagcagaggaucagccaaauugcaaugguuuguggaaaggaacaugguaauuccagaaggccguguuauagaccuugguuguggaaggggaggauggaguuacuauugugccggccuuaaaaaaguaacagaaguucgaggcuauacaaaggguggaccaggacacgaagaaccuguuccaaugucuaccuacggauggaauauaguaaaacuuaugucagggaaagacguuuuuuaccucccaccagaaaaaugugacacacucuuaugcgauauuggagagagcucaccuucuccuaccguugaagaguccaggacaauacgugugcuaaaaaugguagaaccauggcuaaagaauaaucaauuuuguauaaaaguuuugaauccauauaugccaaccguuauagaacauuuggaacgguuacagcgaaaacacggaggaaugcucgugaggaacccccuaucuagaaauaguacgcaugaaauguacuggauuuccaauggcacggggaacauagucgccaguguuaacaugguuucucgccuguugcuaaauagauuuacgaugacacauagaagaccuaccauagaaaaagacguagaucuaggagcaggaacccgucaugugaacgcugaacccgaaacaccaaauauggaugucaucggggaacgaauaaaacguauaaaagaagaacauaauuccacuuggcacuacgaugaugagaauccguacaaaaccugggcauaucaugggaguuacgagguaaaggcuacggggucagcaagcucaaugauaaauggaguuguuaaacuucugacaaaacccugggaugugguaccgauggugauucaaauggcaaugacagauacaacccccuucgggcaacagaggguauucaaggaaaaagucgauacucggacaccuagaaguaugccaggcacucguagaguaaugggaaucacagcugaauggcuauggagaacacuagguagaaauaaaaaaccucgauuauguacccgagaggaauuuacuaaaaaaguacgcaccaaugcagcgaugggcgccguauuuaccgaagagaaucaaugggauagcgcaaaggcagcaguagaagaugaggauuuuuggaaauugguggauagagaacgagaauugcacaagcuugggaaauguggcucgugcguauauaacaugauggguaaaagagagaagaaauuaggagaguuugggaaagcgaaagggucucgugcuauuugguacaugugguuaggagcucguuacuuagaauuugaagcacuggguuuuuugaaugaagaccauugguuuucucgagagaacagcuauaguggaguggagggugagggauuacacaaauuggguuauaucuugagagauaucucuaaaauaccaggaggagcgauguacgcggacgacacagcuggaugggauacaaggauuacagaagaugaccugcacaacgaggagaaaauuacacaacaaauggaccccgagcacagacaauuggcuaaugcgauuuuuaaacuuaccuaccaaaacaagguagugaaaguucaaagaccaacgccaaccggaaccguaauggacauaaucagccgaaaggaccagagaggcagcggacaaguuggaacauacggacucaacacauuuacuaauauggaggcgcagcuuauucgucaaauggaaggugagggagucuuaaguaaagccgauuuagaaaacccacaccuaccugaaaaaaaaaucacgcaaugguuggaaaccaaaggagucgaaagacuaaaacguauggcaaucucaggggacgauugcguuguaaagccuauagaugauagauucgccaaugcccuauuggccuuaaaugauaugggaaagguccgcaaggauauuccccaauggcaaccaagcaaaggauggcaugauuggcaacaggugcccuucugcagccaccauuuccaugaacuaauaaugaaagauggucgaaagcuaguagugcccugucgaccucaggaugaacucaucggccgagcaagaauaagccagggagcaggguggagccuucgggagacagcuugccuggguaaagcuuacgcucaaauguggagccucauguauuuucaucgccgugauuuaagguuggcuucaaaugcaaucugcagcgccgugccaguucacuggguaccgaccucgagaaccaccugguccauacacgcccaucaucaguggaugaccacggaggacaugcuaacgguuuggaaucguguuuggauagaagacaacccauggauggaagauaagacacccgucacuaccugggagaacguaccauaucucggaaaaagagaagaucaauggugcggcucgcugauuggauuaaccagcagagcaacuugggcucaaaauauuccuacugcgauccagcaaguaaggucacugauaggaaacgaggaauuccucgacuauaugccuucuaugaaaagauuuagaaaagaagaagagagcgaaggggcaauuugguaa

SEQ ID NO: 23434 - RNA, 9873 nt, Artificial Sequence
  derived and/or modified CDS sequence (opt6) from DENV-3__FJ639807__SS-prME
acuucauuaugucuuaugaugauucucccugcagcuuuagcauuucaccucaccucccgugacggagaaccaagaaugauaguagggaaaaaugaacgugguaaaucuuugcuguuuaaaacagcaucagggauuaauauguguacgcuuauagcaauggauuuaggagaaaugugcgaugauaccguuacauacaaauguccgcacauaacggaaguugagccagaggauauugauugcuggugcaaucuaacaucuacauggguaacuuaugggacaugcaaccaagcuggugaacaucgucgggauaaaagaaguguagcucuagcaccgcacguuggcaugggacucgacaccaggacacaaacauggaugucggcggaaggcgcauggcgacaaguagaaaaaguagaaaccugggcacuaagacaccccgguuuuacuauacuagcacuuuucuuagcgcacuauauaggaaccucucuaacccaaaaagugguuauauuuauacuacucauguuaguaacgccgucgaugacuaugaggugcguaggagucggaaaccgagacuuuguagaagguuuguccggggcuacauggguggaugucguauuagaacacggcgggugcguaacaaccauggccaaaaacaaaccaacccucgauauagaacuacagaaaacugaagcaacgcaacuugcaaccuugagaaaauuguguauagaagguaaaauaacaaauauuacgacugacucacggugcccuacgcaaggcgaggcagugcugccugaagaacaagaccaaaauuauguauguaaacacacuuauguagauagaggauggggcaacgguugcggacucuuugggaaaggcagccuugugacaugugcgaaauuucaaugucuagaaccuaucgaaggaaaagucguacaauacgaaaaccucaaauauaccgugauaauaacugugcauaccggugaccaacaccaaguaggcaacgaaacacaggguguaacugcagagauaacaccacaggcgucaacuaccgaagcaauccucccagaauaugggacccuaggacuagaaugcagcccaagaacggggcuagacuucaaugagaugauacuauuaacaaugaaaaacaaagcauggaugguacaccgacagugguucuucgaucucccucugccauggaccaguggagccacaacagaaacuccaacguggaacagaaaagaauuguuaguaacuuucaaaaacgcacaugccaagaaacaggaggucgucguauuagguagucaagaaggugcuaugcauacggccuuaacaggagccacagagauucagaacuccggaggaacgucgaucuuugccggucauuuaaaaugccggcuuaaaauggauaaauuggaauuaaaagggaugucuuaugcuauguguacuaauacauuuguacucaagaaagaaguuuccgaaacacagcauggaacuauauuaauaaaaguggaguauaaaggggaggauguaccgugcaaaauuccguuuucuacugaggaugggcaggguaaagcucauaaugguagauuaauaacagcaaauccaguugucacgaagaaagaggaaccaguaaauauagaggcagagccacccuuuggagaaagcaacauaguuauugguauaggagauaacgccuugaaaaucaacugguacaagaaaggaaguuccauagggaaaauguuugaggcaacagcacguggugcaagaagaauggcaauauuaggugauacugcgugggauuuuggaagugucggcgguguacucaauaguuuagguaaaaugguacaccagauauucggcagugcuuacacugcacuauuuucgggcguuaguuggguaaugaaaauagguauuggggucuuauugaccuggauagggcugaacucgaaaaauacuagcaugaguuucagcuguaucgcaauaggaauaauuacucuauaucucggggcgguggugcaagccgauauggguugugugauaaacuggaaaggaaaagagcuuaagugcgguucggggauuuuugugacgaaugaaguucacacuuggacggagcaguauaaauuucaagcagacucgcccaagcgacuggcaacagcaauagcaggagccugggaaaauggcguuuguggcauaagaaguacaacccggauggaaaaucuacuuuggaaacagaucgccaacgaauuaaacuacauccuuugggaaaauaauauuaaacuaacgguugucguuggagauacaauaggaguauuagaacagggcaaacguacacuaacaccacaaccuauggaacuaaaauauucauggaaaacauggggcaaagcgaagauaguaacagcugagacacaaaauucaucauucaucauugaugguccuaauacaccugaauguccaagugcaucaagagcauggaaugugugggaggucgaagacuacggauucgguguguucacaacaaacauauggcuaaaauuaagggaaguauacacacaacuuugcgaucacaggcuuauguccgccgccguaaaagaugagagggcaguacacgcagauaugggguauuggauagaaucccagaaaaaugguaguuggaaauuggaaaaagcaucccuaauugaaguuaaaacgugcacuuggccaaaaucacauacguuauggucaaacggcguauuagaauccgauaugauaauaccgaagucuuuagcaggccccauaucacaacacaauuacaggccagguuaucauacgcaaacagcaggaccguggcacuuaggaaagcucgaauuagacuucaacuacugugagggaacaacuguugugaucacagaaaauuguggaacaagagggccuucacugcgaacaacaaccgucagugggaagcugauacacgaaugguguugucgaagcuguacacuuccgccauuacguuacaugggcgaggacggaugcugguauggaauggaaauucgaccuauaucagagaaagaagaaaacaugguaaagagcuuaguuucagcuggcucuggagagguagacaauuucacaaugggaguauuaugcuuggcaauacuguucgaggagguaaugcggggaaaauucggcaagaaacauaugauagccggcguuuucuucacauucguguuacuccugucaggacaaauaacauggagagauauggcucacacauugauaaugaucgggucaaacgcaagugaccgaauggguaugggaguuacauaucuugcuuugauagccacauucaaaauucaaccauuuuuggcauuaggauuuuuccucaggaaacuaacuucacgagaaaaucuguuauuagggguuggccuagcgauggcaacaacauugcaacucccagaagauauugaacagauggcaaacgguauagcacugggcuugauggcacugaaauuaauaacgcaauuugaaacguaccaguuauggacugccuugauuuccuugacuugcuccaacacaauuuucacacuuacgguagcuuggagaaccgcgacauuaauucuggcuggggucucauuguugccaguaugccaaucaucgucaaugcggaaaacugauuggcuaccaaugacgguagcugcuaugggaguuccuccacuaccauuauuuaucuucucacugaaagacacguugaagcgaaggaguuggccuuugaaugaaggaguuauggcugucggauuagucaguauucucgcaucuucucuccuucggaaugacgucccuauggcaggcccccucguagcugggggucuacucauagcaugcuaugucauaacagguaccucggcugaccuuacuguagagaaagcagcagacgugacaugggaggaagaggcagaacagacuggagugagucauaaucucaugauaacuguagacgacgacgguacaaugcggaucaaggaugaugaaaccgaaaauauauugaccguauuacugaagacugcacuguugauaguaagugggauuuuuccguacagcauaccggcaacucuauuaguguggcauacauggcaaaaacaaacacaaagaaguggcgugcuuugggauguaccaucuccaccugaaacacagaaagcagaguuagaagaagguguauaucgaauuaagcaacagggcauuuucggcaaaacucaagugggaguuggagugcaaaaagaggguguauuccacacuauguggcacguuacaaggggagcaguguugacguacaacgguaagcgcuuagaaccgaacugggcaagugucaagaaagacuuaauaaguuacggaggaggauggagauugucugcacaauggcaaaaaggggaggaaguucagguaauagcgguggaaccgggaaagaaucccaaaaacuuccagaccaugccggggacauuccaaacuacuacuggugaaauuggagcaauagccuuagauuuuaagcccggcacuucagggucaccaauaaucaauagagaaggaaaagugguugguuuguacgguaaugguguaguuacgaaaaacggaggguaugucucaggaaucgcgcagacgaacgcugaaccagacgguccuacaccagaacuagaggaggaaauguuuaaaaagagaaaucuaacgauaauggaccugcauccaggcucuggaaaaacgagaaaauauuuaccagccauagugcgugaagcuauaaagagacgucuaagaacauuaauacuagcgccgacgagagugguagccgcagagauggaagaggcauugaaaggucuuccaauccguuaccaaacuacggcaacuaaaagcgaacauacgggcagagagauuguggaccuaaugugucaugccacuuuuacaaugaggcucuuaucucccgugagaguuccaaauuauaaccuaauaaucauggacgaagcgcauuuuacggacccagcaucuaucgcagcacgggguuauauaucaacgcgugugggaaugggagaagcugcggcaauuuucaugacagcaaccccuccaggaacugcagaugcuuucccucagagcaacgcaccaauacaagaugaagaaagagauauaccggagagaucuuggaauagcgguaacgaguggauaacugauuuugcagggaaaacugucugguuugucccaucaauaaaagccggaaaugauaucgccaauuguuuaaggaaaaauggaaagaaaguuauacaauugagccgaaaaacuuuugauacugaguaucaaaagacaaaacuaaacgauugggauuuuguagugacaacugacauaagugagaugggagcuaacuucaaggcggauaggguaauugauccaagacgaugcuuaaaacccgugauacuaacagauggaccagagagagucauauuagcagguccaaugccugucacagcugcaucagcggcccaaagacgcgguagagucggucgcaacccccaaaaagaaaaugaucaauauauuuuuacaggacaaccucuaaauaaugaugaagaucacgcucauuggacugaggcaaaaauguugcuugacaauauaaacacaccugaaggaaucauacccgcacuauucgagccggaaagagagaaauccgccgcaauugacggcgaauaccgacucaaaggagaaagucgaaaaaccuuuguagaauuaaugcggagaggugaucuaccugucuggcuagcucacaaaguagcuucagaagggauaaaauacacggaucgcaaauggugcuucgacgggcaacgaaauaaucaaauuuuggaagagaacauggacguggaaauauggacaaaagaaggagagaaaaagaaacuuaggccuagaugguuagaugcucguaccuauagugauccacuggcacuuaaagaguucaaggacuucgcugcagguagaaaaaguauagcacuagaccugguaaccgagauugguagaguaccaacccaucuugcgcacagaacacgcaaugcccuugauaacuugguuaugcuacacacuagcgaacaugguggaaaagccuauagacaugcuguggaggaacuuccggaaacaauggaaacccuguuacugcucgguuuaaugauucuauuaacggguggugccaugcuguuuuuaauaagcggcaaagguauuggaaaaacuagcauuggcuuaaucuguguaauagcuucuagcggaaugcucuggauggcugaaauaccucuccaauggauagcgucagcgauaguacuugaguucuuuaugaugguacuauuaauucccgaaccugaaaaacagaggaccccucaagacaaccaacuggcauauguagugauugguauucuaacucuagcagcaaccauugcagcaaacgaaaugggacuacuagaaacuacgaaaagagauuuaggaaugucgaaggaaccuggggucguaaguccaacaaguuaucuagauguagaucuucacccagcaucggccuggacuuuauacgcaguugcaacuaccguuauaacgccaauguuacggcacacuaucgaaaauagcacagcaaaugugucacucgcugcuauagccaaccaagccguggucuuaauggggcuagauaaaggauggccgauaaguaaaauggacuuaggggugccauugcucgcacuagggugcuauucacaaguuaauccacuaaccuuaacggcagcgguucuccuacucauuacucauuaugccauaauagggccaggucuacaagcuaaagcaacuagagaggcacaaaaacguacggcggcgggaauuaugaaaaacccaacaguagacgggauaaugaccaucgauuuggauccaguaauauacgauucuaaguucgaaaaacaauuaggccaggugaugcuacucguauuaugugcgguucaauuauuacuaaugagaacuucuugggcgcucugugaagccuuaacgcuagcaacugggcccauuacaacucuuugggaaggcaguccggguaaauucuggaacacuacaauagcagucaguauggccaauauuuucaggggauccuaucuugcaggggcaggauuagccuuuucuaucaugaaaucggugggaacuggaaaacgugguacgggcucucaaggugaaacucuuggagaaaaauggaagaaacgauuaaaucaacucucaaggaaggaauuugauuuauacaagaaaucuggaauuacagaaguugacagaacugaagcaaaagaaggguuaaagagaggugagaucacgcaccacgccguuucucgugguucagccaaacuucagugguuuguugaacggaauaugguuauucccgagggucgagucauagaucuggguugcggacgugguggauggagcuacuauugugcgggguugaagaaaguuacugaaguacgagguuacaccaaaggagggccgggacaugaggaaccggucccaaugucgacguauggguggaauauaguaaaauugaugucugguaaagauguuuucuauuuaccgccagagaaaugugauacacuccugugugauauuggagaguccucaccuagcccaacaguugaagaaagucgcacaauuagggugcuaaaaaugguagaaccuuggcuaaagaauaaucaauuuugcauaaaaguauuaaauccuuauaugccuaccguaaucgagcaccuagaaagauuacaacgaaaacacggcgguauguuaguaagaaauccauugucccguaauucaacccaugaaauguacuggauaucaaaugguaccggaaauauuguagcauccguuaacaugguuuccagacuuuuacuaaauagauucacgaugacacacagaaggccaacaaucgaaaaagauguugaccugggggcaggaacucgacacguuaaugcagaaccagagacuccgaauauggacguuauuggcgaaagaaucaagcgaauuaaagaagaacauaauaguacuuggcauuaugaugacgaaaacccuuauaagacgugggcauaccacgguucuuaugagguaaaagcaacugguucagcaucuagcaugauuaauggaguagucaaguuauuaacgaaaccaugggacguuguccccauggugacgcaaauggcaaugaccgacaccacucccuuuggacagcaacguguauuuaaggagaaagucgauacaagaacaccaagaucaaugcccggcacacgacguguaaugggaauaacugcagaguggcuguggagaacauuagggagaaauaagaaaccaagacucugcacuagagaagaauuuacgaagaaagugcgaacaaacgcagcaaugggggccguuuuuacagaagaaaaccaaugggauagugcaaaagcugccguagaagacgaagauuuuuggaaauuaguagauagagagcgagaacugcacaaguuagggaaaugcgguucauguguuuauaauaugaugggaaaaagagagaagaaauuaggagaguucggaaaagcgaaaggcuccagagcuauaugguauaugugguuaggagccagauaccuagaguucgaagcguugggauuucuuaaugaagaucauugguucagucgcgaaaauagcuauagcggaguugaaggagagggauugcauaaacugggauacauauugcgugacauauccaaaauuccagguggugcuauguacgcugaugacaccgcuggaugggacacuaggauuacugaagaugauuuacacaacgaagaaaagauaacccagcaaauggacccagaacaucgacaguuggcaaaugcgauauucaaacuaaccuaucaaaauaaaguuguaaagguccagagaccaaccccgacuggaacaguaauggauauaauaucgagaaaagaccaaagaggaaguggucaaguagggacauauggccuaaacacguucacuaauauggaagcacaguuaauaagacaaauggagggagagggugugcuaucaaaggcugauuuggaaaauccacauuuaccagagaagaaaauaacacaaugguuagagacaaagggaguagaacgccucaagaggauggcuauuaguggagaugacuguguagugaaaccuaucgaugaucgcuuugcaaacgcuuuguuggcacuaaacgauaugggaaaaguucgaaaggauauaccucaauggcaaccaucgaaaggcuggcacgauuggcagcagguacccuuuuguucacaucacuuucacgaguugauaaugaaggaugggcgaaaauuaguagugccaugcagaccacaagaugagcuaaucggacgagccaggauaucacagggcgcaggcuggucguugcgagaaacggccuguuuaggcaaagcauaugcccagauguggucgcuuauguauuuccaucgccgagauuuacgacuugcaagcaacgccauauguucggcaguacccguacauugggugccaacuagcagaacaacauggucuauucaugcacaccaccaauggaugacaacagaagauaugcuaacaguuuggaauagaguauggauugaggauaaucccuggauggaagacaagaccccagugacuacaugggaaaauguacccuauuuaggcaaaagagaagaucagugguguggcagucuuauaggacuuaccucuagggcaacaugggcacaaaauauaccaacugccauucagcaagucagaucgcuaauagguaacgaagaauuucuggauuacaugccaucaaugaaacgauucaggaaggaggaagaaucugagggugccauaugguaa

SEQ ID NO: 23435 - RNA, 9873 nt, Artificial Sequence
  derived and/or modified CDS sequence (opt6) from DENV-3__FJ639810__SS-prME
acgucucuuugucuaaugaugauuuuaccagcggcuuuagcuuuccaccuaacaagucgcgauggugaaccacguaugaucguagguaaaaaugaacgagguaaaaguuuauuauuuaaaacagcuucagggauaaauaugugcacacuaauagcgauggaucuuggagaaaugugugacgacaccguaacauauaaauguccacacauaacggaaguagaaccagaagacauugauugcugguguaaucuaacauccacgugggucacuuacgguacauguaaccaagcgggugaacacaggagggauaaacguagcguggcacuagcgccacauguaggaaugggguuagacacucgcacacagaccuggaugucagcagaaggagcguggagacaagucgaaaaaguggaaacuugggcgcuacgacaucccggguuuacgauucuagcacucuuucuagcacacuacauaggcacaucucucacccagaaaguuguuaucuuuauacuacucaugcuugugacucccagcaugaccaugagauguguaggcguagguaauagagauuuuguggaaggucuuagcggagcaaccuggguagauguuguacuagaacauggaggauguguuacaacaauggcuaaaaauaaacccacccuugacauagagcuacagaaaacggaggcgacacaguuagcuacauuaaggaaauuauguauugaaggaaaaaucacuaacauaacaaccgauucaaggugcccuacucaaggcgaggcuguauugccagaagaacaagaccaaaauuacguauguaaacauacuuauguagaucguggauggggaaacgguugugguuuauucgggaaaggaagccucgugacaugcgcuaaauuccaguguuuagaaccuauagaaggcaaaguuguacaauacgaaaacuuaaaauauacuguaauuauuacaguucacacgggugaucaacaucaaguaggaaaugaaacacagggcgucacagcggaaauaacaccucaagcuagcacaacugaggcgauacuuccagaauauggcacacuaggguuagaaugcaguccgaggaccggauuggacuuuaacgaaaugauacuccuaacaaugaaaaauaaagcguggaugguacaucgacaaugguucuucgacuuaccauuaccauggacgucaggugcaacgaccgagaccccuacuuggaacaggaaagagcuauugguuacauucaaaaacgcacacgccaagaaacaggaaguaguaguuuuaggaagucaggaaggagcaaugcauacugcacuuaccggcgcaacugaaauccaaaauagugguggaacaucaauauucgcuggucacuuaaaaugucgauugaaaauggacaaacuugaauugaaaggcaugucuuaugcaauguguacgaauaccuuuguucucaagaaagaaguuucagaaacacaacacgguacaauacuaauuaaaguugaguauaaaggggaggacguaccauguaaaauuccguuuuccaccgaagauggucaagguaaagcucauaacggaagacuaauaacugcaaacccuguuguaacaaagaaagaagaaccagucaauauugaggcagaaccuccauucggugaaucuaacauugugauuggaauaggagauaaugcgcuaaaaauaaacugguacaagaaagguucaagcauuggaaaaauguuugaagccacggcuagaggugcucgccguauggcgauacuuggagacacagcaugggauuuuggaagugugggaggaguauuaaauucauuaggaaagauggugcaucaaauauuugguuccgcguacacagcccucuucuccggcgucucuuggguuaugaagauaggcaucggaguacuauuaaccuggauaggauuaaauagcaaaaacacaaguaugucauuuuccugcaucgcaaucggaauaauaacacuuuacuuaggagcaguuguacaagccgacacaggauguguaauaaauuggaaaggcaaagagcuaaaauguggaagcggaauauuuguaacaaacgaaguacacacuuggaccgaacaguauaaguuucaagccgauaguccaaaacggcuagcaacggcgauugcaggggcaugggaaaauggaguaugcggcauaagauccacgacacgcauggaaaauuuacuguggaaacaaauagccaaugaguuaaauuauauccuuugggaaaacaacaucaaacuaaccguaguaguuggagauauuauaggaguauuggaacagggaaaaagaaccuuaacaccucaacccauggaacuaaaauacaguuggaagaccuggggcaaagcacgaauagugacagcagagacucaaaauaguaguuucauaauugauggacccaacacaccagaauguccuaauacaaguagggcauggaacguuugggaaguugaagacuacggguucggaguguuuacaacaaacaucugguugaaauugagagaaguguauacccaacuaugugaucacagauuaaugagcgcagcaguaaaagaugagagagcgguacacgcggacaugggauauuggauugaaucccaaaagaacgggaguuggaaauuggagaaggcuucacuaauagaagugaaaacguguaccuggccaaaaucacacacucuauggucaaacgggguauuagagagugauaugauaauuccaaaauccuuagcggguccaauaagccaacauaauuaucggccaggauaucauacucaaacagcugguccguggcauuuagggaagcucgaacucgauuucaauuauugugagggaacaacagucguaauaacugagaacugcgggacaagagguccgucuuuacgaacaacaacaguguccggaaaacugauacaugaauggugcugucgaucauguacauuaccaccacuuagguauaugggcgaagacggauguugguaugggauggaaaucagacccaucucagaaaaagaagaaaacauggugaaaagccugguuucagcgggguccggagagguggauaauuucaccauggguguguuaugccucgccauucuauucgaagaaguaaugcgaggcaaauuugggaagaaacacaugauagccggcgucuuauuuacauuuguacuucuacuaagcggacaaaucacauggcgugauauggcucacacauugaucaugaucgguucgaaugcauccgaccgaauggguaugggaguaacguaccuagccuuaauagccacauuuaaaauacaaccuuucuuagcccuaggauuuuuccucaggaaacuaaccagcagagagaauuuacuacuuggcguaggacucgcaauggcaacuacauuacaacugccagaagauauagaacaaauggcgaacggcaucgcucuaggucuaauggcguugaaacuuauuacucaauucgaaacauaucaacucuggaccgccuuaauaaguuuaacauguagcaauacaauauuuacauuaacuguagcauggagaacagcgacacuaauacuggccggugugagucuguuaccagugugccaaucuagcaguaugagaaaaacagauuggcuaccaaugacaguagcugcuaugggaguuccaccacuaccccuauuuaucuuuugucuuaaggacacucuuaaacggagaagcuggccacuuaaugaaggcgucauggcggucggguuaguauccauauuggcaucaagucucuuaagaaaugacguuccaauggcaggcccccucguagccggaggacuauugauagcgugcuauguuauaaccggaacaucggcagaccucacuguagaaaaagcagcagaugucacaugggaagaagaagccgagcagacgggcgugucacauaaucuaaugauaacaguugaugaugauggaacuaugcgaauaaaagaugacgagacggaaaacauacuuacaguacuauugaaaacugcgcuacuaauuguaaguggaaucuucccuuauucaauucccgcuacacuacucgucuggcauacauggcagaaacaaacucaaagaucgggaguacuaugggauguaccuucacccccagaaacgcagaaggcagaguuagaggagggaguauaccgaauaaaacagcaaggcauuuucggaaaaacucaaguuggagucggaguacaaaaagaagguguguuccacacuauguggcauguuacaagaggagcaguauuaacauacaaugguaaaagacuggaaccuaauugggcauccguaaagaaagauuuaauaucuuauggaggcgguuggcgacuguccgcucaauggcagaaaggggaggagguacaaguaauagcuguggaacccggcaaaaaccccaagaauuuccagacaaugccgggcacguuucaaacaacuaccggagaaaucggggcaauagcucuugauuucaaaccgggaacuuccggaucuccaauaauaaaucgggaagggaaaguuguagggcuauacgggaauggcguagugacuaaaaauggaggauauguaucuggcauagcacagacaaacgcggaaccugacggaccaacaccagaauuagaagaggaaauguuuaagaaacguaacuuaacuaucauggaucuccauccagguaguggaaaaacgcguaaauaucuuccagcaaucguuagggaggcuauaaaaaggcguuuacgcacuuugauacuagcuccuacuagagucguggcagccgaaauggaagaggcacuaaaaggucuaccgauaagauaucagacuacagccaccaaaagcgagcacacaggcagagaaaucguagaucuaaugugucaugccacauuuacuaugagacuuuuaucaccuguuagaguccccaauuauaauuuaaucaucauggaugaggcacauuuuacggauccagcuucuaucgcagcaagagguuauauuaguacacgaguagggaugggagaagcugcugcaauuuucaugacagcaacgccaccaggaacagcggacgcguuuccucagagcaaugccccuauacaagaugaagaacgugauauaccugaacggagcuggaauaguggcaacgaauggauaacggauuuugcugguaaaacggucugguucguaccgaguauaaaagcuggcaaugauauugccaacugccuacgaaagaaugguaagaaagucauccagcuuucuagaaagacauucgacacggaguaccagaagacgaaauuaaaugauugggauuucgucguaacuacagacauaucggagaugggcgcgaacuuuaaagcggaccggguaauagauccgaggcgaugucuuaagccgguaauacuaacagacggcccagaaagagucauauuagcggggcccaugccaguuacggcugcaagugccgcucagagaagaggaagaguaggcagaaauccucaaaaagaaaaugaucaauacaucuucacaggacagcccuugaacaaugacgaagaucaugcacauuggacugaagcaaagauguuauuagauaauauaaauacccccgaagggauaaugccagcuuuauucgaacccgaacgugagaagucugccgcuauagacggagaauaucgucuaaaaggagaaucaagaaaaacguucguagaacuuaugcggagaggagaucuuccuguauggcucgcacauaaaguugcaagcgaggguauaaaauauacggacagaaaaugguguuuugacggacaacgaaauaaucagauuuuggaagaaaacauggauguggaaauuuggacaaaagaaggggagaagaagaaauugaggccgagaugguuagaugcucguacguacucugacccucuagcccuaaaggaauuuaaggacuucgcugcugguaggaaaaguauugcauuggaucuaguuacugaaauaggaagagugccaacucaucucgcccaucguacgcgaaacgcacuggacaauuuggucauguugcauacaucugaacaugguggcaaggcauauagacacgcuguagaagaacugcccgaaacuauggagacccuuuuacugcuaggccugaugauucugcuaacagguggugcuaugcuguuccucauuucaggaaaaggaauuggaaaaacgagcaucggguugauaugugucauagcuuccuccggaauguuauggauggcagaaaucccucuacaauggauugccucggcaauaguacuugaguucuuuaugaugguacuuuuaauacccgaaccagaaaaacaaagaacaccucaggacaaccaacucgcauauguaguaauuggcauucucacgcuagcugcuauaauagcggcuaaugaaaugggacuuuuggaaaccacgaagcgugaucuuggaaugucuaaggaaccugguguuguaucaccaacaagcuaucuugauguagaucuucacccugcaucagcauggacacuuuaugccguugccacgaccguuaucacaccaaugcuuagacauacgauagaaaacagcacggcaaauguaucccucgcugccauugcuaaucaagccgugguucuaaugggauuagacaagggguggccgauuaguaaaauggaucuaggcguaccauuguuagcacuaggauguuauucccaggucaauccucuuacauugacagcagcgguacuauuacuaauuacacauuacgcgauuaucggacccggacuacaagcuaaggcaacaagggaagcacagaagcgcacggcagccggcauaaugaaaaauccuacugucgauggcaucaugaccauagauuuagauccaguuauuuacgauaguaaguuugaaaaacagcuaggacaaguaaugcuucucgucuuaugcgcuguacaacuguuguugaugcgaacaucaugggcauuaugugaagcucuuacgcuagcuaccgggccgauaaccacguuaugggaaggauccccaggaaaguucuggaacaccacgauagcuguaucaauggccaauaucuuucgcgguaguuaccuggcgggugcaggauuggcauuuucuauuaugaaaucuguaggaacuggcaaaagagguaccgguucgcagggcgaaacacugggagagaaauggaaaaagaaacucaaccaacugucgagaaaggaauuugaccucuauaagaagaguggaauuacugaaguggauagaacggaagccaaagaaggacuuaaaagaggggaaauaacucaucaugcugugucuagagggucggcaaaauuacaaugguucguagaaaggaacaugguuaucccagaagggagagugauagaccucggauguggacgagguggauggucauauuacugugcaggacucaagaaaguaacagaaguaagaggcuacacaaaaggaggacccggccaugaggaaccuguucccaugucaacauacgguuggaacauaguaaaauuaauguccggcaaagauguauuuuacuugccaccugaaaaaugugauacguuacuaugugauauuggagaaaguucaccgucaccgacaguagaagaaagucguacgauacgcguacuaaaaauggucgaacccuggcuuaaaaacaaccaguucugcaucaaaguucugaauccguauaugccagccgugauugaacauuuagaaagacuucagaggaaacauggagggauguugguacgcaauccccuaucuagaaauucaacacaugagauguauuggauuucaaaugguacuggaaacauaguagccagugucaauaugguuagcagacuauugcuuaaucgauuuacaaugacccaucgacgaccuacgaucgaaaaagauguggauuugggugcaggaacccgucaugucaaugcagaaccagaaacuccuaauauggauguuaucggagagaggauuaaaagaauuaaagaagaacauaacucgacguggcauuaugacgacgaaaauccauauaaaacaugggcauaucauggcucauaugaaguaaaagcaacuggaucagcaaguucaaugauuaauggaguaguaaagcugcuaacgaagccgugggauguaguaccaaugguuacacagauggccaugaccgauacgacgccuuucggccagcaaagaguauuuaaagagaaaguugauacuaggacgccaagaucaaugccugguacaagaagagugauggguauuacggcagaauggcucuggagaacacuuggaaggaauaagaaaccccguuuaugcacccgggaagaauuuacaaagaaagugcgaacgaacgcagcaaugggagcuguauuuacggaagaaaaccaaugggauagugccaaagcugcaguggaagacgaggacuucuggaagcuaguugaucgcgaacgcgaacuacauaaacuugguaaaugcggaucaugugucuauaauaugauggggaagagggagaagaaauuaggugaguucgggaaagcgaaagguucaagagcaauaugguauauguggcucggugcaagguaucuugaauuugaagccuugggauucuugaaugaagaucauugguucucucgagaaaauucauacucagguguggaaggagagggauuacacaaacucgguuacauacuaagagauauaagcaaaaucccagguggagcaauguaugcugacgauacagcgggaugggacacacggauuacggaagacgaucuauacaaugaagaaaagauaacacaacagauggauccggaacauagacaauuggcaaaugcgauauuuaaguuaacuuaccaaaauaaaguaguaaagguacagagacccacaccaacagguaccguaauggacauaauauccagaaaagaucaacgcggaucaggucagguggggaccuaugguuuaaauacguucacaaacauggaagcucaauugauucgacaaauggaaggagaaggaguuuuaaguaaagcagaucucgagaacccgcaucugccagagaagaaaauuacacaaugguuagaaacaaaaggaguugaacgacugaaacgaauggcgauuucaggagacgauugcguuguaaaaccuauagaugaucguuucgccaacgcuuuguuagccuuaaacgauaugggaaaaguccgcaaagacauaccacaguggcaaccaagcaagggauggcacgauuggcagcagguuccauucugcucacaucacuuucaugaauuaaucaugaaagauggaaggaagcuagugguaccguguaggccacaagacgaacuaauagggcgugcaagaauaagucaaggcgcagguuggucuuugcgagaaacggcaugccugggaaaggcuuaugcacaaauguggaguuuaauguauuuucauagaagagaucuuagauuggcaucuaacgcuauuugcuccgcagucccaguccauugggugcccacaucgagaaccaccuggucuauccaugcgcaucaucaguggaugacuacagaagauauguugacuguguggaaucgaguuuggauagaagauaauccguggauggaagacaagacccccguuacgacaugggaaaacgucccauauuuagggaaaagagaggaucaguggugcgguaguuuaauaggucuuacaaguagagcgacaugggcacaaaauauucccacugcuauucaacagguaaggucauuaauuggaaacgaagaauuucuugauuauaugccuucaaugaaaagauucagaaaggaggaggaguccgagggcgcaauaugguag

SEQ ID NO: 23436 - RNA, 9873 nt, Artificial Sequence
  derived and/or modified CDS sequence (opt6) from DENV-3__FJ639816__SS-prME
acuagccugugcuugaugaugauauuaccugcuacauuagccuuucauuugacaagucgcgacggcgaaccaagaaugauaguugguaaaaaugaaagagguaaaucgcuucuauuuaaaacagcgucagguauaaacaugugcacacugauugcaauggaccuaggggaaaugugcgaugacacagucacauauaaauguccacauauaacggaaguggaaccagaagacaucgacuguugguguaauuugacuucuacuugggugacuuacgguacaugcaaucaagccggcgaacaucgaagagacaaacguaguguagccuuggcaccgcacguaggaaugggauuagauaccagaacgcaaacauggaugucagcggaaggugcauggcggcaagucgaaaaaguagaaacuugggcauugcgucaccccggguuuacaauacuugcguuauuucucgcccauuauaucgguacuucacugacucaaaaaguaguaauauuuauacuucuuauguuggugacaccuucgaugaccaugcgcugcguugggguaggcaauagagauuuuguugaaggcuugucgggagcuaccuggguggacguaguacuggaacauggaggaugcguaacaacaauggccaaaaacaaacccacuuuggacauagaacugcagaaaacagaagcgacucaacuugcuaccuuacguaaauuguguauagaaggaaaaauaacgaauaucacaaccgacagucgcuguccaacccaaggggaagcuguguuacccgaagaacaagaucaaaauuaugugugcaaacauaccuauguugaucgggguuggggaaaugguuguggauuauuuggcaaagguucauuaguaacaugugcaaaauuucagugucuugaacccauugaaggcaaaguuguucaauaugaaaaucugaaauauacaguuauaauaacaguacacacgggagaucaacaccaaguggguaaugaaacucagggugucacugcggagauuacaccucaggcuucuacaacagaagcaauucuuccagaauacggaacucugggguuggaaugcucucccagaacggggcuugacuucaaugaaaugauccuguugacuaugaaaaacaaggcuuggauggugcauaggcaaugguucuuugaucucccacuaccuuggaccuccggagcuacgacugaaacaccaaccuggaacaggaaagagcuacugguuacauucaaaaacgcacaugcaaagaaacaagaaguaguaguguuagguucacaagagggggcaaugcauaccgcccuaacaggagccacagaaauucaaaauaguggaggaacgucuauauucgcuggacaucuuaaauguagguuaaaaauggauaaauuagaguuaaaagggaugaguuaugcgaugugcacaaacacguuugucuugaagaaagaggugucagaaacacaacauggcaccauacuaauuaaaguagaauauaaaggagaagacgugcccuguaaaauaccauuuagcacggaggaugaacaagguaaagcacauaaugggcgauugauaacagcaaauccuguugugaccaagaaagaagaaccuguuaacauagaagcugagccgccauuuggagaaucuaauaucguaauuggaauuggagauaacgccuuaaaaauuaauugguacaagaaagguucauccauuggaaaaauguucgaggcaacugccagaggagcuagaaggauggcgauacuuggcgauaccgcgugggauuuuggaagcguuggugguguauuaaauagccuaggcaagaugguacaucaaauuuucgggagugcauauacagcauuauuuuccggcguaagcugggugaugaagauuggaauugguguguuacucaccuggauaggauuaaacucgaaaaauaccagcaugucguuuuccugcauagccauaggaauaauuacauuauaccuuggagccgugguacaggcggacauggguuguguuauaaacuggaagggaaaagaauuaaaguguggaagcggcauuuuuguaacuaacgaaguacacacauggacugaacaauacaaauuccaggcagauaguccgaaaagacuagcuacagccaucgcgggugcaugggaaaauggcguaugugggauacgcucuacuacaagaauggaaaaccuucuuuggaaacagauagccaaugagcucaacuacauacuuugggaaaauaauauaaaauuaacuguugucguaggggacauuauagggguauuagaacaggguaaaagaacauuaacaccucagccgauggaauugaaguauaguuggaagacguggggaaaagcacgaauugucaccgcggaaacgcagaacuccucauuuaucauagauggucccaacacacccgaauguccuagugcuucgagagcauggaauguaugggaaguagaggauuacgguuuugguguuuucacuacuaauauaugguuaaaacuacgugaaguguauacucaauugugcgaucauagauuaaugucagcggcuguaaaagacgaacgagccguacacgcagauauggguuauuggauugaaucucagaaaaauggaucuuggaaacuagaaaaagccagucuaauagaggucaaaacuuguacauggccaaaaucccacacacuauggucuaauggaguacuugaaagugauaugauaauaccgaagucauuggcaggaccuauaagucaacauaauuauagaccagguuaccauacacaaacugcugguccauggcaccuaggaaagcuggaguuagauuucaauuauugugaggggacaacaguugugauuacugaaaacugugguacacgcgguccgucccuucguacaacaacagugucuggaaaacuaauucaugaguggugcugucgaagcugcacauugccaccauugagguauaugggagaagacgguugcugguacggaauggaaauacgacccauaucggaaaaagaggaaaauaugguuaaaucuuuaguaucggcuggaaguggagaagucgacaacuuuaccaugggcgugcucugccuagcaauucuauuugaagaaguuaugaggggaaaauucgguaagaaacauaugauagccggugucuucuuuacauuuguacuccugcuaucuggacagauaaccuggcgagacauggcacauacacuuaucaugauaggaaguaaugcaagcgacaggauggggauggguguuacauauuuggcgcuaauagcuacuuucaagauacaacccuuccuagcucucggauucuuucuaaggaaacuuacaaguagagaaaacuuacuacuaggagucggcuuggcuauggcaaccacucuccaacuaccagaagauauagagcaaauggcaaauggcauugccuugggccuaauggcuuuaaaauuaauaacacaauuugaaaccuaucaacucuggacagcucuuauaucuuuaacaugcucaaauacuauauucacacucacaguagcauggcgaacggcgacuuuaauauuagcgggcguaagucuuuugccuguaugucaaaguucaaguaugcgaaaaacggacuggcuaccuaugacgguagcugcuaugggaguuccaccucucccccuauucauauucucucuuaaggacacauuaaaacgccgaucauggccucuaaacgaaggaguaauggcuguuggacugguaucgauucucgcuagcagcuuauuacgaaaugauguaccgauggcgggaccguugguagcaggaggauuauuaauugcaugcuauguaauaacuggaacaucugcagaucuuacaguagagaaggcggcugacguuacgugggaagaagaggcggaacaaacuggagugagucauaaucuaaugauuacaguggaugacgauggcacgaugagaauaaaagaugaugagacugaaaauauacuaacgguucuuuuaaaaacagcgcuucugauaguuaguggcauauucccauauucaauaccggcaacuuugcuaguauggcacaccuggcaaaaacagacucaaagaagcggcguucugugggauguucccaguccaccagaaacacaaaaagccgagcuagaagagggcguauauaggauuaaacaacaaggaauuuuugguaaaacacaaguuggcgucggugugcaaaaagaaggaguuuuucauacaauguggcauguaacacggggagcagugcuuacguauaacggcaaaagacuagaaccaaauugggccucagucaagaaagacuugauaucguauggagguggauggagguugucagcucaauggcaaaaaggugaggaagugcaaguuauugcuguagagccagguaaaaauccuaaaaauuuucagacaaugccagguacguuucagacuacaacgggugaaaucggggccauagcucuggauuucaagccagggacuucuggaagccccauuauaaacagggaaggaaagauaguuggacuauacggaaacggaguagucaccaaaaauggagguuacgugagcgguauugcucaaacuaacgcggaaccggacggacccaccccagaacucgaggaagagauguucaaaaagcgaaaccucacaaucauggaucuucauccuggauccggcaaaaccagaaaauaccuaccugcuauuguaagagaggcaauuaaacgucgacuaaggacacugauucuugcacccacgagggucguagcagcugagauggaagaggcacugaaggggcuaccaauacgauaucaaacuacagccacgaaaagugaacauacgggacgagagauuguggauuuaaugugucacgcuacguuuacaaugcgauugcuaucuccaguacgggugccgaauuauaaucuaauuauaauggacgaagcucauuuuaccgaccccgcuuccaucgcagcccgagguuauaucaguacucgcguuggaaugggugaggcugcagcuauuuuuaugacagcaacgcccccaggaacagcagaugccuucccacaaucaaacgcaccuauucaagacgaagagagggacauaccagagagaagcuggaauagcggaaacgaauggauaacggacuucgcagggaagacaguaugguucguaccaagcauaaaagcgggcaacgauauagcgaauuguuuaaggaaaaaugggaagaaaguuauacaacuaucacguaaaacauuugauacggaguaucagaaaacuaaauuaaacgacugggauuucgugguaacuacggauauaagcgaaaugggcgcaaacuucaaagcagaccggguaauagacccuagaaggugucuuaagccaguaauuuugacagacggcccagaacgaguaauauuagccggaccuaugccaguuacugcugcaucagcagcgcaaagaaggggaaggguugggagaaacccacaaaaagaaaacgaccaguauaucuuuacuggucaaccacucaacaaugacgaggaccacgcucauuggacggaagcaaagaugcucuuggacaauauuaauacgccugaagggaucauaccagcacuauuugaaccagaacgggaaaagagcgcagccauugauggagaguauagacuaaagggagagagucguaaaacauuuguugaauuaaugagacgaggggacuuaccggugugguuagcgcauaaaguugcaucagaaggaauaaaauauacagauaggaagugguguuucgacggucaaaggaauaaucaaauucuagaagaaaauauggauguggaaauauggacaaaagaaggagagaagaagaaacugagaccacguuggcuagaugcgaggaccuacuccgauccuuuggcguuaaaggaauuuaaagauuucgcagcagguagaaaaucaauagcguuggaccuaguuacugagaucggucgcguuccaacucauuuagcgcaucgaacacguaaugcauuagauaauuuaguuaugcuacauaccucagaacauggaggcaaggcuuaccggcaugcaguagaagaacucccggaaacaauggagacucuacuacugcuaggucuaaugauacuacuuacgggaggcgcuauguuauuccuaauaucugguaaaggaauaggcaaaacaagcauuggguuaauauguguaauagcuucgagcggaaugcuauggauggccgaaauaccguuacaauggauugcuucggcuauaguucuagaguucuuuaugaugguucuauugauaccagaaccagaaaaacaaagaacuccacaggauaaccaacuagccuauguuguuauagguauccuaacacuagcggcuaccauagcagcgaacgaaaugggcuuauuagagacaacaaaacgagauuuaggcaugaguaaagaaccaggugugguuaguccaaccuccuaucuagauguugaucugcacccugcuagugcuuggacuuuauaugcaguugcgacuacaguuauaacucccauguuacgacauacuauagagaauaguaccgccaauguuucacucgcugcuaucgcgaaccaggcaguugucuugaugggauuggauaaaggauggccgauauccaaaauggacuuggguguaccccuccuugcacuaggguguuauagccagguuaacccguugacgcuaacugcagcaguauuauuauuaauaacacacuaugccauaaucgggccgggacuacaagccaaggcuacacgagaggcacaaaaacgaacugccgcuggaauaaugaaaaacccgaccguagaugggaucaugacaauagauuuagaccccguuauauaugacuccaaguuugaaaaacaguugggacaaguaaugcuuuuaguguugugugcaguacaauuacuucuaaugagaacaucaugggcuuuaugcgaagcauuaacccuugcaacgggucccauuacaacgcugugggaagggucuccgggaaaauuuuggaauacaacaaucgccguauccauggcaaauaucuuuagaggaucauacuuagccggugcgggucuagcauuuagcgucaugaagucgguggguacuggcaaaagaggaacuggaagccaaggagagacccuaggggagaaguggaagaagaaauuaaaccaacuaucaaggaaagaguuugauuuguacaagaaaucagguaucacggaaguggaccgcacggaagcaaaagaaggacugaaaagaggggaaauaacucaucacgcugugucgagaggaagugcgaaauuacaaugguuuguagaaagaaacaugguuauaccugaagggcgagugauagaccuggggugugggcgaggagguuggaguuauuacugcgcagguuuaaagaaaguaacugagguaaggggauauaccaaaggagggccaggucacgaggaaccaguaccuauguccacauauggcuggaacauugucaaacuaaugagcggaaaagaugucuucuauuuaccacccgaaaaaugcgacacauuauuaugcgauauuggugaaaguucacccucccccacaguagaagaaucaagaacaauacgggugcuaaaaaugguagaaccuuggcuuaaaaacaaucaauuuuguauuaaaguucucaacccauauaugccaacaguaauagaacaccuugaacguuuacaacguaaacaugggggcaugcuaguuagaaauccgcucagucgaaauagcacacaugaaauguauuggauaagcaacggaacuggaaauauuguagccuccguaaauaugguauccaggcuucuacuuaauagauucacaaugacgcaccggagaccuacuauagaaaaagauguugaucuuggagccggaacaaggcauguuaacgcagaaccagagacaccaaacauggaugucauuggagagagaauuaaaagaaucaaagaagaacauaacucuaccuggcauuacgaugacgaaaacccauauaaaacaugggccuaucacggaaguuaugaaguaaaagccacaggcucagcaucaucaaugauaaauggcguaguaaaauugcuuacuaaaccaugggauguaguaccaauggucacucaaauggcgaugaccgauacuacaccguuuggacagcagcguguuuucaaagagaaaguugauacaaggacuccucguagcaugcccgggacucgccgaguaaugggcauuacagcggaauggcucuggagaacauuaggaagaaauaagaaaccucggcuaugcacucgcgaagaauuuaccaagaaagugaggacuaacgcugccaugggcgcaguuuuuacagaagaaaaccaaugggauagcgcuaaagcugcgguggaggaugaggauuuuuggaaacuugucgauagagaaagagaacuccacaaauuagguaaguguggaucaugcguuuauaacaugauggggaaaagggagaagaaauuaggugaauuugggaaagcaaaaggaucucgagcaaucugguauauguggcuuggagcccgcuauuuagaguuugaagcacuuggauuuuuaaacgaggaccauugguuuucaagagagaauaguuacagcggaguugaaggcgagggauuacauaaauuaggauauauucuaagggauauaagcaaaauacccggcggagcgauguaugcagacgauacagcagguugggauacgaggaucacugaagaugauuuacauaaugaagagaaaauaacgcaacaaauggaucccgaacacagacaacuggccaacgcaauuuuuaaauuaacuuaccaaaauaaaguaguaaagguccaaaggccuacgccuacaggcacugucauggacauaauuagcagaaaagaccaacgaggaucgggacaagugggaacauauggucuaaacacauucacaaacauggaagcgcaauuaauaagacaaauggaaggagaaggggugcugaguaaagcugacuuggaaaacccacaccucccugagaagaaaauuacucaauggcuagaaacgaagggaguugaaagacuaaaacggauggcuauuucgggugaugacuguguuguuaagccuauagaugauagauuugcaaacgcgcuguuggcacucaaugacauggggaagguaaggaaagacauaccacaauggcaacccucaaaagguuggcacgauuggcaacagguaccuuuuuguucgcaucauuuccacgaauuaaucaugaaagauggccguaaauuggucgugcccugcagaccacaggaugaauugauuggccgagcuagaauuucucaaggagcaggauggagcuuaagagaaacagccugucuugggaaagccuacgcgcaaauguggucuuuaauguacuuucaucgaagggaucuuagauuagcaaguaacgccauuugcucugcaguuccaguucauugggucccuacuagcagaacgaccugguccauucaugcacaccaucaguggaugacuaccgaagacauguugacuguguggaacagaguauggauugaagacaauccauggauggaagauaaaacgccaguaacgacuugggaaaacguaccauauuuagggaaacgugaagaccaauggugcggaagccucauaggucucacgagucgcgcuacaugggcgcagaauauuccgacugcaauacagcaagucagaucgcuaauugguaaugaggaauuucuggacuauaugcccucgaugaaaagguuccguaaagaggaagaaucagagggcgcgauuugguag

SEQ ID NO: 23437 - RNA, 9873 nt, Artificial Sequence
  derived and/or modified CDS sequence (opt6) from DENV-3__FJ639817__SS-prME
acgucgcuaugcuuaaugaugauauugcccgcugcuuuagcuuuucaccucacaucuagggacggggaaccccgcaugauaguaggcaaaaaugaacggggaaaauccuuauuauuuaaaacagcaucaggaaucaacauguguacgcuuaucgcaauggacuuaggagaaaugugugacgauacuguaacuuauaaauguccccauauaacugaaguugaaccugaagacaucgauuguuggugcaauuugacgaguacaugggucacuuauggaacaugcaaucaagcaggagaacauagaagggauaaacggucaguggcucucgcgccccauguagggaugggacuugacacacgcacacaaaccuggaugagugcugaaggagcuuggcgucaaguggaaaaaguagaaacuugggcacuucgccauccaggauuuaccauacuagcucuauuucuagcccauuacaucggaacuagcuugacacaaaaaguagucauauuuauccuucuaauguuggugacgccuucaaugacaaugagaugcgugggaguagguaaucgugauuuuguagaagguuuaucgggagccacauggguagauguaguucuugagcaugguggauguguuacgacaauggcuaaaaauaaaccaacacuugacauagagcuacagaaaaccgaagcaacucaauuggccacacuacgaaaacuaugcauagaaggaaaaauaacuaacguaacgacggauucucgauguccaacacaaggugaagcaguacugccugaagaacaagaucagaacuacguaugcaaacauaccuauguggauagaggaugggguaauggauguggccuauuuggaaaagggucguuaguaacaugugcgaaauuucaauguuuggaaccaauugaaggaaaagucgugcaauaugaaaaucuaaaauauacagugaucaucacagugcauaccggagaccagcaucaaguuggcaacgaaacucaaggagucacugcggaaaucacaccacaggcuagcacuacagaagcaauacuuccagaguacgguacccugggcuuggaauguaguccgaggacaggucuugacuucaacgaaaugauucuacuaaccaugaagaacaaggcuuggaugguucauaggcagugguucuuugacuugccuuuaccguggacaaguggcgcaacuacagaaacgccuacauggaacaggaaagaguuguuaguaacguucaaaaaugcucaugcuaagaaacaggagguugugguucuagguucacaggaaggagcgaugcauacagcauuaacuggugcuacugaaauccagaacucuggcgguacaaguauauucgcgggacauuugaaaugcagauuaaaaauggauaaacucgaauuaaagggaaugaguuaugcaauguguacuaauaccuucguuuuaaagaaagaaguaagcgagacccaacacgguacaaucuugaucaaggucgaauacaaaggagaagacgucccguguaaaauaccauuuucuacagaggacgggcaaggaaaagcccauaacgggcguuuaauaacugcgaauccagugguaaccaagaaagaagaaccugugaacaucgaagcagaaccacccuucggagagucaaauaucgucauaggaauaggugauaacgcucuaaaaaucaauugguauaagaaaggaucaaguauaggaaaaauguucgaggcaaccgcacgaggggcuagaagaauggcaauauugggugacacugcaugggauuucggaaguguaggugggguuuuaaacucgcuagguaaaaugguacaccaaaucuuugguucugcguauacggcauuauucucugguguaucaugggucaugaaaauaggaauaggcguccuacuaacguggaucgggcugaacucgcggaacacaucaaugaguuuuaguugcauugcaauagguaucauaacacuguaucuaggcgcgguugugcaagcugauauggguuguguuauuaacuggaaaggaaaagaacuuaaaugugggucgggcauauuuguaacaaaugaaguacacacauggacagagcaguacaaauuccaagccgauucaccgaaaagauuagcaacugccaucgcuggagcuugggaaaauggagugugcgguauacguucgacgacacgcauggaaaauuuacuauggaagcaaauagcuaaugagcugaacuacauauugugggaaaauaacauaaagcuaacaguaguagugggugauauuauuggugugcuggagcaaggcaaaagaacacuuacaccucagccaauggaguugaaguacucauggaaaacaugggggaaagcuaaaauagugaccgcggaaacgcaaaauaguucauucauuauagacggaccuaauaccccggagugcccuagcgcuucucgagcuuggaauguuugggaaguagaagauuacggauuuggaguuuuuacaacgaauauuugguuaaaguugcgugaagucuacacacagcuuugugaucacagacuaaugagugcagcuguuaaggaugaaagagcuguacacgcagacauggguuauuggauagagucccagaaaaaugguucuuggaaauuagaaaaggcuucuuuaauugaagugaaaacuuguacauggcccaaaagucauacacuauggucgaacggaguacuagaauccgacaugauuaucccaaagagcuuagcagguccuauaucucaacauaauuacaggcccggauaucauacacaaacugccgguccuuggcacuugggaaaacuugaguuagacuucaauuauugcgaagguacgaccguuguaauuacggaaaauuguggaacgagaggaccaaguuugcgaacaacaacgguaucuggaaagcuaauucacgaaugguguuguagaagcuguacacugccaccauuaagauauaugggagaggauggaugcugguaugggauggaaauuagaccgaucagcgaaaaagaggagaacaugguaaaaagucucgugucagcaggaaguggagagguagauaauuuuacuaugggaguacucuguuuagcuauucuguuugaagagguaaugagggggaaauuuggcaagaaacauaugauugcuggcguauucuuuaccuucguacuacuuuuaucuggccaaaucacguggagggauauggcgcauacacuaauaaugauuggaucuaacgcuagugaucgcaugggcaugggcgucacguaccuagcacugaucgcaacguuuaagauacagccuuuucuagcauuaggauucuuuuuacguaaacuaacaucgcgcgaaaaucugcuauuagguguugggcuagcuauggccacuacacuacaacuaccggaagacaucgaacaaauggcuaacggaauugccuuaggucuaauggcucuaaaacugauaacgcaauuugagacauaucagcuauggacagcgcuuauuagucucacuugcaguaacacgauuuucacguuaacgguagcuuggaggacugcuacguuaauacuggcaggagucucgcugcugcccguaugucaaaguucguccaugaggaaaacagauugguuaccaaugacaguagcugcuauggguguaccucccuuaccuuuauuuauauuuucgcuaaaagacacccuuaaaagaagaagcuggccacucaaugaaggcguaauggcgguagggcuaguaucaauccucgcuucaagucuauugcguaaugauguaccuauggcaggaccgcuugucgcugggggauuacuaauagcguguuaugugaucacgggaaccuccgcugaccuaacugucgaaaaagccgcggaugugacuugggaagaagaagcagaacaaacaggcguaucucauaaucuuaugauaacuguugacgaugacggcacaaugagaaucaaggaugaugagacagagaauauucugacuguacuucuaaaaacggcacuauuaauaguaagcggaauauuucccuauuccauaccagcaacuuuauugguuuggcauaccuggcaaaagcaaacacaacgauccggaguuuuaugggaugugccaagcccacccgaaacacagaaggcugagcuugaagagggcguauacagaauuaagcagcaggguauuuuugguaaaacucaaguuggaguuggaguucaaaaagaaggcgucuuccacacgauguggcacguaacaaggggcgcgguucuaaccuacaacgguaaaaggcuggaaccuaacugggccaguguaaagaaggauuugauaaguuauggaggaggcuggcgcuuaucagcucaauggcaaaaaggcgaggagguccaaguaauugccguugaaccaggaaagaauccaaagaacuuucaaacuaugccuggaacuuuucaaaccaccacuggcgaaauaggagcuaucgcacuggauuucaaaccagguacauccgguaguccuauuauaaacagagaagguaagguaguagggcuauaugguaauggcgucguaaccaaaaaugguggauacguaagcgggauagcgcaaaccaacgcagaacccgaugguccaacaccagaauuagaagaggagauguuuaagaaacgcaauuugacuauaauggaucugcacccugggucagguaaaaccaggaaauaucuaccggcuauaguucgugaggcuauuaagagaagauuaagaacucuuauacuagcgccaaccagaguggucgcggcggaaauggaagaagcucuaaaagguuuaccgauacgcuaccaaacuacagcaacaaaaucugaacauacaggaagagaaauagucgaccuaaugugucaugcgacuuuuacaaugaggcuucugaguccuguaaggguacccaauuauaauuugaucauaauggacgaagcucauuucacagacccagcaagcauagcggcccguggcuauauuaguacucgaguaggcaugggugaagcagcugcaauauuuaugaccgcaacaccuccuggcacagcagacgcauucccacaaagcaacgcaccgauacaggaugaggaaagagauauaccagaaaggucuuggaacucggguaaugaauggauuacugacuuugcuggaaaaacugugugguucguaccauccauuaaagcaggaaacgacaucgcaaacugccuuaggaagaacggaaagaaaguaauccaacugucacgaaaaaccuucgauacagaguaucagaaaacgaaauuaaacgacugggauuucgucguaacuaccgauauaucugaaaugggagccaacuuuaaagcugaucgugugauagauccucgcagaugccuaaaaccgguaauauuaaccgauggaccagagcgugugauacuugcaggaccuaugccaguaacggcggccucagcggcucaacguagagguagagugggcagaaacccccaaaaagaaaaugaccaauauauuuucacaggucaaccccuuaacaaugacgaagaccacgcacacuggacggaagccaaaauguuauuagauaacaucaauacgccugaaggaauuauaccugcuuuauuugagcccgaacgugagaaaucagcagcgauagauggagaauaucgauuaaaaggagaaagucgaaaaacauuugucgaacuaaugcgaagaggugauuuaccagucuggcuggcucauaagguggcuagugaaggaauuaaauauaccgaucguaagugguguuucgauggacaacgaaauaaucaaauucuugaggaaaacauggacguggaaauauggacuaaagagggggagaaaaagaaacuaagaccacgauggcuugacgccaggacauauagugauccauuagcuuuaaaagaauuuaaagauuuugcagccgggcgcaaaucgauugcgcuggacuuaguaacugaaauaggccgugucccuacucaccuugcacaccgcacgcgcaacgcucuugauaacuuagucaugcuccacacaagugagcaugggggaaaggcuuacagacacgcaguagaagaauugccagagacaauggagacacuguuauuguuaggacuuaugauccuucuaacgggaggagcaauguuauuccuuauuucgggaaaaggaauugggaaaacaucuauaggcuugaucugcguuauagccucuucaggaaugcuguggauggcggagauaccacugcaauggauugcuagugcaauugucuuagaguucuuuaugauggugcuacuaauaccagaaccggaaaaacaaaggacaccacaagauaaucaacuggccuacguagucauaggcauacuuaccuuggcagcaauuaucgcagccaacgaaauggguuuacuagaaacaacuaaacgcgauuuaggaaugucaagagaaccgggaguuguaaguccaacaucuuauuuagauguugaucuacauccagcaagugcguggacccucuacgccguagcaacgacagucauaacaccaaugcuucgucauaccauugaaaacucuacugcgaauguaucucuggcggcaauagcgaaucaggccgugguacuaaugggcuuagauaaaggcuggcccauaaguaagauggacuuagggguacccuuguuagcgcuaggauguuacagccaaguuaauccacuuacguuaacagccgcuguacuucuacucaucacacauuacgcaauaauugguccaggccuccaagcuaaggcaacccgagaagcgcaaaaacgaacugcggcuggaaucaugaagaaccccacgguggauggaaucaugaccauagacuuagacccaguaauuuaugacaguaaauucgaaaagcaauuaggacaggucaugcuauuaguucuuugugcaguacaacuauuauuaaugcgaacaaguugggcacugugugaagcguuaacacuagcaacaggaccaaucacaacauuaugggaagguucuccgggcaaguuuuggaacacaacgauagcaguaagcauggcgaacauuuuucguggcuccuaccucgcuggugcgggguuagcauuuucuauuaugaaauccguaggcacgggaaagcguggaacaggcucacagggggagacccucggagaaaaguggaaaaagaaacuaaaccaauuaagucgcaaagaauuugaucucuauaagaaaucuggaauuaccgaagucgaucgaacagaggcaaaggaaggauuaaaaagaggggaaauaacccaccaugcaguaaguagaggcucggcgaaauuacaaugguucguugaacggaacaugguuauaccagaaggucgcguuauagacuuaggaugcggccgaggagguugguccuacuauugcgcuggacucaagaaaguuaccgaaguuagaggcuacaccaaagggggaccaggacaugaagaaccaguaccaaugucaaccuauggauggaauaucguuaagcucaugaguggaaaagauguguucuauuuaccaccagaaaagugugacacacugcucugugacauuggagaguccagcccuucuccaacaguggaagaaucucguacaauucgaguacuuaaaaugguagaaccauggcucaaaaauaaccaauucugcaucaaaguucuaaacccuuacaugccagcuguaauugagcauuuggaaagacuacaaagaaaacauggaggaauguuaguuaggaacccucuuucacguaauaguacacaugaaauguacuggauuagcaacggaacaggaaacauaguugccucaguaaauauggucucucgauuacucuugaaucgguucacuaugacacauagaagaccaacaauugagaaggauguagauuuaggugcuggaacuagacacguuaacgcagagccugagaccccaaauauggauguaauaggugagcgaauuaagaggaucaaagaagaacauaauagcaccuggcacuacgaugaugagaauccguauaaaacaugggcuuaccauggauccuacgaaguaaaagcgacaggaucagcaucaaguaugauuaauggaguuguaaaacuauuaacaaagccuugggacguaguaccaauggugacccaaauggcaaugacugauacaacuccauucggccaacaacgaguauuuaaggaaaaaguagauacaagaacgccuagaagcaugccaggaacucgucgagucauggguaucacagcagaauggcucuggcgaacauugggacguaauaagaaaccgagacuauguacgagagaagaguuuaccaagaaaguaagaacaaacgcagcaaugggcgcuguauucacugaggaaaaccaaugggacucagcuaaagcagcaguugaagaugaagauuuuuggaagcuaguagacagagaacgugaauuacauaaauuaggaaaaugugguucauguguuuauaacaugauggggaagcgggaaaagaaacuaggagaauuuggaaaagcgaaagguagucgagcaauaugguauauguggcuuggugcccguuauuuagaauuugaggcacucggauuccuuaacgaggaucauugguucucuagagaaaauagcuacucagguguagagggagaaggauuacacaaauugggauacauauugcgagacauuaguaaaauuccagguggcgcaauguaugcggaugauaccgcaggcugggauacccgaaucacagaagaugacuuacauaacgaagagaaaauaacccaacaaauggauccagaacaccgacaacuagcaaacgcgauauucaaacucacguaucaaaacaaagucgugaaagugcaacgacccacaccgacaggaacuguuauggauauaauaagcaggaaagaucaaagggguaguggacaagucgggaccuauggcuugaacaccuucaccaacauggaggcacagcuuauacgccagauggaaggagaagguguucuuucaaaggcagauuuagaaaauccacaucuuccagagaagaaaauaacucaaugguuagaaacaaaagguguugaaagguugaaacgaauggcuauaaguggggaugacuguguuguaaaaccaauugaugacagguucgcaaacgcguuguuagcuuugaacgacauggguaaaguucgaaaagacauuccacaauggcaaccaucuaaaggauggcaugauuggcagcagguucccuucugcucacaucacuuucaugaacuaauaaugaaagaugguagaaaauuaguagucccguguaggccgcaagaugaauugauuggcagagcucgaauuucgcaaggugcagguugguccuuacgagagaccgcauguuuagguaaagcauacgcacaaauguggagcuuaauguauuuccacagaagggacuuaagacuggcuaguaaugcgauuugcagcgcaguaccaguccauuggguaccaacuucccggacgaccuggucaauucaugcucaucaucaauggaugacaaccgaggacauguuaacaguauggaaucgagucuggaucgaagauaauccauggauggaagacaaaacgccggucacgaccugggaaaacgugccauauuuagggaagagagaagaucaauggugcggaagucuuauagguuuaacgucacgggcaacuugggcccaaaacauaccaacagccauccagcaagugagaucucuaauuggaaaugaagaauuuuuagacuacaugccuuccaugaaaagauucagaaaggaagaagaaagcgaaggagcaauaugguaa

SEQ ID NO: 23438 - RNA, 9873 nt, Artificial Sequence
  derived and/or modified CDS sequence (opt6) from DENV-3__FJ639825__SS-prME
acaucacuaugucucaugaugauauuaccggcagcauuggcuuuccaucuaacaucaagagauggagaaccaagaaugauaguagggaaaaacgaaagaggaaaaucucuacuuuucaaaacagccucuggaauaaauauguguaccuuaauagcaauggaccuaggagaaaugugugaugacacuguaacauacaaauguccacauauaacugaagucgaaccagaggacaucgauugcugguguaaucuuacaucuaccugggucacuuauggaacuuguaaccaagcuggagaacaucguagagauaaaaggucaguagcgcuagcgccgcacguagggaugggauuggacacgagaacgcaaacguggaugagugccgaaggcgcauggagacaaguagaaaaaguugaaacuugggcauuaaggcacccuggguucaccauacuggccuuauucuuagcacauuauauagggacaucacucacccaaaaagugguuauauuuauuuuacuuaugcugguaacgccgucaaugacuaugcgauguguggguguaggaaacagagacuuugucgaaggauuaucuggugcaacuugggucgaugugguguuagaacacggaggcuguguaacgacuauggccaaaaauaaaccaacuuuagauauagaauugcagaaaaccgaagcaacccaacuugccacacuuagaaaauugugcauagaagguaaaaucacaaacauaacuacggauagcagaugucccacucagggagaagcaguacuaccggaggagcaagaccaaaauuauguaugcaaacauacauauguugauagagguuggggaaauggauguggucucuucggaaaaggcagcuuaguuacaugcgcuaaauuccagugucuugaacccauagaaggaaaagucguccaauacgaaaauuuaaaauauaccguuaucauuacugugcacacaggagaucaacaccagguugguaaugaaacgcaaggugugacggcagaaaucaccccgcaagcgucgacuaccgaggcuauauugccagaguauggaacacucggauuagaguguucacccaggacaggguuggacuucaaugaaaugaucuuacucacgaugaaaaauaaagcguggauggugcaccgacaaugguucuuugacuuaccuuugccuuggacgaguggagcaacuacugaaacaccgacuuggaauaggaaagagcuauuagugacauucaaaaaugcacaugcaaagaaacaagaggucguuguacucggaagucaagaaggggcgaugcacacggccuugacgggcgccacugaaauacaaaacagcgguggcacuucuaucuucgcaggacaucucaaaugccguuuaaaaauggacaaacuggaacuuaaagggaugucuuaugcuaugugcacuaauacauuuguacucaagaaagagguuuccgaaacacagcaugguacaauucucauaaaaguugacuauaaaggugaagaugucccaugcaaaauaccauuuucuaccgaagauggacaaggaaaagcacacaacggaagguuaaucacagcaaauccaguaguuacgaagaaagaggaaccuguaaauauugaagcugaaccaccauucggcgaaaguaacaucgugauugggaucggggacaacgcuuuaaaaauuaauugguauaagaaagguucuucaauaggcaaaauguuugaggcaacagcaagaggcgcucguagaauggcaauuuuaggggacacugcgugggacuuuggaucaguagggggcguuuuaaauuccuuagggaaaaugguacaccagaucuucggaucugcuuauacagcauuauuuagcggcgucucguggguaaugaaaauagguaucggagugcuucuuacguggauaggauugaacucgaaaaauacaucuaugucguuuucaugcauagcuauugguauaauuaccuuauaccuaggugcugugguucaagcagacacugggugugugauuaauuggaaaggaaaagaauuaaaaugugguucuggcauauucgucaccaaugaaguacacacguggacugaacaauauaaauuucaagcggauucaccaaaaagauuagcaaccgcaauugccggagcaugggaaaaugguguuuguggcaucagaagcacuacaaggauggaaaaccuauuguggaaacaaauagcaaaugaacucaacuauauacuuugggagaauaauauaaaacucacaguaguugucggagacauuaucggaguuuuagaacaaggaaaaaggacacugaccccacaaccgauggaacuuaaauauuccuggaaaacaugggggaaagcaaaaauaguuacagccgagacacaaaacaguaguuuuauaauagacgguccaaacacaccggagugucccagcgcgucucgagcuuggaacguaugggaaguagaagacuauggcuucggaguauuuaccacaaauaucuggcuuaaauuaagggaaguuuacacacaacaaugcgaucaucgacugaugagcgcagccgucaaagaugagcgagcuguucaugcagauaugggguauuggauagagucucagaaaaaugguucauggaaacuagaaaaagcaucacuuauagagguaaaaacuugcacguggccaaaaucucauacguuauggucgaacgguguguuagagucugauaugaucauaccaaaaucuuuagcagguccgauuucacaacacaacuacagaccugguuaucacacacaaaccgcaggacccuggcauuuagguaaacuugagcuugacuuuaacuacugugaggggacaaccguuguaauaacagaaaacuguggcacuagaggccccagcuuacggacaacuacggucucgggaaaauuaauucacgaaugguguugccguagcuguacccuaccuccucuaagauauaugggcgaggacggauguugguacgguauggaaauucgaccaaucuccgaaaaagaagagaacaugguaaaaagucuagugucugcggguagcggcgaaguagacaacuuuacuaugggcguucucugcuuagcaauccuguucgaggaggugaugcguggcaaauucggaaagaaacacaugauagccgguguauucuuuacuuucguacucuuauuaagcgggcaaaucacguggcgcgacauggcacauacauuaaucaugauuggcaguaaugcgagcgacaggaugggcaugggagugacuuaucuugcccuuauagcaaccuuuaaaauucaacccuuucuagcauuaggauucuuuuugagaaaguugacaucaagggaaaaucuauugcuaggaguuggacuagccauggcaaccacgcuucaauugccugaagauauagaacaaauggcaaaugguaucgcccuugggcuaauggcacuuaagcuaaucacccaauucgaaaccuaccagcuauggacggcccuuaucagcuuaacauguaguaacacgauuuuuacauuaacugucgcuuggcguacugcgacacuaauauuagcugggguuucgcugcuccccguaugucagucaucuaguaugaggaaaacugauuggcuaccaaugacaguagcagcaauggggguaccgccauugccccucuuuaucuuuuccuuaaaagauacuuuaaaaagaagaaguuggccccuaaacgaaggaguaauggcaguaggccuaguaaguauacuugcuaguucauuacuaaggaaugauguaccaauggccggaccccuuguugcuggugggcuacugauagcauguuacgucauuacugguacaucagcugaucuuacugucgaaaaagcugcugauguuacaugggaagaagaagcagaacaaacaggugugucccacaacuuaaugaucacugucgaugacgauggaacaaugagaauaaaagaugaugaaaccgagaauauucucaccguauuguuaaaaacagcuuuauuaauaguaagcggaauuuuuccauauaguauacccgcaacucuacucguuuggcauaccuggcagaaacaaacacaaaggaguggaguacuaugggaugucccaucuccgccugagacgcaaaaagcggaguuggaggaaggaguauacaggauaaaacaacaagggauuuuuggaaaaacgcaaguaggaguuggggugcaaaaagagggaguauuucacaccauguggcauguaacaaggggagcaguacuaacuuauaacgggaagagacuugaaccgaauugggcgucggucaagaaagacuuaauuagcuauggaggggguuggcgauuaagugcacaguggcagaaaggagaagaaguucaaguaauugcugucgaaccaggcaaaaaucccaagaacuuccaaacaaugcccggaacuuuucaaacgacgaccggcgaaauaggggcuauagcucuagacuucaaaccgggcacgagugguagcccaauaauaaaccgggaaggaaaaguaguugggcuauauggcaauggcguaguaacuaaaaauggcgguuaugugaguggaaucgcacaaaccaaugcugaaccagacgguccaaccccagaauuagaggaagaaauguuuaagaaaagaaacuuaaccauaauggaucugcacccagguucggguaagaccagaaaauaucuccccgcaauagugagggaagcgauaaaacgcagauuaagaacacuuauuuuagcaccaaccagaguugucgcagcagaaauggaggaagcacugaaaggacuucccaucagauaccaaacaacagcgacaaaaagugaacacacagguagagagaucgucgaucuuaugugucacgcaaccuuuacgaugagacuacugucaccuguaaggguuccgaauuacaacuuaauuauaauggaugaagcacacuucacggacccagcuucuauagcagccagggguuacauaucaaccagaguggguaugggcgaagcagcagcuauuuuuaugacagcuacuccaccagguacggcagaugcauucccucaauccaacgcaccaauccaggaugaagagagggauauuccugagcgaaguuggaauagcgggaacgaauggauuacggacuuugcuggcaaaacugucugguuuguacccagcauuaaagcugggaacgauaucgcuaauugcuuaagaaagaacgguaagaaagugauacaauuaaguagaaaaaccuuugauacagaauaucagaaaacaaaauugaacgauugggacuucgugguaacuaccgacauuagcgaaaugggugcuaauuucaaagcggauagaguaauagauccucgucgauguuuaaagccaguaauauuaacagauggaccggaacgcguaauacuggcuggaccuaugccagugacagcagccagcgcugcucagcggagaggacgcguaggacggaacccccaaaaagaaaacgaucaauauauuuuuacaggacagccgcuaaacaacgacgaagaucaugcccacuggacggaggccaagauguuguuggauaacauaaauaccccugagggcaucauacccgcuuuguuugaaccugagcgagagaaaagcgcagcaaucgauggagaauauagauugaaaggagaaucacgaaaaacauuuguagaacucaugagacgcggugaucugcccguuugguuagcucacaaaguugcauccgaagggauaaaauauacagacagaaaaugguguuucgacggccagcgcaauaaccagauacucgaagaaaacauggauguugaaauuuggacuaaagaaggugagaagaagaaauuacgcccgagauggcuggaugcaaggaccuauuccgacccgcuggcacuaaaggaauuuaaggacuucgcugcaggacgaaaaucuauagcacuagaccucgucacggagauaggaagaguacccucucaucucgcacauagaacgaggaaugcgcuugauaaucuugugaugcuacauacgucagaacacggugguaaagcauaccgacacgcaguugaggaguuacccgaaacaauggaaacguugcuucuacuagggcuaaugauuuuacucacuggaggcgcuauguuauuucucaucucaggaaaagguauuggaaaaacuucaauaggacugauuugcguuauugcuagcucagguaugcuauggauggcagaaauuccacuccaauggauugcgucagcuauugugcuggaauuuuucaugaugguacuucuuauuccugagccugagaagcaaagaacaccccaagauaaccaguuagcauacgugguaauaggaauuuuaacacuggcagcuauaauugccgcuaacgaaauggguuugcuugaaaccaccaagagagacuuaggcauguccaaagaacccggaguaguuucaccaacgagcuaucuagauguagaccuccaccccgcaagugcuuggacucuguaugcuguagcuacuacaguuauaacaccaaugcuccgccauacaauagagaacaguacagcgaacguaaguuuagccgcaauagcaaaccaagcaguggugcugaugggccucgacaagggauggcccauaagcaagauggaucuggguguuccacuccuugccuuagggugcuacucacagguaaacccauugacacucacggcagcugugcuauuacuaauaacccacuaugcaauaaucggaccuggacuccaagcuaaagccaccagggaggcccaaaaacgaacagcggcgggaauaaugaaaaauccgacaguugaugguauaaugacuaucgacuuggauccaguuaucuaugauaguaaguuugaaaaacaauuaggacaaguaauguugcuuguacugugugcaguacaacuccuucuuaugagaacaucaugggcacuaugcgaagcgcugacgcuagcaaccggaccuauuacaacacuaugggaagggagucccggaaaauuuuggaacacaacgauugcugugaguauggcaaacauuuucagaggcuccuacuuagcaggagcggggcuugcauuuuccauuaugaaaaguguugguacggggaaaagagguacugguagucagggcgaaacuuugggggaaaaauggaagaagaaacuaaaucaacuuaguaggaaagaauuugauuuauauaagaagagugguauuacugaaguugaucgcacugaggcaaaggaaggccuaaaaagaggagaaauuacacaucaugccguaaguagaggaucggcgaagcuacaaugguucguagaacggaacauggugauaccugaaggccgagugauugaccugggcuguggaagaggggguuggucauauuacugcgcaggucuaaagaaaguuacagaaguacgaggcuacacaaaaggagguccaggucaugaagaaccaguaccgaugaguacauacggauggaacauagucaagcucaugucugguaaagacguauuuuacuuacccccugagaagugugauacacuauuaugugacauuggagaaucaucuccuaguccaacaguggaagagucacgaaccauaagagucuuaaaaaugguugagccuugguuaaagaacaaucaguuuugcauuaaaguauuaaauccauauaugccaaccguuaucgaacauuuagaacgccuacagcggaaacauggaggaaugcuugugcguaauccauuaagcagaaacaguacacacgaaauguauuggaucuccaacggaacaggcaacaucguagcgagcguuaauaugguuucaagauuguuacuaaauagguuuacuaugacgcaucguagaccaacgauugagaaggacguagauuuaggugcaggaacacgucacgucaaugcagaaccugaaacgccaaauauggaugugaucggggaaagaaucaaacguauaaaagaggagcacaacaguacauggcauuacgaugacgaaaauccauacaaaacgugggcauaucaugguucauacgaagugaaagcuacaggcagugcaucaagcaugauaaauggaguaguaaaacuuuuaacuaaaccaugggacguugucccgauggucacgcagauggcaaugacagacacuacuccauuuggacaacagaggguguuuaaagagaaaguugauacacgcacuccucgcucaaugcccggcacuaggcgugugaugggcaucacagcagaaugguuauggcgaacauuaggccggaauaagaaaccccggcuuugcaccagggaggaguucaccaagaaaguaaggacaaacgcagcuaugggcgccguguucacagaagaaaaccaaugggacagugcuaaggcagcaguggaagaugaagacuuuuggaagcuaguggacagggagagagaauuacacaaacuuggaaaauguggaucaugcgucuacaacaugaugggaaagagggagaagaaacuuggcgaauuugggaaggcuaaaggaagucgagcaauuugguauauguggcuaggagcucguuauuuagaguucgaagccuuagguuuccuuaacgaagaccacugguucucgagagaaaauucauauagugggguugaaggugaaggccuccacaaauuaggauauauacuacgagacauuaguaaaaucccuggaggcgccauguaugcagacgauacggcgggaugggauacaaggauaacugaggacgauuuacacaaugaagaaaagauaacgcaacaaauggaccccgaacauaaacaguuagccaacgcuauauuuaaacuaacguaccagaauaagguaguaaagguacaaaggccuacaccaacaggaacaguaauggauauuauuucaaggaaggaccagagagguucaggccaaguugguacuuaugguuugaacaccuuuacuaacauggaagcacaauuaauacgucagauggaaggugaaggcguauugagcaaggcugauuuagagaacccucaccucccagaaaagaaaauaacucaaugguuagaaacaaaagguguugaaagacuaaaacgaauggcuauuaguggggacgauugcguagugaaaccuauagaugaucgcuucgcaaaugcacugcuagcgcucaaugacaugggcaaggucaggaaagauaucccccaauggcaacccucuaagggauggcacgacuggcaacaaguuccauucuguucacaccauuuucacgaauuaaucaugaaggaugguagaaaguuaguaguuccgugucggccucaggaugaauuaauaggucgggcgcgaauuucucaaggagcaggguggucacugagagaaacggcuugccuuggaaaggcauacgcacaaauguggaguuugauguauuuucaccgaagggaucugcgguuagccucaaacgcaauauguucggcaguaccaguacauugggugccuacaaguagaaccacuuggagcauucaugcacaucaucaauggaugacaacggaggacaugcuaacgguguggaauaggguguggauagaagacaaccccuggauggaagacaagacaccaguaacgacaugggaaaauguaccguacuugggaaaaagagaggaccaaugguguggcucauugauuggacucaccagucgggcuacaugggcucaaaauauuccaacagccauacagcaaguacgaucauuaauuggaaaugaagaauuuuuagauuauaugccuucaaugaagcgguuucgaaaggaagaagaaagugaaggcgcuauaugguaa

SEQ ID NO: 23439 - RNA, 9873 nt, Artificial Sequence
  derived and/or modified CDS sequence (opt6) from DENV-3__FJ639826__SS-prME
acgucucuaugucuaaugaugauauuaccagcagcauuagcauuucauuuaacaagccgugacggugaaccucgaaugaucguagggaaaaacgaacggggaaaaaguuuauuauucaaaaccgccucaggaauuaauaugugcaccuuaauagcuauggacuuaggggaaaugugugaugauacuguaaccuacaaaugcccucacauuaccgaaguagaaccagaggacaucgauuguugguguaauuugaccucuacauggguaacguacgguaccuguaaucaagcuggugaacauaggagagacaaacgguccguagcacuagcuccccacguuggaaugggacuggauacucgaacacaaacuuggauguccgcagaaggugcauggcgacaaguggagaaaguagaaacgugggcuuugagacaccccggguuuacuauacuagcacuauuuuuagcacauuauaucggcaccucacuaacacaaaaaguuguaauuuuuauauuguuaauguuagucaccccguccaugacaaugagguguguaggaguaggcaaccgggacuucguagaaggacuuaguggcgcaacauggguugacguaguccuagaacaugguggcugcgugacaacaauggcgaaaaauaaaccaacccuugacauagaauuacagaaaacggaagccacacaauuagcuacucuaagaaaauuauguauugaaggcaaaauaacaaacauuacuacugauaguagauguccuacucaaggagaagcaguuuuacccgaagaacaagaucaaaauuacguaugcaaacauacuuacguagaucggggauggggaaacggaugcggauuauucggaaaaggaagccuuguaacaugugccaaauuccaaugucuagaaccaauagaagguaaaguuguacaauacgaaaaucucaaauauacuguaauuauuacuguacauacuggagaucaacaucaagucggaaaugagacacaagguguaacggcagaaauuacaccucaagccaguaccacggaagcaauuuugcccgaauacgggacuuuagggcucgaauguagcccacgaacuggauuggacuucaaugaaaugauauuacuaacgaugaagaacaaagccuggaugguucaucgucaaugguucuuugaccuucccuuacccuggacaagcggagccaccacggagacccccaccuggaaucguaaagaacuccuaguaacauuuaaaaacgcacacgccaagaaacaagaaguaguaguauuagguagucaagaaggagcuaugcauacugcacuaacaggagcaaccgagauucaaaauagcggaggaacuucuaucuucgccgggcaccuaaaauguagacuaaagauggacaaacucgaacuaaaaggaaugagcuaugcuaugugcacaaacacauuuguacugaagaaagaaguaucagaaacucaacaugggacaauacuuauaaaaguggaauauaaaggagaagauguaccuugcaagauuccauuuaguaccgaagacggacaaggaaaagcgcauaauggaagacuaauaacugcuaacccaguggugacaaagaaagaggaacccgugaauauagaggcagaaccucccuucggugagaguaauauaguaauaggaauuggagauaacgcccuaaaaauaaauugguacaagaaggggaguucaauaggcaaaauguucgaagccacugcaaggggagcacgacggauggcaauucuuggcgauacagcgugggacuucggaucaguaggugguguucuuaauagccuaggaaaaaugguacaucaaaucuucgguagugccuauaccgcauuauuuagcgggguuagcuggguaaugaaaauagggauagguguauuacugacauggauaggauuaaacucgaaaaacacuagcaugucguuuucauguaucgcaauugggauuauuacgcuauaucugggggcgguuguacaagcagauacaggcugcguuaucaauuggaaagggaaggagcuuaaaugcggcuccgguauauucguuaccaaugaaguucauacguggacagaacaauacaaauuccaagcagauucucccaaacgauuagcgacugcaauagcgggggcaugggagaauggcguaugugguauaagaucaacaacacgaauggaaaauuuacuuuggaaacaaauagcaaacgaacugaacuauaucuuaugggagaauaauauuaaguugacggucguuguaggggacauaauagguguacuugaacaagggaaaagaacacuuacgccacaacccauggaacucaaauauagcuggaagaccugggggaaggcucggaucguaaccgcagaaacacaaaacucaucuuucauuauugacggaccuaauacuccggaguguccaaacacauccagggcauggaacgugugggaaguugaagacuacggcuuuggaguuuucacaacuaacaucugguugaaauuacgugaaguauacacucaacuaugugaccacagauugaugucggcggcuguuaaggaugaaagagcuguucaugcagacaugggcuauuggauugaaucacagaaaaacgguucuuggaagcuagaaaaagcaagucuaauugaagucaagacaugcacauggccaaaaagucacaccuugugguccaaugguguacuagaaagugauaugauaauucccaaaucuuuagcagguccuaucucacaacauaauuauagaccugguuaucauacccaaacagcagggccauggcaccucggaaaacuggaauuagacuucaacuauugugaaggaacgacugucguuauaacggaaaauuguggaaccagggguccuucucuucguacaacuaccguaucggggaaguuaauacaugaauggugcugccgaucauguacuuuaccgccucuacguuacaugggugaggacggaugcugguauggaauggaaaucagaccuauuucggagaaggaagaaaacauggucaaaaguuuagucagugcugggucuggugaaguggauaauuucacaauggguguucucugccucgcaauucuuuuugaagaaguuaugcgagguaaauuuggcaagaaacauaugauagcggggguguucuucacauuugucuuacuucugaguggacaaauuacauggcgugauauggcgcauacguuaauuaugaucgggaguaaugcaacagaucgaaugggaaugggugugacauacuuagcucuaauagcuacauucaaaauucaaccauuucucgcauugggauucuuucugcgaaaauugacgucucgugagaaccuacuacucggcguuggccuugcuauggccacgacacugcaauuaccagaagacauagaacaaauggcaaauggcauagcauuagguuugauggcuuugaaacugauuacccaauuugaaacauaucaacuauggacagcauuaauuagucuuacaugcucaaauacuauauuuacauuaacgguagcauggcgaacagccacuuuaauauuggcgggcguaucauuauuaccuguaugccaaucgaguucuaugagaaagacugauuggcuucccaugacaguggcagcuauggguguaccuccuuuaccauuauucauauuuucuuuaaaagacacucuaaaacgcaggaguuggccauuaaacgaaggcguaauggcugucgggcucguuagcauucuggcaagcagucugcuccggaacgauguuccuauggccggaccgcuuguagccgguggucuucuuauugcauguuacguaaucacugguacuucggccgaccuuacugucgaaaaagcugcugaugugacaugggaagaagaagcugaacaaacggguguuagccauaauuuaaugauuacuguugacgacgauggaacaaugcggauaaaggaugaugaaacagaaaauauccuaacgguauuacuaaagacugcgcugcucauuguaaguggaauauucccguacucuauaccagccaccuuacuuguguggcauacuuggcaaaaacagacccaaagaaguggggugcuaugggauguaccaaguccgccugaaacccaaaaagcagaauuagaggaaggaguauaucguaucaagcagcaaggaaucuucggcaaaacccaggugggcguaggcguucaaaaggaaggaguguuccacacuauguggcauguuacacgcggagcaguauugacuuacaacggcaaaagauuagaaccuaacugggcuaguguaaagaaagaccucauaaguuacggaggaggauggcgacucagugcgcaguggcagaaaggcgaagaaguacaaguuauagcaguggaaccgggcaaaaaccccaaaaauuuccaaacaaugccagguaccuuucaaacuacaacgggagaaauaggugcaauugcccuugacuuuaaaccugguacaagugguucuccuauuauaaaucgagaagguaaagucguggguuuauacggaaauggagugguaacgaaaaaugguggguacgucucaggcauagcucaaacaaaugcagaaccggaugggccaacaccugaacuagaggaagaaauguuuaagaaacgcaaucuaacaaucauggaucuacaucccggcaguggaaaaacaagaaaauauuuacccgcgauaguuagggaagcaauuaaaagacgacuacguacgcugauacuagccccaacuaggguaguagcagcagagauggaagaagcauuaaaaggacugccuaucagauaccaaacuacugcaacuaaaagugaacacacggggagagaaauugucgaccucaugugucacgcuacauuuaccaugcgcuuauuaaguccuguccggguaccaaacuacaauuugaucauuauggaugaagcccacuucacggauccagcaucaauugcggccagaggcuacauuucaacccgaguuggaaugggugaagcagcugcaauauucaugaccgcaacucccccugguacugcggaugcuuucccccaaucaaaugccccaauucaagacgaagaacgagacauaccagaaagaucuuggaauagcggcaacgaguggauaacagacuuuacagguaaaacggucugguucgugccaucgaucaaagcagggaaugacaucgccaauugccuaagaaagaaugggaaaaagguaauccaacucucaagaaaaacuuuugauacagaguaucagaaaacaaaacuuaaugauugggacuuugugguaacaacagacauaagugaaaugggagcaaauuucaaagcggaccgcguaauagauccgcgucgaugccuaaaaccaguaauauuaacggacggucccgaacgagugauauuagcuggaccaaugccagucacugcagcgucagcagcgcaacgccgcgggagaguuggaaggaacccucagaaggaaaacgaccaauauauauuuaccggucaaccccucaacaaugaugaagaucaugcucacuggacugaagcaaaaauguuauuagacaauauaaauaccccugaaggaauaauacccgcucuguuugagccugaaagggagaaaagcgcagcaauagacggugaauaccguuuaaagggugaaucaagaaaaacauucgucgaauugaugcggcgaggagaucuacccguuugguuagcgcacaagguagccucagaaggaauaaaauacacggaucguaagugguguuucgacggccagagaaacaaccaaauacuagaggaaaauauggauguugagauauggaccaaggagggugagaaaaagaaauuaagaccaagaugguuagacgcucgaaccuacagcgacccucucgcauuaaaagaauuuaaggauuucgcagcgggaagaaagucaauagcucuugacuuaguuacagagaucgggagggucccaacucauuuagcccaccgaacacgaaaugccuuggacaaucuagucaugcuacauaccagugaacacggcggcaaagccuaucgccaugcgguagaagaacugccagagacuauggagacacuucuucuacucggguugaugauacugcuaacuggaggagccauguuguuccucaucucugggaaaggcauugggaaaacaaguauaggguuaauauguguaauugcaucaucaggcauguuauggauggccgaaauucccuugcaauggaucgcuagugcuauuguauuagaguucuuuaugaugguauuacucauuccagaaccugaaaagcagagaaccccucaagacaaucagcucgcauacguaguaauuggcauacuaacacuagcugccauaauugcugcaaaugaaaugggauuacuggaaaccacaaaacgagauuuggguauguccaaagaacccggaguaguuucaccuacaucuuaucuggauguagaucuacauccggcuucagcuuggacgcucuaugcgguagcaacuacaguaauuaccccaauguugcgacauacaaucgaaaacucaacugcaaacgugagcuuagccgcgauugccaaccaagcgguuguacuaaugggucucgauaaaggcuggccuauaucuaaaauggaccuagggguaccacucuuagcgcuaggaugcuauucacaaguaaacccauuaacacugacagcagcagugcuccuccucaucacucauuaugcgaucauaggaccaggcuugcaagccaaagcgacgcgagaagcacagaaaaggacggcagcaggcauaaugaaaaacccuacaguagaugggauaaugacuauagaccuggacccuguuaucuaugacuccaaauucgagaaacagcuuggucaaguaaugcuauugguuuuaugcgcuguucaguuauuacuaaugagaacgucuugggcacuuugcgaagcacuaacucuggccacagggccuauaacaacccuaugggaagguagcccgggaaaauucuggaacacuacuauagccguaaguauggcgaauaucuuuagaggaagcuaucuagcaggagcuggacuugcuuuuaguauaaugaagagugucgguaccggcaagagagguaccggcagucagggugagacccuaggagaaaaauggaagaagaaacucaaucaacuaucgcgaaaagaguuugaucuauauaagaaaagcgguauuaccgaaguagauagaacggaagcgaaggaaggacucaagcgaggugaaauuacccaucaugccguaucaagagguucagcgaaacuucaaugguucguugaaagaaauauggucauuccggagggacgggugaucgauuugggauguggaagagguggauggucuuauuacugcgccgggcucaagaagguaacagaaguaagaggcuauacgaaagggggaccaggacaugaggaaccuguaccaaugaguaccuacggauggaauauaguaaaauuaaugucuggaaaagauguuuucuaccugccaccggagaagugugacacccuacuuugugauaucggugaaaguucaccuucgcccaccguggaagaaucaagaacgauuaggguacugaaaaugguagaaccuugguuaaagaacaaucaauucugcauaaagguucuuaauccuuauaugccagccguaauugaacaucuagaaaggcuacaacgaaagcacggaggcaugcuuguacggaauccuuuaaguagaaacagcacccacgaaauguauuggaucaguaaugguacgggcaauauaguagccaguguuaacaugguaagucguuuacuucucaaucgcuucacuaugacucauagacgucccacaauugaaaaagauguagaucuaggggcaggcacacgccacguuaacgcagaaccagaaacaccuaauauggauguuauuggugaacgaauaaagcgaauuaaagaggagcauaacaguacguggcauuacgaugaugaaaauccuuacaaaacuugggccuaccaugguuccuaugagguuaaagcgacagguagcgccagcucaaugaucaaugguguaguaaaacuguuaacaaaaccaugggacguggugccaaugguuacacagauggccaugacugauaccaccccuuucggacagcaaaggguuuuuaaggaaaaaguagacacaagaacgcccagaucaaugccuggaacuagacgaguaauggaaauuaccgcggaauggcuauggagaacacuaggcaggaacaaaaagccccgacuuuguacaagggaggaauuuaccaagaaaguaagaacaaaugcggcgaugggagcgguauucacggaagagaaucaaugggacuccgcuaaagcggcaguagaagaugaggauuucuggaaacuuguugaucgagagagagaauuacauaaacuuggaaaauguggaaguuguguauacaacaugaugggcaagagagaaaagaaacuaggugaguucggaaaagccaaaggaucacgugcaauaugguauaugugguuaggcgcccgauauuuagaauuugaagcccuuggcuuuuugaaugaggaucacugguuuaguagagaaaauaguuauucaggcgucgaaggagaaggccuucacaaacugggauauauucucagagauauuagcaaaauaccuggaggagcuauguaugcagaugauacagcaggaugggacacacgcauuaccgaggaugauuugcauaaugaggagaaaauuacacaacaaauggacccagaacauagacaauuagcaaaugcaaucuucaaacuuacuuaccaaaauaaagucguaaaaguacaacgaccaacgccuacagguacugucauggauauaauuaguagaaaagaccagcgcggaucaggacagguaggcacauauggccugaauacguucacaaacauggaagcacaguugauuagacagauggagggcgaaggcguacuaaguaaagcggauuuggaaaauccucaucuaccagagaagaaaauuacucaaugguuagaaacaaaaggcguagaacgccuaaagagaauggcuauuuccggugaugacugcguaguaaaaccaauagaugauagauuugccaaugcauuacuagcguugaaugauaugggcaaaguaaggaaagacauaccacaguggcaaccuucuaaaggauggcacgacuggcaacaaguuccauucugcagucaucacuuccacgaacuaauuaugaaagacggacguaaauugguugugccuugucgaccgcaagacgaacuuauugggcgggcccgcauaucgcagggugcugguuggucuuuaagagaaacagcaugucuugguaaggcauacgcgcaaauguggucacuaauguauuuccacagacgcgauuugcgauuagcaucaaacgcaauaugcucugcagucccaguucacuggguaccaacuucaagaaccacuugguccauacaugcucaucaucaauggaugacaacugaagacaugcuaacaguauggaauagagucuggauugaagauaauccauggauggaagauaaaacaccugucaccacaugggaaaacguaccauacuuagguaaacgggaagaucaaugguguggaucacucauagguuuaaccucaagggcaaccugggcgcagaauauaccgacggcaauccaacagguucgaucuuuaauaggaaacgaggaauuuuuagauuacaugccuagcaugaaaagauucagaaaggaagaggaaucagaaggagcaauaugguaa

SEQ ID NO: 23440 - RNA, 9873 nt, Artificial Sequence
  derived and/or modified CDS sequence (opt6) from DENV-3__FJ810416__SS-prME
acuucacugugucuaaugaugauuuuaccggcagcuuuagcuuuccacuugacaucaagagauggagaaccgaggaugaucguugguaaaaaugaaagaggaaaaucguuacuauuuaaaaccgcaucaggcauaaacaugugcacacuaauugcgauggaccuuggcgaaaugugugacgauacaguuacguacaaauguccucacauuacugagguagaaccagaagacauagacuguuggugcaaccuuacaucaacuugggucacauacggcacauguaaucaagcuggggaacaucgaagggauaaacguucaguugcacuagcuccucauguagggaugggccuagacacuaggacccaaaccuggaugagcgcagaaggugcauggcgucaaguagaaaaaguugaaacaugggcacuaagacauccaggcuuuacuauucuagcucuauuucuagcacacuacaucgggaccagucuaacacaaaaagugguaaucuucauacuguuaauguugguuacgcccuccaugacuaugcggugcgucgguguugggaauagagauuuuguagaaggauuaucaggugcuaccuggguugacguaguauuagaacacggcgguugcgucacaacaauggccaaaaauaaacccacauuagacaucgaacuucagaaaacagaagcuacccaauuagccacgcuacggaaacuaugcauagaagggaaaauaaccaacaucacuacagauucaagaugcccgacacagggcgaggcaguucuuccagaagaacaggaucaaaauuauguuuguaaacauacuuauguggauagagguuggggaaacgggugcggacuuuuugguaaaggaagccuagugacgugcgcaaaauuccaauguuuagaacccauagaagguaaaguggugcaauaugagaaucuaaaauauacuguaauaauaacuguccauaccggcgaccaacaucaaguagguaacgaaacccaaggaguaacggcugagauuacgccacaagcgucuaccacugaagccauucuaccagaguacggaacauuaggauuggaaugcucaccucgaacuggcuuggauuucaaugaaaugauacuccuaaccaugaaaaauaaagcguggaugguucacagacagugguucuucgauuuaccuuuaccauggacuucaggcgcuacgacggagaccccuacuuggaaccggaaagaguuauuaguuacauuuaaaaaugcacacgccaagaaacaggaaguaguaguguuagggucgcaagaaggagcaaugcauacugcacuuaccggugcuacugaaauccaaaacagugguggcacaucaauuuuugcaggccauuuaaaaugucggcuaaaaauggacaaauuagaguuaaaaggcaugucuuacgccauguguacaaacacauuuguccucaagaaagagguauccgaaacgcagcacgguacaauacuaaucaaaguggaauauaaaggcgaggauguaccuugcaaaauacccuuuagcacggaagauggucaggguaaagcccacaacgguaggcucauaacagcgaacccuguaguuaccaagaaagaagaaccaguuaacauugaggcugagcccccauuuggagaaucgaauauaguuauaggaaucggggacaacgcauuaaaaaucaauugguauaagaaagggucgaguaucggaaaaauguuugaagcaaccgcaagaggugcuaggagaauggcgauacuaggagacaccgcaugggacuucggaucuguuggagguguacuaaauucgcuagguaaaauggugcaccaaauuuucggcucugcauauaccgcauuauucucuggaguaaguuggguuaugaaaauugggauaggcguacuacuaacauggaucggguugaauagcaaaaauacgucaaugaguuuuucaugcauagcaaucggaaucauaacucuauaucuuggagcuguuguucaagcagauaugggaugcgucauaaacuggaaagggaaagagcucaaauguggcucaggaauuuuugucaccaacgaaguccauacuuggacugaacaauacaaauuccaggcagauucgccgaaacgauuagcgacagcaaucgcuggggcaugggaaaauggaguauguggcauuagauccacaaccagaauggaaaaucuauuauggaaacaaaucgcuaacgagcuuaauuauauccugugggaaaacaauaucaaacuaacagucguaguaggugauauuauaggcguacuagaacaaggaaaacgaacauuaacuccacaaccgauggaguuaaaguauucauggaaaacauggggaaaagcuaaaaucguuacagccgagacacaaaacucgucauuuauaauagacggcccaaauacgcccgaaugucccucagcaaguagggcauggaauguuugggaagucgaggacuauggguucggcguguucacaaccaacauuugguuaaaacuaagagagguguauacccaacuaugcgaccauagacuaaugagcgcggcaguuaaagacgaacgugcuguacaugcagacauggguuacuggauagaaucacagaaaaauggaucauggaaguuggagaaagcgagucucauagaaguaaagacauguacuuggccaaagagccacacuuuauggucuaacgguguucuagagucagacaugaucaucccaaaaucgcuugccggcccuauuucccaacauaauuacagaccagguuaccauacacaaacugccggcccuuggcaucuaggaaaauuagaauuagacuuuaacuacugugagggaacaacuguggucauaacagaaaacugcggaacucgcgguccuaguuuacgaaccacuacgguaucaggaaaacuaauccacgagugguguuguagaucaugcacucuuccaccccuuagauauaugggagaagacggauguugguacggaauggagauuagaccuauaucagaaaaagaagagaacaugguaaaaagccuggucagugcagggucuggagaaguggauaauuucacgaugggaguccuuugcuuagcuauauuauucgaagaaguaaugagggguaaauucgguaagaagcacaugauugcugguguuuucuucaccuuuguauuacugcuuucaggucaaauuacauggagggauauggcucauacuuuaauuaugauuggaucuaacgcauccgaucguaugggaaugggcguaacuuaccucgcuuuaauagccaccuuuaaaauccaacccuuccuggcauugggguucuuucuaagaaaacuuacauccagggaaaauuugcuauuaggcguaggucuugccauggcuaccacccuacaacuaccagaagauauagaacaaauggcaaaugguauagcauuaggacuuauggcguugaagcugaucacacaauucgaaacauaccagcuauggacugcucugauuagucucaccuguucaaacaccauauuuaccuuaacaguagccuggagaacggcaacauuaauuuuagcuggcguaucucuauuaccaguuugucaaucuaguaguaugcguaaaaccgauuggcuaccuaugaccguagcugccaugggugucccuccacuuccacuauuuauauuuagccuaaaagauacacucaaacggcguucuuggccacuaaaugaaggagucauggcgguagggcuagucucgauauuggcuucgucacuacuacgcaacgacguaccaauggcuggacccuuaguugcaggcggacuauuaauugcaugcuacguuauuacaggaacaagcgcugacuugacaguggagaaagccgcggacguuacaugggaagaagaagccgaacagacuggagugucucauaaccuaaugauuaccguggacgaugauggcacaaugagaaucaaggacgacgaaacagaaaauauauuaacaguucuucuaaagacagcacuuuugauugucagcgguauuuuuccuuauagcauaccggcuacguuacugguauggcacacguggcaaaaacaaacucaacggaguggaguuuugugggaugucccuucaccaccggaaacucaaaaagcggaacuugaagaagggguauaucggauaaagcaacaaggcaucuucggaaaaacacaaguugggguagguguucaaaaagaagggguauuccauacuauguggcacguaacucggggugcaguucuaacuuacaaugggaagcgacuagaacccaauugggccucuguuaagaaagauuugaucaguuacggcgguggcuggcgucuaagcgcacaauggcaaaaaggugaagagguccaagugauagcuguggaaccaggcaaaaacccgaaaaauuuucaaacuaugcccggcacauuucagacuaccacaggugaaaucggagccauagccuuggacuucaagccagguacuuccggaucgccaaucauaaauagagagggaaaaguaguaggauuauacggaaacggggucguaacgaaaaacggcgguuacguaucggguaucgcacaaacaaaugcagagcccgauggacccacaccugaacucgaagaagagauguuuaagaaaagaaaucuaacuauuauggacuuacaucccgggucaggaaaaacaagaaaauaucuaccagcuauagugagagaagccauuaaaagaaggcugagaacuuuaauccuugcacccaccagagucguagcggcugaaauggaagaagcguuaaagggacuaccgauuagguaccaaacaacugcuacuaaaucagagcacacgggaagagaaauaguagacuuaaugugccaugcaacauuuacaaugagauuacuaucgccuguacgaguaccuaauuauaacuuaauuauuauggaugaagcacacuuuacggauccagcuucgauagcagccagagguuacauaagcacuagagugggaaugggagaggcugcagcuauuuuuaugacagccacuccaccaggaacugcagacgcguuuccccaaagcaaugccccuauacaagacgaggaaagagacauaccagaacgaucuuggaauagcggcaaugaguggaucacagacuuugcugggaaaacgguaugguucguacccaguaucaaagcaggaaacgacauugcaaauugcuugcgaaagaacggcaagaaagugauccagcuauccagaaaaacuuucgacaccgaguaucagaaaacaaaacucaaugauugggauuucguaguuacaacugauauuucagagaugggugccaacuuuaaagcugauagaguuauugauccacguaggugcuuaaagccaguuauucuuacggaugggccagagagaguaauucuagccggaccaaugccaguaaccgcugcaucugcagcacaaaggcgaggacgcguagggagaaacccccaaaaagagaaugaucaauauauuuuuacuggucaaccauuaaacaacgaugaagaucacgcacauuggacagaagcgaaaaugcucuuagauaauauaaauaccccagaaggaauaauuccagcauuauuugaaccugaacgagagaaaucagcugcaauugauggcgaauacagauugaaaggugaaucaagaaaaacguuugucgaguuaaugagacguggagauuuacccguauggcuagcacauaaaguugcuagcgaaggaaucaaauauacagacaggaaaugguguuuugaugggcaaaggaauaaccagauauuagaagaaaacauggauguagaaauuuggacuaaagagggagagaagaagaaauugagaccgcgaugguuagacgcaagaacauauucugauccauuagcauuaaaagaauuuaaagacuucgcggcuggacgcaagucuauagcacucgaucuuaugacagaaauaggaaggguaccaucccauuuagcccaucguacaagaaacgcacuggacaauuuagucauguuacauacaucagaacauggagggaaggcuuauagacacgcgguugaggaacuacccgaaacuauggaaacgcuacuacuacuagguuuaaugauccucuuaacuggaggagccaugcuguucuuaauaagugguaagggaaucggaaaaacguccauugguuuaaucuguguaauagcgaguagugguauguuauggauggcugaaauaccuuugcaauggauagcuagugcaauuguacuugaguucuuuaugaugguucuguuaauucccgaaccagaaaagcaaagaacaccucaggacaaucaguuagcuuacguagugauaggaauauuaacuuuggcagcaauaauugcagcuaacgaaaugggacucuuagaaacuacgaaaagggaucuugguaugaguaaagaaccuggugugguauccccaaccuccuaccuagauguggauuuacauccagcaucggcauggacauuauaugcaguagcaacaaccguaauaaccccuaugcuuaggcauacuaucgagaauaguacagcaaacgucagucuugcugcaauagcaaaccaagcuguaguauugaugggguuagacaaaggguggccaauuucaaaaauggacuugggagucccccuccuagcacuaggaugcuauagccaaguuaacccauugacucuaacugcugcgguucuccuuuugauaacacacuacgcuauaauagggccaggauuacaggccaaagcaacgagagaggcucaaaagagaacagcagccggaauaaugaaaaauccaacaguggacggaauaaugacuauugaucuugauccaguuauauacgauaguaaauuugaaaaacaacuuggucagguaaugcuucuaguccuaugugcuguacaacuacuacugaugagaaccaguugggcgcugugcgaggcauuaacgcucgcuacuggacccauaacaacccuaugggaaggaaguccggguaaauucuggaauaccacaauagcugugucuauggccaauauauucagaggguccuaucuugcaggggccggucucgccuuuucaauaaugaaauccgucgggaccgguaaacgagguacaggaagucaaggggaaacccuaggcgagaaauggaagaagaaacuuaaucaacuuucacgcaaagaauuugaucuuuacaagaaaaguggcauuacugagguagauagaacagaggcaaaagagggguugaagcguggagagauuacacaucacgccgucucaagggggucugcaaaauuacaaugguuuguagaacgcaacaugguaauuccggaaggaagagucauugaucuaggaugcggccgaggaggguggucuuacuauugcgcaggauugaaaaaggugaccgaggugaggggguacacaaaaggaggaccgggccacgaagaaccaguaccuauguccacauauggcuggaauauugugaaacuuaugucaggaaaggacguauuuuaucuuccacccgagaaaugugauacgcuacuuugcgacauaggagaaucaaguccgagccccaccguagaagaaagucggacaauuagagugcuuaagaugguggagccuuggcucaaaaacaaucaauucugcauuaaaguauuaaauccauacaugccaacgguaguagagcacuuagaaaggcugcaaagaaagcauggcggaaugcuaguuagaaauccacuaucucgaaauucaacgcacgaaauguacuggauaucaaauggcacugggaauauaguggcaagcguuaauaugguaucacguuuguuguuaaacagauuuacaaugacacacagaaggccuacaauagaaaaagacguugacuuaggagcaggcacccgccauguaaacgcggaaccagaaacucccaauauggauguaauaggagaacgaauaaagagaaucaaagaagaacacaauagcacuuggcauuacgaugacgagaauccuuauaaaacgugggccuaucacgggucguacgaaguaaaagcuacaggcucugccagcucaaugauaaacggugugguaaaacuacuuacuaagccaugggacguaguaccaauggugacucaaauggcaaugacugacacgacucccuucggucagcagagaguauuuaaagaaaaaguggauacuagaacgcccagaucgaugcccgggacuagaagaguaauggguauaaccgcagaaugguuauggaggacauuaggacguaacaagaaaccuaggcucuguacgagagaagaauuuaccaagaaaguaagaacaaaugcagccaugggagcaguauuuacagaagagaaccaaugggauucagcuaaggccgcuguagaagaugaagauuucuggaaauuaguagauagggaaagagaacuacacaaacuuggaaaauguggcucguguguguauaauaugauggguaaaagggagaagaaauuaggugaauuugguaaagcaaaagggagccgcgccauuugguacauguggcucggagcacgauacuuggaguucgaagcacuaggcuuuuugaacgaggaucauugguuuucaagagagaauaguuauucgggugucgaaggugaagguuugcauaaacuaggcuauauacuacgagauauaagcaaaauuccggguggggcaauguacgccgaugauacggcuggaugggacacgagaauaacagaggaugauuuacacaacgaagagaaaauuacacagcaaauggauccagaacaccgucagcuugcuaaugcuaucuucaaauuaacuuaccagaauaaaguaguaaaaguacaaagaccgacgccaacggguacgguaauggacauaaucuccaggaaagaucagagagggucggggcaaguugggacauauggauugaacaccuucacaaacauggaggcucagcucauccgacaaauggaaggagaggggguacuaagcaaagcggaccuagagaacccccgcuuaccagagaagaaaaucacgcaguggcuagaaacaaaaggaguagaacgacuuaaaagaauggccaucaguggcgacgauuguguaguuaaacccauagaugaccgauuugcuaacgcccuacuagcuuugaacgauaugggaaaagugcgaaaagacauuccucaauggcaaccaucaaaaggguggcaugauuggcaacaagugccuuucuguagucaccacuuucaugaacugaucaugaaagacggucgaaagcuaguugucccauguaggccccaggaugaacucaucgggcgagcaagaaucucccaaggcgcaggcuggucacuucgagaaacagcuugucuaggaaaagccuacgcacaaauguggagcuuaauguacuuccaccggagagaccuaagacucgccaguaacgccauauguucggccguaccuguucacugggucccgacaagcagaacuacauggagcauucacgcccaccaucaauggaugacuaccgaggauaugcucacggucuggaauaggguuuggaucgaagauaauccauggauggaggacaaaaccccuauaacuacaugggaaaacgucccguauuuagggaaacgagaggaucaauggugugguagucuaauaggauuaacaucaagggcgacgugggcccaaaauauaccaacugccauucaacaaguuagaagucugauuggaaaugaggaguuuuuagauuacaugccauccaugaaaagguuucguaaggaagaagaaucagaaggagccauaugguaa

SEQ ID NO: 23441 - RNA, 9873 nt, Artificial Sequence
  derived and/or modified CDS sequence (opt6) from DENV-3__GQ252678__SS-prME
accucacugugucugaugaugauauuaccagcagcauuagcauuucauuugacgucccgagauggugaaccuaggaugaucguugguaaaaaugaaaggggaaagagcuuacuauucaaaaccgcaucugguauaaauauguguacacuaauugcaauggacuuaggugaaaugugcgacgauacgguaacuuauaaauguccucauauaacugaaguugaaccagaagauauagauugcugguguaaucuaacaagcacuuggguuacauauggaaccuguaaucaagcuggagaacaucggcgagauaaaagaucuguagcguuggccccacauguaggaaugggauuagauacaaggacacaaaccuggaugucugcggaaggagccuggcgucaaguugaaaaaguggagacuugggcacuuaggcaccccgguuucacuauccuggcgcucuuucuggcgcauuauaucgguacgucacuuacucaaaaaguuguaauauuuauauuauuaaugcuagugacuccaaguaugacuaugagaugugucggagucgguaacagagacuucguagaaggacugucuggggcuacauggguagaugucgugcuagaacauggagguugcguaaccacuauggccaaaaauaaaccaacccuugacauagaacuacagaaaaccgaggcaacucaacuugcaacauuacgaaaacucuguauugaaggaaaaauaacgaacauaacaacagauuccagaugcccgacacagggagaggcaguauuaccagaagaacaagaccagaacuacgucugcaaacacacuuauguggauagggguuggggaaaugguugcggacuguucggaaaagggagccuugugacaugugcuaaauuucagugucucgaaccaauagaaggaaaaguuguacaauacgagaacuugaaauauaccguuauaaucacagugcauacuggggaucaacaucagguaggaaaugaaacccaagguguaacggcggagauaacaccucaagcaucaacaacggaggcaauauuaccagaguacgggacgcuaggacuugaguguagcccuagaacgggucuagauuucaaugagaugauauuauuaacuaugaaaaauaaagcauggaugguccauagacaaugguucuuugaccuaccacuuccuuggacgucaggcgcaacuacagagacccccacuuggaauaggaaagaauuacugguaacuuuuaaaaacgcacaugcuaagaaacaagaaguugucguauuaggaucccaggaaggcgccaugcacaccgcguugacuggagcuacggaaauacaaaacuccggaggcaccucaaucuucgccggucauuugaaaugccgccuuaaaauggacaaacuagaauuaaaagggaugucauaugcuaugugcacuaacacauucguccuuaagaaagaaguguccgaaacccaacacgguacuauauuaauuaaaguagaguauaaaggagaagauguuccauguaaaauuccauuuucaacugaagacggucaaggcaaagcccauaauggccgcuugauuacagcgaauccaguggucacuaaaaaggaagaaccaguaaauauugaggcagaaccacccuuuggcgaauccaacauuguaauugguaucggugacaaugcuuuaaaaauaaacugguauaaaaaggguaguucuauagguaaaauguuugaggcuaccgcacguggcgcucguagaauggcaauauuaggggauaccgcuugggauuucgguaguguugggggaguuuuaaauagcuuggggaagaugguacaucaaauauuugguucggcguacacggcuuuauucucagggguaagcuggguuaugaaaauaggaauugggguacuacuuacuuggauaggacucaauucuaaaaauaccagcauguccuuuagcuguauagcuauaggaauaauuacguuauacuuaggcgcaguagugcaggcagacaugggaugugugauuaauuggaaagggaaagaacucaaaugcggauccgguauauuuguuacaaacgaaguacauacauggacugaacaauacaaguuucaagcugauucaccaaaacgauuagcuacagcuauagcaggcgcgugggaaaacgggguaugugggauccgauccaccacacgaauggaaaacuuauuauggaaacaaauagcuaaugaguugaacuauauacuuugggaaaauaauauaaaauuaacuguagucguaggagacauuaucggaguccuugagcaaggcaaaagaacgcugacuccacaaccuauggaacuuaaauauucauggaaaacauggggcaaggcaaaaauaguuacagcagaaacacagaacagcaguuuuauaauagauggaccaaacacuccagaguguccaucagccagucgagcauggaauguaugggaagucgaagacuacggauuuggugucuucacuacuaauauauggcucaaauuaagagaaguuuacacacagcucugcgaucaucgcuuaaugagcgccgcaguaaaagaugaacgagccguucacgcggauaugggcuacuggauugaaagucagaaaaacggguccuggaaacucgaaaaggcauccuuaauagaaguaaagacguguaccuggcccaaaucacauacacuauggucaaacgguguauuagagucagacaugauuauaccaaaaucacuagccggcccgauaucccaacauaacuaccgaccaggauaccauacccaaacugcaggaccuuggcacuugggcaaacucgaacuagauuuuaacuacugugagggaacaacaguagucauaacagaaaacugcggaaccagaggaccuucgcuccgaacuacaacaguaagcggaaaacuaauacaugaauggugcuguagaucguguacccucccucccuuaagauauaugggagaagacggauguugguacggcauggaaauucguccaauuucagaaaaggaagaaaauaugguaaagucacuuguuucggcaggcaguggugagguggauaauuuuacgaugggcguucugugcuuagccauacuauuugaagaaguaaugcguggcaaauuuggcaagaaacauaugauugcaggcguauucuucacauuuguacuucuacucagcggccagauuacauggcgcgauauggcucacacauugauuaugaucggaagcaaugcaucggaucguaugggaaugggaguaacauaucuggcuuuaauagcgacuuucaaaauacaaccuuucuuggcacuaggguucuuucuaagaaaacucacaucacgagaaaaucuucuacuaggagucggucuagcgauggcaaccacauugcagcuuccggaagauauugaacagauggcaaacgguauagcccuaggguuaauggccuuaaaauugauaacucaauucgagacguaucaguuguggacagcacugauaucacuaacuuguuccaauacgauauuuacauugacuguagcauggagaacagccacuuuaauuuuggccggaguaucauuacuaccugugugccaaaguucuucaaugcgcaaaacugacugguuaccaaugacuguugcugcgauggguguaccaccauugcccuuguucaucuuuucacuaaaagauacuuuaaaacgucguucauggccauuaaaugaaggaguuauggcggugggcuugguaaguauccuagcuaguucuuugcuacguaaugauguuccaauggccgggccccuuguagcaggaggauuauuaauagcauguuauguaauaaccggcaccucugcagauuugaccgucgaaaaagcugccgauguaacaugggaagaggaagcagaacaaacaggagucagucacaaucucaugauuaccguggaugaugaugggacgaugcgaaucaaagacgaugaaacagaaaauauuuugaccguccucuugaagacggcacugcucauuguaucagggauuuuuccuuauucaauccccgcaaccuuacugguauggcauacauggcaaaaacaaacccaaagaagcgguguucuuugggaugucccaucucccccagaaacucagaaagcagaguuggaggaagguguguauagaaucaaacaacagggaauauucgguaaaacgcaggucggaguaggcguccagaaagaaggagucuuccacacgauguggcauguuacacgaggagcuguauuaacgcacaauggaaaacggcucgagccuaauugggcaucgguaaagaaagacuuaauaaguuacggaggaggcuggcgucuuucagcccaguggcagaaaggagaggaaguucagguuauagcaguugaaccagggaagaaucccaagaacuuucaaaccaugccuggaacguuccaaacaacaacuggagaaauaggugcaauagccuuagacuucaaaccuggaacuagcggcaguccaauaauaaaccgugaaggcaaagucguaggcuuauauggaaauggagugguuacaaagaauggaggguauguuucagguauagcccaaacgaaugcugaacccgacggacccacgccugaacuggaagaagaaauguuuaagaaaagaaaccuuaccaucauggauuuacacccagguucaggcaaaacgaggaaauaccuuccggcuauaguucgagaggcgaucaaaagaagacuccgaacauuaauacuggcuccgacaagaguuguagcagcggaaauggaggaggcauuaaagggacucccgauuagauaucaaacuacagcaacaaagucugagcacacuggacgagagauuguagauuuaaugugccaugcgacauucacuaugcgacuuuuaaguccggugagagugccuaauuauaauuuaauuauaauggaugaggcucacuucacagauccagccucaauagcagcucggggcuauauuucaacgcgcgucggaaugggagaagcagccgcuauauuuaugaccgcgacaccuccaggaacugcagaugcauuuccacagucaaaugcaccaauucaagaugaagaaagagacauacccgagcgauccuggaauagugguaacgaauggauaacagacuuugcagguaaaacuguuugguucguaccaucaaucaaagcagggaacgauauagccaauugccuaaggaaaaacggcaagaaaguuauacaacuaucuagaaagacauucgauacggaauaccagaaaacuaaacuuaaugacugggacuuuguaguuacuaccgacauuucagaaaugggugcgaacuucaaagcggacagagugauugaccccaggcguugcuuaaagccaguuauucuaacggacgguccugaaaggguaauucuagcuggaccuaugccaguuacagcugcaucagccgcacaaagaaggggacgcguaggaagaaacccgcaaaaagaaaaugaccaauacaucuucacgggucagcccuuaaauaaugaugaagaucacgcucacuggacugaggccaaaaugcuauuggacaauauuaauacaccagaaggcauaauccccgcacuuuuugaaccugagcgugagaaaucagcugccauugacggcgaguauaggcuaaaaggagaaagccgcaaaaccuucguagaauuaaugcgaagaggagaucuuccggucugguuggcacauaaaguugcaagcgagggcauaaaauacaccgaccgaaaaugguguuucgacggccaacgaaauaaccaaauccuagaagaaaauauggauguggaaauuuggacaaaagaaggcgagaaaaagaaauuaagaccaagaugguuagacgcgcggacguauucugauccucuugcucuuaaagaauuuaaagauuuugccgcgggucgcaaaucgauagcuuuggauuuaguaaccgaaauuggacguguucccacacaucucgcucauaggacaagaaacgcuuuggacaacuuaguaauguugcauacaucagaacaugggggcaaagcauauagacacgcuguggaggaacuaccugaaaccauggaaacauugcuucuacuuggucucaugauuuugcuaacuggcggagccauguuauuccuaaucucaggaaaaggaauaggaaaaacaaguaucggacuuauauguguaauugcgaguuccgguaugcuguggauggcagaaauuccucuacaauggauugcuucagcaauuguucucgaguucuuuaugauggucuuacuuauacccgaaccggaaaaacaacgcacgccacaggauaaucagcuagccuauguuguuauuggaauauuaacucuugcggcaauuauagcagcuaaugaaaugggucuacuagaaacuacaaaaagggacuuaggaaugaguaaagaacccggugugguaagcccaacaucguacuuggacgucgacuuacauccagcgagcgccuggacguuguaugcuguagcgacaacaguaauuacuccaauguuacgacauaccaucgaaaacagcacugcaaauguuucccuagcugcuauugcaaaccaagcuguaguacuuauggguuuagauaaaggauggccaaucucaaagauggaucuuggugugccucuauuagcucuaggauguuauagucaggugaacccauuaacacuuacugcagcuguacuuuuauuaaucacacacuaugcuauaauuggaccgggauugcaagcgaaagcgacuagagaagcccagaaaagaacagcggcagggauuaugaagaauccuacaguugacggcauaaugacgaucgacuuagacccaguuauauaugacucuaaauucgagaaacaauuaggacaaguuaugcuccuaguccugugugcaguacaauuauuauuaaugcgaacaaguugggccuuaugcgaagcucucacacuugcaaccggcccaauaacaacccuuugggaaggaucaccagguaaauuuuggaacacaacgauugcugugagcauggcaaacaucuucaggggaaguuacuuggcaggggcggguuuagcuuuuucaauaaugaaaucggucggaacgggcaaaagggggaccgguucgcaaggcgaaacacuaggugagaaauggaagaagaaauugaaccaacuaucgagaaaagaauuugaucucuacaagaaaucaggaauaacagagguagaccggacugaagcaaaggaaggacugaaaagaggagagauaacacaucaugcgguuucucgaggaucagcaaaacuacaaugguuugucgagagaaacauggugauacccgaaggacgaguuauagaccuugguugcggucguggaggauggucuuacuauugcgcaggucuuaaaaagguaaccgaaguuagggguuauacaaagggaggaccaggucacgaagaacccgugcccaugaguacauauggcuggaacauaguaaaguugaugagugguaaagauguauucuaucuuccucccgaaaaaugugacacauuacuuugugauauaggagaaucaucuccuagcccuacaguugaagaaagccgaaccauaagaguucucaaaaugguagaaccuuggcugaaaaauaaucaauuuuguaucaaagugcuaaauccauauaugccuacaguuaucgaacaucuagagagacugcaaagaaaacauggggguauguuaguacgaaauccacuuucaagaaauucuacccacgaaauguacuggauaucaaauggaacaggcaacaucgucgcuagcguaaauaugguaucacgcuuacuacuuaauagauucacuaugacacacagaagaccuacaauugaaaaagacguagauuuaggcgccgguacgcgacaugucaaugccgagccagagaccccgaauauggauguaauuggugaaagaauuaagaggauuaaagaggagcacaauucuacguggcauuaugaugacgaaaauccuuauaagacaugggcguaccacggaucauaugagguuaaagcuacagguucggcaucuaguaugauuaauggcgucgugaaacuucuuaccaaaccgugggacguaguccccauggugacccaaauggcaaugacugauaccacgccguuugggcaacagagaguguucaaggaaaaagucgacacccgaacuccgagaucaaugccaggcacuagaagggucaugggaauaacagcagagugguuauggcggacacuagguagaaauaagaaaccgagauuauguacuagggaagaauuuacaaagaaagugaggacaaacgcagccaugggagcaguguucacggaggaaaaccaaugggauagcgcuaaagcagcaguagaagaugaagauuuuuggaaauuaguggaucgagaacgugaauuacauaaguuaggcaaaugcggaaguugcguauacaacaugauggggaaaagagagaagaaacuuggugaauuugguaaagcaaaagguagccgugccaucugguauaugugguuaggagcucgauauuuagaguuugaagcacuaggauuccuaaaugaggaucauugguucucgagagaaaauucauauucugguguugagggagaaggacuacacaaacucggauacauauuaagagacauauccaaaauaccaggcggcgcuauguaugccgacgauacugccgggugggauacuaggauaacagaagaugauuuacauaaugaggagaaaaucacccagcagauggauccagaacaccgccagcuugcaaacgcaaucuucaaacugacuuaucaaaacaaaguaguuaaaguucaaagaccaacaccaacaggaacggugauggauauaauaucaagaaaagaucagcgagggagcgggcaaguagggacguaugggcugaacacuuuuaccaauauggaagcucaacucauacgacaaauggaaggagaagggguacuaaguaaagccgaucucgaaaacccgcacuuaccggagaagaaaauuacgcaaugguuagaaacaaagggaguggagcgacuuaaaagaauggcaauaaguggugaugacugcguggucaaaccuaucgacgauagauuugcuaaugcgcugcuugcacuaaacgauauggggaaagugaggaaggacauaccucaauggcaaccgucaaaaggauggcaugacuggcagcaagucccuuuuuguagucaucauuuucaugaauuaauaaugaaagacggucguaaacugguaguuccaugcagaccccaagaugaguugauugguagggcuaggaucucucaaggagcaggauggucccuaagagaaacugcuugucucggaaaggcauaugcucaaauguggucucuaauguacuuucauagacgugacuuacgauuggcaaguaaugcaauauguuccgcugugccgguacauuggguaccuacaucccguacgacauggaguauccaugcucaucaucaauggaugacaacagaggauaugcuaaccguguggaacaggguauggauagaagauaaccccuggauggaagacaaaacaccuguaacaacaugggagaacguuccuuaccugggaaaacgcgaagaucaaugguguggcucauuaaucggacuaacauccagagcgacgugggcacagaauauaucuacagcaauucaacaaguccgcaguuuaauaggcaaugaggaauuuuuggauuauaugccaucuaugaagagauuuaggaaagaagaagagagugaaggcgccauuugguga

SEQ ID NO: 23442 - RNA, 9873 nt, Artificial Sequence
  derived and/or modified CDS sequence (opt6) from DENV-3__FJ850098__SS-prME
acuagcuuaugccuuaugaugauacuuccugcugcucuugcauuucaccuuacaagucgagacggcgaaccaaggaugauaguaggcaaaaaugaaagagguaaaucgcucuuauucaaaacagcaucugguauuaauaugugcacauuaauagcaauggauuuaggggaaaugugcgaugacaccguuacguauaaauguccacacauaacagaagucgaaccugaagacauagacugcuggugcaaucuaacaucaacauggguaacguaugguacguguaaccaagcgggcgagcacagacgugauaaacgaucaguagcacuggcaccucauguugguauggguuuagacacacggacucaaacauggaugucugcagagggcgcuuggcgucaagucgagaaaguagaaaccugggcuuugagacauccgggauuuacuauacuagcauuauuccuagcacacuacauagguacaucacucacucaaaaaguaguuaucuuuauauuguuaaugcuagugacacccucaaugacgaugagauguguugguguagggaauagggauuucgucgagggucuaucuggagcuacauggguggacgucguauuggagcauggaggaugcgugacuaccauggccaaaaauaaaccuacucuggauauagaauuacagaaaacggaagcaacacaacuggcaacauuaagaaaauuaugcauagaagguaaaaucacaaacauaaccacugauuccagaugcccaacacaaggggaggcuguucuuccagaagaacaagaucaaaauuacguauguaaacauacauacguugauagaggcuggggaaaugguugcggucuguucggaaaaggcucucuaguaacaugugcaaaauuucaaugcuuagagcccauugaagggaaagucguucaauaugaaaaucuuaaauacaccguaauaauaacaguacacacuggcgaucaacaccaaguaggcaaugagacccaaggugugaccgcagagauaacaccacaagcauccaccacagaagcaauacuaccugaguaugguacauuaggauuagaauguucaccaagaacaggauuggauuuuaaugaaaugauucuucugacgaugaaaaauaaagccuggauggugcaucgucaaugguucuuugaccuaccccuaccauggaccucaggagccacuacugaaacacccacguggaacaggaaagaacuacuuguuaccuucaaaaaugcacacgccaagaaacaagaagucguuguacuagguagucaagaaggcgcaaugcauacagcccuuaccggagcuacugaaauacaaaacucuggggguaccaguauauuugcaggucauuuaaaaugucgcuugaaaauggacaaguuagagcuuaaagguaugaguuacgccauguguacgaauacguuugugcuaaagaaagaaguaucagaaacccaacacgggaccauuuuaauuaaaguagaauauaaaggagaggauguaccgugcaaaauucccuuuucaacugaagauggucaagguaaggcacauaauggccgcuuaauaacagcuaacccuguagucacgaaaaaggaagacccagucaacauagaagcagaaccaccuuuuggagaaaguaauaucgucauuggaauuggagauaacgcacuaaaaauuaacugguacaagaaagguuccaguauaggcaaaauguucgaggccacagcacguggcgcucguagaauggcaauacugggugauacagcaugggauuuugggucuguaggaggaguacuaaacucacuugggaaaaugguccaucaaauauuugggagcgcguacaccgcacuauuuucagguguauccuggguuaugaagauuggaauaggcguauuauugacguggauaggauuaaacaguaaaaauacgagcaugucauucaguuguaucgcuauaggaauaauaacauuauaucuaggagcugucguacaagcugacaugggauguguuaucaauuggaaaggcaaagaauuaaagugcggauccggaauauuuguaacaaaugagguucauacauggacagaacaauauaaauuccaagccgacucaccaaaacgacuugcuacugccauagcuggagcaugggaaaauggggucuguggcauccggagcaccacaaggauggagaacuuacucuggaaacaaauagcaaacgagcuaaauuacauuuuaugggaaaauaauauuaaacuaaccgucguaguuggugaugugauagguguucuugaacaagggaaacgaacacuuacucuccaaccaauggaguuaaaguacucuuggaaaacuuggggaaaggcaaaaaucguuacugccgaaacucaaaacucuuccuuuaucaucgacggaccgaacaccccugaauguccuagugcaucuagggcuuggaauguuugggaagucgaagauuauggcuucgguguuuuuacuacuaacauuuggcuuaaacuuagagaaguuuauacgcaauuaugugaucacaggcuaaugucggccgcaguaaaagacgaacgagcgguucaugccgacauggguuauuggauugaaucacagaagaacgguucauggaaacuagaaaaggcuucauuaauagaaguaaagacaugcacguggccuaagucccauacuuuauggucuaauggcguacucgaaagugacaugauuauaccaaaaucccuugcuggaccaauaucacaacauaacuaucgacccgguuaucacacccagacugcgggcccauggcaccuagggaaacuugaacuagauuuuaacuacugugagggcacaacgguaguaaucacagaaaauugugggacaagggggccaucacuacgaacaaccacuguaucaggaaaacugauucaugaaugguguugucguucuuguacauuacccccucuuagguacaugggcgaggauggauguugguacgguauggaaaucagacccauaucggaaaaagaagaaaauauggucaagucacuugucucugcugguucaggagaaguagacaauuucacuaugggaguucugugccucgcaauauuguucgaagaaguaaugcgagguaaauuugggaagaaacacaugauagcggguguguucuuuacuuuugucuuguuacucagugggcaaauaaccuggcgagauauggcucauacucuuauuaugauagguucgaacgcuucagacagaaugggcaugggaguaacauaccuagcgcugauagcuacauucaaaauccaaccauuuuuagcacucggauucuuucuaagaaaauuaacuagcagggagaaucugcuacuagguguaggcuuagcgauggcuaccacucuccaauugccugaggacauagaacagauggcuaacgggaucgcauuaggacuaauggccuuaaaauugauaacacaguucgaaacuuaucaacucuggacggcauuaauuagucugacauguucaaacaccauauucacgcugacuguagccuggcguacugcaacacuuauacuggcagggguuucccuauuaccuguaugucaguccucuucaaugcguaaaacggauuggcuaccuaugacaguggcagcaaugggagucccaccacuaccauuauuuauauucucucuaaaagacacccucaaaagaagaagcuggccacuaaacgagggcguaauggcuguaggguuaguauccauuuuagcaagcagccuccuuaggaaugacguuccaauggcugguccccuaguggcaggagggcuauuaauagcuuguuauguaauaaccgguacaagugcggaucucacaguagaaaaagcagcagaugucaccugggaagaggaagcagagcagacugguguaucccacaauuuaaugaucaccgucgaugaugauggcacgaugagaauaaaagaugacgaaacugagaauauacucacugucuuacucaaaacugcucuguuaauaguauccggcauauuucccuauaguauccccgcaacgcuauuaguguggcauacauggcaaaaacaaacgcaacguagcgguguucuaugggacguaccaaguccuccagaaacucagaaagcagaacucgaagaagggguuuauagaauaaaacaacaggggaucuucggaaagacucaaguuggaguagguguacaaaaagaagggguguuucacacaauguggcauguaaccagaggggcuguacugacauacaauggcaaacgauuagaaccaaauugggcaucagucaagaaagauuuaauuuccuauggaggaggauggaggcuaagcgcacaguggcagaaaggugaggaaguucaagucaucgcaguagagccagguaaaaacccuaaaaauuuucagacaaugcccggaacauuucaaacuacaacuggugaaauaggagcuaucgcgcuagacuuuaaaccuggaaccucaggcuccccuauaauuaacagagaaggaaaggugguuggccuauacgguaauggaguagucaccaaaaacgggggauauguuagcgguaucgcacaaaccaaugcagaacccgaugguccgacucccgaguuggaagaagagauguuuaagaagcgaaauuuaacaauaauggaucuacacccuggaagcgguaaaacacguaaauaucuuccugcuauuguccgcgaggccaucaaaaggagacuaaggacucuaauuuuagccccaacuagaguaguggccgccgaaauggaagaagcguugaaaggucuaccgauucgguaucagacaacagcuaccaagagcgaacauacaggcagggaaauagucgacuuaaugugucacgccacauuuacuaugagacuacuaucuccaguaagaguaccuaauuacaaucuaauuauaauggacgaagcacauuuuacugauccagcuuccauagcagccagaggauacauaucuacuaggguuggaaugggugaagcagcagcgauuuuuaugacagccaccccaccagggacugcagaugcauuuccacaaaguaaugcaccgauccaagacgaagaaagagacauaccagagcgcucauggaacucggggaacgaauggaucaccgauuuugcaggcaaaaccguuugguuugucccauccaucaaagcaggaaacgacauugcaaacugcuugcgcaaaaacgggaagaaaguaauacaacucaguagaaaaacuuucgacacugaguaccagaaaacaaaacuuaaugauugggauuucguaguaacuacugauaucucagaaaugggcgcaaauuucaaagcagauagaguaauagauccgagacgauguuuaaaaccugugauacuaacugaugggccugagcgcgugauauuagcagggccuaugccaguaacggccgcauccgcugcccaacgacgaggacguguaggaagaaacccccaaaaagaaaacgaucaguacauuuuuacgggacagccacuaaacaacgaugaagaccacgcacauuggaccgaagcaaagaugcugcuggauaacauuaauaccccagaaggaauuauucccgcacuguuugaaccagaacgagagaaauccgcggcgauugacggagaguaucgcuuaaagggcgaaucucgaaaaaccuucguugaguuaaugcgacguggggaccuucccguuuggcuagcacauaagguagcuagugaaggaauaaaguauacagaucguaaaugguguuuugauggucagcgcaacaaccaaauucucgaagaaaauauggacgucgaaaucuggacuaaagaaggagagaaaaagaaacuucgaccaagaugguuggaugcaagaacuuauucggacccauuagcacuuaaagaauuuaaagauuucgccgcaggcaggaaaucgauugcgcuggauuugguaacggaaauagggagaguuccuagccauuuagcacauagaacgagaaaugcucuagauaauuugguuaugcuacauacaagugaacacggcgguaaagcguaccgucaugcaguagaggaacugccugaaacuauggaaacucuauuacuacuuggacuaaugauucugcucaccggcggcgcuaugcuuuuccugauaucaggaaaagguauuggaaaaacaagcauuggacuaauauguguuauugcgucuucgggaaugcuauggauggcagagauuccucuacaauggauagcuuccgccauuguucuggaauuuuucaugaugguuuuguugauaccugagccagaaaaacaacgcacaccacaggauaaccaacucgcauauguagugauugguauccuuaccuuggccgcuaucauugcggccaacgaaaugggacuuuuagagacaacuaagagagacuuggguauguccaaggaaccaggcguuguuuccccgacaaguuaccuagauguagaucuccauccagcgagugcauggacacuauacgcgguggcaacuacgguuauuacucccauguuaagacacaccauagagaauaguacagcgaauguaucauuagccgcaauagcuaaucaggcaguuguauuaaugggucucgauaagggcuggccaaucucaaaaauggaucuuggagugccacuucuugcacuaggaugcuacagucaggucaauccucugacacucacugcagccguacuuuugcuuauuacgcacuacgcaauuauugguccagguuugcaagcuaaagcaacacgcgaagcacagaaaagaacagcugcaggaauaaugaaaaauccuacuguagauggcauuaugacaauugaccuugacccagucauauacgacucuaaguucgaaaagcaauuaggacaaguuauguuacugguccuuugugcgguacagcuauuguuaaugcggacaucgugggcacuuugcgaagcacuuacucucgccacaggaccaauaaccacucuuugggaagggucgccaggaaaauuuuggaacacaacuauugccguaucuauggcaaauauuuuuagagggucauaccuggcuggugcgggucuagcguucaguauaaugaaaucuguaggaacaggaaagcguggcacagguagccaaggagaaacacucggcgaaaaguggaagaagaaacugaaucaauugagcagaaaagaauuugaucuauauaagaaaucgggaauuacagagguagauaggacggaagcaaaagaaggacuaaaaagaggggaaauuacacaccacgcuguaagucgggguagugcaaaacuacaaugguucgucgaaaggaacauggucauaccagaaggaaggguaauagaucuagguugcgggcgaggagguuggagcuacuauugugcuggccuuaaaaagguaacugaggugcgaggauauacuaaaggagggccgggucaugaggaaccaguaccaaugucaacauacggauggaacauaguaaaauugaugucaggaaaagacguauuuuauuuaccaccagagaaaugcgacacucucuugugcgauauaggagaaucgucuccgucgcccacgguugaggagagucgaacuauaagaguucuuaagaugguggagccguggcuaaagaauaaccaguuuuguaucaaaguacucaacccuuacaugccaacaguaguagaacauuuggaaaggcuacaacgcaaacauggagguaugcuaguacgcaauccgcuaucacgcaacuccacacacgaaauguacuggauaagcaauggcacaggaaacauuguugccagugugaauauggucagucguuuacuacugaauagguucacaaugacacauagaagaccuaccauagaaaaagaugucgacuuaggugcggguacaaggcauguaaaugccgaaccggaaacacccaauauggauguuauaggggaacggauaaagaggauuaaagaagaacauaauagcacauggcacuaugaugaugaaaacccauacaaaacgugggcuuaccauggcucauaugaggugaaggcuacaggaucugcaucaaguaugauaaacggagucgucaaacuccuaacaaaaccuugggacguuguaccaaugguuacccagauggccaugacggacaccacuccauucggacagcagagggucuuuaaagaaaaaguagauacacguacaccuaggucaaugccuggaacaagaagagucaugggaaucacggcggagugguuauggcgaaccuugggucgaaacaagaaaccuagauuaugcacgcgggaggaauuuacuaaaaagguacgaaccaacgcagcuaugggggcagucuuuacagaagaaaaccaaugggauucggcgaaagcagcuguugaggaugaagauuucuggaaauuaguagauagagagcgcgagcuacauaaacuuggaaaguguggaucaugcgucuacaacaugaugggaaaaagagaaaagaagcuaggugaguuugguaaagcaaaaggaagucgugcaaucugguacaugugguuaggagcacguuaccuagaauuugaagcauuaggauucuuaaaugaagaccauugguuuucgcgagaaaauucauacaguggcguagaaggagaaggacuacauaaauuaggauacauuuuacgugacauaagcaaaauaccaggcggcgccauguacgccgaugauacggcagggugggauacacgaaucacggaggaugaccuacauaaugaggagaaaaucacgcaacaaauggauccggagcaucgacaauuagcaaaugcaauauucaaacuuacguaccaaaauaaggucgugaaaguucaaagaccaacucccacagggacaguuauggauauaaucucgcgaaaagaccaaagaggaucaggccaaguggguacuuacggcuuaaauacguuuacgaauauggaggcacaacuuaucaggcaaauggaaggugaagguguucuuagcaaagcggaucuggaaaacccaagacuuccugagaaaaagauuacccaauggcuagaaacgaagggcguugaaagauuaaaaagaauggcuauaagcggagaugacuguguagucaaacccauugacgacagauuugcaaacgcacuacucgcucucaaugauauggguaagguaagaaaagacauaccacaauggcaaccuucgaaaggauggcacgauuggcaacaaguaccauucuguucacaccacuuccaugagcuaauuaugaaggaugguaggaaguuaguagugccuugcagaccucaggacgaacuaauuggucgcgcucgaauaucacaaggggccgguuggucucuccgugaaacagcaugucuuggaaaggcuuaugcucaaauguggucucucauguauuuccauaggcgagacuuacgcuuagccucaaaugcgauaugcucagccguaccuguccacuggguaccaacuagcagaacaaccuggucaauccacgcgcaucaccaauggaugacuaccgaagacauguugacaguuuggaauagagucuggauagaagauaaucccuggauggaagacaaaacccccguaacuacgugggaaaacguaccguaucuaggaaaaagagaggaccagugguguggcaguuuaaucggauugacaagucgggcuacuugggcucagaacauucccacagcuauacaacaagucagaucacucauuggaaaugaagaguucuuagauuauaugccaagcaugaaaagguucagaaaagaagaagagagugaaggagcuauaugguaa

SEQ ID NO: 23443 - RNA, 9873 nt, Artificial Sequence
  derived and/or modified CDS sequence (opt6) from DENV-3__KF955479__SS-prME
accagucugugucucaugaugauacuaccagcagcucucgcuuuucauuuaaccucacgggauggugaaccccguaugauaguugggaaaaacgagcgcgguaaaaguuuacuuuucaaaacugcuagugguauuaauauguguacucugauugcaauggacuuaggagagaugugugacgauacgguaacguacaaauguccccauauuacugaagucgaaccugaagauauagauugcugguguaaucuaaccagcacauggguaacguacggcacguguaaucaagcuggcgagcauaggagggauaaaagaaguguugcauuggcgccucauguaggaaugggacuugacacccgaacucaaacauggaugagugcugaaggagcauggagacagguggaaaaagucgaaacaugggcauuaagacacccagguuuuacaauacuugcacuuuuccuagcacauuacauagguaccucucuuacacaaaaaguggugauauucauuuuacuaauguuggugacuccuaguaugacgaugcgcuguguuggaguuggaaauagggauuuuguugaaggacuuuccggugcaacguggguugacguaguauuagaacauggagguuguguuacgacaauggccaaaaacaaaccgacacuagauauugaauugcagaaaacagaagcuacccaauuagcaacacuaagaaaacucuguauugaaggaaaaauaacgaauauaacaacggacuccagaugcccaacacaaggagaagcgguuuuacccgaggaacaagaucagaauuacguuuguaaacacacguacgucgaccgaggauggggaaauggcugcggacucuuugguaaaggaaguuuagucacuugugcgaaauuccaaugucuugaacccauagaaggaaaaguuguacaguaugaaaacuuaaaauauacugucauuauaacaguucacacaggugaccagcaucaggucgguaacgagacacaaggagugaccgcugaaauaacaccacaagcaucaacgacugaagccauucucccagaauaugguaccuugggccuugaaugcucaccaaggacgggccuagacuuuaaugaaaugauacuacuaacgaugaaaaauaaggcuuggaugguacacagacaaugguucuuugacuuaccucuaccauggacaaguggagcaacaacggagacgccgaccuggaaccggaaagaacuauuaguuacauucaaaaaugcacacgcuaagaaacaagaaguuguugucuuggggucucaagaaggcgccaugcacacugcuuuaacaggugcaacggaaauccaaaauuccgggggaaccucaauauuugcgggacauuuaaaaugcagguuaaaaauggauaaacuagaauuaaaaggcaugucauacgcgaugugcacuaauacuuuugugcuaaagaaagaaguuuccgaaacccagcauggaacuauccuaauuaaagucgaauauaaaggagaagauguucccugcaaaauacccuucucuacugaagacggacaaggaaaagcacacaacggcagacuaauaacagccaacccaguagugacgaaaaaggaagaaccuguuaauauugaagcugagccuccauuuggcgaaucaaauauagugauaggaaucggggacaaugcccugaaaauuaauugguacaagaaagguaguaguauuggaaaaauguuugaagcuacggcaagaggagcccgucggauggccauacugggagacacagcuugggauuuugguagugucgguggcguuuuaaauagucuuggcaaaaugguacaucaaauuuuuggaucggccuacacggcacuguucuccggcgucucgugggugaugaaaauugguauugggguccuguuaacguggauuggacuuaauucgaagaauacuucuaugagcuuuucauguaucgcaauuggaauaaucacuuuguauuugggagcuguaguacaggcggauaugggaugugugauaaacuggaaagguaaggaacuuaaguguggcaguggcauauuuguuacgaacgaaguacacacuuggacugaacaauauaaguuccaggcagauucaccaaaaagacuugcgaccgcgaucgccggugcuugggaaaacggugucugugguaucaggucuacaacucggauggaaaauuuacuguggaaacaaaucgcuaacgaacugaacuacauauuaugggagaacaacaucaaguuaacaguuguggugggagacauuaucggcguauuggaacaaggaaaacggaccuuaacgccacaaccgauggagcugaaauauaguuggaagacuuggggaaaagccaagauaguaacggcugaaacucaaaacucuagcuucauaauugauggaccaaacacuccugaauguccuagcgcuucacgugcauggaacguuugggaaguagaagauuauggguuuggcguguuuacuacaaauauaugguuaaaauuaagggaaguuuauacacaacugugcgaucauagauuaaugucagcggccguaaaagaugaacgagcaguucacgcagacauggguuauuggauagaaucacagaaaaacgggucauggaaauuagaaaaggcaucauuuauagaaguaaaaaccuguacauggccaaaaagucauacacuuuggaguaaugguguauuagagagugauaugauaauaccaaagucacuugcuggaccaauaagccaacacaauuaucgucccggauaucauacacaaacggcuggcccauggcaucucggaaaguuagaacuggauuucaauuacugugaaggaacgaccguagucauaacggagaacugugguacacgcggcccaucucuucgaacaacuacggugucuggaaaauugauacacgaaugguguugccgcucgugcacacuaccaccacuuagguacaugggggaggacggauguugguacggaauggaaaucagaccuauaucagaaaaagaagaaaacauggucaaaucccuaguuagcgcaggaucaggggaaguagacaauuucacuaugggaguauugugcuuagcaaucuuauuugaagaaguaaugcgugggaaauucggcaaaaagcauaugauagcgggaguauucuuuacuuuugugcuguuacugaguggacaaauuacguggcgcgauauggcacacacucucauaaugaucggcucgaaugccucugaucgaauggggaugggagucacauacuuagcuuuaauagcgacauucaaaauccaacccuuucuugccuuaggauuuuucuuacgcaaacuaacaagucgcgaaaacuugcuucuaggaguugggcuugcaauggcaacgacuuuacaauuaccagaggauaucgaacagauggcaaacgggaucgcucuaggacugauggcccuuaaacuaauaacucaguuugaaacuuaucaguuauggaccgcauuaaucucgcucacauguuccaauacuaucuuuacacucacgguggcauggagaacagcaacauuaauacuagccgggguaucuuuacugccaguaugucaauccucaucaaugcgaaaaacggauugguugccaaugacaguugccgcaaugggagucccuccuuuaccacuauuuauuuuuagccuaaaagacacccuaaagcgaagauccuggccacugaacgagggaguaauggcaguaggguuagucagcauacuagcaaguucacucuuaagaaaugauguccccauggcagggccacuugucgcugggggauuacuuauagcguguuacgugauaaccggaacauccgcagauuuaacgguagaaaaagcagcagauguaaccugggaagaagaagcugaacaaacgggcgugagccauaaccugaugauaacaguugacgaugauggaacaaugcggauaaaggacgaugaaacugaaaauauucuaacuguacuauuaaaaacagcacuacuaauuguauccggaauauuuccauacuccaucccagcuaccuuauuaguguggcauacauggcagaaacaaacacaacggagcggcguacuuugggacguccccucucccccugaaacacagaaagcugaacuugaggaaggcguuuaucguaucaaacaacaagguauauucggaaaaacacaaguuggggugggaguacaaaaagaaggaguuuuccauacuauguggcauguuacacgaggugccguauugacuuauaauggaaaacgacuugaacccaauugggcauccgucaagaaagaucuuauuagcuacgguggaggauggcgucuauccgcacaguggcaaaaaggcgaagagguacaagucaucgcaguggagccagguaaaaaucccaaaaacuuucaaaccaugccuggaacuuuccaaacaacuacuggugaaaucggagcaauagcacuagacuucaaaccgggcacaagugggucccccauuauuaacagagagggcaaagucguaggguuauaugguaaugguguaguuacuaaaaacggaggauaugucucagggauagcucagacaaacgccgaaccugaugggccgacaccggaauuggaagaagagauguuuaagaaacgaaacuugacuauaauggauuuacaucccgggucagggaagacuagaaaauaucuuccugcuauaguacgggaagcaauaaaaaggcgucuccgaacgcugauauuagcccccacaaggguaguggcagcggaaauggaagaggcauuaaagggauuaccaauacgauaccaaacaaccgcaacaaaguccgaacacacaggacgagaaaucguggaccuuaugugccaugcuacguuuaccaugagauuacuaaguccaguuagaguaccuaacuauaauuuaauuauaauggacgaggcucacuuuaccgacccugccagcaucgcagcuagagguuauaucucaaccaggguugggaugggagaagccgccgcaauauucaugacagcgacuccgccugggaccgccgaugcauucccgcaaaguaaugcaccaauucaggacgaggaacgagauaucccggaacguucauggaauaguggaaaugaauggauaacugacuucgcaggaaaaacaguaugguucgucccauccauaaaagccggaaacgacauugcaaacugccuucggaaaaauggcaagaaagucauccaacuaaguaggaaaacauuugauaccgaguaucagaaaaccaaguugaacgacugggacuucguaguaacuacugauauaucagaaaugggugcuaacuuuaaagcagaucgagugauagacccaagacguugucucaagcccguuaucuuaacugaugggcccgaaagggucauacuagcaggcccgaugcccgucacggcagcaagcgccgcgcaaagaagaggccgaguggggagaaacccacagaaagaaaaugaucaauauauuuuuacggggcaaccauuaaauaacgaugaagaccaugcucauuggacagaagcaaaaauguuacuggacaacauaaauacaccagaaggaauuauuccagcccuauucgaaccagaacgggagaaauccgcugcuauugacggggaauacagauuaaaaggcgagagccggaaaacuuucguggaauuaaugagaagaggugaucuaccugucugguuagcucacaaagucgcaucggagggaauuaaauauacugauagaaaguggugcuucgauggacaacguaauaaucaaaucuuagaagagaacauggacguagaaauauggacgaaagagggcgagaagaagaaauugcgaccacguugguuagacgcaagaacuuacucggacccccuagcguuaaaagaauuuaaagacuucgcggcgggaagaaaauccauugcacuugaucuagugacggagauaggaagagugccuucacaucuagcccauagaacacguaaugcguuagauaacuuagugaugcuucauacuagcgaacauggugguaaagccuauagacaugcgguagaagaacuuccugaaacuauggaaacacuccuccugcuaggucuaaugauacuccuuacagguggugcuaugcuuuuucuuauaagcggcaagggcauaggaaagacgaguauaggccucauuugcguuauagcuaguucaggaaugcuuuggauggcugaaauaccccuacaauggauagccucagcaauaguauuggaguucuuuaugauggucuugcugauaccagaaccagaaaaacaaagaacgccgcaagacaaccagcuugcguacgugguuauaggaauauuaaccuuagcggccauaauugcagcaaacgaaaugggacugcuagagaccaccaaaagagaucuugguaugaguaaagagccaggcguaguaucgccuacaucuuaucuagaugucgaccuucaccccgccucagcauggacauuauacgcaguagcuacaaccguuauaacgccaauguugcgacacacgaucgaaaauaguacugcaaauguuucucuugcagccaucgcuaaccaggcugucguacugaugggccucgacaaaggcuggccgauaucaaaaauggaucucggcguaccguuauuggccuuagguugcuauucgcaaguaaauccucuaacguuaaccgcugcgguuuuauuacugauaacgcauuaugccauuauuggaccaggauugcaagcaaaagcuacccgggaagcucagaaaagaaccgcugcugguaucaugaagaacccaacuguagauggaauuaugacuaucgauuuagacccuguuaucuaugauucgaaauuugaaaaacagcucggucaggucauguuacuugugcuuugcgccguacaauuacuacuaaugcgaacaaguugggcccugugcgaagcccuuacuuuagcaacaggcccuauaaccacuuugugggaaggcucaccuggaaaauucuggaauacgacgauugcuguuuccauggcaaauauauuucgcgguucuuaucuugcaggagcaggccuagcauucucuauaaugaaaaguguaggaacuggaaaacgaggaacgggaagucaaggcgaaacauuaggugagaaauggaagaagaaauuaaaucaauuaucacgaaaagaauuugaucuguacaagaaaucagguauaacggaagucgauagaacugaagcaaaagaaggcuugaaacgaggagaaaucacgcaccacgcagucucucggggaagcgcaaaacuacagugguuuguagaacgcaauaugguaaucccggaagguaggguaauagacuuaggauguggccguggaggauggucuuauuacugcgcaggacuuaaaaagguaacagaagugcgugguuacacuaaaggagggccuggucaugaagaaccaguuccaaugucuacuuaugguuggaacauaguaaaacuuaugucaggcaaagacguguuuuacuugccacccgaaaaaugcgacacucuccuuugugacauaggagaaaguagcccaucaccaacaguugaagaaaguagaacaaucaggguguuaaagauggucgaaccauggcuaaagaacaaucaguuuuguauuaagguucucaauccuuauaugccuacaguuauagaacauuuagaacgauuacaacgaaaacauggaggaaugcugguuaggaacccacugucucgaaauaguacucacgaaauguacuggauaucuaauggcaccgggaauaucguagcgucaguaaauauggucagucgacuacucuuaaaccguuucacaaugacucaucgaagaccaacaauagaaaaagauguugacuuaggggcuggcaccaggcacguaaacgcagaaccagaaacgccaaauauggacguaauaggggaaagaauaaaacguaucaaagaagaacauaauucuacguggcauuaugaugaugaaaaccccuauaaaacaugggcuuaucacggaucuuacgagguaaaagcuacugguucggcgagcagcaugaucaacgguguaguaaaauuguuaacuaaaccaugggacgugguuccaauaguaacccaaauggccaugaccgauacaacuccauuuggccaacagcguguguucaaagagaaaguagauacacggacuccaagaaguaugccuggaacaagaagaguaaugggaauaacggcggaaugguuauggcggaccuuaggacgaaacaagaagccucgguuaugcacacgagaagaauuuacuaagaaaguccguacaaacgcggcaaugggagcuguauucacugaggaaaaucaaugggacagcgcaaaagcagcuguugaagaugaagacuuuuggaaauuaguggaucgugaacgcgaacugcauaaacuagggaaaugcggcucaugugucuauaauaugaugggaaaaagggagaagaagcugggugaguuuggcaaagcgaaagguucgcgugcuaucugguauauguggcuaggggcuagguaccucgaauuugaagcgcuagguuuucugaacgaagaccacugguucagucgagaaaacaguuauagcggcguagaaggugaaggauuacacaagcuaggauauauuuugagagauauaagcaaaauuccggguggggcaauguaugcagacgauacagccggaugggauacaaggauuacagaagaugaucuacauaacgaagaaaagauuacccaacagauggauccugagcacagacaacuugcuaaugcgauauuuaaacugacguaucaaaauaagguagucaagguucaaagaccaacaccaacuggaacugugauggauauaauuucaagaaaagaucagagaggaucuggccagguagggacguauggccucaauacauuuacaaacauggaagcucaauuaauaagacaaauggaaggugaggguguacucucaaaagcagauuuagaaaauccucaucuaccagaaaagaagauuacacaguggcuagaaacaaaaggaguggaaagauuaaaaaggauggcaauaucaggagaugauugcguagucaaaccgaucgacgaucgauuugccaaugcguuacuagcucuaaacgacaugggaaaaguaagaaaagauauaccccaauggcagccuaguaaaggcuggcaugacuggcagcaaguuccauuuuguagccaucacuuucaugaacuaauaaugaaagacggaagaaagcuagucguaccuuguagaccucaggaugaauugauuggacgagcacgaauuagucaaggcgcgggguggucauuacgcgagacugcuuguuuaggaaaagcauaugcacaaauguggagcuuaauguauuuucauaggagagacuuacgucuugcaucgaaugcuauauguagugcugugccuguacacuggguaccaacuucaagaacgacauggucgauucacgcccaccaucaauggaugacaacugaggauaugcuaaccgucuggaaccgcguuuggauugaagauaacccguggauggaagauaaaaccccaguaacgacaugggaaaaugugcccuauuuaggaaagcgggaggaucaguggugugguucguuaauaggacuuacaucacgcgcaacgugggcucagaauauaccaaccgcgauucaacagguccguucguuaauuggcaacgaggaauuucuggauuauaugccaaguaugaaacgguuuaggaaagaggaagaaucggagggcgcuauaugguga

SEQ ID NO: 23444 - RNA, 9873 nt, Artificial Sequence
  derived and/or modified CDS sequence (opt6) from DENV-3__FJ850109__SS-prME
acaagucuaugucuuaugaugauauuacccgcagcuuuagcauuccaucuaaccucacgagauggcgaacccagaaugaucguagguaaaaacgaaagagggaaaaguuuacuuuuuaaaacagcaagcggaaucaauauguguacgcuaauugcaauggauuuaggggaaaugugugaugauacugucacuuauaaauguccacauaucacagaaguggaaccagaagacauagauuguugguguaauuuaacaaguacauggguaaccuacggaacuuguaaccaagcuggagaacacaggagagauaaaagauccgucgcucuugcuccgcacguggguaugggacuagauacgagaacacaaacauggaugucggcagaaggagccuggagacaaguugaaaaagucgaaacaugggcguuacgucacccuggauuuacaaucuuagcacuauuuuuagcccauuacacgggaacgucccuaacccaaaaaguaguaauuuucauuuuguuaaugcuuguuacaccaagcaugacaaugcguugcguaggcgugggaaauagagauuucgucgaaggccuaucaggagcuacauggguggauguaguuuuagaacacggagggugcguuacaaccauggcuaaaaacaaaccuacacuagauauugaacuucagaaaacugaagcuacgcaacuagcgacccuacgaaaauuaugcaucgaaggcaaaauuacuaauauaacaacagacucucgauguccgacucaaggagaagcugucuuaccagaagaacaagaccaaaacuauguauguaaacacacuuaugucgaucgcggguggggcaacgguuguggauuauuuggaaaaggcucacuuguuaccugugcgaaauuccaaugcuuagagccuauagaaggaaaagucguucaauacgaaaaucuaaaauauacagucauaauaacaguucacacuggcgaccaacaccaagucgguaaugaaacccaaggagugaccgccgagauaacuccucaggcaucuacuaccgaggcaauuuuaccugaauacggcacguugggcuuggagugcucuccuagaaccggguuagauuucaacgagaugauacuauuaaccaugaaaaacaaagccuggauggugcacagacaaugguucuuugauuuaccucuuccuuggacaucaggagcaacaacagagacgccaacuuggaaccgcaaagaacuuuugguaacauucaaaaaugcccaugccaagaaacaagaaguaguugucuuaggaagucaagagggagcaaugcauacggcacuuacaggggcaacagaaauacaaaacucugggggaacaucuauuuuugcaggccacuuaaaauguagauuaaaaauggauaaauuagaacuuaaggguaugaguuaugccaugugcacaaacacuuuuguucucaagaaagaaguuucagagacacaacaugguacgauccuaauaaaaguugaauauaagggggaagaugugccaugcaaaauaccauuuuccacagaagacgggcaagggaaagcacacaacgggcgucuaauaaccgcaaauccagugguaacuaagaaagaggaaccgguaaacauagaagcugaaccaccuuucggagaaaguaacaucguuauagguauuggagacaauaguuuaaaaauaaacugguauaagaaaggaaguagcauugguaaaauguuugaggcgacagcacggggagcucgucgaauggcaaucuugggggauacggcaugggauuucggaagcgugggugguguauuaaacagucuuggaaagaugguccaucagauauuugggagugcuuauacagcacuauuuucggguguuucaugggugaugaaaauuggaaucggagugcucuuaacuuggauuggacuaaauagcaaaaauacaucuaugucauuuaguugcaucgcaaucgguauaauaacauuauauuuaggagcagucguacaagcugauacaggcugcgucauaaauuggaagggcaaggaacucaaaugugguucugguauauuugucacgaaugagguacacacauggacugaacaauauaaguuucaagcugacucaccaaagagauuggcuacugcuauugcaggagcuugggaaaacgguguauguggcauucgaucaacuacacguauggagaaucuauuauggaaacaaauugcaaaugagcuaaacuacauacuaugggaaaauaacauuaaacuuacaguuguaguaggagauauaauuggcgugcuugaacaaggcaaaagaacuuuaacgccucaaccaauggagcuaaaauacucauggaaaacauggggaaaagcaagaauaguaacggcagaaacucaaaauaguagcuuuauaaucgauggaccaaacacuccagaaugucccaacacaagccgagcauggaaugucugggaaguagaagauuacgguuuuggcguguucacaacaaauauuugguuaaaacuaagggaaguauauacccaauugugugaccaccgauugaugagugcagcagugaaagacgagagggcuguacaugcugauaugggcuauuggaucgagucccaaaagaauggcaguuggaaauuagaaaaagccaguuuaauugagguuaagaccuguacuuggccgaaaucccacacauuauggagcaaugggguacucgaaucggacaugauaauuccaaagucauuggcuggaccuaucucucaacauaacuauaggccugguuaccacacccaaacugcggguccauggcauuuggguaagcucgaacuggauuucaacuauugcgagggaacaacagucguuauaaccgaaaacuguggaacuagaggucccucccuacgaaccacuacaguuagcggaaaauugauccaugaaugguguuguaggagcuguacauuaccgccguuacgguacaugggcgaagacggauguugguacgggauggaaauccgccccauaucugaaaaggaagaaaacauggucaagaguuuaguaucugcuggauccggugaagucgauaacuuuacuaugggcguauuaugccuagccauacuuuuugaagaaguuaugagaggaaaauuuggaaagaaacauaugauugccggaguguucuuuacuuucgucuuacuguuauccggacaaauaacuuggcgugacauggcgcauacucuaauuaugaucggaagcaaugccacggaccgaauggguauggggguaacuuaccuugcuuuaauagcaacauuuaaaauccagccuuuccucgcuuuaggguucuuuuuacgaaagcuaacaaguagagaaaaucugcugcuagggguagggcucgcaauggcaaccaccuugcaacucccagaagauauugagcagauggcaaaugguaucgcauuagggcuuauggcacucaaauuaauuacccaguuugaaacguaccaauuauggacagccuuaauaucacuaacaugcagcaauacuauuuucacacugacgguagcguggcguacugcgacguuaauauuggcaggagugaguuuacuccccguaugccagucaaguucaaugagaaagacagacuggcuacccaugacuguagcggcuaugggagucccacccuuacccuuauucauauucucgcuaaaggauacccuaaaacgccgaaguuggccguuaaacgagggaguaauggcuguugguuuagugagcauacucgcaucgucgcuucuuaggaaugacguuccaauggcgggaccacuuguagcuggagggcuucugauugcauguuacguaaucacaggcacuucagcugaccuaacagucgaaaaagcugcugaugucaccugggaagaagaagcugaacagaccggagucucccauaauuuaaugauaacaguggaugacgacggaacgaugagaauaaaggaugaugaaaccgagaauauucuaacuguucuucuuaaaacugcccucuuaaucguauccggaauuuuuccguauucgauacccgcuacuuuacucgucuggcauacguggcagaaacaaacccaacgauccggaguucuaugggacguacccucacccccggaaacgcaaaaggcagaauuggaagagggaguguaucggauaaaacaacaagguauuuuugggaagacucaagugggaguuggcguccagaaggaaggagucuuccacacaauguggcacgucacgagaggggcuguuuuaacuuauaauggaaaaagacuagaaccgaauugggcaagcguuaagaaagaucucauuagcuacggaggcggguggcggcucucugcgcaguggcaaaaaggagaagaagugcagguaauagccguagaaccaggcaaaaaccccaaaaauuuccaaacaaugccugguaccuuucaaacaacaaccggugaaauaggcgcuauagcguuagauuucaagccugggacuucaggaagcccaauuauaaauagagaaggaaaaguaguuggacuauauggaaacgggguugucacuaaaaauggaggauaugucaguggaauugcucaaacuaacgcugaaccggauggaccaacuccugaacuugaagaagaaauguuuaaaaagcggaacuuaacuauaauggacuuacauccagguucaggcaaaacacguaaauacuuaccugcaauagugcgagaggcgauaaaacgaagguuaagaacauuaauucucgcuccuacaaggguuguggcagcagaaauggaagaggcuuuaaagggccugcccauaagauaccaaacuacagcgacaaaauccgaacauacaggaagagaaauaguagacuuaaugugccacgcaaccuuuacuaugcgccuucuaagcccaguaagagucccgaauuacaacuugauuauuauggaugaagcacauuuuacggauccagcuucaaucgcugcaaggggauacauuucuacacgagugggaaugggagaagcagcagccauauuuaugaccgccacaccuccuggcacugcagacgcguucccacaaucaaaugccccaauucaagaugaggagagggauauuccggaacgcaguuggaacagugguaaugaauggauuacugauuucgcuggcaaaacagugugguucguaccgaguauuaaagccggcaaugauauugcgaauugccucaggaaaaacggaaagaaaguaauacagcuuucuagaaaaacauuugauacagaauaccagaaaacuaaauuaaacgauugggauuuuguaguaacuaccgacauuuccgagaugggugcaaauuuuaaagcagaccgcgugauugauccucggcgaugccuaaaaccgguaauacuaacggaugguccugaacgagugauucucgcuggaccaaugccaguaacggcagcaagcgcagcgcagagacguggacguguuggccgaaauccgcaaaaagagaacgaucaauauauauuuacgggacagccacuuaacaacgaugaagaucacgcccacuggaccgaagcuaaaaugcugcuugauaauauaaauacuccagaaggaauuauaccagcccuauuugaacccgagagagaaaaaucagcugccauagacggugaauaucgacucaaaggagaaagcagaaagaccuucguagaauuaaugagaagaggagacuuaccgguauggcucgcacauaaaguggcaagcgagggcaucaaguacacagaucggaaaugguguuuugauggacagagaaauaaccaaauacucgaagaaaacauggauguagaaaucuggacuaaagaaggugagaagaagaaacuaagaccucgaugguuagacgcacgcacauauuccgauccucuagcucuuaaagaguucaaagauuuugcggcagggagaaaaagcauagcauuggaucuagugacugaaauaggaagagugccaacacaccucgcacauaggacgcgaaaugcccucgacaaccucgucaugcuacauacgucggaacauggggguaaagccuauaggcaugcaguggaagaacucccagaaacgauggagacccuguuauuauuaggacucaugauucuucuaaccggaggagcaauguuauuuuuaauuagcggaaaggggauaggcaaaacaaguauaggauugaucuguguaauugcaucgagugggaugcuauggauggcagaaauaccacugcaauggauagccucagcaaucguauuagaauuuuucaugaugguacuacuaauaccugaacccgagaagcagcgaacuccucaagauaaucaauuggcauauguggugaucggaauacugacauuagcugcuauuauagcagcgaacgagaugggucuucuggagacuacgaaacgugauuuagggaugucuaaagaaccgggggucguuucuccuacaagcuaucuugauguugauuugcaucccgcuucagcguggacuuuauaugcaguugccacuacugucauaacuccuauguuaagacauaccaucgaaaauucaaccgcgaacguaucacucgcugcaauagcuaaucaggcggucguauugaugggacucgacaagggauggccaauuucaaaaauggauuuagggguaccacuucuggcuuuaggaugcuacucccaggucaacccacuaaccuuaacagccgcuguucuauuauuaauuacccacuaugcaauuauaggaccggggcuucaagcaaaagcaacacgagaggcacagaaaagaacagcugcugggauaaugaagaauccaacugucgauggaauuaugacaauagacuuagauccaguaauauaugacucuaaauuugagaaacaauuagggcaaguuaugcuccuggugcuaugcgcaguucaauugcuacuaaugcgaacgucaugggcacuaugugaagcucucacauuagcgacaggacccauaacaacccuaugggagggaucuccuggaaaguuuuggaacacuacgauagcugucaguauggcaaauauauuccgagggucuuaucuagcuggggcaggucucgcuuucucaauaaugaagucagugggaaccggaaaacgcgguacaggcucgcagggagagacacuuggagaaaaauggaagaagaaauuaaaucaauuaagucggaaagaauuugaccuguauaagaaaagugguauaacggaaguggauagaacagaagcaaaagaggguuuaaaaagaggagaaauuacgcaccaugccguaagucgaggaucagcaaaacuacagugguuuguagagcguaacaugguuaucccagaaggcaggguaauugauuuagggugcggaagaggcggguggaguuauuacugugccgggcugaagaaaguuacugagguaagaggauauaccaagggcgguccuggccaugaagaaccugucccuaugucgacauauggguggaacauuguaaaauuaaugagugguaaagauguauucuacuuaccaccggagaagugugauacacuacucugugauauaggagaaagcagcccaucaccgacuguggaagaaagucgaacaauaagaguccuuaaaaugguagaaccguggcucaaaaacaaucaauucugcauaaaaguucugaauccuuacaugccagcugugauugaacaucuugaaagauuacagcgaaagcauggagggaugcuuguuagaaauccauuaagcagaaauucaacucaugaaauguauuggauaucaaaugggacaggcaauauagucgcaucgguuaacaugguuucaagacuauuacucaaccgcuuuacuaugacacaccgcagaccaacuauagaaaaagauguugacuuaggggccgggacucgacauguuaaugcagaaccagaaacaccaaauauggaugugauaggugaacgcauaaaaagaauaaaagaggaacacaacucaacuuggcacuacgaugacgagaacccauauaaaacuugggcuuaucauggaucuuaugaaguuaaagcaacgggcuccgcaaguagcaugauaaacggagucgugaaacugcugacaaagccgugggauguaguaccuauggucauccaaauggcaaugacagauacgacaccauucggccaacaacguguauuuaaagagaaaguagacacaagaacaccaaggucaaugccuggcacaagacgugucauggagauaacugcagaauggcuauggagaacuuugggucgaaauaagaaaccuaggcuuuguacccgagaagaguucaccaagaaaguaaggacgaacgcugcuaugggagcaguuuuuacagaagaaaaucaaugggauagugcuaaagcagcaguugaagaugaagauuucuggaaacuuguugauagagaaagggaacuccauaaauuggguaaauguggcucuugcguuuacaacaugaugggaaagcgagagaagaaacugggggaauuuggaaaagcuaaaggaaguagggcgauaugguacauguggcuuggagcccgauaccuagaguucgaagcauuaggcuuccuaaacgaagaccauugguucucacgagaaaacaguuauuccggaguagagggggagggccuccacaaacuuggauacauacuuagggacauaaguaagauuccagggggugcgauguaugcagacgacacagcggggugggauacuagaauuacagaagaugaccuacauaacgaagagaaaauaacucaacaaauggauccagagcauagacaguuagcuaaugcgauuuuuaagcuaacauaccaaaauaaaguaguuaagguacagaggccgacaccuaccggaacggugauggauaucauuucgcgaaaagaccaaagagggucuggacaagucgguacauacggauugaauacauuuacgaauauggaggcccaguugauaagacagauggaaggugaaggaguguugagcaaagcugacuuggagaacccucacuugcccgagaagaaaauaacacagugguuggagacaaaaggagucgaaagacuuaaacgaauggcgauaaguggcgaugauugcguagucaaacccauagaugaccguuucgccaaugcguuacucgcacuaaaugauauggguaagguaagaaaggacauuccacaguggcaaccaucaaaaggcuggcacgauuggcaacaggucccauucuguagccaucauuuccacgaacuuauuaugaaagacggcaggaagcuaguugugccguguagaccacaagaugaacucauuggcagggcuagaaucagucagggugccggcuggucgcuuagagagacagccugcuuagggaaggcauacgcucaaauguggucgcugauguauuuccaucgucgugaucuaaggcuagcaucaaaugcuauuugcucagcuguaccaguccauuggguuccuaccucccgaacaacauggucaauucacgcgcaccaccaauggaugaccacugaagacaugcuaacugucuggaaccggguauggauagaagacaauccguggauggaggacaaaacaccggucacuacaugggaaaauguuccauacuugggcaaacgcgaagaucaauggugcggauccuuaauugguuuaacgucccgagcaacgugggcccaaaacauuccaacggcgauacaacaagucaggaguuugauagguaacgaggaguucuuggauuauaugccaucuaugaaaagauucagaaaagaagaagaaagcgaaggggcaauaugguga

SEQ ID NO: 23445 - RNA, 9873 nt, Artificial Sequence
  derived and/or modified CDS sequence (opt6) from DENV-3__GQ868586__SS-prME
acaucgcuaugccuaaugaugauauuaccagcggcuuuggcauuucaccucacaagucgggacggugaaccacguaugauagugggcaaaaaugaacgagguaaaagucuacuguucaaaacggcauccggaaucaauaugugcacacugauugcuauggaucuaggggaaaugugugaugacaccguaacauacaaauguccacacauuacagaaguagaaccagaagauauagacuguuggugcaaccuuacaucaacauggguuacauauggcaccuguaaucaagcuggagaacaucgacgcgacaaaagaucaguggcauuagcaccccauguaggaauggguuuagauaccagaacacaaacauggaugagcgcagaaggagcauggagacaaguagaaaaaguagaaacgugggcuuuacgucauccaggauucaccauauuagcauuauuuuuagcccauuauauaggaacaucacuaacccagaaaguuguaauauuuauacuauugaugcuuguuaccccaagcaugacaaugagguguguaggaguaggaaaucgugauuucguagaaggacuuagcggagcaacuuggguagaugugguauuggaacacgguggguguguaaccacaauggccaaaaacaaaccaacccuugacauugaauuacagaaaacagaagccacacaacuagcuacauuacgcaaacuauguauugaaggaaaaauaacaaauauaacaaccgauucucguugcccuacgcaaggggaagcaguucugccagaagaacaagaccaaaauuauguauguaaacauacguacgucgaccguggcugggggaaugggugcggccucuucggcaaagguaguuuaguaacuugcgcaaaauuccaaugccuagaaccaauugaagggaaaguagugcaauaugaaaaccuaaaauauacaguaauaaucaccguucauacuggagaucaacaucagguaggaaaugaaacccagggugugaccgcagaaauaacaccccaagcauccacaaccgaagcaauacuaccugaauaugggacacuaggccuggaaugcaguccaaggacuggacuagacuuuaaugaaaugauccuacuaacuaugaaaaacaaagccuggaugguccauagacaaugguucuuugaccuaccgcugccguggacaucaggagcuaccacugagacaccaacguggaauaggaaagaacuuuuaguaacauucaaaaacgcacacgccaagaaacaagaaguaguaguccuagggucacaggaaggggccaugcauacagcgcuaacuggcgcaaccgaaauacaaaauagcgggggaaccucgauauucgccggacaucucaaauguagauuaaaaauggauaaacucgaacuaaaagggaugaguuaugcuauguguacaaacacguuuguucucaagaaagaaguaagugaaacacaacauggaaccauccuaauaaaagucgacuacaaaggcgaagauguuccuuguaaaauaccuuucucaaccgaagauggacaaggcaaagcacacaacggccgauuaauaaccgccaaucccguuguaacgaagaaagaggaaccagugaauauagaggcagagccacccuuuggugaaagcaauauagucauaggaauaggugacaacgcacuuaaaauaaauugguauaagaaagguucaagcauaggaaaaauguuugaagcaacagcacggggcgcucgucgaauggcaauccugggagacacugcaugggauuuuggauccguagguggcguccuaaauucauuaggcaagaugguccaucaaauauuuggaagugcauauacggcccuauuuucaggcgugucuuggguaaugaagauuggaauugguguacuuuugacuuggauuggacuaaacagcaaaaacacgaguaugucauuuaguuguauugcuauagggauuauuacucuuuauuugggagcuguaguacaggcugauacggguugcguaauaaacuggaaaggaaaagaauuaaaaugugguaguggcauuuucguaacaaaugaaguccacacauggacagaacaauacaaauuccaagcggacucaccaaaaagacuagccacagcaauugcuggagccugggaaaauggaguaugcgggauacgcucaacuacaaggauggaaaauuuacuuuggaaacagauugcuaacgaacuaaacuacaucuugugggagaacaacauaaaauuaacagugguaguaggugauaucaucggaguuuuagaacaaggaaagaggaccuugacaccacaacccauggaacucaaguauuccuggaaaaccugggggaaagcgaaaaucguaacagcagaaacacaaaauuccuccuuuauuauagauggcccaaacacuccagaaugcccgucagccuccagagcguggaaugugugggagguggaagacuacggcuuuggcguguuuacuacaaauaucugguuaaaacuaagggaaguuuacacacagcaaugugaucauagauugaugagugcggcuguaaaagaugaacgagcaguacaugcggacaugggauauuggauugaaucucaaaagaaugguagcuggaaacuugaaaaagcaagccuaauagaaguaaagacaugcacauggccuaagagucacacucugugguccaauggaguccuagaguccgacaugauaauuccgaaaucuuuggcagguccaauaucacaacauaacuauaggccugguuaccauacgcaaacugcugguccauggcauuuagguaaauuggaacuugauuuuaauuacugugaaggcacaacagucguaauaacugaaaacugcggaacucguggcccgaguuuacgcacaacaacagugaguggaaaguugauacaugaauggugcugcagauccuguacuuuaccacccuuacgauauaugggagaagacggcugcugguacgguauggaaauaagaccgauaagugaaaaagaggaaaauaugguaaagaguuuaguuagugcagggagcggcgagguggauaauuuuacuauggguguguuauguuuagcaauacucuucgaggaagugaugagggguaaauuugggaagaagcauaugauugcaggaguauucuuuacguuuguuuuguugcuaucaggucagauaacuuggagagauauggcgcauacguuaauaaugauaggaaguaacgcaucugauaggaugggaaugggaguaacuuauuuagcccucauugcaacguucaaaauccagccauuccuagcauuaggcuucuuuuugcguaaacuuacuucacgagagaaucugcuccuuggcgucggauuagcaauggcaacaacgcuucaauuaccugaagauaucgaacaaauggcaaauggaauagcccuaggucuaauggcgcucaaacucauuacacaauucgaaaccuaucaauuauggacagcuuuaaucagcuuaacaugcucaaauacaauauuuacgcuaacuguagccuggcgcacggcuacccugauacuggcuggcguuagucucuuaccugugugucaaucaaguagcaugaggaaaacggacugguugccaaugacgguagcugcuaugggaguacccccguuacccuuguuuauauuuucacucaaagauacauugaaaagaagaucauggccgcuaaaugaaggcguaauggcgguaggccuaguuaguauauuagccagcagcuuauugagaaaugacguaccaauggcugguccauuaguugcuggcggucuguuaauagcauguuacguaauuacuggcacuucggcggaucugaccguggaaaaagcggcagauguaaccugggaagaagaggcagaacagacuggcguuucccauaaucuuaugauuaccguagaugaugauggcacuaugagaauuaaagacgaugaaacugaaaauauuuugacaguacuauugaaaacagcgcuguuaauagucucggggauauucccuuauucaauccccgccacguuacuuguguggcauaccuggcaaaaacaaacgcagcggagugguguacugugggacguaccguccccaccugaaacucaaaaggccgaauuagaggaaggagucuauagaaucaaacagcaagguauauuugggaagacucaggucggaguagggguacagaaggaagguguauuccacaccauguggcacguaacucggggagcaguacugacauacaacggaaaaagauuggagccaaacugggcaucagucaagaaagaccuuauaucguauggaggaggauggaggcuaucggcccaauggcaaaagggagaggaaguacagguaauagcgguagaaccagguaaaaacccaaagaacuuucaaacuaugccuggaaccuuccaaacuacaacuggagagauaggagcaauagcacucgacuucaaaccgggaacaaguggaagcccgauaauuaaccgagaagggaaagugguagggcuauauggcaacggaguaguaaccaaaaauggaggcuauguauccgguauagcgcagacgaacgcugaaccagaugguccuacaccugaacuagaagaggaaauguuuaagaaacgaaaccugaccauuauggaucuacacccugguucggguaaaacacgcaaauaucuuccagcuauaguaagggaagcuauaaaacgaagguuacgaacacuaauauuggcgccuacuagggugguggcggcagaaauggaagaggcuuugaaggguuugccaauuagguaucaaaccacagcaacaaagagugaacauacgggacgcgaaauaguagauuugaugugccaugcaacguucacuaugagacuacugagcccuguaagaguaccaaauuauaacuuaauuauaauggacgaagcccacuuuacagauccugcaucuauagcggcacggggauauauuucaacuagggucgguaugggagaagcagcugcgauauuuaugacggcaacaccgccgggaacugcagaugcuuuuccacaguccaaugccccaauacaagaugaagaacgcgauauacccgaacgaaguuggaacucuggaaacgaauggauaacagauuuugcuggcaagacagugugguucgucccaucaauaaaagcuggaaaugacauagcaaacugccuacguaagaauggcaagaaagugauacaauugagccgaaagaccuucgacacggaguaucagaaaacaaaauuaaaugacugggauuucguaguaacuacagacaucucggaaaugggugcaaacuucaaagcugaucgggugauagacccucgacgaugucuuaaacccgugauacuuaccgacggacccgagcgaguaauccucgcaggaccaaugccagucaccgccgcauccgcugcacagcgacguggucgaguaggcaggaauccccaaaaagaaaacgaccaguauauauuuacaggucaacccuugaauaaugacgaagaucaugcacauuggacugaggcaaaaaugcugcuggauaauauaaauacucccgaagguauuauacccgcuuuauuugagccagagagagaaaaaucugcagccauagauggggaguaccggcugaaaggagaaucaaggaaaacuuuugucgaacuaaugagaagaggagaccuaccuguuuggcuagcacauaaaguugcuucagaaggaauaaaguacacugauagaaagugguguuuugauggccagagaaauaaccagauucuugaagaaaauauggacguagaaauuuggacuaaagaaggagagaagaagaaacuccgaccaagauggcuagacgcaagaaccuacucugauccucuagcguuaaaagaguucaaagauuuugcugcgggaagaaagucuauagcccuugacuuagugacugagauaggcaggguucccucgcaucuugcgcaccgaacgcgaaacgccuuggacaacuuaguuauguuacauacuagcgagcacgguggaaaggcuuauaggcaugccguugaggaauuaccagaaaccauggaaaccuuauuacuauuagguuuaaugauccuuuugaccggaggagcaauguuauuccugauuucuggaaaaggcaucggaaaaacaagcauagggcuuauaugugucauagcgaguagcgguauguuauggauggcagaaauaccucuccaguggauugccagugcgauaguuuuagaauuuuucaugaugguacuauuaauaccagagccggaaaaacaacguacaccccaagacaaccaacuugcuuaugucgugauaggcauucuuacucuagcugcaauuaucgcagcaaaugaaaugggguuauuggaaacaaccaaaagagaucuuggcaugaguaaagaacccggagucguaucaccaacaaguuacuuggauguugauuuacauccugcuucagcauggacuuuguacgccguugcuacaacugugauaacuccaaugcuacgccacacgaucgaaaacagcacagcaaacguuucacuagcugcgauagcaaaccaagcaguaguuuuaaugggauuagauaaaggauggcccauuucuaaaauggaucugggugucccacuccucgccuuaggcugcuacagccaaguaaacccguuaacauuaacggcagcuguauuguuguugauaacgcacuaugcgauaauaggcccgggauugcaagccaaagcaacgagagaggcucaaaaacgaaccgcugcugguauaaugaaaaaccccacuguugauggaauaaugacgauagaccuugauccaguaaucuacgacucaaaauuugaaaaacaauuaggacaagucaugcuacucguguuaugcgcuguacaauugcuccucaugcguacaucuugggcccuuugugaggcuuuaacacuagccacaggccccaucacaacgcucugggagggaucaccaggaaaauuuuggaauacuacuauugccguaagcauggcaaauauuuuuagaggauccuaucuagcgggagccggacuugcuuuuaguauuaugaaaagcguuggaacuggaaagcgaggaacagguagucaaggagaaacacucggugaaaaauggaagaagaaauugaaccaacuuucuagaaaagaauuugauuuguauaagaaaagcggcauuacugaaguagaucguacagaagcuaaagaggggcuaaaaaggggcgagguaacucaucacgcaguuucaagagguucagcgaaauugcagugguucguugaacguaacauggucauaccugaagguagaguaauagacuuaggguguggcaggggcggauggucauacuauugugcugguuugaagaaaguaacggaaguuaggggguauacaaaaggaggaccaggucaugaagaaccuguaccaaugucaacuuauggauggaauauugucaaauuaaugagcggaaaagauguauuuuaucuaccuccggaaaaaugugacacguugcugugugacaucggugaaaguucuccaucccccacaguugaggaaaguaggaccauaagaguguuaaaaaugguggaacccuggcuuaaaaacaaucaauucugcauuaaaguacuuaaucccuauaugccaacaguuauugaacaccuugaaagacuacaaaggaaacacggcggaauguuggugagaaauccauugagcagaaacucgacccacgaaauguacuggaucucaaauggaacggggaacaucguggcuucaguuaauaugguguccagauuacugcuaaauagguuuaccaugacgcacaggcgacccacaauugaaaaggauguagaccuaggggcgggcaccagacauguuaaugcggaaccggaaacaccaaauauggacgucauaggcgaaagaauuaaaagaauaaaggaggaacauaauucaacguggcauuaugaugaugaaaaccccuacaaaacgugggcauaucauggaucauacgaaguuaaagcaacaggcagugcaagcagcaugaucaacggagugguaaaacuuuuaacgaaaccuugggacgucguuccaaugguuacucaaauggcgaugacagauacaacuccauuuggucaacaaaggguauucaaggagaagguugacacgaggacuccacgcucaaugcccgguacgagaagagucaugggaauaaccgcugaauggcuauggcguacucuugguaggaauaaaaagccucggcuuuguacaagagaagaguuuaccaagaaggugcgcacuaacgcagccaugggagccguauucacagaggaaaaucaaugggauucagccaaagcagcaguugaggaugaggauuuuuggaaguuaguagaacgugaaagagaacuacacaaguugggaaaauguggauccugcguauauaauaugauggguaaaagagagaagaaacuuggugaguucgggaaagccaaaggaucacgggcuauaugguauaugugguuaggcgcgagauaucucgaguucgaggcacuaggauuucuuaaugaggaccacugguuuucaagagaaaacucuuacaguggagucgaaggagagggacuccauaaacuagguuacauauugagggauauaucgaagaucccagguggggcuauguaugcagaugacacggccggaugggauacaagaauuacggaagaugaucuucacaaugaggagaaaauaacccaacagauggacccggaacacaaacaacuugcaaaugcgauuuuuaaauuaacuuaucagaacaaaguaguaaaaguacaacgaccaaccccuacaggaacuguuauggauauaaucucacguaaagaucaaagagguucaggacaaguaggcacuuauggucuaaacaccuucacgaauauggaagcacaauuaauacggcagauggaaggugaaggaguauuaaguaaagcugacuuggaaaacccccaucugccagagaaaaagauuacacaauggcuggagacuaagggcgucgagaggcucaaaaggauggcuauaucaggggacgacugcguaguaaaaccuauagacgacagauuugcaaacgcacuccuugcauuaaacgauaugggaaaagugcgaaaagacauuccacaauggcaaccaagcaaaggauggcaugauuggcaacaaguaccuuuuugcagucaccacuuucaugaauuaauaaugaaagauggacguaaguugguagucccauguagaccccaggacgaguuaaucggcagggcaagaauuucucaaggagcaggauggucauugagggagaccgcaugccucgccaaggcuuacgcucagauguggagccuuauguauuuucacagaagagaucuacgucuugcuucuaaugcgauuuguucagcuguaccuguucauugggugccaacuuccagaacaacauggucaauccaugcccaucaucaauggaugacaacggaagauaugcuuacuguauggaaccgaguauggauugaagauaauccauggauggaggauaagacgccugucaccacaugggaaaauguuccuuacuuagguaaacgagaagaucaauggugcggaucacuaauaggacuuacaucucgagccacaugggcacaaaauauaccuacagcuauucaacaaguacgauccuuaauaggaaacgaggaauuuuuggacuacaugccaagcaugaaacgauucagaaaagaagaagaaucagagggagcuauuugguaa

SEQ ID NO: 23446 - RNA, 9873 nt, Artificial Sequence
  derived and/or modified CDS sequence (opt6) from DENV-3__FJ850110__SS-prME
acaucauuaugccugaugaugauucuuccggcagcguuagcauuucauuugaccucaagggauggagaaccgagaaugauuguugggaaaaaugaacgcggcaaaagucugcuuuucaaaacagcaucaggaauuaacauguguacgcuaauugcaauggauuuaggagaaaugugugaugacacgguaacauauaaaugcccucauauuacagaaguggaaccugaagauaucgauugcuggugcaaucuaacaucuacuuggguaacauaugggaccuguaaucaagcaggagaacaucgucgagauaaaaggucaguugcauuagcaccgcauguaggaaugggucuugacacaagaacccaaacauggaugagugcggaaggugcauggcgccaaguggaaaaaguugaaaccugggcccuucgacaucccggcuuuacaauuuuagcucuguuuuuggcacauuauauagguacgagucucacucaaaaagucguaauauucauuuuacugauguuaguaacaccgagcaugacaaugagguguguggggguagguaaucgugacuuugucgaaggguugaguggggccacauggguagaugucguuuuggaacacggaggaugcguuaccacaauggcgaaaaacaaaccaacuuuagacaucgaauugcagaaaacugaagcaacgcaacucgcaacucuaaggaaauuauguaucgaaggaaagauuacaaauaucaccacugauucgagaugucccacacaaggcgaagcaguauugccagaagaacaagaucagaauuauguuugcaaacacacguacgucgacagggggugggggaauggcugcggccuuuuuggaaaaggauccuugguaacaugugccaaauuucaaugucuagaaccuauugaaggaaaagucguucaauaugaaaauuuaaaauauacagucaucauaacaguacauacaggagaucaacaucaagugggaaacgaaacacaaggcguaaccgcggaaauuacuccccaagcauccaccacagaagcgauacugcccgaauacggaacuuuaggauuagaaugcucuccaaggacugguuuagauuucaacgagaugauccuauugacgaugaaaaacaaggcauggaugguacacaggcaaugguucuuugaucugccuuuaccguggacaucgggugcaacaacagagacaccuacauggaaccgcaaagaguuauuggucaccuucaaaaacgcacacgccaagaaacaagaagugguuguacuaggaagucaggaaggggcgaugcauacagcguuaacaggcgcuaccgaaauccaaaauucgggaggcacgagcauauucgcuggacaucuaaaauguagauugaagauggauaagcucgaguuaaaaggaaugaguuacgcaaugugcacaaacaccuuuguuuugaagaaagaaguaucugagacacaacauggaacaauacugauaaaaguggaauacaaaggcgaagauguaccuuguaaaauaccuuucaguacagaagauggucaagguaaggcccauaacggaagguuaauuacagcuaacccggucgucacuaagaaggaagaaccaguaaauauugaagcagagccaccuuuuggggaaucgaacauugucauaggaauaggugauaacgccuuaaaaauuaauugguacaagaaaggaagcucaauugguaaaauguuugaagcaacggcaaggggcgcacgaaggauggccauccuuggugauacugcgugggacuuugguucaguagguggaguauuaaauuccuuaggaaaaaugguccaucaaauauucggaagugcauacacagcacuguucucaggaguuucauggguaaugaaaauaggaauaggggucuuauuaaccuggauugggcuaaauagcaaaaauacaucuauguccuuuaguuguauugcgauuggaauaaucacacuuuauuugggcgccguuguacaagcagacacaggguguguaauaaauuggaagggaaaagagcuaaaauguggaagcggaauuuucguaacgaaugaaguacauacguggacugagcaauacaaauuucaagcugacucaccgaaaagguuagcaacagcaauugcgggcgcgugggagaauggaguaugcgggauacguucgacuacaagaauggagaacuuacuguggaagcaaauagcuaacgagcuaaacuacauuuugugggaaaacaacauuaaauuaacuguugucgucggugauauaaucggcguacucgaacaaggaaaaaggacacucacaccucaaccuauggaauuaaaauauucauggaagacgugggguaaagcaagaauaguaacagcagaaacacaaaacaguuccuuuauaauagacgggcccaauacaccugaauguccuaacacgagcagagccuggaaugugugggagguugaagacuauggcuuuggcguauuuacaacuaauauauggcucaaauuacgagaagucuauacgcaauuaugcgaucauagacugaugagugcggcgguaaaagaugaaagagcaguacaugcagauaugggcuacuggauagagucgcagaaaaauggaaguuggaaacuggaaaaagcauccuugauagaaguaaagacaugcacuuggcccaaaucacacacauuguggaguaaugguguauuggaguccgacaugauaauuccaaagucccuagcggguccaauaagucaacauaauuauagaccuggcuaucacacacaaacggcuggcccuuggcauuuggguaaacuugaauuagacuuuaacuauugcgaaggaacgacaguugugauaacagaaaauugcggaacucgcgguccaagccuccggacgacuacagucucaggaaaauugauccaugaguggugcuguaggagcuguacuuuaccuccccuccgauacaugggagaagacggauguugguaugguauggaaauaagaccaauaaacgagaaagaagaaaacaugguaaaguccuuagucuccgcaggaucaggggagguggacaacuuuacaaugggaguuuuauguuuggcuauauuguuugaggagguaaugcggggaaaguucgguaagaaacauaugauugcaggaguauucuucacauuuguguuacuacuuagugggcaaaucacauggagagauauggcccacacacugaucaugauaggcucuaaugcgacagauaggaugggaaugggaguaacguauuuagcguuaauagcaaccuuuaagauccaaccuuuucuagcccucggauucuuccuacgaaaguuaacaucccgcgaaaaccuauuauuaggcguagggcuugcaauggcuacuacucuucaacugccggaagauauagaacaaauggcaaacggcauagcgcuagguuuaauggcauuaaaauuaauuacucaauuugaaacauaucagcuauggacugcauuaauuaguuuaacaugcucaaauacaauauuuacccuuacaguagcuuggcguaccgcgacguuaaucuuagcuggaguuucacucuuaccagucugccaaaguucuagcaugcguaagacugauugguuaccuaugacagucgcagcaaugggugucccuccgcuaccauuauucauauuuucacucaaggauacccugaaaagacguagcuggccuuuaaacgaaggaguaauggcuguugggcuaguaagcauauuagcauccucguuacuacguaaugacguuccuauggcuggcccguuagucgcuggaggacugcuaauagcuugcuauguaaucacggggacgucagccgauuuaaccguagaaaaggcagccgauguaacaugggaagaggaggcagagcagacagguguaagccacaauuuaaugauuacaguagaugacgaugguacaaugcguauaaaagacgaugaaacugaaaauauccuuaccguucuauuaaagaccgcgcuuuuaauaguuagcggcauauucccguauaguauuccggcaacauugcuggucuggcacacguggcaaaaacaaacacagagaucuggcguguuaugggauguaccaaguccaccagaaacacaaaaagcagaacucgaagagggaguguaucgaauaaaacaacaaggaaucuucggaaaaacacaagucggagucgguguacaaaaagaggguguauuccacacaauguggcauguaacaagaggcgcuguucuaacauauaauggaaaaagauuggagccaaacugggcuucggugaaaaaggaccucauaagcuauggaggcgguuggcgauuaagugcucaguggcagaaaggagaagaagugcagguaauagcaguugaaccgggaaagaacccaaagaacuuucagacaaugccgggcacuuuccagacgaccacgggagagauaggagcaauagcguuggacuuuaaaccugggacuucgggcucaccaaucauaaacagagaaggaaaaguagugggacuauauggaaauggggugguuacaaagaacggaggauauguaucaggcaucgcucaaacaaaugcugaaccugauggcccaacuccagaauuagaagaagaaauguucaagaaaagaaauuuaacaauaauggauuuacauccaggauccgggaaaacuagaaaauauuuaccugcuauuguaagagaagcuauuaaaagacgacuucgaacgcuuauauuagcaccgacacggguugucgcagccgaaauggaagaggcuuuaaaaggucucccaauaagauaccaaacgacugccacgaaaucugaacauaccggucgugagauuguugaucucaugugucaugcaaccuucacuaugagacucuugucccccguuagaguucccaacuauaauuuaauaauaauggaugaggcucauuucacggacccugcgaguauugccgcacguggauacauuucaacucgugucggaaugggggaggcugcagcuauuuuuaugacggcuaccccaccggggacagcagaugcguucccacagucgaaugcaccuauucaagacgaagagagggauauaccggaacgaagcuggaacucuggaaaugaauggauaacagacuucgcgggaaaaacugucugguucguaccaagcauaaaagccgguaacgacauagcaaauuguuuaaggaagaauggaaagaaagugauacaguugagucgaaaaacauuugacacagaguaucagaaaaccaaauugaacgauugggacuucguagugaccacugauauuucugaaaugggcgccaauuucaaagcagacagagucauagauccuagaagaugccucaaaccgguuauucugacggacggaccggaacgaguaauacucgccggaccuaugccuguaacggcugcgucugcagcacaacggaggggaagagucgggaggaacccgcaaaaagagaacgaccaauacauauucacgggucaaccauuaaacaacgacgaggaccaugcgcauuggacagaggcaaaaaugcucuuagauaauaucaauacgccagaagggaucauuccagccuuauuugagccugaaagagagaaaagugcagcuaucgacggagaauaucguuuaaaaggcgaauccagaaaaaccuuuguggaacuaaugagaagaggagaccuacccgucuggcuugcacauaagguagccucagaggggauaaaauauaccgacagaaagugguguuuugauggacagagaaauaaucaaauauuagaggagaacauggacguagaaauuuggaccaaagaaggcgaaaagaagaaauuacggccgaggugguuagaugccaggacauacuccgacccucuagcauugaaagaguucaaagacuuugcggcuggccgcaaaucuauugcucuagaucuuguuacagaaauuggaagaguuccuacccaucuagcacacagaacuagaaacgcacuagauaaccucguaaugcuucauacgucugaacauggugguaaagcauacagacaugccguagaagaauugccagagacaauggaaacucuacuguuauuaggauuaaugauucuccuuacagggggugccauguuauucuuaaucucaggaaaagguauagggaagacuucuaucggucuaaucuguguaauagcaucuucuggaauguuauggauggcggaaaucccacugcaguggauugcgucugcgauaguacuugaguuuuucaugaugguuuuauuaauuccagaacccgaaaagcagaggacaccccaagacaaucaguuagcauaugucguaauaggcauccugacucuagcugccauuauugcggccaacgaaauggguuugcucgagacuacuaagagagaccugggaauguccaaggagccgggagucguaagcccuacaucuuaccucgacguugaccuucacccagcaagcgcauggacuuuauacgcgguagcuacaacuguaauuaccccaauguugaggcacacaauagaaaacuccacugcaaauguuucguuagccgcuaucgcaaaccaagcugucguccucaugggucucgauaaagguuggccaauaagcaaaauggacuugggagugccuuuauuggcauuagguuguuacagucagguuaauccauuaacacuuacugcagcaguuuuauuacucaucacucauuacgcaauaauaggaccaggauuacaagcuaaagcaacacgggaggcucagaaaaggacagcagcaggcauaaugaaaaauccgacaguagauggaauaaugacgaucgaccuagaccccgugauauacgauaguaaauuugaaaaacaacucggacaagugauguuauuaguuuuaugugcgguacaacuauuauuaaugagaacuuccugggcauugugugaagccuuaacauuagcaaccgguccaauaacaacuuuaugggaaggaucaccagggaaauucuggaauaccacaauugcagugaguauggcaaacaucuucagagguagcuaccuugccggagcaggcuuagcauuuaguauaaugaaaagcguagggacaggaaaacgaggaaccggaagucaaggagaaacacuaggugaaaaguggaagaagaaacuaaaucaacuaagcaggaaagaguucgacuuauauaaaaagucggggauuacagagguggauaggacugaagcuaaagaaggguuaaaacgcggcgagaucacccaucacgcggucucaagaggcucugcgaaauuacaaugguuuguugaacgcaauaugguaauaccagaaggaagagugauagaccuagggugugguagaggaggguggucguacuauugugccggcuuaaagaaaguaacugaaguaagaggguauacaaaaggggguccaggucaugaggagccuguaccaaugucaaccuauggguggaauauaguuaaacuaaugucaggaaaggauguauucuauuuacccccggaaaagugcgauacuuugcuaugcgauauuggggagucauccccuucgccuaccguugaagaaucaagaacaauuagaguguuaaaaaugguagagccuuggcugaaaaacaaccaauuuuguauaaaaguccugaaccccuacaugccagcaguaauagagcaucuagaacgacuccaaagaaaacacgguggaaugcuaguccgaaauccuuuaucgagaaacucaacacacgaaauguauuggauauccaaugggacuggcaacauuguagcaagcgugaacaugguaagucguuuguuacuaaaucguuuuacuaugacucauagacgaccuacaauugaaaaagauguagauuugggagcagguacgaggcacguaaacgcggaaccagaaacucccaacauggauguuauaggggaacgaaucaaaaggaucaaagaggagcauaauaguaccuggcauuaugaugaugaaaauccguauaagacuugggcauaucauggaucguaugaaguaaaagccaccgguucugcuaguucuaugauaaaugguguaguaaaguuauugacaaaaccaugggacguaguaccgaugguuacacagauggcuaugacagacacaacaccauucggucagcaaagaguauucaaggaaaaagucgauacuagaaccccaaggucaaugcccgggacuaggaggguaauggagauaacagcugaauggcuguggcgcaccuuaggaagaaacaagaaaccuagacucugcacuagagaagaauuuacaaagaaaguuagaacuaaugccgcgaugggagcuguauuuaccgaagaaaaucaaugggauagcgcuaaagcugccguggaggaugaagauuuuuggaagcuaguagauagggaacgugaacuacauaaacucggaaaguguggaucaugcguuuauaauaugauggguaaacgagagaagaaacuaggagaauuuggaaaagcaaaaggaucgagagcaauaugguauauguggcugggggcuagauaucuagaguucgaagcgcuuggauucuugaacgaagaucacugguucuccagggagaacaguuauagcgguguagagggugaaggucuacacaaguuaggcuacauuuuacgggauauaucaaagauuccaggaggagcuauguacgcagaugacaccgccggaugggacacccggauuaccgaagacgaucuacauaaugaagagaaaauuacgcagcaaauggacccggaacacagacaacuggcaaaugcaaucuucaaauuaacuuaucaaaauaaaguaguaaaaguccaaagaccgacgccuacgggcaccguuauggauauaauaucucguaaagaccagcguggcaguggucaaguaggaacguauggucugaauacuuucaccaauauggaagcacaacugauacgacaaauggagggagaaggaguauugaguaaagcugauuuggagaacccucauuuaccggagaagaaaauaacucaaugguuagaaacuaaagggguggaaagguuaaagcguauggcaauaucaggugaugacugugucguaaaaccuauugaugacagguuugcgaaugcauuauuagcguuaaaugauauggguaaagucagaaaggauauuccccaguggcaaccguccaagggauggcaugacuggcagcaaguacccuucuguucacaucauuuucaugaauuaauaaugaaggacggaagaaaacucguaguacccuguagaccucaggaugaauuaauaggcagggcaagaaucagucaaggagccgguuggucuuuacgcgagacagcaugccuugguaaagcguacgcacaaauguggucauuaauguauuuccaccggcgcgaucuaagguuagccagcaacgcaauuugcucggcaguaccaguccacuggguaccaacgagucgaacaaccuggaguauacaugcacaucaccaauggaugaccacagaggauaugcucacuguuuggaaccgcgucuggauugaggauaauccuuggauggaagacaaaacgcccguaacaacaugggaaaacguacccuaccuugggaagcgugaagaucaauggugcgguucauugauuggcuuaacaagccgggcaacuugggcacagaauauacccacagcaauacagcaagucagaagucugaucgguaaugaggaguucuuagacuacaugcccucaaugaaacgauuuagaaaagaagaagagagugagggugcaauuugguga

SEQ ID NO: 23447 - RNA, 9873 nt, Artificial Sequence
  derived and/or modified CDS sequence (opt6) from DENV-3__FJ850111__SS-prME
acuuccuuaugucucaugaugauacuuccugcagcguuggcauuucauuugacauccagagauggagaaccuagaaugaucguugguaaaaaugaaagaggaaaaucauuauuauuuaaaacggccagcggaauaaauauguguacuuugauagcaauggaucucggagaaaugugugaugacacaguaaccuauaaauguccucauaucacagaaguagaaccagaagauauugauugcugguguaaccuuacaucgacgugggucacuuaugggacaugcaaucaagcaggcgaacaucgaagagauaaaaggaguguggccuuggcaccgcacguuggaaugggauuagacacacguacccaaacauggauguccgcagaaggagcguggcgucaaguagaaaaaguagaaacuugggcccuuagacauccuggauuuaccauuuuggcguuauuccuugcacauuacauaggaacgagcuuaacgcaaaaagucguuaucuuuauucucuugauguuaguuacgccgucaaugacuaugagaugcguagggguaggaaacagagacuucgucgaagggcucuccggagcgacauggguagauguagugcucgaacauggagggugcguaacaacaauggcgaaaaacaaaccaacauuagauauugagcuccagaaaacggaagcaacccaauuggcaacauuacgaaaacuaugcaucgaggguaaaauaacaaauauuacuacugauagcagaugccccacccaaggagaagccgucuuacccgaagaacaagaccaaaacuauguauguaaacacacuuauguagauagggggugggggaauggaugcgguuuguucggcaagggaucauuaguaacuugugcuaaauuccaauguuuagaaccaauagaaggcaaaguaguucaguaugaaaauuuaaaauacacugugauuauaacggugcauacuggugaucaacaucagguaggaaacgaaacgcaaggaguaacagcagaaauuacgccgcaagcaaguacuaccgaagccauauuaccggaauauggcacucuaggccucgaauguagcccaagaacuggccucgacuucaaugaaaugauauuacuaaccaugaaaaacaaggcuuggaugguacacagacagugguucuuugauuuaccccuucccuggacauccggagcuacuacagagacgccuacuuggaaccgaaaagaacuccuuguaacauuuaagaacgcucaugcgaagaaacaagaggucgucguccucggaucucaggaaggagcaaugcauacggcuuuaacaggagcuacagaaauacaaaacuccggcgguacgucuauuuuugcagggcaucucaaaugccggcuaaaaauggauaaauuggaacuaaaaggcaugucauacgcaauguguacgaacacauucguucucaagaaagaaguuagcgaaacacagcacggaacaauccuaauuaaaguagaguacaaaggggaagacguucccugcaaaauaccauucucaacagaagacggucagggaaaagcacauaacggaagguugauaacggcaaaccccguaguuacuaagaaagaagaaccuguuaauauagaagcggagccgccuuuuggugaauccaacauuguaauaggaauuggagauaacagccucaaaaucaacugguacaagaaagggucaucgaucggaaaaauguuugaagccacagcacgaggagcaagaagaauggcaauacuaggagacaccgccugggacuucgguucagucgggggaguucuuaauucucuugguaaaaugguccaccagauauucggguccgcauauacugcucuuuucuccggggucucuugggugaugaaaauuggaauagguguuuuauuaacauggauuggauuaaacaguaaaaacacauccauguccuuuucaugcauagcuauaggaauaauaacucucuaucugggagccgucguccaagcugauacagguugcguuaucaauuggaagggaaaagaauugaagugcgguucgggaaucuucguuaccaaugagguucacacuuggacugagcaguacaaauuucaagcagacucaccuaaacgccuugcuaccgcaauagcuggugcaugggagaauggcguauguggaauaagaaguacuacgcgcauggagaauuuacucuggaaacagauugcaaacgaacuuaauuauauacugugggagaauaauaucaaacucacuguuguaguaggagacauaauaggaguauuagagcaagguaaaagaacacuaacgccacagccgauggaacucaaauauaguuggaaaaccuggggaaaagcacguauaguuacggcagaaacucaaaauucaucuuuuauaauagauggaccaaauacuccagaauguccaaauacaucuagagcguggaauguaugggaaguagaagacuacgguuuuggaguuuucacaacuaauauuugguuaaaacugcgugagguguauacucaauuaugugaucauagguuaaugagugcagcgguaaaagaugaaagagcaguucacgccgauauggguuauuggauagaaagucagaaaaauggguccuggaagcuagagaaagcaagucuaauugaaguaaaaacuuguaccuggccaaagucacauacucuauggaguaacggcguacuagaauccgauaugauaauaccaaagaguuuggcaggaccaauaucucaacauaauuaucguccgggcuaucacacacaaacagccggaccguggcaccuagggaaguuggaacuagauuuuaauuacugugaagggacuaccguuguaauaacagaaaauugugguacgagagguccuucacuuagaacgacaacaguuucugguaaauugauacaugaauggugcugcagauccuguacucucccuccacuaagauauaugggagaagauggcuguugguauggaauggaaauacgaccgauuuccgaaaaagaagaaaauaugguaaaaagccuaguaucagccgguaguggugaaguugauaacuucaccaugggcguguuaugccuugccauacuauuugaggaaguuaugcgaggcaaauucgguaagaaacauaugauagcugguguauuuuucaccuuuguucuauuacugaguggacagauuacuuggagagauauggcucauacauugauuaugaucggauccaaugccacagaccguaugggaauggguguaaccuauuuagcguuaauagcaacguuuaaaauacagccauuuuuagcauuaggcuucuuucuaaggaaacucacaucgagagaaaauuugcuguuggguguuggcuuagcaauggcaaccacccuacaacuaccugaagacauagagcagauggcaaauggaaucgcauugggacuuauggccuuaaaguuaauuacacaauucgaaacauaucaguuauggaccgcccuaauuagcuugaccuguaguaacacgauauucacacuaacaguugccuggcgaaccgccaccuuaauacuugccggggugucucuuuugccaguaugccagucgucuucaaugcgaaaaacagauuggcucccaaugacugucgccgcuaugggcguaccuccucuaccauuauuuauauuuucauuaaaagacacauuaaagagacguuccuggcccuugaacgaaggcgugauggcugucggccucgugucuauccuagcgucaagucucuuaaggaacgacguuccgauggcggguccacugguagccggcggcuuacucauagccuguuacgucauaacugguacaucagcugauuuaacgguagaaaaagcugcggauguaacgugggaggaggaggcggaacaaaccggagugucacacaacuugaugaucacaguagaugacgauggaacaaugagaauaaaagacgaugaaacagaaaacauucuaacuguguuacuaaagaccgcacuccuaauuguuucggguauauuccccuacagcauuccggccacacucuugguuuggcacacuuggcaaaaacaaacccaacgaucgggagucuugugggacguaccaaguccuccagaaacucagaaagcagagcuagaagagggaguauacagaauuaaacaacaaggaauauucggaaaaacucaaguagguguaggaguacaaaaagaagguguuuuucacacuauguggcauguaacaagaggagccguguuaacauauaacgguaaacgauuagagccuaacugggcaucugugaagaaagaccuuauaucuuauggggguggguggagacucagugcucaauggcaaaaaggagaagagguccaagucaucgcuguugaaccaggaaagaacccgaaaaauuuccaaaccaugccugguacuuuucagacuacuacaggggaaauaggagcuauugcgcuagacuuuaaacccggaacgucagguaguccuauuauaaauagagaaggaaaagucguaggguuauacgguaacggugucgucacuaaaaaugggggauauguaaguggaauugcacagacaaaugcggaaccagacgggcccacgccagaauuagaagaagagauguucaaaaagcguaauuugacuauaauggacuugcaucccgguagugguaagacacgaaaauaccuucccgcgauagucagggaggcgaucaaacgaagacuaagaacacucauauuagcucccacaagaguaguagccgccgagauggaagaagcacucaagggucugccuauacguuaucagacaaccgccacaaaauccgaacacacaggacgugaaauaguagacuuaaugugucaugcaacguucacaaugagacuuuuaucaccgguccgugucccuaauuacaauuuaaucaucauggaugaagcucauuuuacugacccagccagcauagcagcaagagguuacaucucuaccaggguugguaugggagaagcagccgcaauuuuuaugacugcaacuccaccuggaaccgcugaugcauucccacaaucuaaugcccccauucaagaugaagagagagacauccccgaacgaucguggaacucggguaaugaauggauaacggacuuugcgggaaagacaguuugguuuguuccgucuauaaaagcgggcaacgauaucgcaaacuguuuaaggaaaaauggaaagaaaguaauucaacuaucacguaaaacguuugauacugaauaccagaaaacgaaacucaacgacugggacuucguaguuacaacagauauauccgaaaugggugcgaauuuuaaagcugaucgugugauugauccacgacguugucuaaaaccaguaauacucacugacgggccggaacguguaauauuagcagguccaaugccggucacagcggcaagugccgcucagagaaggggaaggguaggccguaauccgcaaaaagaaaaugaccaguauauauucacagggcaaccuuuaaacaaugaugaggaucaugcccacuggacagaggcaaaaaugcuauuggauaauauuaacacgcccgaaggcauaaucccagcacuguucgaaccggaacgugagaaaagugcagcuauugacggagaauauaggcugaaaggagagucacgcaaaacauucgucgaacuaaugcgucgcggcgaucuacccguauggcucgcacauaagguugcuuccgaaggaauuaaguauacagauagaaagugguguuuugacgggcaacggaauaaccaaauacuugaagaaaauauggauguagaaauauggacaaaagaaggugagaagaagaaauugagaccuagaugguuggacgcacgcacauacagcgauccacuggcucuuaaagaauuuaaagacuuugcagcaggacguaaaucgaucgcguuagaucuuguaacugaaauaggccgaguaccuacacauuuagcacaucgcacuagaaaugcacuugacaauuuggucaugcuacauacgucugaacauggagggaaggcguaccggcacgcgguugaagaacugccagaaacuauggaaacguuacuccuauuaggacucaugauuuuacuaacagguggagcuaugcuauuuuuaauaucaggaaaaggcauugguaaaacaaguaucggcuugauuugcguuauagcaucuucggggaugcuauggauggcagagaucccccuucaguggauagcaucagcuauaguucucgaguucuuuaugaugguccuauuaauaccagaaccagaaaaacaaagaacaccacaagauaaucaacucgcuuacguuguuauugguauauuaaccuuagcugcgauuaucgccgcuaaugaaaugggccuauuagaaacuacuaagcgggaucuggggauguccaaagaaccagggguaguaagcccaacuucuuaucucgauguugacuuacauccagcgucagcauggacuuuauacgccgucgcgacaacaguaaucacaccuaugcuuaggcauacaauagaaaacagcacagccaacgucucucuagcugcuauugcuaaccaggcuguaguacuaaugggcuuggauaaaggguggccaaucucuaaaauggacuugggaguacccuugcuagcccuaggaugcuacagccagguuaaucccuugacauugaccgccgcagucuuacuuuugauaacucacuacgcuaucauaggaccagggcuucaagcaaaagcaacgcgugaagcccagaaacgcacagccgcggggauaaugaaaaauccgacaguagacggaaucaugacuauagaccuagauccaguaauauacgacaguaaauuugaaaaacaauuggggcaaguuauguuauuagugcucugugccguacaguuauuacuaaugagaacaucuugggcacugugugaagcauuaacacucgcuacuggaccuauaacuacuuugugggaaggaaguccggguaaauucuggaauacaaccauagcagucucaauggcgaauauuuuucgcggaucauacuuggcgggagcaggauuggcuuuuucuaucaugaaaucggugggaaccggaaaacgagggacaggaucucagggagaaacacuaggcgaaaaguggaagaagaaauuaaaccaauuaaguagaaaagaauuugaccuguauaagaaaucaggcauuacugaaguugacagaaccgaagcuaaagagggucugaaaagaggggaaaucacacaccaugccguuucucgagggagugcuaaauugcaaugguucguagagagaaauaugguuauaccagaaggaagggucaucgaccucggauguggacgugggggauggucauauuauugcgcugguuuaaagaaagucaccgaggugcgaggauauacuaaaggaggacccgggcacgaagaaccaguaccuauguccacauacggcuggaauaucguaaaauuaaugucaggcaaagauguauuuuacuuaccuccagaaaaaugcgauacucuuuuaugcgauauaggugaaagcagcccuucucccacaguugaagagucacgaacaauaagagucuugaaaaugguagaaccauggcuaaagaauaaucaguucuguauuaaaguucuaaauccauacaugccagcagucauagaacaucuagaacgcuuacaaagaaaacauggcggaaugcuaguaagaaaucccuugucucgaaacucaacgcacgaaauguacuggauuucuaaugguacuggaaauauaguugcuaguguuaacaugguaaguaggcugcuacucaaccgauucaccaugacgcaccgccgucccacuauugaaaaggacguagacuuaggggcugguacucgucacguaaaugcagagccagaaacgccgaacauggacguuauaggugaacggauaaaacggauaaaagaagaacauaauucuacuuggcauuacgacgacgaaaauccauauaagacuugggcguaucacggcucguacgaaguaaaagcaaccgguucagccagcucaaugauaaaugggguggucaagcuacuaacaaaaccaugggauguaguaccaaugguuauucaaauggcaaugacggacacaacaccuuuuggacaacaacguguauucaaagagaaaguagacacuagaaccccgaggaguaugccuggcacgcgcagggucauggaaauaaccgccgaaugguuguggcguacacuaggacgaaauaagaaaccaaggcuuuguacacgagaagaauuuacaaagaaaguacgcacaaaugcugcaaugggggccguauucaccgaagaaaaccaaugggacagcgcgaaagcugcuguggaagaugaagauuucuggaaauuagucgauagagaaagagaacuacauaagcugggaaaaugugggagcuguguauacaauaugaugggcaagagagagaagaaacugggugaauuuggaaaagcaaaaggcucucgugcgauuugguauaugugguugggcgcaagauauuuagaguuugaagcccuaggauuucuuaaugaggaucauugguuuagcagggaaaauaguuauucaggagucgaaggagaaggacuacauaaauuaggcuauauacuucgugacaucaguaaaauaccagguggagccauguacgccgacgauacagcagggugggauacaaggauaacggaagaugaucuacauaaugaagagaaaauaacgcaacaaauggaccccgaacaucgucaacuugcgaaugcaaucuuuaaacuuaccuaucaaaauaaaguagugaaaguccaacgccccaccccgacaggaacagucauggauauaaucucaagaaaggaucaacgaggaagcggccaaguuggcacauacggguuaaauacauuuacuaacauggaagcgcaauuaauaaggcagauggaaggagaaggaguguuaucuaaggccgaccuggagaauccccauuuaccagaaaagaaaauaacacaaugguuagagacgaaaggggucgaacgacugaagagaauggcaaucucaggagacgauuguguagugaaaccgauagacgaucgguuugccaacgcucuacuggccuuaaaugacaugggaaaaguacgaaaagacauaccacaauggcagccaaguaaaggguggcaugacuggcaacagguaccuuuuugcucacaccauuuucaugagcuaauuaugaaggacggccgaaaauuaguuguuccaugucggccacaagacgaauuaauuggacgagcacgcauaucucaaggagccgguuggucgcugcgagaaacagccugucuaggaaaagcauaugcucagauguggagccucauguacuuucauaggagggacuuacgacuagcuagcaaugcgauuuguucugcggugccaguucauuggguuccuacaaguagaacaacauggucaauacaugcacaucaucaguggaugacaaccgaagauaugcuaacggucuggaacaggguauggauagaagacaauccauggauggaagacaaaacaccagugacaacuugggaaaacgugccauaccucgguaagagagaagaucaauggugugguaguuuaauaggccuuaccagucgagccacgugggcacaaaauauaccaacagcgauucaacaagugagaagccuuauaggaaaugaggaguuccuugauuauaugccaucaaugaagagauuuagaaaagaagaagaaucggaaggugcgaucugguag

SEQ ID NO: 23448 - RNA, 9873 nt, Artificial Sequence
  derived and/or modified CDS sequence (opt6) from DENV-3__KF955486__SS-prME
acuucacuaugcuuaaugaugauacuaccagcugcacuagcauuucacuuaacuucucgcgacggagaacccagaaugauaguaggcaaaaaugaacgaggaaaauccuuauuauucaaaacugcgagcggaauaaacauguguacacuuauagcaauggauuuaggcgagaugugcgaugauacaguaacuuacaaaugcccucauauaaccgaaguagaaccagaagauauagacuguuggugcaaucuuacaaguacauggguaaccuauggaacgugcaaucaagcaggagaacauagaagggacaaacgaagugucgcauuggcaccgcacguugguaugggauuagacacucgcacucaaacauggaugucagcugaaggcgcauggaggcaaguugaaaaaguggaaacaugggcucugagacacccagguuuuacaauccuggcacucuuuuuagcgcacuacauugggacaucccucacucaaaaagugguaauuuucacauugcuuauguuagucaccccaucaaugaccaugagaugcguaggagucggaaauagagacuucguagaagggcuuagcggggcgacauggguagaugucguauuagagcacggcggcuguguaacuacaauggccaaaaauaaacccacgcuggauauagagcuccagaaaacggaagcaacgcaguuagcaacauugcgcaaacugugcauagaaggaaaaaucacgaacauuaccacagauaguagauguccgacacaaggcgaggcuguacuaccugaggaacaagaccaaaacuaugugugcaaacauacauauguagaucgaggaugggggaauggaugcggucuauucgguaaaggcucucucguaacaugcgcuaaauuucaaugccuugaaccuauagagggaaaaguaguucaguaugaaaaccucaaauauacuguaauaaucacgguacacacuggagaucagcaucagguaggcaaugaaacucaaggagucaccgcagaaauaacuccucaggcaaguacgacggaagcgauauuaccagaauacggaacuuuggguuuggaaugcuccccaagaacaggacuagauuucaaugagaugauccuuuuaaccaugaaaaauaaggcuuggaugguacaccggcaaugguuuuucgaucuuccguugccuuggacaagcggagcaaccacagaaacaccuacauggaaccgaaaagaacucuuaguaaccuuuaaaaaugcacacgccaagaaacaagaaguaguaguacuuggaagccaagaaggagcaaugcauacggcuuuaacaggagcuacggaaauacaaaauucuggugggaccucaauauuugcuggucaccugaaauguagauuaaaaauggacaaacuugaacuaaaagguaugucuuaugcaauguguacaaauacauucguacuaaagaaagaagugucagaaacacaacauggcacuauuuuaauaaaaguagaguacaaaggcgaggauguccccugcaaaauuccguucagcaccgaggauggacaaggaaaagcccauaauggucgucuuaucacugcaaacccaguuguuacgaagaaagaggaaccaguuaacauugaagcggaaccaccguuuggagagucaaauauagucauagggauuggagauaaugcuuugaaaaucaauugguacaagaaagguucgucaauagguaaaauguuugaggccacagcuagaggagcgaggcgaauggccaucuuaggggauacugcuugggacuucgguaguguaggagggguuuuaaauucacuugggaaaaugguacaucaaaucuucggaucggcauauacugccuuauuuagugguguuagcuggguuaugaaaauaggaauuggaguccuuuugacguggauuggcuuaaacucgaaaaauacaagcaugucauucuccugcauagccaucgggauuauaacacuauacuuaggagcugucguacaagccgauauggguugugugauaaauuggaaaggaaaagagcugaaaugugguaguggaauuuuuguaaccaacgaaguacauacauggacggagcaauacaaauuccaagcugauucaccgaaacgucuugcgacagccaucgcaggagcaugggagaacgguguaugugggauaaggaguaccacacgaauggaaaauuuguuguggaaacaaauugcgaacgaauuaaauuauauacuuugggagaauaauauaaaauuaacuguaguagugggagauauuauagguguacuggagcaagguaagagaacauuaaccccacaaccaauggaauuaaaauacagcuggaaaacauggggaaaagcaaagaucguuacugcggaaacucaaaauagcucauucauuauagacgguccaaauacgccugaauguccaucugcaucuagagcauggaauguaugggaagucgaagacuauggauuugguguuuuuaccacgaacauuuggcuuaaauuaagagaaguauauacacaauugugugaucauagguuaaugagcgcagcgguaaaagacgaacgcgcaguccaugcagacaugggauauuggauugaaucacagaaaaauggaucuuggaaguuagaaaaagcaaguuugauugaaguaaaaacgugcacauggccaaaaagccacacuuuauggucgaacgguguacuagagucagauaugauuauacccaaaucucuugcuggcccgauaucucaacauaauuauagacccggauaucauacccaaaccgccggaccauggcacuuagggaaguuagaacuagauuucaauuauugcgaagguacaacagucgucaucaccgaaaauugcggaacaaggggacccucacuucgaacgacuacaguuucgggaaaauuaauacaugaaugguguugucgcagcuguaccuuaccacccuuacgcuacaugggagaggauggauguugguaugguauggagauuaggccaauaagcgaaaaagaagaaaacaugguaaaauccuuagugagcgcagggaguggagagguggauaauuuuacgauggguguacuaugucuagcaauauuauuugaagaaguaaugagagguaaauuuggcaagaaacacaugauugcaggaguauucuuuacuuuuguucuuuuacuaucuggucaaauaacauggagagacauggcacacacacucauaaugauaggcagcaaugcaagugacagaaugggaaugggagucacguaucuugcacugauagcaacuuuuaaaauucaaccguuucuagcauuaggauucuuuuuaagaaaacuuacgagccgugaaaauuuauuacuagguguagguuuagccauggcaacuacauuacagcuuccagaggauauagaacaaauggccaauggcauugcauugggacuaauggcauugaaacuaaucacacaauucgagacauaccaguuguggaccgcucuuauuucauuaacgugcucuaauacuauauuuacgcucacaguggccuggagaacugcaacgcuaauuuuagccggagucaguuuacucccggucugucaauccaguucgaugcggaagaccgauugguuaccaaugacgguugcagcaaugggagugccgcccuuaccauuauucauuuucagccuaaaagacacccucaagaggcgaaguuggccucuaaaugaaggaguaauggcggugggauuagucucgaucuuagcuagcucgcuuuuacgcaaugacguuccgauggcagguccauuaguggcgggaggauuauuaaucgcaugcuacguaauuacugguacgagugcggaucuuaccgucgaaaaggcagccgacguuacgugggaggaagaagcggaacaaacuggagucucacacaaucuaaugauaacaguugacgaugaugggaccaugagaauaaaagaugaugaaacagaaaauauuuuaacaguuuuacuuaaaacggcccuccuuauuguuagcggaauuuuuccauacagcaucccagcgacguugcugguguggcacacguggcaaaagcagacgcaaagaucggguguacuaugggauguccccucgccacccgaaacucaaaaagcagagcuggaagaaggcguauacagaauaaaacagcaaggcaucuucgguaaaacucaaguuggaguuggcguccaaaaagaggguguauuccacacaauguggcauguaacgagaggcgccguucuaacauacaaugguaaacgucucgaaccgaacugggcaucaguuaagaaagacuuaauaucauacgguggaggcuggagacuuucggcacaauggcaaaaaggagaagagguucagguaaucgcgguagagccaggcaaaaaccccaaaaauuuccaaacgaugccugguacauuucaaacuacgacuggagaaauaggagcaauagcuuuagacuuuaaaccagguacaucugguucucccauuauuaaucgugaagggaagguuguaggauuguauggcaacggcgugguaacuaaaaauggaggguaugucagugggauugcucaaaccaaugcugagccugacgguccuacccccgaacuagaagaggaaauguucaagaaaagaaacuuaacuauaauggauuuacauccugggagugggaagacacgaaaauaucuuccagcaauugugagagaggccauaaagcgacgcuugcggacuuuaauauuagcaccaacccgaguuguagcugcugaaauggaagaggcuuuaaaaggucuucccauuagauaccaaacaacagcuacuaagucugaacacacuggaagggagauuguagaucugaugugucacgcaaccuucaccaugcgacuacucucaccuguucguguaccgaacuauaaucuaauaauaauggacgaagcacacuucaccgauccugcgucuaucgcagcccgcgguuauaucucgacucgaguaggaaugggugaggcagcggccauauuuaugacggccacuccuccugguacugccgaugccuuuccccaauccaacgcuccaauacaagaugaggagaaagauauucccgaaagaucauggaacuccgggaaugaauggauaacagauuuugcagguaaaaccguuugguucguaccauccauuaaagcaggaaaugauauagcgaacugucuucgaaagaauggaaagaaagucauacagcucagccguaaaacuuuugauacagaauaucagaaaacgaaauuaaacgacugggauuucguagugacaaccgauauaucagagaugggggcaaauuucaaagccgacagagucauagaucccaggagaugucuuaaaccggugauauuaacagacggaccagaacggguaauauuagcagggccuaugccugugaccgccgcgagugcugcucaaagaagaggucgaguugggcgaaauccucaaaaagaaaaugaccaauauauauuuacagggcaaccacuaaauaaugacgaggaccacgcucacuggacagaagcuaagaugcuauuagacaauauaaauaccccggaagguauaauuccagcgcuauucgaaccagaaagagaaaaaucagcagccauugacggcgaauauaggcuaaaaggagagaguagaaagacauucgucgaauuaaugcgcaggggagaucuacccguuugguuagcacauaaaguagcaucggaaggaauaaaauauacagauagaaaaugguguuuugauggccagagaaauaaucaaauucuagaagaaaauauggacguagaaauuuggacuaaagaaggcgagaaaaagaaacuucgcccgagauggcuagaugcacgaaccuacagcgacccccuagcgcuuaaagaauuuaaagauuucgccgcgggaagaaagaguaucgcuuuagacuuaguaacagaaauagguaggguaccaacacaucuugcucaccgaacacggaaugcgcuggauaaccucguaaugcuacacacuagcgagcacggaggaaaggcuuacagacacgcaguagaagaacucccagaaaccauggagacgcugcuacuacucggccuaaugauuuuacuaaccgguggcgccaugcuauuccugauuaguggcaaaggaauugggaaaaccaguauaggucugauuugcguaauagcauccuccggaaugcucuggauggcagagauuccauugcaguggauugccuccgcuauugugcucgaauuuuucaugaugguucuauugaucccugaacccgaaaaacagagaacaccgcaagauaaccagcuugcguacgucguaauaggaauuuuaacauuagcagccauuauagcggcuaacgaaaugggucuauuggagaccacgaaacgugaucuuggaauguccaaagaaccagggguugucagucccacaaguuaccuagauguagaccuccauccugcaucagcuuggacacucuaugcaguagcaacgacagugaucacaccgaugcugcgacauacaaucgaaaauucaacggcaaacguaagucuggcggcuauugcaaaucaagccguaguauugaugggacuagauaaagguuggcccaucuccaaaauggaucugggagugccgcuccuugcccuagggugcuauagucagguaaacccacugacacugacggcagcugugcuccucuuaauaacacacuacgcuauaauagguccgggauuacaagcuaaagcaacaagggaagcacaaaaacguacggcggccggaauuaugaaaaauccuacaguagaugggaucaugacuauagaucuggauccggucauuuacgacucaaaguuugaaaagcaauuaggucaaguuaugcuacuuguucuaugcgcaguacaacuacuacuaaugaggacaucaugggccuuaugugaagcucuaacgcuagcaacaggaccgauuacuacauugugggagggaaguccaggcaaguuuuggaauacaacaauagcugugagcauggcuaauauuuucagggguucauaucuagcaggggcgggacuagcauuuucuauuaugaaaaguguaggaacggguaaacgcgguacaggaucacagggagaaacacugggcgagaaauggaagaagaaacugaaucaacuuucaaggaaagaauuugacuuguacaagaaaaguggaauuacagagguagauaggacagaggcuaaagaaggguuaaaacguggcgaaaucacacaucacgcggucucacgagguucagcaaaauuacaaugguuuguagaaagaaauaugguuauuccggaaggaagagugaucgauuugggauguggacggggaggcuggucauauuauugcgcagguuugaagaaaguaaccgaaguaaggggauacacaaaagguggaccuggucaugaagaacccguaccaauguccacuuacggauggaauauagugaaacuuaugagugggaaggacguauuuuauuuacccccugagaaaugugacacguuauuaugugauaucggagaaaguaguccgucaccaacuguggaagaaucuagaacaauaagaguccugaaaaugguugagccuuggcucaaaaacaaucaauuuuguauuaaaguucuaaauccuuacaugccuaccguuauagaacacuuagaaaggcuacaaaggaagcauggagguauguuaguucgcaacccuuuaagcaggaauaguacccacgaaauguauuggauaucgaauggaacuggaaacaucguagcaagcguaaacauggugucacgauuguuauugaacagguuuacuaugacucaccgaaggccuacaauugaaaaagacguagaccuaggggcugguacacgacaugugaaugccgaaccagaaacaccaaacauggacguaauaggagagagaauuaaaaggauuaaggaggagcacaacagcacuuggcauuaugaugacgaaaaucccuauaagacaugggcguaccacgguucuuacgaaguuaaagcaacugguucugcaaguaguaugauaaauggaguagucaaauuacuuacuaaaccaugggauguagucccaaugguuacacaaauggcaaugacagacacuacaccauucggacaacaacgagucuuuaaggaaaaaguggacacccgcacacccaggucuaugccugguacaaggcgggucaugggaauaacagcggagugguuauggagaacacuuggacgaaauaagaaaccacgacuaugcacaagggaagaguuuaccaagaaaguacgaacgaaugcugcgaugggagcggucuucacugaagaaaaucaaugggauagcgcaaaagcugccguggaagaugaggacuucuggaaacuuguugauagagagcgggaguuacauaagcugggcaaaugcggaucguguguauauaauaugaugggaaaaagagagaagaaauuaggcgaauuuggaaaggcaaaaggaagccgagcuauaugguauauguggcuaggcgcuagauaucuggaguucgaagcacuuggauuccuaaacgaagaccauugguucucgagagaaaauucuuauucaggaguagagggagaagggcuacacaaauuaggauacauucucagagacauaagcaaaauaccagguggcgcgauguacgcagaugacacagcggggugggauacgcgaauuacugaagaugaccuucacaacgaagagaaaauuacucagcaaauggacccugaacaucgucaacuagcgaaugcaaucuuuaagcugacguaccagaacaaaguaguaaaaguacaacgcccuaccccuacggggacuguaauggauauuauuuccagaaaagaucaacgggguucuggucaaguaggcaccuauggacuuaacacauuuacaaacauggaagcacaacuaauaaggcaaauggagggcgagggcguauuaagcaaagcggaucuugagaauccucaucuuccagaaaagaaaauaacacaauggcucgaaacuaaaggcguagaacgcuuaaaaaggauggccauauccggagacgacugcgucguaaaaccuauagaugauagauuugcaaaugcccuacuagcacuaaacgacaugggaaaaguaagaaaagauauaccgcaauggcagcccucuaagggauggcaugacuggcaacaaguacccuuuuguucacaccacuuucaugaauugauaaugaaagacggucgaaagcuaguuguaccauguagaccucaggacgaauuaauugggagagcgaggauuagccaaggcgcaggauggagccuuagggagacggcuugccuaggaaaagcauaugcacaaauguggucucugauguauuuucaucgccgagauuuaagauuagccaguaaugccauauguuccgcaguaccugugcacuggguuccaacguccagaacuacguggagcauucacgcccaucaccaauggaugacgaccgaagauaugcuuacgguguggaacagaguauggauagaagauaacccauggauggaagauaaaaccccggucaccacaugggagaacguccccuaccucgggaagcgagaagaucaaugguguggaaguuuaauaggacuaacaucccgagcgacuugggcucaaaacauccccaccgccauccaacaggugagaucauuaaucggaaacgaagaguucuuagauuauaugccaagcaugaaaagauuuagaaaagaagaagaaucugaaggugccauaugguag

SEQ ID NO: 23449 - RNA, 9873 nt, Artificial Sequence
  derived and/or modified CDS sequence (opt6) from DENV-3__FJ898468__SS-prME
accaguuuaugucucaugaugauuuuaccugcugcauuggcauuucauuuaaccagucgggacggggaaccucgaaugauuguggguaaaaaugaacgagggaaaucauuauuguucaaaacugcaagcggaauaaauauguguacuuuaauagcuauggauuuaggugaaaugugugaugacacugucacuuacaaaugcccucauaucacugaaguagaaccagaagauauagauuguugguguaauuuaacaaguacuuggguaacguacggaacauguaaucaagccggugaacaucgacgugauaaacguucaguugcucuagcuccacauguagggaugggauuggauacucggacacaaacuuggaugucagcagaaggggcauggaggcaagucgaaaaaguagagacgugggcacugcgacaucccggcuuuaccauacuagccuuauuucuagcacacuauauugggacgagucuaacacaaaaaguaguuauauuuauccuauuaaugcuaguuacacccucgaugacuaugcgaugugucggaguagguaaccgagacuuuguggaaggccucucuggugcaacguggguugaugugguacuagaacaugguggaugcguaacaacuauggcgaaaaauaaaccuacucuggauauugaauuacagaaaaccgaggcuacacaacucgcaacguugcgaaaacuuuguauugaaggaaaaauuacaaacauaacgacagauagcagaugccccacacaaggggaagcaguacuaccagaagaacaagaucaaaacuaugucuguaaacauacauacguagacagggguuggggcaacggcuguggguuauuuggaaaagguagucuaguaacaugugcgaaauuccaaugucuggaaccuauagaaggaaaaguuguacaauaugagaaccuaaaauacacaguaauaauuacuguacacacaggugaucaacaccaaguaggaaacgagacccagggaguaacugcugaaauaacgccucaagcaucaacaacagaagccauauugccugaauauggaacccucgguuuagaauguucaccacguacuggacuugauuuuaaugaaaugauauuauuaacuaugaaaaacaaagcguggauggugcaucggcaaugguuuuucgauuugcccuuaccuuggaccaguggugcuacgacggaaacuccgacauggaacagaaaagaauuauuaguaacuuuuaaaaacgcacaugccaagaaacaggaaguaguaguucuuggaucccaggagggggcuaugcauaccgcauuaacuggagcgacagagauccagaauagcggaggaacaucaauuuucgccggccauuugaaauguagacugaaaauggacaaacuagagcuaaaagguauguccuaugcaauguguacaaauaccuucguccuaaagaaagaggucagcgaaacacaacaugggacaauacucauaaaaguugaguauaaaggugaagauguaccaugcaaaauuccauuuucgacagaagauggacagggcaaagcucauaacggaagauuaauuacagccaaucccguagucacaaagaaagaggagccuguuaauauagaagcugagccaccauuuggagaaucuaauaucgugaucgggauaggagauaaugcucuuaaaauuaacugguauaagaaagguaguaguauuggaaaaauguuugaagcaacagcacgaggugcaaggcguauggcgauauuaggggauacagcuugggacuucgguagcgucggaggaguauuaaacucacuuggaaaaaugguucaucaaauauuuggaagcgcuuacacugcacuauuuucuggagugagcugggucaugaaaauuggaauagguguuuugcuuacauggauaggccugaacaguaaaaauacaaguaugucauucagcugcauugcaauaggcauaaucaccuuauacuugggggcgguuguacaggcagauauggguugcguaauaaacuggaagggaaaagaacugaaaugcgguuccgguauauucguaacuaaugaaguacauacauggacggaacaauauaaauuccaagcugauucaccaaaacgacuagcgacugcaauagccggagcgugggaaaaugggguuuguggcauacgaucgacaacuagaauggagaauuugcuauggaaacaaauagcuaaugaacuaaacuacauucuuugggagaauaauaucaaacuaacaguagugguuggugaugugauuggaguacuugaacaaggaaaacgaacacuaacaccgcaaccaauggagcuaaaauauuccuggaaaaccuggggcaaagccaaaauugugaccgcugaaacucagaacaguucauucauuauagaugguccuaacaccccagaaugcccuagugcuagcagagcauggaaugugugggaagucgaagacuaugguuuuggaguguuuacuacuaauaucuggcuaaaauuacgcgaaguuuauacgcaguugugugaccauagguuaauguccgcugcagugaaagacgagagggcgguacacgcggacaugggcuacuggauugagucgcagaagaauggaaguuggaaacuggaaaaggcuucccuaauagaaguaaaaacgugcacguggcccaaaucacauacacuauggucgaauggcguccuagagagugacaugauaauaccaaagagccuagcaggacccauuucucagcacaacuacagaccuggauaucauacucagacagccgggccauggcauuuagggaaacuugaauuggauuuuaauuauugugaggguacuaccguuguuauuacggagaauuguggaacccgcgggccuucucuacgaacuacaacaguaucgggaaaauuaauacaugaauggugcugcagaaguugcaccuugccuccacuaagguauaugggagaagacgguuguugguaugguauggaaauucgaccgaucucggagaaagaagagaauaugguuaaaucgcuugucucagcagggucaggggaaguugauaauuuuacuauggguguauuaugccuagcuauucuguucgaagaagucaugagaggaaaauuuggcaagaaacacaugauugcaggagucuucuuuacauuuguuuuauuguuaucaggacaaaucaccuggcgagauauggcacauacauuaauaaugaucgguagcaaugcuagugacaggaugggcauggggguuacauacuuagcccuuauagcgacuuucaaaauacaaccuuuccuagcacucggcuucuuccucaggaaauuaacuucaagagaaaaucuacuuuugggaguugguuuagccauggccacuacccuccaacucccagaagauauagaacaaauggcuaacgggauagcacuaggacuaauggcauuaaaauugauuacacaauuugaaacauaucaacuauggacugcauuaauaucuuugacauguucuaacacgaucuuuacguugacaguugcguggcgaacggcaacacuuauacuagcaggaguaucguuauuaccagugugucagucuagcagcaugcgaaaaaccgauuggcuaccuaugacaguugccgccauggggguaccuccauugccacucuuuauauuuucacuaaaggauacauugaaaagaaggaguuggccacuaaacgagggugugauggcuguaggccuagugaguaucuuggcuucuagccuauuaagaaacgauguaccaauggcuggcccauugguggcuggaggacuuuugaucgcaugcuacguuauaacagggacauccgcagacuugacaguagaaaaagcagccgacguuacuugggaagaagaggcagagcaaacugggguaagccacaaucuuaugaucacagucgaugaugacggaacuaugagaauaaaagaugaugagaccgaaaacauucuaacagucuuacuaaaaacugcauugcugauugugucuggcauauuccccuauagcauaccagcgaccuuauugguuuggcacaccuggcagaaacagacgcaaagaagcgggguauuaugggacguaccaagcccacccgagacgcaaaaagcagaacuggaggagggaguauauagaauuaaacagcaaggcaucuuugggaaaacacaaguugguguaggagugcaaaaagaagguguauuccacacaauguggcacgugacaagaggcgccguacuuaccuacaacgggaagagguuagaaccgaauugggcaagugugaagaaagaucuaauaaguuacggggguggguggagacuuucugcacaguggcaaaaaggagaggaaguacagguaauugcgguugagccagguaagaauccaaagaacuuucaaacaaugccagguacauuucaaaccacuacaggagaaauaggugcaauugcccuugauuuuaagccaggaaccucuggaucgcccauuaucaaucgagaagggaaagucguagggcucuacggaaacggagucguaacgaaaaauggaggauauguauccggaauugcgcaaacaaacgcagaaccugacggaccgacaccagaauuagaagaagagauguuuaagaaaaggaaccuaaccauaauggaccuacauccuggaucuggaaaaacucgaaaguaucugccagccaucguccgggaggcaauuaaaaggagacuaagaacgcuaauccuugcgccuacccgaguaguagccgccgagauggaagaagcauuaaaaggucuuccaauccgguaccaaacaacggcuaccaaaagugaacacacuggaagagaaaucguagaucucaugugccaugcaacauucacgaugaggcuauuaaguccaguacguguuccaaauuauaauuuaauaauaauggaugaagcccauuuuacggaccccgcgucgauugcugcuagaggauauauaaguaccagagucgggaugggcgaggcagcugcgauuuucaugacagcuacaccacccggaacugcugaugcauuuccucaaucuaaugcgcccauacaagaugaagaacgagauauuccggaaagguccuggaacucaggaaaugaguggauuacugauuuugcugguaaaacaguaugguuuguaccaaguaucaaagcgggaaaugacauagcuaacugcuuaagaaagaauggaaagaaggugauucaacuaucaaggaaaacuuuugauacagaauaucagaaaacgaaauugaaugauugggauuucguagucacaacugacauaucagagaugggagcaaacuuuaaagcugaucgagugaucgauccuagacguugccuuaagccaguuauccucacggacggaccggaacgcgucauauuggcaggcccuaugccuguaaccgcagcaucugcggcacaaaggagaggaagaguuggccgaaauccacaaaaggaaaaugaccaauacauuuuuacaggucagcccuuaaacaacgacgaggaccacgcccacuggacugaagcuaaaauguugcuugauaacauaaacacgccugaaggcauuauaccugcacuuuucgagccugagagagaaaagagugcagcaauugacggugaauacagacuaaaaggagagagcagaaaaacauuuguagaguuaaugcgcagaggcgaccugccaguauggcuagcacauaaagucgcaucggaaggaauaaaguacacagacaggaaauggugcuucgauggccaacgaaauaaucaaauuuuagaagaaaauauggauguagaaauuuggacaaaagaaggagagaagaagaaacuaagaccuagaugguuagacgcacguaccuacagcgaucccuuagcguuaaaagaauuuaaagauuucgcugccggccggaaaucaaucgcacuagauuugguuacagaaaucggacgggucccuucacacuuagcucauagaacaagaaacgcacuagauaaucuaguaauguuacauacaucagaacacggaggaaaagccuacagacacgcagucgaagaacuuccagagaccauggagacgcuccuauuauugggccucaugauuuuacuuacuggaggugccaugcuauuccuaauaucagggaaaggaauagggaaaacaaguaucggauuaauaugcguaauagccaguucagggaugcuauggauggccgagaucccccuacaauggauugcgucugcaauaguacuagaguucuuuaugaugguucuacugauuccagaaccagaaaaacaacgcacaccucaagacaaucagcuagcauacgucguaauugguaucuuaacacuugcugcaaucauugccgccaacgaaaugggccuuuuagaaacuaccaagcgagauuuagguaugagcaaggaacccgguguagucucuccaacuucauaccucgauguagauuuacauccagcaagugcauggacucuuuaugcgguagcaacaacaguaauaacacccauguuacgucacacaauagaaaacucaacugccaacgugucacuugcggcgauugcaaaucaagcuguugucuuaaugggccuagauaaagguuggccaauuaguaagauggacuuaggugugcccuuacuagcuuuagguuguuacagccaaguaaacccuuugacacuuacggcagcuguuuugcugcugauaacccauuaugcuauaauagggcccggauuacaagcaaaggcuacacgagaagcccagaaaagaaccgcggcuggcaucaugaaaaacccgacaguugauggcauaaugaccauagauuuagauccagucauauaugauagcaaguuugagaaacaacuagggcagguaaugcuccucguccugugcgcaguucaacuacuuuuaaugcggacgagcugggcauuaugugaggcuuugacguuggccacgggaccgauuacuacacuaugggaaggaagcccaggaaaauuuuggaacacuaccauagcuguuaguauggcgaauauauuucggggaagcuaucuagcuggggcgggacuugcauuuaguaucaugaaaucgguuggaacuggcaagcggggaaccgggucacaaggugaaacacuaggcgaaaaauggaaaaagaagcuaaaucaacuuucuagaaaagaauuugaccuguacaagaaaucaggcaucacugaagucgauagaacagaagcuaaagagggcuuaaagcguggggaaaucacucaucacgccgugucgagggguucagccaaacuacaaugguuuguggaacguaacaugguaaucccugaggguaggguaauagauuugggauguggccgagguggauggaguuauuauugcgcuggccuaaagaaaguuaccgaaguuaggggcuacacaaaagguggccccgggcaugaagaaccagucccaaugucuaccuacggauggaauauugucaaacuaaugucaggaaaagauguauucuacuugccaccugaaaagugugauacuuuguuaugcgacauuggggaauccucuccuuccccaaccguugaggagaguagaacaauucguguacuuaaaaugguagagccaugguuaaagaacaaccaauuuugcauaaaaguacugaacccauauaugccaacgguaguagagcauuuagaaagauuacagcgaaagcaugguggcauguuagucagaaacccucuaucacguaacagcacgcacgaaauguacuggauuuccaaugggacugguaauauugucgcaaguguuaacauggucagucgucuacugcuaaauagauucacuaugacacaccgucgaccgacuaucgaaaaagacgucgauuuaggugcggggacaaggcauguuaaugcggaaccagaaacacccaacauggacgugauuggagaacgcauuaaacgaauaaaagaggaacauaauagcaccuggcauuaugaugaugagaauccuuauaaaacuugggcuuaccaugguucauacgaagugaaagcaacaggaucugcaaguucaaugaucaauggaguaguuaaguuacuaacuaaacccugggauguuguacccaugguaacacaaauggccaugacagauacaacuccauuuggucaacaaaggguauucaaggaaaagguggacacucguacaccgcgauccaugccuggaacgagacgggucaugggcauaacugccgaauggcucuggcgaacacuaggaagaaauaagaaaccaagacuguguacaagggaagaguucacuaagaaaguaagaacgaacgcagcaaugggugcuguauuuacugaagaaaaucaaugggauucagcuaaagcggcgguugaagacgaagacuuuuggaaacuuguagaucgagaaagagaacuacauaaacuggggaaaugcggaagcuguguauauaauaugauggggaaaagggagaaaaaguuaggggaauuuggaaaagcgaaaggcucaagggcgauuugguauaugugguugggugcuagauaucuagaauuugaagcauuaggguuucugaaugaggaucauugguuuuccagagagaauaguuacucaggcguugaaggcgaaggguuacauaaguuaggauauauacuuagggacauaucuaagauaccgggaggggccauguacgccgaugauacggcaggcugggacacccgaauuacugaagacgauuuacauaaugaggagaaaauuacgcagcaaauggauccagaacaccgacagcuagccaaugcgauauuuaaacugacauaucaaaacaaaguagucaaagugcagcguccaacuccuacaggcacaguaauggacaucauaucaagaaaagaccaaagaggaucaggacaaguaggaaccuauggauugaauacauucacuaauauggaagcccaacucauacgucaaauggagggggaaggagugcuaucuaaagccgacuuagaaaauccaagauugcccgagaagaaaaucacgcaauggcuagagacuaaaggagucgagagacugaaaagaauggcaauaagcggggaugauuguguagucaagcccauagaugaccgauucgcaaaugcuuuacuagcauuaaacgacauggguaaagugagaaaagacauaccccaguggcaaccuucuaaaggauggcaugauuggcaacaaguaccuuuuuguagucaucacuuucaugagcucauaaugaaggacggcagaaaacuugucguuccguguagaccccaagaugaacuaauaggcagagcaagaauaucucaaggugcaggauggagucuaagggagaccgcaugucucgguaaagcauaugcgcaaauguggaguuuaauguauuuucauaggagggauuuaagauuagccucgaacgccauauguagugcuguuccgguacacuggguuccgacuucccguacaacuuggagcauucacgcgcaucaucaauggaugacaacggaagacaugcuuaccguauggaauaggguguggauagaggacaauccauggauggaagauaaaacccccgucacgaccugggagaaugucccuuaucucggaaaacgagaagaucaaugguguggcagucuaauaggguuaacuucuagagcaacuugggcucaaaauaucccuacagcgauacaacaagucagaucacuuauaggcaacgaagaauuuuuagauuauaugcccagcaugaagcguuuuagaaaagaagaagagucagaaggggcuauaugguaa

SEQ ID NO: 23450 - RNA, 9873 nt, Artificial Sequence
  derived and/or modified CDS sequence (opt6) from DENV-3__FJ898469__SS-prME
acaaguuuaugcuuaaugaugauacuuccugcggcacuugcguuucaucuuacgucucgagauggggaaccaaggaugauagucgguaaaaaugaaagagguaaaagucuguuauuuaaaacagcaucagguaucaacaugugcacauuaauagcaauggauuuaggcgaaaugugugaugauaccguaacauauaaauguccucauauaacagaaguugaaccggaagauauagacugcugguguaaucucacaaguaccuggguuacauauggaacuugcaaucaagcgggagagcaucgaagagacaaaaggaguguugcccucgcaccacaugucggaaugggccucgacaccaggacacaaacauggaugucagcugaaggugcauggagacaaguagaaaaaguugaaacgugggcccuucgccacccggguuuuacaauauuagcacucuuucuagcgcacuacauugguacaucacugacacaaaaaguagugaucuucauauuacugaugcuugucacaccaucgaugacgaugcgauguguugggguuggcaaccgugauuucguagagggacucaguggugcuacauggguugacguaguucuugagcauggagguuguguuacuacaauggcgaaaaacaaaccaacauuggauauagaacuucagaaaacugaggcaacucaacuagcaaccuugagaaaauuguguauugaagguaaaauuaccaauauaacaacagauucuaggugccccacccaaggagaagcaguacuaccagaagaacaagaucaaaauuacguuugcaaacauacauauguggaccggggcugggguaauggcugcggccuauuugguaaagguaguuugguaacgugcgccaaauuucaaugcuuagaaccuauagaaggaaaagucguccaauacgaaaaucuuaaauacacaguaaucaucacuguacauacgggggaucaacaccaaguugguaaugaaacccaagguguuacagcugagauaacaccgcaagcaaguacuacggaagcuauacuaccggaauacgguacacuugguuuagaauguaguccaagaacaggauuagacuuuaaugaaaugauauuauuaaccaugaaaaauaaggcuuggaugguacauagacaaugguucuuugaucuaccacuaccauggacuucuggagcaaccacugaaacaccaaccuggaauaggaaagaauugcuugucaccuuuaaaaacgcacaugccaagaaacaagaagucgucgugcuuggaagucaagaaggagcaaugcauacggcauuaacgggcgccacugaaauucaaaauucuggaggaacuucuauauucgccggccaucuuaaaugccgcuuaaaaauggacaaacucgaacuaaaagggaugucguacgccauguguacgaacacauucguacuaaagaaagagguaucagaaacucagcacggaacaauucuaauaaaaguagaauauaaaggagaagaugugccuugcaaaauucccuucucaacagaagacggucaaggaaaagcccauaacgggcgauuaauuacagcgaacccgguaguuacuaagaaagaagaaccaguaaauaucgaagcggaaccacccuucggcgagagcaacauuguaauugggauaggcgauaaugcauugaaaauaaacugguauaagaaaggaaguagcauuggcaaaauguuugaagcaaccgcacguggugcacggcggauggcaauucuaggugauaccgccugggauuuuggauccguaggggguguucucaauucacuagguaaaaugguacaccaaauuuuuggaagugcauacacagcacuauuuucuggagugagcugggugaugaaaauuggaauagggguucuccucacauggauaggacuaaauucgaaaaauacaucaaugagcuucaguuguauugcuauaggaauaauaacauuauacuuaggagcgguaguacaagcugauaugggguguguuauaaauuggaaagggaaagaauuaaaaugcggaaguggcauuuuuguaacaaacgagguucacacauggacagaacaauacaaauuccaagcagauagcccaaaacguuuagccacggccauagccggugcaugggaaaacggagucugcggaauuaggaguacgacccgaauggaaaaccuauuauggaaacaaauagcaaacgaauuaaauuauauccucugggagaauaacauaaaacuaacaguugucguaggugacauaauugguguuuuagaacaagggaaacgaaccuuaaccccacaacccauggaauuaaaauacucauggaaaacauggggcaaagcaaagaucguuacagcggaaacacaaaauagcucuuucaucauagauggcccaaacacaccugaaugcccgagugcgucgagggccuggaacguaugggaagucgaagauuauggguuuggugucuuuacuacaaacauauggcucaaacugagggagguauauacacaauugugcgaccaucguuuaauguccgcggccguaaaagacgaaagagcaguucaugcagacaugggcuauuggauagaaucacagaaaaaugguucauggaaauuggagaaagccaguuuaauugagguaaaaacaugcacauggccgaaaucacauacauuauggaguaacggaguguuggagagugauaugauaauuccaaaaucacuagcagguccaauuucccagcauaauuaccggccagguuaccacacgcaaaccgcaggaccauggcaucuaggcaaauuagaacuugacuuuaauuauugugaaggaaccacgguaguaauaacagaaaauuguggcacuagagguccuucucuucgaaccacuaccguaagcggaaaauuaauucaugagugguguugccgcucaugcacacuaccucccuugcgguauaugggugaagaugguuguugguaugggauggagauuaggccaauaucugaaaaagaagagaacauggucaagucauugguaucugcgggaaguggcgaaguagacaauuuuacaaugggaguacucuguuuagcuauuuuauucgaagaaguaaugagggggaaauuuggcaaaaagcauaugauagcgggaguguucuuuacauuuguucuacuauuauccggacaaauaacauggagagacauggcacacacuuuaauaaugauugguucgaacgcaucugaucguauggguaugggaguuacauaccuugcauugauagcaacauucaagauucagccauuucuagcgcuagguuucuuuuuaaggaaacuaacaucacgagagaauuuauuacuaggcguuggacucgcgauggccacaacucuacaacuuccugaagacauugaacaaauggcgaauggaauagcauugggucuuauggcuuuaaaauugaucacccaauuugaaacuuaucaguuauggacagcgcuaaucucccucacguguucaaauacuauuuucacucuuacaguugccuggagaacagccacauuaauauuagcaggcguaagucugcuaccugugugucaaagcucaucuaugcggaagaccgauuggcuaccgaugacagucgcagcgaugggaguuccaccacuaccccucuucauauucucuuuaaaggacacuuugaagcgcagaucauggccucuaaacgagggaguaauggcuguagggcuaguaucuaucuuagcauccucgcuuuugcggaaugaugugccuauggcaggcccuuugguggccgguggucuacugauugcuugcuacgugauuaccggaacaagcgcagauuuaacaguagagaaggcagcagaugucacaugggaagaggaggccgaacaaacaggagucagccacaauuuaaugauuaccgucgaugaugauggaacaaugcgaauaaaagaugacgagacagaaaacauucugacggucuuauugaaaacugcacuucucauaguaagcggaauauuucccuacucaauaccagcuaccuuacugguuuggcauacuuggcagaaacaaacacaaaggaguggaguacuuugggacgucccuucuccaccagagacucaaaaggcugaguuggaggaaggaguauaccgaauuaaacaacagggaauauuugguaaaacacaaguaggcguaggaguucaaaaggaggguguuuuccacaccauguggcaugucacucguggagcuguauuaacauacaaugguaaaagacucgaaccaaauugggcuuccgugaagaaagaccuaaucagcuauggaggaggguggcguuuaucagcgcaauggcaaaaaggugaagaaguacaagucauugcagucgaaccgggaaagaaucccaaaaauuuucaaacaaugccuggaacauuccaaacaacuacgggggaaaucggagcaaucgcacuugauuucaagccaggaaccagcgguaguccaauuauaaaccgagagggaaaagucguaggucuuuacgguaaugggguugucacuaaaaacggggguuauguaagcgggauagcucaaacuaacgcggaacccgacggaccgacuccggaauuggaggaagagauguucaaaaagagaaaccuaacuauaauggaccuacacccuggaaguggaaaaacaagaaaauaucugccugcaauagucagggaagcuaucaaacgcagauuacgaacacuaaucuuagcacccacucgagugguagccgcugaaauggaggaagccuugaaaggguuaccuaucagauaucaaacaacugcgacaaaaagcgaacacaccggaagagagauuguggaccuaaugugucacgcaacuuucacgaugagacugcugagcccgguaagaguuccuaacuauaaccucaucauuauggacgaagcucacuucacggacccggcaucaauugcagcucgcggguauauaaguaccagggucgguaugggcgaagcagccgcuauuuuuaugacagcaacuccuccggguacagcagaugcuuucccucaaucuaaugcaccuauacaagacgaagagagagacauuccggagagaucguggaacuccgggaacgaauggauaacagacuucgcgggcaagacuguaugguuuguuccuaguauuaaagcagggaaugauauagcaaauuguuuaaggaaaaacgguaagaaaguuauacaauuguccagaaaaacauuugauaccgaauaucagaaaacaaaacuaaaugacugggauuuuguagucacgacggacauuagcgaaaugggagcuaauuucaaagcagauagagugauagauccuagacggugccuaaaaccaguaauauuaaccgauggacccgagcgaguaauacuggcaggaccaaugccuguaacagcagcaagugcggcucagagaagaggcaggguugguaggaauccucagaaggaaaaugaucaauacauauuuaccggccaaccguuaaacaaugaugaagaucaugcacauuggacagaagcuaaaaugcuucuggauaauauaaauacaccagaggguauuauaccggcucucuucgagccggagagagaaaagagcgcagccauagacggagaguacagacuaaaaggcgaguccagaaagacauucguagaauugaugagaagaggagaccuaccagucuggcuagcacacaaaguagcgucagaaggaauaaaauacaccgaccgaaaaugguguuuugauggccagcguaacaaccaaauauuagaagaaaacauggauguggaaauauggacaaaggagggugagaagaagaaacuccgaccgagaugguuggaugcucggacguauuccgauccacuggcguuaaaagaauuuaaagauuucgcagcggguagaaaaucaauagcucucgauuuagugacagaaaucggacgugugccaacucaccucgcacaucgaacacgaaaugcacucgauaaccuaguuaugcuucacaccucagaacacggaggaaaagcauaucgccacgccguggaagaguuaccugaaacaauggagacucuacugcuguuaggacuaaugauacuccugacagguggagcaauguuauuucuuauaucaggaaaagguauagguaaaacaucaauagguuuaauauguguaauagcaucaagugggaugcuauggauggccgagauuccacuucaguggauagcuuccgccaucguuuuggaauuuuucaugaugguucuauuaauaccggaaccggaaaaacaaagaacaccccaagacaaucaacucgcguacguaguaauugggauacuaacgcuagcagcuaucauugcugcaaacgagaugggucugcuagaaacaacuaaacgagaucuugggaugucaaaagaaccaggagucguaaguccuacuagcuaccuagacgucgauuugcauccugccagugccuggacacuguacgcaguggcaacgacugucauaaccccuaugcuccgacacaccauugaaaauucgacugcuaacguaaguuuggccgcuauagcuaaucaagcaguaguacuuaugggauuggauaaaggauggcccaucucuaaaauggaccuaggagucccacugcuugcacuuggcugcuacagucaaguuaacccacuaacuuuaacagcagcaguauuauuauugaucacucauuaugcaauuauagguccagguuuacaggcuaaagcgacaagggaagcgcaaaaacgcacagcugcuggaauuaugaaaaacccaacaguagauggaaucaugacaauugacuuagauccaguaauuuacgacaguaaauuugaaaaacaauuggggcagguaauguuauuaguguugugcgcgguacaauuauuacugaugcgaacaaguugggcacuuugugaagcccucacucuagcgacagggccgaucacgacgcucugggagggcagucccgguaaauucuggaauacuaccauagccgugucaauggcgaauauauucagagggaguuauuuagcaggcgcaggauuggcauuuaguauaaugaaauccgucgggacugguaaaaggggaacaggguuacaaggcgagacacugggagaaaaguggaagaagaaacuuaaucaacuuaguagaaaagaauuugaccucuauaagaaaucugguauaacagagguagacagaacagaagcaaaagaggggcuuaaaagaggggaaauaacacaccaugcuguaaguagagguagugcaaaguugcaaugguuuguggagcgaaauaugguuaucccagaaggucgcgucauagauuuggguugugggagagggggcuggucauauuauugcgcuggacuuaagaaagugacagaggugagaggguacacuaaaggaggacccgggcaugaggaacccgugccuaugucgaccuauggauggaacauaguuaaacuuaugucagggaaagacguauucuacuuaccuccggagaaaugcgacacccuccucugugauauaggugagaguaguccuucuccaacuguggaagaaagccggacaauaaggguauugaaaaugguagaaccauggcuuaaaaacaaucaauuuuguaucaaaguucuaaauccuuauaugccuacgguaauugaacaucuugagagguuacagagaaagcauggagggaugcuaguaagaaaucccuugaguagaaauucaacacacgaaauguacuggaucucuaauggaaccgguaacauaguagcgucuguaaauaugguaucgcgguuauuauuaaaucgcuuuacaaugacacacagaagaccuacaaucgaaaaagacguugacuuaggcgcggggacgcggcauguaaaugcagaacccgaaacacccaacauggaugucauaggugaaagaauaaaaagaauaaaagaagaacacaauucuacauggcacuacgaugaugaaaacccguacaagacaugggcauaccacgggagcuacgaaguaaaggccacagguuccgcgagcagcaugauaaacggaguagucaaacuucucacaaagcccugggauguaguuccuauggugacacaaauggcgaugacugauacaacaccguuuggacaacaaagaguuuuuaaggaaaaaguagauacgagaaccccaaggucgaugccaggaacacggagaguuaugggcaucacugcagaauggcuguggcgcacauuagggcgcaauaagaaaccgagguuaugcacaagagaagaguuuaccaagaaagucaggaccaaugcggcgaugggcgccguuuucacugaagaaaaucaaugggauucagcaaaagcagccguggaggaugaagauuuuuggaaguuaguggaucgugaaagagaacugcacaaacuaggaaagugugguucaugcguauacaacaugauggguaaaagagagaagaaacuuggcgaauuugggaaagcaaagggguccagagcgauuugguacauguggcucggcgcaagguauuuagaguucgaagccuugggauuuuugaacgaagaccauugguuuucaagagagaacagcuacucugggguagaaggugaagggcugcacaaacuaggcuauauacuacgugauauuagcaaaauccccggaggggcuauguacgcagaugacacugccgggugggauaccagaauuacugaagaugaucugcauaaugaggagaaaauaacucagcaaauggacccagaacaccggcaacuugcuaacgcuauauucaaacuaacguaccagaacaaaguuguaaagguacaaagacccacuccaacggggacgguuauggacaucauaagcagaaaagaccagagaggaucaggucaaguuggaacguacgggcuaaauacauucacuaacauggaagcucaauuaaucaggcaaauggagggagaaggggugcuaucgaaggcagacuuggaaaacccacaccuacccgaaaagaaaauaacucaguggcuugagacgaagggaguagaaagacuuaaacgaauggcgauuuccggggacgacuguguugugaagccaauugaugacagauuugcaaacgcucuuuuagcccuuaacgauauggguaaaguacguaaagacaucccacaauggcagccaaguaaaggcuggcacgauuggcaacaaguuccguucugcucacaccauuuucaugaacuuauuaugaaggaugggaggaaguuaguugucccguguagaccgcaagacgaacugaucggacgcgcucgaauuagucaaggagccggauggucauuacgggaaacugcgugucucggaaaagcguacgcccaaauguggucucuaauguauuuccacaggagagauuuaaggcuugcuagcaaugcuaucuguagugccguacccguucauuggguaccgacuucucgaacaacguggaguauacaugcacaucaucaauggaugacaacagaagauauguuaacgguauggaaucguguuuggaucgaggauaauccguggauggaagacaagacaccaguaacaacuugggaaaacgucccauaucuuggcaaaagggaagaucaauggugugguucucuuauaggauugaccagucgcgcgacaugggcacaaaauauaccaacggcuauacaacaaguacgaagucuuauaggaaaugaagaauuucuugauuauaugccuucuaugaaaagauuuaggaaagaagaggaaagcgagggagcuauaugguaa

SEQ ID NO: 23451 - RNA, 9873 nt, Artificial Sequence
  derived and/or modified CDS sequence (opt6) from DENV-3__FJ898470__SS-prME
acgagucuguguuugaugaugauauuaccugcagcacucgcuuuucauuugacuucuagagauggugaaccacgaaugauaguaggcaaaaaugaacgcgggaaaucuuuguuauuuaaaacugcaucaggaauaaacaugugcacacuaauagcaauggaucuaggagaaaugugugacgauacaguaacauauaaauguccgcauaucacagaaguugaacccgaagacauugauuguuggugcaaccuuacgucuacuuggguuacguacgguacauguaaccaagcaggagaacaccgcagagacaaaagaagcguagcccuagcuccacaugucgguaugggacucgacacacgaacacaaaccuggaugucagcugagggugcauggagacaaguggaaaaaguugaaacaugggcccugcgacacccagguuucacaauacuggcucuuuuccuggcacacuauauaggcacuucuuuaacacaaaaaguaguaauuuucauuuuacuaauguuaguaacgccaucaaugaccaugcgcugcguuggcguuggaaaucgagauuuuguagagggccuaagcggugcgacauggguugauguaguacuagaacaugggggaugcguaacaacuauggcuaaaaauaaaccuacauuagacaucgaacuacagaaaacugaggcuacucaauuagcaacgcuuagaaaacuguguaucgagggcaaaauaacaaauaucacaacagauucaagauguccaacgcaaggugaggcugucuuaccagaagaacaagaccaaaauuaugucugcaaacauaccuauguagaucgggggugggguaacgguuguggacuauucgggaaaggaucauugguaaccugugcaaaauuccaaugcuuagagcccauagaggggaaaguaguacaauaugaaaacuuaaaauacacaguuauuauuaccguacauacgggggaucaacaucaagucgguaaugaaacgcaaggcgugacagcugagauaacgccacaagcaucaacaacggaggcaauauuaccugaauacgguacauuaggauuagaaugcaguccuaggaccggacuugauuuuaaugagaugauauuauuaacaaugaaaaauaaagcauggaugguacauaggcaaugguucuuugaucuaccuuuaccuuggacaucuggagcuacaaccgaaacaccaacuuggaaccgcaaagaauuguugguuacauucaaaaacgcacaugccaagaaacaagaaguaguaguacucgggagucaggaaggagcgaugcacacagccuugaccggagcuacagaaauacaaaauucuggcgguacuagcaucuucgccggccauuugaaaugucgccuuaaaauggacaaacuggaguuaaaagguaugaguuaugccauguguacaaauacauuuguucuuaagaaagaagugucagaaacacaacacggaaccauucugaucaaaguagaguacaaaggagaagacguaccauguaaaauaccauucaguacggaagauggacaggggaaggcacacaauggaagauuaauaacugcaaacccagucguuacuaagaaagaagaaccaguaaacaucgaagccgaaccaccguucggagagaguaauaucguaauuggaauaggagacaaugcacuaaaaaucaauugguacaagaagggaaguucgauaggaaaaauguuugaggcaaccgcaagaggggcucgcagaauggcaauacugggagauacagcgugggacuuugggagugucgggggaguuuuaaacucgcuggguaaaaugguacaucaaaucuucggauccgccuauacggcacuauuuucuggaguguccugggugaugaaaauuggaauagguguucuucugacauggauaggucuaaauagcaaaaauacaaguaugaguuuuucuuguaucgcaauuggaauaauaacauuguaccuaggagccguaguacaagcugacaugggaugcguaauuaauuggaaaggaaaagaacugaaaugcggcucaggaauuuuugucacaaaugaaguacauaccuggacugaacaauacaaauuccaagcugacagccccaagaggcuagcaacagcaauugcaggcgcuugggaaaauggugugugcgguauuagauccacuacucggauggaaaauuuauuauggaagcaaauugcaaaugaacuuaacuauauacuaugggagaauaacauaaagcuaaccguaguagucggggauauuauuggcgucuuagaacaaggaaaacgaacccuaaccccgcagccgauggaauugaaauacucauggaagacauggggcaaagcgaaaauaguaacggcagaaacacagaacucaucuuuuauaauagaugggccaaauacaccugaaugcccgucugcaucacgugcauggaaugugugggaaguugaagacuacggauuugguguauucacaacaaauauauggcuaaaguugagagaaguguauacucagcuuugcgaucauagacugaugagcgccgcaguaaaggacgaacgggcaguacacgcugacauggguuacuggauagaaucucagaagaacgggaguuggaaauuagagaaagcaaguuuaauagagguuaaaacuugcacguggccuaaaucgcacacacucuggaguaauggaguacucgaaagcgacaugauuauaccaaaaucauuagcggggccaauaagucaacauaauuacaggccaggguaccacacucagacagccggcccuuggcaccuaggaaaguuagaauuagacuucaauuacugcgagggaacuacagucgucauaaccgaaaacugugggacacgaggaccaaguuuacgcacgacuaccgucagcggcaaacuuauacaugaaugguguugucgcucgugcacacugccgccucuaagauauaugggcgaagacggauguugguaugguauggaaauacgacccauuagugaaaaggaggaaaauauggucaaauccuugguuagugccggaucgggugaagucgauaauuuuacgauggguguacucugucucgcaauacuuuuugaggaaguaaugagagguaaauucggcaagaaacauaugauagcaggaguauuuuucacauuuguuuuguugcuuucgggucaaauaaccuggagagacauggcacacacacuaaucaugauugggaguaaugcgagugaucgcaugggaaugggagugacauauuuagcucuaauugcaacauucaaaauccaacccuuccuagccuuaggauucuuuuuacgaaaacuuacaucacgggaaaaucuuuuguuaggcguaggucuugcaauggccacuacacuucaguuaccagaggacaucgaacaaauggccaacggaaucgcacucgggcuaauggcucuuaaauugauaacacaauucgaaacauaccaauuguggacggcauuaauuagucugaccugcucuaacacaauauuuacacuaacgguagcguggcgaacggcgacacuaauuuuggcaggcguuagucuacuaccaguuugccaaucguccuccaugcguaaaacagauuggcuucccaugacgguggccgcgaugggaguaccuccauuaccgcuauuuaucuucucauugaaagauacccuaaaacgaaggaguuggccucucaacgagggagugauggcuguuggacugguuagcauccuggccucaucccuuuugaggaaugauguaccaauggccggaccacuuguugcugguggauugcucauagcgugcuauguuaucacuggaacaagugcagaucuuacaguagaaaaagcugcugaugucacaugggaagaggaagcagaacagacaggaguaucacauaauuuaaugauaaccguggacgacgauggaacuaugagaauaaaagaugacgagacugaaaacauauugacagucuuauuaaaaacagcacuacugauagucucuggcauauuccccuacucuauaccugcaacuuuauuaguauggcauacauggcaaaaacaaacgcagcgaagcgguguucucugggacgucccaucacccccagaaacucagaaggcugaacuggaagaaggaguauacagaauaaaacaacaagguauauuuggaaaaacccaaguuggggugggcgugcaaaaagaaggaguauuccacacuauguggcacguaacuagaggcgcggucuuaacauauaaugguaaacggcuagagccgaacugggcaaguguuaaaaaggaccuuauuucauacgguggcggcuggaggcucucagcacaauggcaaaaaggagaggaaguacaaguuaucgcgguugaaccaggcaaaaaucccaaaaacuuucaaaccaugccuggaaccuuccaaacgacaacuggagaaauaggggcaaucgcucuagauuuuaaaccgggcacauccggcagucccauuauaaaucgagagggaaaaguggugggguuauacgguaacggaguaguaacgaaaaacggagguuauguaucaggaauagcucagacgaaugcugaaccugauggaccuacaccagaacuagaagaggagauguuuaagaaaagaaaucuuacaauaauggaucuacauccaggaagcggcaaaacuagaaaauaucuaccggccaucguaagagaagcuaucaaaagacgguuaagaacauugauucuagcuccaacgagaguaguagcggcagaaauggaagaagcauugaaaggacuuccuauuagguaucaaacuacagccacaaaauccgaacacacaggccgugaaauuguggaucuuaugugccacgccacuuuuaccaugagauugcuaucaccugugagaguccccaauuacaauuuaaucauaauggacgaagcacacuucaccgauccagcaaguauugccgcaagaggauacauuagcacaaggguaggaaugggcgaggcagcugccaucuucaugacagcuacgccaccagguacagcagaugcuuuuccccaaaguaaugcacccauucaagaugaagaaagagauauacccgaaagaaguuggaacucaggaaaugaauggaucacagacuuugccgggaagacuguuugguuugucccuucaaucaaggcugggaaugacauagcgaacugccucaggaaaaaugggaagaaagucauacaauugagccgaaagacauuugauacugaauaccagaaaacgaaauuaaaugauugggacuuuguaguuacaaccgacauaagugaaaugggagcaaacuuuaaagcagauagagucauugacccaagacguugucuaaaaccagugauacuaacagacgguccggaaaggguaauccucgcagggccaaugcccguaacugcugcauccgccgcccaaagaagaggcagagucgggagaaacccucaaaaggaaaacgaucaguauauauuuacaggucaaccguuaaauaacgacgaagaucacgcacauuggacggaggcgaaaaugcuuuuagacaauauuaauacuccggaaggcauaauaccggcacuauucgaaccagaaagagaaaaaucagcggcuauagacggagaguauaggcucaaaggcgagagccgaaagacauuugucgaguuaaugcgucguggggaucuaccaguaugguuggcccauaaaguugcuucagagggcauuaaguauacggauaggaaauggugcuucgauggccaaaggaauaaccaaauauuagaagaaaacauggacguagaaauauggacgaaagaaggagagaaaaagaaauugaggccuagauggcuagacgccaggacguauagugacccucuugcccuaaaagaguuuaaggauuuugccgcugguaggaaaucaauugcacuugaucuuguaaccgagaucggacggguuccuacucaccucgcacaccgaacacgcaaugcucucgacaaucuaguuaugcuacauacguccgaacacgggggaaaagcauacaggcaugcaguagaagaguuaccagagacgauggaaacacuuuuacuguuaggucuuaugauacucuuaacgggcggggcaauguuauuuuuaauaucuggaaaagguauaggaaaaacaaguauagguuuaauauguguuaucgcaucauccgguaugcuauggauggccgaaauacccuuacaguggaucgcaucagcuauugucuuagaguucuuuaugaugguauuacuaauaccagaacccgagaaacaacgaacaccucaagacaaccaauuagcguacguggucauugggauccuaaccuuagcagcaauaauagcagcaaacgaaaugggccuucuggagacgaccaaaagagacuuagguaugucaaaagaacccggaguagucucaccuacaaguuaucuggauguagauuugcauccugccucagcauggacauuauaugccguugcaaccacagugauuacgccgaugcugcgucacacuauugaaaacucuacagcaaacguaucgcuugcugcaauagcaaaccaagcaguaguccucauggguuuggauaaaggauggcccauuagcaaaauggauuugggcgucccacuucuagccuuaggaugcuauucccagguaaauccauuaacucuuacggccgcuguacuuuuauugaucacacauuaugcgauaauuggaccugguuuacaagccaaggcaacacgagaggcucagaaaagaaccgcggccggaauaaugaaaaauccuacaguugaugguauaaugacuaucgauuuagacccaguaauauaugacucaaaauuugaaaagcagcuaggccagguaaugcuccuuguauuaugugcgguucaacucuuauuaaugcguacuucaugggcauugugugaggcccugacccuagcaacgggaccuauaacgacauugugggaaggaagccccggcaaguuuuggaauacgaccauagcaguaucuauggcaaacauauuuagggguaguuaucucgcaggagcgggucuugcguuuucgaucaugaagaguguuggaacaggaaaaagagguacuggaucgcaaggagaaaccuugggcgaaaaguggaagaagaaacuaaaucaacuuucgcgaaaagaauuugaucuguauaagaaaucugggauaacggagguggacagaacagaagcaaaagaagggcucaaaaggggcgaaauaacccaucaugcagucucgaggggaagcgcaaaauugcagugguucguagagaggaauaugguuauaccggaaggaagaguaauugauuuggguugcgggcgaggugguugguccuauuacugcgcuggucugaagaaagucacugaaguacgagguuacacgaaaggugggccgggacacgaggaacccguccccaugucaacguauggauggaacauaguuaaacucaugucuggaaaggauguauuuuaccucccgccggaaaaaugcgacacauuauuaugcgauauuggugagagcuccccaucacccacaguugaagagucaagaacuaucaggguucuaaaaaugguugaaccuugguugaaaaacaaucaauucuguauaaaagugcuaaauccauacaugccaaccgugaucgagcacuuagaaagacuacagagaaagcacggaggaauguugguaagaaauccauuauccagaaacaguacacacgagauguauuggauuucaaauggaacaggaaacauuguagcaucagucaauaugguaucucggcuauugcugaaucgauucacaaugacacaucgacgaccgaccauagaaaaagacguagacuugggagcaggcacucgacacguaaaugcugagccagaaacacccaauauggacguaauaggugagcgcauaaaacgaauaaaggaggaacauaauuccacguggcauuaugaugaugaaaaccccuacaaaacaugggcuuaccacgguucuuacgaaguaaaggccacagggucugcaaguucuaugauaaacggcgugguaaaacuuuugacaaaacccugggacguagugccuaugguaacacaaauggccaugacugauacaacaccuuuugggcaacaaagaguauucaaagaaaagguagauacucgcacgcccaggucaaugcccgguacaagacguguuauggguauaacagcagaauggcucuggaggacccuuggucgaaacaaaaagcccagacuguguacccgagaggaguuuacuaagaaaguuagaacaaaugccgcgaugggagcaguauuuaccgaggaaaaccagugggacagcgcaaaagcagcgguugaagacgaagauuucuggaaacuuguugacagggagcgagaacuacacaaauuaggaaaaugugguucuuguguuuacaacaugauggguaagagggaaaagaaacuaggcgaauuugguaaagcgaaaggaucgagagcaauaugguacauguggcuaggagcucgauauuuggaauuugaagcucuagguuuucuuaaugaggaccauugguucuccagagaaaauucauauagugguguugaaggagaaggccuacauaaacuaggauacauucuaagagauauuaguaaaaucccuggaggagcgauguacgcugaugauacugcaggcugggacaccagaauuaccgaagacgaucuacauaaugaagaaaagaucacgcaacagauggauccugagcaucgacaauuagcuaaugcaaucuuuaaauuaacuuaucaaaacaaaguugugaaagugcaaagaccaacacccgcuggaaccguaauggacauuauuucucgcaaagaucaacgcggaaguggacaagugggaacuuauggacuaaacacguuuacgaacauggaagcccagcuuauacgccaaauggaaggagagggagucuuaucgaaagcagaucuagaaaacccgcaccuaccugagaagaaaauaacacaauggcuagaaacuaaaggcguagaacgauuaaaacgaauggcuauaaguggagaugacugugucguaaaaccaaucgaugauagauucgcgaaugcauuguuggcucuaaacgacaugggcaaaguccggaaagacauaccccaauggcagccaucuaagggguggcaugacuggcaacaaguacccuucugcucucaccacuuucaugaauuaauaaugaaggauggucgaaaacuuguagucccguguagaccccaagaugaacucauuggaagggcacgaauaucacaaggagcaggauggucauuacgugaaacggcuugccuagggaaggcuuaugcccagauguggucucucauguauuuucacagaagagaccuuagguuagccucaaaugcaaucugcagugcgguuccaguucauuggguaccaacgagccguacaacguggucuauccacgcccaccaucaauggaugacuacugaagauauguuaacuguauggaacaggguauggauagaggacaaccccuggauggaagacaaaacucccgucacgacaugggaaaauguuccuuauuuaggaaaaagagaagaccaguggugugggucucugauaggacugaccuccagggcaaccugggcccaaaauauaccaacugcaauucaacagguaagaaguuugaucggcaaugaggaauuucucgacuauaugccaucuaugaaaagguuucgaaaagaagaggaaagugaaggagcuauaugguaa

SEQ ID NO: 23452 - RNA, 9873 nt, Artificial Sequence
  derived and/or modified CDS sequence (opt6) from DENV-3__FJ898471__SS-prME
accucuuuauguuuaaugaugauccuuccugcagcacuugcuuuccacuuaacgucaagagauggugaaccuagaaugauaguagguaaaaaugaaagaggaaaaagucuucuuuuuaaaacggcaucuggaauaaauaugugcacucuaauagcaauggaucuuggcgaaaugugugaugacacaguaacguacaaauguccgcauauuacagaaguugaaccugaagauauugacugcugguguaaucuaacaucuacuuggguuacauacggcacguguaaucaagcaggggaacacagacgagacaaacgaucagucgcacuggcgccacacguugguaugggacuagauacaagaacucaaacauggaugucagcugaaggggcauggagacagguagagaaaguagaaacuugggcguuaaggcacccugguuuuacaauauuagcacuuuuucuagcgcacuacaucgggacaagucuaauacaaaaagugguaauauucauacuauuaaugcucguuacuccaucgaugacuaugagaugcgucgguguaggaaaucgugauuucguugaagguuugucaggagcaacauggguagauguuguauuggaacacggggguuguguaacaacaauggcuaaaaauaaaccaacuuuggacauagaguugcagaaaacagaagcaacccaacuugcaacauuacggaaauuauguauagagggaaaaauuacgaacauaacgacggacucucgaugcccgacccaaggagaagcgguacucccagaagaacaagaucagaauuacguaugcaaacacacauacguagaucgaggaugggguaaugguugugggcucuuuggaaaaggguccuuaguuacgugcgcaaaauuucagugccucgaaccaauagaaggaaaagucguccaauaugagaaucuuaaauauacugugauuauuacaguacauaccggcgaccagcaucaaguuggaaacgaaacacaagguguuacugcagagauaacgccucaagcguccacgacggaggcaauucugccugaauacgguaccuuagggcuagaaugcagcccaagaacgggcuuagacuuuaacgagaugauucuauuaacgaugaaaaacaaggcuuggaugguacauagacaaugguucuucgaccuaccuuuaccuuggacgucaggagcuaccacugaaacaccgacguggaacagaaaagagcugcuuguaacguucaaaaacgcucaugcuaagaaacaagaaguggucgugcucgguagucaagagggagcaaugcacacagcuuuaacaggggcaacagaaauucaaaauaguggaggcacaagcaucuuugcuggucauuugaaauguagacuaaaaauggauaaauuagagcuuaaagggaugucuuacgcgaugugcacuaauacguuuguccuuaagaaagaaguaucagaaacacagcaugguaccauauuaauaaaaguagaauauaagggagaggauguacccuguaaaauaccguuuagcacagaagauggucaagggaaggcgcacaauggcagacuaauuacugcaaaccccgucguuacuaagaaagaggaaccggugaauauugaagcugaaccaccauuuggggaaucgaacauuguuauaggaaucggugacaaugcauuaaaaaucaauugguauaagaaagguagcucaauaggaaaaauguucgaagcaacugcccgaggagcgcgccgcauggccauacucggcgacacagccugggauuucggaucaguagggggaguacuaaauucauuggguaagauggugcaccaaaucuucggaucggcauauacagcacuuuucucaggaguaaguugggugaugaaaauuggaauaggaguacuguugacuuggauaggauugaacagcaaaaauacuagcaugucauucaguuguauaguuauaggcaucauaacccuauaucuaggcgccguaguacaagccgacaugggaugcgucauuaauuggaaaggaaaggaacuaaaaugcggaagcgguauauuugucacaaaugagguucauacauggaccgaacaauauaaauuucaagcagauuccccuaaacgucucgcaacggcgauagcuggagcuugggaaaauggaguaugcgguauucguuccaccacacgcauggaaaacuuacuauggaagcaaauagcgaacgagcuuaauuacauacuuugggaaaauaacauuaaguugaccguuguuguuggugacauuauuggaguacuugaacaagguaagcgaaccuuaaccccacaaccaauggaauuaaaauacucauggaaaaccugggguaaagcgaagauaguaacagcagaaacucagaacucaucauucauaaucgauggaccaaauaccccugaaugucccagcgccucacgugcguggaacguuugggaggucgaagacuacgguuuuggcgucuucacgacuaauauauggcugaaauuaagagaagucuauacucaauuaugugaucauagacuuaugucagcagccguaaaagaugagcgagccguucacgccgauauggguuauuggauagaaucacaaaagaauggaucuuggaagcucgagaaagccucacuuauugagguuaaaacuugcacuuggccuaagucacauacauuguggucaaauggaguacuugaauccgauaugaucaucccuaaaucacucgcuggcccaauuucacaacacaauuaccgcccaggcuaucauacccaaacagccgguccguggcaucuuggcaagcuggaguuagauuucaacuauugcgaaggaacuacaguuguaaucacggaaaauuguggcacaagaggucccucucuccguacaacuacagucucagguaaguuaauucacgaaugguguugcagguccugcacgcuaccuccccugagguauaugggugaggauggauguugguacggaauggaaauacgaccaauaagugagaaagaagaaaacauggugaaguccuugguuucugcagggaguggagaaguagauaauuuuaccaugggggucuuaugucuagccaucuuauuugaagaagucaugagaggcaaguuuggaaagaaacauaugauagccgguguauucuuuacguuuguauugcugcugucaggacaaauaacauggagagacauggcacauacuuuaauaaugauaggcagcaaugccucugauagaauggguauggguguuacauacuuagcacuaauagccaccuucaaaauacaaccauuuuuggcgcuaggauucuuccuccguaaauugacaagccgagaaaauuuguugcucggugugggacuggcaauggcaacaacacuacaauuaccggaagauauagaacaaauggcaaaugggauugcauuaggccugauggccuuaaaacuuauuacacaguuugaaaccuaccaacuuuggacggcauuagucucuuugacuugcucuaauacuaucuuuacccuaacggucgcguggagaacagcgaccuuaauauuggccggcgugucauugcugccugugugucaaucuucuucuaugcgaaaaacugauuggcuaccuaugaccguugcugcuaugggaguacccccacugccccuguucauauuuagccucaaagacacccucaaaagaagaucauggccuuuaaaugaaggcguaauggcgguaggguugguauccauccuagcgucaagucuauuaagaaacgauguuccuauggcugguccuuugguugcaggcggauuacuuaucgcgugcuauguuauuacuggaacaucugcugauuugaccguagaaaaagcagcagacguaacuugggaggaagaagcagaacagacuggaguuucacauaacuuaaugaucacuguagacgaugauggcacaaugagaauuaaagaugaugaaacugaaaauauucucacaguuuuguuaaaaacugcacuccuuauuguaagugggauauucccuuauagcauaccugcuaccuuauuaguguggcauacuuggcagaaacaaacgcaaagaucuggaguccuuugggaugugccgaguccaccggagacacaaaaagcugaauuagaggaagguguuuauagaauaaaacaacaaggaauauucggaaaaacccaggugggcguggguguacaaaaagaaggaguauuucacaccauguggcauguaacccgaggugcaguucuaacuuacaacgggaaaagacuagaaccaaauugggcuagcgucaagaaagacuugauaucauaugguggggguuggagauuauccgcucaguggcagaaaggggaagaaguacagguaauagcaguggaacccgguaaaaaucccaaaaauuuucagacaaugccuggcacuuuccaaacuacgacuggagaaauaggagccauagcacuagauuuuaaaccaggcacuucagguaguccuaucauaaauagagagggaaaaguaguggguuuguauggcaauggaguuguuacuaagaaugguggauaugucucuggaauagcacaaacgaaugcagaacccgacggaccaacuccagaauuagaggaagaaauguuuaagaaacgcaacuuaacaaucauggacuugcacccaggcucaggcaaaacuaggaaguaucuaccagcaauuguaagagaagccaucaaacgacgauuaagaacuuuaaucuuagccccaacucgaguaguagcagccgagauggaagaagcauuaaagggcuugccuauacgguaucagacaaccgcaacaaaaucggaacacacaggucgggaaauuguagaccuuaugugucaugcaaccuuuacgaugagacuccuaagcccugugcgcguaccuaauuauaaccuuauaaucauggaugaagcacauuucacagauccagcuucaaucgcugcccgugguuacauaucgacuagaguugguaugggagaagcagcugcaauuuuuaugacggccacgccuccagggacagcggaugcuuucccucaauccaaugccccgauacaagacgaagaacgugacauaccugagagaagcuggaacucgggaaaugaguggauaacugacuucgcaggaaagacuguaugguucgucccaucgaucaaggcugggaacgacauagcaaauuguuuaaggaaaaauggaaagaaagugauucaauuaagcaggaaaacauucgacacggaguaucagaaaacaaaacuuaaugauugggauuucgugguuacuaccgauaucucugaaaugggugcaaauuucaaagcugaccgaguuauugacccacgacgguguuugaaaccugugauauuaacugauggaccggaaagggugauacuagcuggaccaaugccugucacggcagccuccgcggcacaacgaaggggacgaguaggcaggaacccccagaaagaaaaugaucaauauauuuuuacaggccaaccucucaacaaugacgaagaccaugcucauuggacggaagccaaaauguugcuugauaauauaaacacgccagaggggauuauuccagcuuuauuugagcccgagcgcgaaaagucagcagcuauagauggggaguacagauuaaaaggcgaaagcagaaaaacguucgucgaacuaaugagacgaggugauuuaccaguuuggcucgccuauaaaguagccagugaaggaauaaaguacacagacaggaaaugguguuucgauggacaaagaaauaaucaaauacuagaagaaaauauggacguugagauuuggaccaaggaaggcgagaagaagaaacuccgaccgcgaugguuggaugcacguacauauagcgauccacuagcucuuaaagaauuuaaagacuucgcugcagguagaaaaucgauagcuuuggaucucguuacugaaauuggacgaguaccgucucauuuagcccacaggacucggaacgcuuuagacaaccucguaaugcuucauacaagugaacauggcgguaaggccuaucgacacgcuguugaggaauugccagaaacaauggaaacucuacuucuauugggguugaugauauuauugacagguggggcaauguuauucuuaauauccggaaaagguauaggaaaaacuuccaucggccucauuuguguaauagcuucuagcggaauguuguggauggcagagauaccgcuacaguggauagcaucugcuauaguguuggaauuuuucaugaugguacuguugauaccggaaccugagaaacaacgaacgccacaagacaaccaauuagcuuauguuguaauaggaauacuaacgcuagcugccaucauugcagcaaaugagaugggacucuuggagaccacaaaaagggaucuaggaauguccaaagagcccggcgugguuucaccaacaucguacuuagauguagaucugcauccugcuucugcuuggacguuauaugcaguggccacaaccgugauuacaccaaugcuaagacauaccaucgagaacaguacugcaaacguuagccuggcagcuauagccaaucaggcagugguacuaaugggacuggauaaagguuggccaauaucaaaaauggacuuaggaguaccucuauuagcacuaggcuguuauucucagguuaacccgcuaacgcuuacagcugcaguacuauuauugauuacccacuacgccauaauaggacccggccuccaagcaaaagcgacuagagaggcacaaaagagaacagccgcagguauaaugaaaaacccaaccguagacgguauuaugaccauagaucuggacccgguaauauaugauucaaaauuugaaaaacaacuuggccaaguaauguugcuuguauuaugugcaguacaauugcucuuaaugagaacaucaugggcauugugcgaagcauugacauuagcgacaggacccauuacgacauuaugggaaggaucacccggaaaauucuggaacacgacgauagccguaucaauggcuaauauauuuagagggucauauuuagccggugcuggacuagcauuuagcauaaugaaauccguaggaacaggaaaacgugguacaggaucucaaggugaaacucuuggagaaaaauggaagaaaaagcuaaaucaauuaaguagaaaagaauuugacuuguauaagaaaaguggcauaacagaaguugaucgaacugaagcaaaagaggguuuaaaacguggggaaaucacucaccaugcaguguccagagguucugcuaaacuacaaugguuuguagaaaggaacaugguaaucccagagggaaggguaauugacuuaggauguggaagaggugguuggaguuauuauugcgcaggucucaagaaaguaacagaaguccgaggguauacuaaaggaggaccaggucacgaagaaccaguuccaaugaguacauacggcuggaauauuguuaaauuaaugagcgguaaagacguguucuaucuacccccggagaaaugugacacucuacuaugugacauaggcgaaaguaguccaagucccacuguagaagaaucgcgaacaauacgugucuugaaaaugguugaacccuggcuuaaaaauaaucaauuuuguauaaaaguccuaaauccauauaugcccacaguuauugaacaucucgaacgacuacagagaaaacauggugguauguuagugaggaacccguuaucuagaaauagcacccacgaaauguauuggauaucgaacggcacuggaaauauuguggcaagcguuaacauggucucuagguuacuuuugaauagauuuacuaugacacaccgcagaccgacaauugaaaaggauguagaucuaggugcagguacuagacacgucaaugcagaacccgaaacccccaacauggacgucauaggagaacggauuaaacgaauaaaagaagaacauaauaguacuuggcauuaugaugaugaaaacccauacaaaacaugggcauaucaugguagcuacgaaguuaaggcgacagguagugccaguaguaugauaaacggcgugguuaaacuucuuacaaaaccuugggaugugguaccaaugguaacgcaaauggcaaugacggauacaaccccauucggacaacagcgaguuuucaaagaaaaaguggauacgagaacaccuaggucaaugccaggaacaagaaggguaaugggaauaacugcagaaugguuauggagaacacuugggagaaacaagaaaccaagauuauguacccgagaagaguucacuaagaaaguaagaaccaacgccgcaaugggugcuguguuuacggaggaaaaccaaugggacucggcuaaagccgcuguagaagaugaagauuuuuggaaauugguugauagagaacgagaguuacauaaguuaggaaaaugcggaagcugugucuacaauaugauggggaaaagagagaagaaacuaggagaauuuggaaaggcuaaaggauccagggcuaucugguauauguggcuuggagcaagguauuuggaguucgaggcguuagguuuucugaaugaagaccauugguucuccagagaaaauuccuauucugguguugaaggugaaggauuacacaaacuuggauacaucuuacgugacauaagcaaaauacccggaggggccauguaugccgacgauacagcagggugggacacucgcauaacugaagaugacuugcacaaugaagagaaaauaacccaacaaauggacccagaacaucgccaacucgcgaacgcuaucuuuaaauuaacauaccaaaauaaaguuguaaaaguacagagaccaacgccuacugguacgguuauggauauuauauccagaaaggaucaaagagggucaggccaagucgguaccuacggacuaaauaccuuuacaaacauggaggcgcaacugauucgucaaauggagggggagggaguuuuaucaaaggcagaucuggaaaauccgcacuuaccggagaagaaaaucacacagugguuagaaacgaagggcguugagcggcuaaagcguauggcuaucuccggugacgacuguguagucaaaccgauagacgacagguuugcuaaugcucugcuagcuuuaaaugacaugggaaaggugcgaaaagauaucccccaguggcaaccaaguaaagguuggcaugacuggcaacaggugccauuuuguucacaccauuuccaugagcuuauuaugaaagaugggagaaagcuggugguaccaugcaggccucaagaugaacuaauuggccgagcaagaauaucacaaggagcaggauggucacuucgugaaacggcaugucuaggaaaagcauaugcacagauguggucacuuauguauuuucauaggagagaucucagacuugcaaguaaugcuauauguucggccgugccgguucauuggguaccaacuucaagaacgacauggucaauacacgcucaucaccaauggaugacaacugaggacaugcuaacagucuggaauagaguguggauagaagauaacccauggauggaggacaagacuccuguaacaaccugggagaacgugccuuaucucgguaaacgugaggaucagugguguggaucauuaauaggucuaacgaguagggcuacaugggcccaaaacauaccuaccgcuauucaacaaguaagaucacugauaggaaacgaggaguuccuugacuacaugccaaguaugaagagauucagaaaggaagaagagucugaaggagccauaugguag

SEQ ID NO: 23453 - RNA, 9873 nt, Artificial Sequence
  derived and/or modified CDS sequence (opt6) from DENV-3__FJ898472__SS-prME
acaucauuaugccuaaugaugauacucccugcagcauuggcuuuucauuuaacuucacgagacggggaaccacgcaugauaguuggcaaaaacgaaagaggaaagagcuuacuauucaaaacagcaucagggauaaauauguguacgcugauagcaauggauuugggagaaaugugcgaugauacuguaaccuacaaauguccacauauaaccgaaguagaaccagaagacauugauugcuggugcaauuugacgaguacuugggucacuuauggaacaugcaaucaagcaggagaacaccggagggauaaacguucaguggcauuagcaccacacguaggaauggggcuugauacccggacacaaacauggaugucugcagaaggugcguggcgacaagucgaaaaaguugaaacuugggcacugagacauccuggauuuacaauacuggcgcuauuccuagcacauuauauuggcacaagccuuacacaaaaggugguaauauuuauccuucuuauguuagugaccccaucaaugacaaugagaugcguuggaguagguaaucgugacuucguagagggcuuaagcggagcaaccuggguugacgucguacuugaacacggugguugcguaacaacaauggccaaaaacaaaccgacuuuggacauagaguuacagaaaacagaggcaacccaacucgcuacuuuaagaaaacuuugcauugaagguaaaauuacuaauauaacgacugacucacgaugccccacucaaggagaagccguucuucccgaggaacaagaucaaaauuacgugugcaaacacacauauguugacagaggguggggaaacgguugcggauuauuugguaaagguucuuuaguuacaugugccaaguuucaauguuuggaaccuaucgagggcaaagugguacaauaugaaaauuuaaaauauacgguaauaauaacgguucacacuggugaccaacaccaaguaggcaaugaaacucaaggaguaacagcagaaauaaccccacaagcaaguacaaccgaagcaauacucccugaauauggaacucucggucuggaaugcucacccagaacagguuuggauuucaacgagaugauccuauuaacaaugaaaaauaaagcauggaugguucauaggcaaugguuuuucgaccucccauuacccuggacauccggugcuacaaccgaaacuccaaccuggaaucgaaaagaacuauuaguaacuuucaaaaaugcacacgcgaagaaacaagaaguugucguauuggguagccaggagggcgcuaugcacacggcacuaacgggugcaacugaaauucagaacuccgggggaacguccauuuucgcaggccaucuuaaaugcagguuaaaaauggauaaauuggaauuaaaaggcauguccuacgcaauguguacuaauaccuuuguccucaagaaagaagugagcgaaacacaacacggaacaauacuaauaaaaguggaauacaaaggugaagauguuccuuguaagauaccauuuagcaccgaagauggccagggaaaggcccauaacggccguuugauaacugccaaucccguuguaacaaagaaagaagaacccgucaauauugaagccgaaccuccauucggugaaaguaauauuguaauagguauuggcgacaacgcucuaaaaauaaauugguacaagaaaggaaguuccauagggaaaauguuugaagccaccgcaagaggcgcucgacguauggcuauucuaggcgacaccgcaugggacuuuggcaguguuggaggagugcuuaauucucuugguaaaaugguacaccaaauuuucgguagugcuuauacagcacuauuuagcggcguaucaugggugaugaaaauagggauuggcguguuacuaacguggauaggguuaaauucuaaaaacacaagcaugaguuuuucgugcaucgcuaucgguauaauuacacuauaccugggagcuguuguacaagcagauaugggauguguuauaaauuggaaggguaaagaacuuaaauguggcaguggcaucuuuguuacuaaugaaguccauaccuggacagaacaauauaaauuccaagcggacucaccaaagaggcuagcgaccgccauagcaggggcaugggagaauggcguuugcggaauaaggagcaccacccgcauggagaaucucuuauggaaacaaauugcaaacgaauuaaacuacaucuugugggaaaacaacaucaaacuaacuguuguagucggcgauaucauaggcguucuagaacaggguaaaagaacgcuuacaccacagcccauggaacuaaaguauucauggaaaacaugggguaaagcaaaaauagucacugcugagacgcaaaacaguucauucauuauagacggaccaaacacaccugaauguccaagcgcaaguagggcauggaacguuugggaaguugaagauuacggcuuuggagucuuuaccaccaauauauggcucaaauuaagggaggucuauacgcaacugugcgaucauagguuaauguccgccgcagucaaagacgaaagagccgugcacgcagacaugggguauuggauagaaagccagaaaaacgguuccuggaaauuagaaaaggcuucauuaauugaagucaaaaccuguacauggccaaaaagccauacucucuggaguaauggcguauuagaaucggauaugauaauaccaaaaucauuggcugguccuaucucacaacauaauuaucguccaggauaccauacacagaccgcagggccauggcaucucggaaaauuggaacuagacuucaauuauugcgagggaacaaccgugguaauuacugaaaauugcgguacaagaggcccgucgcugcgcacgacaacaguaucagguaagcucauccaugaaugguguuguagaaguuguaccuuacccccacuaagguacaugggugaggaugggugcugguacgguauggagauaagaccuauaucggagaaagaagaaaauaugguaaagucauugguaucagcaggcucaggugaaguagacaauuucacaaugggcguacuuugccuugccauauuauuugaagaggugaugagagguaaguucggcaaaaagcauaugauugcuggcguauuucuaaccuucguacuacuauuaagcggucaaauaacuuggagagacauggcucacacguugaucaugauagguucuaaugcaucagaucgcaugggaaugggcgucacuuauuuagcccuuauagcuacuuuuaaaauccaaccauuuuuagcuuuaggcuuuuuccugcgaaaauuaaccaguagagaaaaucuucuauuaggaguugggcuggcaauggcaacaacuuugcaguugcccgaagacauugaacaaauggcuaauggaauagcacuagguuuaauggcacucaaacuuauaacucaauuugagacauaucaguuauggacugcauugauaucauuaacuugcucaaacacgauauuuacauugacuguugcuuggcguacugcgacuuugauccuagcugggguaagucucuugccaguaugccaaaguuccagcaugaggaaaacugauuggcuuccaaugaccguugcggcaaugggugucccuccauugccauuauucauauucaacuuaaaggacaccuuaaaaagaagaucguggccauugaacgaaggagugauggcuguuggguuagugucaauacucgcgaguucguuauugagaaacgaugucccaauggcugggccccuaguagcuggcggacucuuaauagcuugcuauguuaucacaggcaccagugcagauuuaacaguggaaaaagcggccgacguuacuugggaagaggaagcugagcagacaggagucucacauaauuugaugauuaccgucgacgacgacgggacaaugaggauaaaagaugaugaaaccgaaaacauauuaaccguccuacuaaaaacugcuuuacuuauagugagcggaauuuuuccauauaguauacccgcaacauuacucguuuggcauaccuggcagaagcaaacacaacguucagguguacugugggaugugccuucuccuccugagacucagaaagcugaacuggaggagggcguauacagaaucaaacagcaggguaucuuugggaaaacucaaguagggguagguguacaaaaagaaggaguauuccauacaauguggcaugucacacgaggggcgguucuaacauauaacgggaaaagacucgaaccaaauugggcgucaguuaagaaagaucuaauaaguuauggagguggguggcgucucucugcacaauggcaaaagggggaagaaguucaggucauagcaguagaaccagggaaaaaucccaaaaauuuucaaacgaugccugggacauuccaaaccacuacuggggaaauuggagcaaucgcgcuagauuuuaaaccaggcaccagcggcagucccauaauaaacagagaaggaaagguagucgggcuuuaugggaacggaguaguaacgaaaaaugguggauauguuucgggaauugcgcaaaccaaugcagaaccugaugggccaacgcccgaauuggaagaagaaauguucaagaaacgaaaucuuacgauaauggacuuacacccuggaucagggaaaacaagaaaauauuuaccagcgauaguacgggaagccauuaaacgaagacuaaggacacuaauucuagcaccuacaagaguagucgcagccgaaauggaagaggcgcuaaaaggauuaccaauaagauaccaaacaacagcaaccaaaagugaacauaccggaagggagauuguggaucucaugugucacgcuaccuuuacaaugcgccucuuaucaccgguacguguuccaaacuacaacuugauaauaauggacgaagcacacuuuacagacccagccucuauagccgcacguggauauauaucuacaagagucggaaugggugaagcagcagcaauauuuaugacugcgacaccaccaggaacugccgaugcuuuuccccaaucaaaugccccaauacaagaugaagaacgugacauacccgaacgaaguuggaacucuggcaaugaauggauaacugacuuugcagggaagaccgucugguuuguaccaucuauuaaagcaggaaaugauaucgcaaacugccugcguaaaaacggaaagaaagucauacaacucagcagaaaaacauucgauacagaauaucagaaaacaaaacuaaaugauugggacuucguaguaacgacugauauaucugaaaugggagcgaauuucaaagcagacagaguuauugauccacggagaugucuuaaaccaguaauacuuacggacggacccgaacgaguuauucuagcuggaccaaugccaguuacagccgcaagugcugcgcaacgaagaggccggguaggucguaacccucaaaaggagaaugaccaauacauauuuacuggacaaccauuaaacaacgacgaagaucaugcacacuggaccgaggcgaagaugcuacucgauaauauaaacacgccggaaggcauuauacccgcacuauuugaaccagaaagagaaaaaucagcagccaucgacggagaauauagacuaaaaggcgaaucuagaaaaacuuucguagaguuaaugagaagaggagauuuacccgucuggcucgcacacaaaguugcauccgaaggaauaaaauacaccgaccgcaaauggugcuucgauggccaaagaaauaaucaaauacuagaagaaaacauggacguagagauauggacaaaggaaggcgagaagaagaaacuaagaccccgcugguuggaugcacgaacauauuccgauccuuuagcguuaaaagaauuuaaagauuuugcggcgggaagaaaaucuauagcucuugauuuaguaacagaaauaggcagaguacccacucauuuggcucauagaacccgcaacgcgcuagauaaccucgucaugcuacauacaagugaacacggaggaaaagccuaucgccacgcaguugaagaauuacccgaaacaauggaaacucuucucuuacuuggauuaaugauacuccuuacaggaggugcgauguuguuucuaauauccggaaaagguauugggaagacaagcaucggauuaauauguguuauugcgucgaguggaaugcuauggauggccgagauaccacuacaauggaucgccucggcaauaguucuagaguucuuuaugaugguacuauuaauuccggaacccgaaaaacaaagaacaccacaagacaaccaauuagccuaugugguaauuggaauuuuaacucucgcagcaauuauagcggcaaaugaaauggggcuuuuagaaacaacaaaaagagaccucgguaugucaaaggaaccaggcguuguuucacccacaucuuaucuugauguagauuuacauccggcaucggcguggacgcuuuacgcagucgccacuacgguaauaacgccuauguuacgccacacaauugaaaacucuacggcaaacgucuccuuagcagcaauagcuaaccaagcagugguacucaugggucuugauaaaggauggccuauuagcaagauggaucuaggaguaccauuacuagcauuaggguguuauucccaaguuaacccacuaacacuuacagcggcuguacuacugcuuauaacccacuaugccauuauuggaccuggucuacaagcaaaagcgaccagagaagcgcagaaaaggacugcagcaggaauuaugaagaacccaacuguugacggcauuaugacgauagauuuagaucccguuauuuaugauagcaaauuugagaaacaacuaggacaaguaauguuauuaguucugugugcaguacaacuuuuauuaaugcgaaccucuugggcguuaugcgaggcuuugacguuagcaacggguccgauuacuacgcucugggaagguucgccagggaaauuuuggaacaccacaauagcaguaucaauggccaauauauuccgggggucguauuuagcgggggcuggacuugccuuuuccaucaugaaaucuguagguacgggcaaaagaggcacuggaucacagggugaaacauugggcgaaaaguggaagaagaaauuaaaucaguuaucacguaaggaguucgaucucuacaagaaaagcggcauuacagagguugaucguacugaagcaaaggaagguuuaaagagaggcgaaauaacgcaucacgccgucagccgcggauccgccaaacuacaaugguuuguagagcguaacaugguuauaccugaaggaaggguaauagaucuuggauguggaagagguggguggagcuacuacugugcaggccuuaagaaagucaccgagguucgugguuauacgaagggcgggccaggccacgaagaaccaguaccaaugagcacuuacggauggaauauaguaaaauugaugagugggaaagacguauucuauuuacccccagagaaaugugacacacucuuaugugauauaggagagucgucaccuuccccgaccguagaagagagucgaacaauacguguacuaaagauggucgaaccuuggcucaaaaauaaucaguuuugcaucaaagucuuaaauccguacaugccgacgguuauagaacaucuugaaagauuacagcgaaaacauggaggaaugcuaguucgaaauccacucucgagaaauucaacacacgaaauguauuggaucagcaaugggacugguaacauaguagcaagcgugaauaugguaagccgucuccuucuuaauagguuuacaaugacucaccgacgacccacgauugagaaagacguagaucugggggcugguacaaggcacgucaaugcggaacccgagacucccaacauggauguaaucggugaaaggauaaaaagaauuaaagaagaacauaauucaacauggcacuaugaugacgagaaucccuauaaaacuugggcauaucauggcagcuaugaaguaaaagcaacugguagcgcgucaaguaugaucaacggaguaguaaagcuccugaccaaaccaugggacguaguacccaugguaacacagauggcaaugacagacacgacaccuuuuggacaacagagagucuucaaagaaaaaguugauacuagaacaccucguaguaugccugggacaaggagagucaugggaauuacggcagaauggcuauggagaacauuaggaagaaauaaaaagcccagacuaugcacgcgggaggaauuuacaaagaaaguuagaaccaaugcagcaaugggugccgucuuuacagaggagaaucagugggauucagcaaaagcggcugucgaagaugaagacuucuggaaauuggucgaucgcgaaagagaacuucauaagcucggaaaauguggaagcuguguauacaauaugaugggcaaaagggagaagaaauuaggugaauuuggcaaagcaaaaggaucgcgcgcuauuugguacaugugguuaggggcaagauaucuugaauuugaagccuuaggguuccuuaaugaagaucauugguucaguagagaaaauucauauagugggguugaaggcgaaggauuacauaaauuaggauacauacuaagagauauaucaaagauuccgggaggagcuauguacgcggaugacaccgcggguugggacacacgaauaacugaggacgacuuacauaacgaagagaaaauaacucaacaaauggauccagaacaucgacaguuggcaaaugcgauauuuaaacucacuuaucaaaacaagguagugaagguucagagaccuacacccacagguacgguuauggauauaauaagucggaaggaucaaagagguaguggacaaguggguacguacggccuuaacacuuuuacaaacauggaagcccaacuuauaaggcagauggaaggagaagggguucuaagcaaagcagaccuagaaaauccacauuugccagaaaagaagaucacccaaugguuagaaacuaaaggcguggagagacuaaaaagaauggcgauaucaggagacgacugcguaguaaaaccgaucgaugaccgauucgccaacgcacuccuagcauuaaaugauaugggaaagguucgcaaggacaucccgcaauggcaaccuagcaaaggcuggcacgacuggcaacaaguaccuuuuugcagccaucacuuccaugaguuaauaaugaaggauggaaggaaacuugugguuccaugccguccccaagaugagcugauuggcagagcgagaaucucccaaggugccgguuggucccuacgagaaacagcaugcuuagggaaagcguaugcacaaauguggucacuaauguacuuucaccgcagagaccuccgauuagcuucaaaugccauuugcagcgccgucccuguacauuggguaccgacgucucgaacuaccuggucaauacacgcucaucaccaauggaugaccacagaagauaugcucacuguauggaauagaguuuggauagaagacaauccuuggauggaagacaaaacaccgguuacgacgugggaaaacgugcccuaucugggaaaaagagaagaccaauggugugguaguuugauaggacuaaccucacgagcuacgugggcacagaacauuccuacagcuauacaacagguucggaguuuaaucggaaaugaagaauuucuugacuacaugccaucuaugaaaagguuucgaaaagaagaagaaagcgaaggagcaauuugguaa

SEQ ID NO: 23454 - RNA, 9873 nt, Artificial Sequence
  derived and/or modified CDS sequence (opt6) from DENV-3__FJ898474__SS-prME
acuucauugugucugaugaugauacuaccagcagcacuggcauuucacuugacaucaagggauggugaaccgaggaugauaguuggcaaaaacgaacgagggaaaucuuuguuauuuaaaacagcaagcggaauaaauauguguacacuaaucgcgauggaucuaggagaaaugugugaugacacggucacuuauaaaugcccacauaucacagaaguagaaccagaagacauagauugcuggugcaaccuaacaucuacauggguaaccuacgguacauguaaccaagcaggagaacaucgccgagacaaaagguccguagcauuagcuccgcacgugggaaugggacuugauacacgcacacaaacguggaugucggcggaaggugcuuggagacaaguagaaaaaguggaaacaugggcgcuuagacacccuggauuuacaauauuagcauuauuucucgcacauuacaucgggacauccuuaacacaaaaagugguuauauuuaucuuacuuaugcuagucacaccgagcaugaccaugagguguguaggggucgggaaucgagacuuuguggaggggcugucuggagcaacuuggguagauguagugcuagaacauggaggguguguaacuaccauggcuaaaaauaaaccuacguuagacauagaguugcagaaaacagaagcaacacaauuggcuacacuaagaaaauuauguaucgaggggaaaauaacgaacauaacgacugauucgagauguccgacacaaggggaagcggcacucccagaggagcaagaccaaaacuauguguguaaacacaccuauguagaucgaggauggggaaacggaugcggacuuuuuggaaaaggaucuuuagugacaugugcaaaauuccaaugccuggaaccaaucgaaggaaaaguaguucaauacgaaaauuuaaaauauacgguaauaauuaccguacauacaggugaucaacaucaaguaggaaacgaaacacaaggaguuacggcggaaauuacgccccaagcaucaacuacugaagcaauuuuaccugaauauggaacccuuggucucgaauguucuccacguacgggauuagacuucaaugaaaugauauuauugacaaugaaaaauaaagcauggaugguacaucgucaaugguuuuucgaccuuccgcucccauggacauccggagcaacaaccgaaacuccaacauggaacagaaaggaacugcucguaacauuuaaaaaugcucacgccaagaaacaagagguagucguucuaggaagucaagaaggcgcaaugcauacagcauugacaggagccacugaaauccaaaauucgggcgggacuucuauuuuugcaggccacuugaaaugucgcuugaaaauggauaaauuagagcuuaaaggcaugaguuaugccauguguacgaauacauucguacuuaaaaaggagguaucagaaacccaacacggaaccauccucauuaagguugaauacaagggcgaagauguaccuuguaaaauaccguucucaacugaggauggacagggaaaagcacauaacgggagacuaauaacagcuaacccgguugucaccaagaaagaggaaccaguuaacauagaggcagaaccgccuuuuggagaauccaauauaguaauuggaauaggagauaaugcccuaaagauaaauugguacaagaaaggaagcucaauaggaaaaauguucgaggcuaccgcaaggggugcgagaagaauggcaauauugggagacacagcgugggauuuugguaguguaggaggaguauuaaauuccuuagguaaaaugguccaucagauauucgggucagccuauacagcauuauuuucaggaguuuccuggguuaugaagauugggauaggcguucuacuaacuuggaucggacuaaauuccaagaacacuuccaugucauucaguuguauugccauaggaauaauuacucucuaccuaggagcaguuguacaagcagauaugggauguguuauuaauuggaaaggcaaagaguuaaaaugcggcucuggaauuuucguuacaaaugaaguacacacauggacagagcaauacaaauuucaggcugacaguccuaaacgacucgcaacagccaucgcuggugccugggagaauggugucuguggaauaaggagcacaacuagaauggagaaccugcuauggaaacagauagcuaacgaauuaaacuauauauugugggagaacaauauaaaauuaacagucguaguaggggauauuauagguguauuggaacaggguaagcggacccuuacuccccaaccgauggaacuaaaauauucauggaaaacaugggguaaggccaagauuaugacugcagaaacccaaaacucaucguuuaucauugacgguccaaauacaccugaaugcccuagcgccucuagggcuuggaacguuugggaagucgaagauuaugguuuuggaguauuuacgaccaauaucuggcuaaaauugcgagaaguuuauacucaauuaugcgaucauagacuuaugucggcugcaauuaaggacgaaagagcuguacaugcagauaugggauauuggauugaaagccagaagaauggaucauggaaauuagaaaaagcaagucucauagaaguaaaaacaugcacguggccgaaaagccauacgcuauggaguaacgggguccuagaaagugauaugauaauuccuaaaggcuuagcggguccaauaagucaacauaaucaucguccuggauaucauacgcagaccgcuggaccuuggcaccuaggaaaauuagaauuagacuuuaauuauugcgaggguacuacuguugucauaacggaaaacuguggaacuagggguccaucacugagaacgacaacaguguccggaaaacuuauacaugaauggugcugucguaguugcacacuaccuccauuaagguacaucggggaggacggguguugguacgggauggaaauuagacccaucucagagaaagaagagaauauggucaagucauuaguaucugcaggcucaggcaaagucgauaauuucacaaugggcguuuugugcuuagcaauacuauuugaagaaguuaugagagguaaauuuggcaagaaacauaugaucgcaggcguauucuuuaccuucguucuucuauuaaguggacaaauaacauggagagacauggcacacacuuuaaucaugauuggaucaaaugcauccgaccggauggguaugggcguuacauaccuagcacugauagcuacguuuaaaauacaacccuucuuggccuuagguuucuuuuuaagaaaacucacaucgcgugaaaaccuauuauuggguguaggacuugccauggcaacaaccuugcagcuaccggaggauauagaacaaauggcaaauggaaucgcguugggguuaauggcgcugaaacuaaucacccaauucgaaacauaccaacuauggaccgcuuugaucucucuuacuugcagcaauacaaucuucacccuuacaguagccuggcgaaccgcuacauugauacuggcuggaguaucuuuauuacccgucugucaaaguucaucgaugcguaaaacagauugguugccaauggcuguagcagcuaugggcguaccucccuuaccucuuuucauauuuagcuuaaaagauaccuuaaagcguagguccuggccucuuaaugaaggaguaauggcagugggcuugguaucaauacuagcaucaucccuucuuagaaacgauguuccgauggccggcccuuuagucgcgggaggauuacuaauagcaugcuacgugauaacagguacuuccgcugauuuaacaguagaaaaagccgcugacauaaccugggaagaagaagcagaacaaacggguguuucacacaaucugaugauaacuguugacgacgacggaacuaugagaauuaaggaugaugaaaccgaaaacauccucacgguauuauuaaaaacggcccuuuuaauuguaagugggauuuucccuuacucuaucccagccacccuauuagucuggcacacauggcagaaacaaacacaacgaaguggagugcuaugggauguuccgucuccgccagaaacucaaaaggccgaacuggaagagggaguauaccgaauuaaacagcaggguauauucgggaaaacacagguaggugucggaguucaaaaagaaggcguauuucauaccauguggcauguaacaagaggggcuguauugacuuauaaugggaaaagacuagaaccuaauugggcaucugugaagaaagauuuaauaucguaugguggagguuggaggcuuucugcucaauggcaaaaaggagaagaaguucagguaauagcaguagaaccuggcaagaaccccaaaaauuuucaaaccaugcccgguacauuccagaccauuacuggagaaauuggugcaaucgcccuugauuuuaagccaggaaccuccggauccccuauaauaaauagagaggguaaaguuguuggacuauacggcaaugguguugucacuaagaaugggggauauguaagcggaauagcucaaaccaaugcugagccagaugggccaacuccagaacuugaagaggaaauguucaagaaacguaauuuaaccaucauggaccuccauccgggcucagggaagacuagaaaauaccucccggcaaucgugcgugaagcaauaaaaagaagacuaagaacccuuauacuggcuccgacgagaguugucgcggcugaaauggaagaagcauugaaagguuuaccuauaagauaccaaaccacggcaacaaagucggaacacaccggacgugaaauaguugaucucaugugucacgcgacuuucacgaugcgacuauuaucaccaguacgaguuccuaacuacaauuuaauaaucauggacgaagcgcauuuuacagauccugcuucaauugcugcuagggguuauauaucuacaaggguagggaugggagaagccgcugcaauauucaugacagcaacaccuccuggaacugcugaugcauucccucaauccaaugcucccauccaagaugaagaaagggacauuccagaacgcucuuggaacaguggaaacgaauggaucacggacuuugcugggaaaaccguaugguuuguacccagcauaaaagcaggaaacgauauagcaaauugcuuaaggaaaaacgguaagaaagucauacaacucagccgaaaaacauuugacacugaauaucagaaaacuaaguuaaaugauugggauuucguuguuacuacagacauaucagaaaugggugcuaacuucaaagcugacagaguuaucgacccucggcgcugucuaaagcccgugauucuuacagauggcccugagcgaguaauccuagcaggaccaaugccuguuacggccgcaagugcagcccaacgucgaggacguguagggcguaauccucaaaaagaaaacgaccaauacauauuuacaggucaaccacucaacaacgacgaagaccacgcucacuggacugaggccaaaaugcuauuagacaauaucaauacaccugaagggauaauuccagcgcucuuugagccggaacgggaaaaaucggcugcaaucgauggagaauauagauuaaaaggugagagcagaaaaacauuuguagaauugaugagaagaggggauuugccaguaugguuagcucacaaaguggcgagugaaggcauaaaauauacugauagaaaaugguguuucgacgggcagagaaauaaucagauauuagaagaaaauauggauguggaaauauggacaaaagagggagagaaaaagaaacuuaggccaagaugguuagaugcuagaaccuacucugacccucuagcauugaaagaauuuaaagacuucgcagcaggacgcaaaaguauugcauuggaucuaguuaccgagauaggucguguucccucccacuuagcacaccggacuagaaaugcauuagauaaccuaguaaugcuucauacgucagaacacggcggacgagcguauagacacgcggucgaagaacugcccgaaacaauggaaacucuauugcuucuaggauuaaugauacuauuaacggguggcgcuauguuauuccuuauuucuggcaaagguauagguaaaaccagcaucggucuuauuuguguaauagcuaguucaggcauguuguggauggccgagaucccucuucaauggauugcaucugccauaguauuagaguuuuucaugauggugcugcuuauaccggagccagagaaacaacgaaccccacaagauaaccaauuagccuacguaguaaucgggauacuaacccuagcugcaauuauagcagcgaaugaaauggggcuauuggaaaccacaaaaagagaucuagguaugaguaaagaaccggguguaguaucaccuacaucuuaccuugauguagacuuacauccagcaagugccuggaccuuguaugccguagcaacaacggucauaacaccaauguuaaggcauacaauugaaaacuccaccgcaaauguaucacuagcugccauagccaaucaagccguaguauuaauggguuuagacaaaggauggccaauaagcaaaauggaccugggcguuccucuauuagcauuaggauguuauagucaaguaaauccauuaacgcuaacagcagcuguuuugcuacuaauaacucauuaugcaauuauaggcccgggucuacaagcaaaggcuacaagagaagcucagaaaaggaccgccgcugguauaaugaaaaauccaacaguugaugggauuaugacuauugacuuagauccuguaauauaugacaguaaguucgagaagcaguugggacaaguaaugcuauuaguacucugugccguacaacuacucuuaaugagaacauccugggcacuaugcgaagcgcucacucuagcaacaggcccaaucacgacgcuuugggagggaucaccuggaaaauuuuggaauaccacuauagccgucucaauggcuaacauauuucgagguagcuacuuggccggcgcgggccuagcauucagcauaaugaaaagcguagguacagggaagcguggaacaggaucccaaggagaaacccuuggcgaaaaguggaaaaagaaacugaaccaacuaucucgaaaggaguuugaccuuuacaagaaaucagguauuaccgaaguggacaggaccgaggccaaagaagguuugaaacguggugagacaacacaucaugcagucaguagaggaucggccaaauugcaaugguuuguugagcgcaacaugguaauaccagaagguagagucauagauuuaggaugcggucgcggaggcuggaguuauuauugcgccggccuaaagaaaguaacugagguaagaggauacacaaaaggaggucccggucacgaagaaccaguuccgaugucuacuuauggcuggaauauugucaaauuaaugucagggaaggacguauuuuaccuuccaccagaaaaaugugauacacuacucugugacauuggcgagucgaguccaagcccaacaguugaggaaucgcgaacuauacguguacuaaaaaugguugagccuuggcucaaaaauaaccaauuuugcauuaaaguacuaaaucccuacaugccaacaguaauagaacaccucgaacgauuacagagaaagcauggcggaaugcucgugaggaauccacugucaagaaacuccacccacgaaauguacuggauaaguaaugguacugguaacaucguugcaagugucaauauggucucaagacucuuacuuaaccgauuuaccaugacccaucgaagaccuacaauagagaaagauguagaccuuggugcaggaacacgucacgucaacgcugagccggaaacacccaauauggauguuaucggagaaagaauaaaacguauuaaagaagaacacaauaguacuuggcauuacgaugacgagaaccccuacaaaacuugggcguaucacggaucauacgagguaaaagccacgggaucagccaguuccaugauaaacgguguagucaaacuucuaacaaagccaugggacguaguaccuaugguaacgcagauggcuaugacagauacaacgccuuucgggcaacaaagaguuuuuaaggagaaaguagauacacguacaccucgaucuaugccugggacaagacgaguaauggguauuaccgcugaauggcuauggagaacuuuaggacgcaacaagaaaccuagauuauguacucgugaagaguuuacuaaaaagguucgaacuaacgccgcaaugggagcuguguuuacagaagaaaaucaaugggauucagcaaaggcugcaguugaagaugaagauuuuuggaaauuaguagaucgagaaagggaauuacauaaauugggcaaauguggaucuugcgucuauaauaugauggguaagagagagaagaaacuaggugaauuuggaaaagcgaaagguucccgugcaauaugguauauguggcuaggagcuagauacuuagaauuugaagcucucggcuuucuaaaugaagaccauugguucagucgcgaaaauucuuacucaggaguagaaggugagggucuccauaaacuugguuacauauugcgcgacauaaguaaaauaccugggggcgcaauguaugcagaugacacagcugggugggacacaaggauaacugaggaugaucuccacaacgaagagaaaauaacucagcaaauggacccagagcacagacaauuggcaaacgcgauuuucaaguuaaccuaccaaaauaaaguaguaaaaguacaacgaccuacaccaacuggaacaguuauggacaucaucucaagaaaagaucaaagagggucaggacaaguuggaacuuacggauuaaauacuuucacgaauauggaagcacaacuaaucagacaaauggaaggcgagggcgucuugucuaaagcagaccuagaaucaccucaccuacccgagaagaaaaucacacaauggcucgaaacgaaagggguagaaagacucaagcggauggcuauuuccggggacgacuguguaguuaaacccauagaugaucgauucgcaaaugcauuauuagcacugaacgauaugggaaaaguuaggaaagauaucccccaauggcaaccgagcaagggauggcaugacuggcagcaaguuccauuuuguucacaucacuuucaugaacuuaucaugaaagacgggcgcaaacugguagugccaugcagaccacaagacgaacugauagguagagcacguauaucgcaaggcgccggauggaguuugcgggagacagcgugccugggaaaagcauaugcccaaauguggaguuugauguacuuccaccggagagauuuaagauuagccaguaacgcaauaugcucagcaguaccaguucacuggguucccacaucucguacuacuuggaguauacaugcccaucaccaguggaugacaacagaggacauguuaaccguauggaaccgugucuggauagaagauaauccauggauggaggacaaaacaccuguaaccacuugggaaaacguacccuacuuagguaaacgagaagaucaauggugugguagccuaauaggucuuacauccagagcgacuugggcccaaaauauaccaacagcaauucaacaagucagaucacuuauaggaaaugaagaauuucuagauuacaugccguccaugaaacguuuucguaaggaagaagagucggaaggugcaauaugguaa

SEQ ID NO: 23455 - RNA, 9873 nt, Artificial Sequence
  derived and/or modified CDS sequence (opt6) from DENV-3__EU529688__SS-prME
accucgcuuugccugaugaugauacugccagcagcauuagcuuuucaucuaacgagcagggauggugaaccucguaugauagucggcaaaaacgaaaggggaaaaucacuacuguuuaaaacggcgagugguaucaacaugugcacucuaauagcaauggaucuaggagaaaugugugaugauacugugaccuauaaaugcccacacauaacagagguggaaccugaagacauagauugcuggugcaauuuaacauccacuugggucacuuacggaacaugcaaucaagcuggagaacaucggagggacaaaaggucuguagcacuugcuccgcacguagggaugggauuagacacccgaacucaaacauggaugagcgcggaaggagcuuggagacaaguagaaaaaguugaaacaugggcauuaagacacccaggauucaccauccuagcuuuguucuuggcacacuauaucggaacaucgcuaacccaaaaaguagucaucuuuauacuacuuauguuaguaacgccaaguaugacaaugcgguguguaggggucggaaaccgugacuuuguugaaggguugaguggcgcaacauggguagacgugguauuggagcauggaggauguguaacgaccauggcgaaaaacaaaccgacgcuagacauagaacuacagaaaacagaagcaacacaauuagcaacauuaagaaaauuauguaucgaaggcaaaaucaccaauauaacaacagacucaaggugcccuacucaaggagaggcaguguugccggaagaacaagaccaaaauuauguuugcaaacauacauauguagaucguggauggggcaacggcugcgggcuuuuugguaaagggucgcuuguaacaugugcuaaauuccaauguuuagaaccaauugaaggaaaaguagugcaauaugaaaaucuaaaauauacugugaucauaaccguacauaccggcgaucaacaccaaguaggaaacgaaacacaagguguuacggcagaaauaacuccucaagcaucaaccacagaagcaauucugccugaauacggaacguuaggacuagaaugcaguccaaggacagguuuagauuuuaaugagaugauccuuuuaacaaugaaaaauaaagcauggaugguacacaggcaaugguucuuugaucugccccucccuuggacuuccggagcaacgacugagaccccuaccuggaacagaaaagaauuguuaguaacauucaaaaaugcacacgccaagaaacaagaagucguagucuuaggaagccaagaaggagcaaugcauacugcgcucacuggagcuacagagauacaaaacaguggcgggacaucaaucuuugcaggacauuuaaaaugccgguuaaaaauggacaaacuagagcucaaagguaugucauacgccauguguacuaacacuuucgugcucaagaaagaagugagcgaaacccaacaugggaccauauuaauaaaaguugaguauaaaggagaagaugugccuugcaaaauuccauucuccacggaagacggacaaggcaaagcccauaacggcaggcucauaacagcgaacccagugguaacuaagaaagaagaaccaguaaacauugaagccgagccaccuuuuggcgaaagcaauauugugauuggaaucggugauaaugccuuaaaaauaaacugguauaagaaaggaaguaguauuggcaaaauguucgaagccacagcgcgaggugcgagacggauggcaauuuugggcgauacggcuugggauuuuggaaguguagguggaguacucaauucacucgguaaaaugguucaccaaaucuucgguucagcauacacugcauuguucaguggagugucauggguaaugaagauugguauaggcguccuacugacauggaucggauuaaauagcaaaaauaccaguaugagcuuuaguuguauagcuauagggauuauuacucuauauuuaggugccgugguccaagcggauauggguugugugauuaauuggaaagguaaagaacucaaaugcgguuccggcauuuuuguuacgaacgaaguccacacuuggaccgaacaauauaaguuccaagcagauaguccuaaaaggcuagcgaccgcaaucgcuggcgccugggaaaacggugucugcggaauccgcucaacuacaaggauggaaaaccuacuauggaaacaaauugcaaaugaacucaacuacauucuaugggaaaauaauauuaaacugacaguaguugucggggacacuauaggaguuuuggaacaaggcaagagaacucuaacgccucaaccaauggaauuaaaauauucauggaaaacguggggaaaagcaaaaauagugacagcagaaacacaaaauucuucguucauaauugacgggccuaauaccccagaauguccaagcgcgucuagagcauggaaugugugggaaguugaagacuauggauucggaguauucacuacaaauauauggcuaaagcuaagggaaguauacacacagcuaugugaucaccgcuuaaugucugccgcugugaaagaugaacgcgcgguucacgcagauaugggauauuggaucgaaagucagaaaaaugggaguuggaagcuagaaaaggcuucccucauugaaguaaagacguguacuuggccaaaaagccauacucuguggucgaacgggguuuuagaauccgacaugauaauucccaagucacuagcugggccaauaagccaacacaacuaccggccaggcuaucacacacagacagcaggaccauggcaucuaggaaaacuagaauuagacuucaauuacugcgaaggaacuacuguugucaucacugaaaauuguggaacgcgagguccaagucucagaacuacaacaguaucugguaaacucauacaugagugguguuguagaucaugcacgcuaccuccguuaagauauaugggggaggacggauguugguacgguauggagauuaggccgaucagugaaaaagaagaaaauauggugaaaucacuggugucagcugguucaggcgagguagacaacuuuacaauggggguuuuguguuuagcuauucuuuuugaggaagugaugagagguaaauuugguaagaaacauaugauagcaggaguauuuuucacauucguauuauugcuaucuggacagauuacauggagagacauggcacacacuuugauaaugauaggaucgaaugcuucagauagaaugggaauggguguaacauaucuugcauugauagcaacauuuaaaauccaaccauuucuagccuuaggcuuuuucuuacgaaaauugaccagcagagaaaauuuacucuugggugugggacuagcuauggcaacuacacuccaauugccagaagauaucgaacaaauggcaaacggaauagcucucggauuaauggcucucaaauuaauaacacaauucgaaaccuaucaauuauggacagcucuaauuagccucacauguuccaauacuauuuuuacccugaccguagcauggcgaacugcuacacuaauccuugcugguguaucacuucucccaguaugccaaucaaguucuaugcgcaagacagacugguuacccaugacuguagcagcuaugggagugcccccauuaccacuuuuuauauucagcuuaaaggauacccuaaaaagaaggucauggccccucaaugagggaguaauggccguagguuuaguuucuauauuagccaguucucuacuaaggaaugacgugccgauggcagguccgcuaguagcaggagggcugcugauagcguguuacgucauuacgggaaccucagcugaucuaaccguggaaaaagcagccgacgugacaugggaggaggaagcggaacaaacaggagucagccauaauuuaaugauaacuguggaugaugacgguacgaugagaauaaaagaugacgaaacggaaaauauauuaaccgucuuauuaaaaacugcacuuuugauaguuuccgguauauuuccauacagcauuccagcaacauuacuuguauggcauacauggcaaaagcaaacgcaacgaagcgggguacuuugggauguuccauccccuccagaaacacagaaagcagaauuagaagaagggguuuauaggauaaaacagcaagggauauuugguaaaacccaagucggcguaggaguucaaaaggagggaguguuucacacaauguggcacgucacaagaggugccguguuaaccuauaaugguaaacguuuagaaccaaacugggcaucgguuaagaaagaccugauuuccuacggcggaggcuggcgucugucggcacaauggcagaaaggagaagaaguccaaguaauagcgguugagccuggcaaaaaccccaaaaauuuucaaacgaugccgggcacuuuccagacuacaacuggagagauuggggcuauugccuuagauuuuaaaccuggcacuucaggaucaccuauaauaaauagagagggaaaaguaguuggcuuguauggaaauggugucguaacgaaaaacggaggcuauguuucugggauagcucagacuaacgccgaaccugacgguccaaccccugaacuugaggaagagauguuuaagaaacgaaauuugaccaucauggacuuacauccugguucgggcaaaacgaggaaguaccuaccugccauagucagagaggcaauaaagaggagauuacgaacgcuaauccuagcaccaacgcgaguuguagcugccgaaauggaagaggcacuaaaaggauugcccauccgauaccagacaaccgcuacuaagucagagcacacaggaagagaaauaguagaccuaaugugccaugcuacguuuacaaugcgauuauugucacccguaagaguaccaaacuacaacuuaauaauaauggaugaagcucacuucacggauccugcguccauagcagcgcgaggcuauaucuccacaagaguugggaugggagaagccgccgcaauauuuaugacugcaaccccaccgggaaccgccgacgcguuuccccaaagcaacgcucccauccaggacgaagaaagagacauuccugagagauccuggaauagcgguaaugaauggauaacagauuuugcuggaaagacuguuugguucgugccaucuauuaaggcggggaaugacauugcuaacugccuuaggaagaacggaaagaaagugauacagcucucacgaaaaacuuuugacacugaauaccagaaaacaaaacugaaugacugggauuucguggugacgacagauauaagcgagaugggagcaaacuuuaaagcagauagaguuauugacccgagacgcugccuaaaacccguuauacuuacagacgguccugaaagaguaaucuuggcaggaccuaugccggucacagcagcgucugcagcucagagaagaggaaggguaggacggaacccucaaaaagaaaaugaccaguauauuuucacgggacaaccacuaaauaaugaugaagaccacgcacauuggacagaagcgaagaugcuccuggauaacaucaauacaccggaaggcauaauaccagcacuguucgaaccagaacgagaaaagucagcagcuaucgacggugaguauagacuuaaaggagaaucuagaaaaacauucguagaauuaaugagaagaggagaccugccaguuugguuagcucauaaaguugccuccgagggaauaaaauauacugaucgaaagugguguuuugauggccagagaaauaaucaaauauuagaagaaaacauggacguugagauauggacaaaagagggagagaaaaagaaacuucggccaagauggcuugaugcaagaacuuacucagacccucuagcacucaaagaauuuaaagacuuugccgcaggacgaaaaucaauagccuuagacuuggucacggagauagguagaguucccucacauuuagcacaccguacaaggaaugcauuagauaaccuggugaugcuucacacaucagaacauggugguaaagcauacagacaugcagucgaagaacuacccgaaacaauggaaacgcuacucuuguugggcuugaugaucuuacugacuggaggagcaaugcucuuucuaauuagcgguaaaggaauaggcaagaccucuauuggacuuauuugcguaauagcuaguucagggaugcucuggauggcagaaaucccacugcaauggaucgcuagugccaucguacuagaguucuuuaugaugguacuauuaauaccagaaccagaaaagcagcgaaccccgcaagacaaucaacuagcuuacguaguaauaggaauuuuaacacucgcggcaauaaucgcugcgaaugaaauggguuuguuagagacuacaaaacgagaccuagggaugucuaaagagccggguguuguaucucccaccaguuaucuagacguagaccuacauccagcauccgcauggaccuuauacgcaguagcgaccacaguaauaacaccaaugcuccgucauacaauugaaaacuccaccgccaauguuucguuagcugcgauagccaaucaagcuguaguauuaaugggacucgauaagggguggcccaucagcaaaauggacuuagggguaccgcuucuagcauuggggugcuauagccaaguaaacccacugacacucacagccgcggucuuacuccuuaucacacacuaugccauaauaggucccggucuucaagcgaaagcgacucgagaagcgcagaaaagaacagcagcaggcauaaugaaaaauccaacgguagaugggauaaugacaaucgaucuagaucccguaauauaugauaguaaauuugaaaagcaauuaggucaggucaugcuccucguccuaugcgcagugcaauuguuauuaaugaggacgaguugggcucugugcgaggcuuuaacuuuagccacaggacccaucaccaccuuaugggaaggaucaccgggaaaauucuggaacacaacaaucgcaguaaguauggcgaacauauuuagagggucguauuuagccggugcaggccuagcauuuucuaucaugaaaucaguggggacaggaaagagggguacaggcucucaaggggaaacauugggcgaaaaauggaaaaagaaauugaaccaauuaucucguaaggaguuugaccucuauaagaagaguggaauuaccgaaguggaucgaaccgaagccaaagaaggauuaaaacgcggagagaucacgcaucacgcaguaagucgaggcuccgcaaaauugcaaugguucguagaaaggaauaugguuauccccgaagguaggguaaucgaucuggguuguggucguggcgguugguccuauuauugugcgggcuuaaagaaaguaacagaagugagaggguacaccaaaggaggaccaggacaugaggaaccaguuccaaugaguacuuacggauggaauauagugaaacuaaugucagguaaagauguauucuaucuaccaccagagaagugugauaccuuauugugcgacauaggagaguccucuccuagcccgaccgucgaagaaucuaggacuauccgaguauuaaaaaugguugagccauggcuuaagaacaaucaauucuguauaaagguccucaauccauacaugccgaccguaauugagcacuuagaaagauugcagagaaaacauggagggaugcuaguuagaaacccguuaucacguaacaguacacacgaaauguauuggauuuccaaugguacaggaaauauaguggcuucagugaauauggugucgcgcuuguugcuaaauagauuuaccaugacucaucguaggccaaccauagaaaaggacgucgauuugggcgcagguacgaggcauguuaaugcagagccugaaacgccaaauauggauguaauuggagaaagaauaaaaagaauuaaagaagaacacaauaguacauggcauuaugacgaugagaacccauacaaaacaugggcauaccaugguucauacgaagugaaggcgacgggaucugcuucaagcaugauaaacggagugguuaagcuacuaaccaaaccaugggacgucgucccaauggucacgcaaauggcgaugacagacacaacuccauucggucaacaaagaguauuuaaagagaaaguagauacacgaaccccaagaucaaugccugguacgaggagaguuaugggaauuacggcugaauggcucuggagaacucuaggaagaaauaagaaaccuagauugugcacuagagaagaauuuacuaagaaagugcgaacaaacgcugcaaugggugcagucuucaccgaggagaaccaaugggauucagcgaaagcagccgucgaagaugaagauuucuggaaacuuguugaccgagaacgggagcuacauaaauugggcaaaugcgggucauguguguauaauaugaugggcaaacgagagaagaaacucggggaguuugguaaagcuaaggggucaagagcaaucugguauaugugguugggcgccagauaucuagaauuugaagcccucggauucuuaaacgaagaccacugguuuaguagagaaaacucauauagcggcgucgaaggugaaggacuccacaaauugggcuacauacuucgggacauuagcaaaauaccagguggagcaauguacgcagaugauacagcaggaugggacacacggauuaccgaagaugaucuacauaacgaagaaaagauaacccaacaaauggauccugagcaucgacaacucgcaaacgccauauucaaacucacguaccaaaauaagguuguaaaaguacaaagacccacaccgacugggacaguuauggauaucauaucaagaaaagaucagaggggaucgggacaaguuggaacauauggacugaacacuuuuacgaacauggaagcacaauuaauaaggcagauggaaggcgaaggcguucuuaguaaggcugaucuagagaacccucauuuaccggagaagaaaauaacacaaugguuagaaacaaaagggguagaaagauuaaaacgaauggcuauaucgggcgacgacugcgucguuaaaccaauugaugacagguuugcgaaugcgcuuuuagcacuuaaugacaugggaaagguuagaaaagauaucccacaauggcagccgucaaagggcuggcacgacuggcagcaaguucccuuuuguucgcaucacuuccaugaauuaauaaugaaagacgggcggaaauuagugguaccuuguagaccgcaggacgaacuaauagguagagcccguaucagccaaggugcgggguggagucuacgagagacugccugccuuggaaaagcauaugcacaaauguggagcuuaauguacuuucaucgucgggaucuaaggcuugccuccaaugccauauguagcgcggucccuguccacuggguaccgacaagcagaacaaccuggagcauccaugcccaccaccaauggaugacgaccgaagauauguuaacuguauggaauagagucuggauugaagacaacccauggauggaggacaaaacuccggucacaacaugggaaaacgugccguaucuaggaaagcgcgaagaccaaugguguggcagcuuaauuggacuuacuuccagagccacuugggcacaaaacauaccaaccgcgauacagcagguacgcucacuaaucgggaacgaagaguuccuugacuacaugccaaguaugaaacgcuuccgaaaagaagaagaaagugaaggggcuauaugguag

SEQ ID NO: 23456 - RNA, 9873 nt, Artificial Sequence
  derived and/or modified CDS sequence (opt6) from DENV-3__EU482613__SS-prME
acaagcuuguguuuaaugaugaucuugccagcagccuuagcauuucauuuaacaucgagagauggugaaccuaggaugauaguugguaaaaacgaaaggggaaagagucuauuauucaaaacggcgucagguauaaacauguguacucuaauugcaauggacuugggcgaaaugugugaugacacaguaacguacaaguguccacauauuacugaaguugagccagaggauaucgauuguuggugcaaucuuacaucuacauggguaacauacggcacaugcaaccaagcgggagagcauaggagggacaaaagaucgguagcacuagcaccgcacguuggcaugggucucgauacaaggacucaaacguggauguccgcagaaggagccuggcgacaaguagagaaaguagagacaugggcauuaaggcauccaggcuuuaccauuuuggccuuauuucuugcacacuauaucggaacgagcuugacgcaaaaaguagucauuuucauucugcuaaugcuaguaacuccaucaaugacuaugagaugcguaggagucggaaaucgagauuuuguagaaggacuaucaggugcuacgugggucgacguaguauuggagcacgguggcugcgucaccacgauggccaagaacaaaccaaccuuagacaucgaacuacaaaaaacggaagccacgcaacuagcaacacuucgaaagcuauguaucgaagguaagauuacgaauauuacaacagauucgcguuguccaacacaaggcgaagcuguuuuaccggaagaacaagaccaaaauuacguauguaagcauacguaugucgauaggggcugggggaacggauguggauuauuugguaaagguucuuugguaacuugcgcgaaauuccagugucucgaaccuauagaagggaaagugguucaauaugagaaucuaaaguacacagugauaaucacaguacacacgggagaucaacaccaggugggaaacgaaacccagggcguaacugcagaaauuacaccccaggcuaguacaacagaagcaauauuaccggaauauggcacacuugguuuggaauguucaccaaggacuggacuugauuucaaugagaugauccuauugaccaugaagaacaaagcguggaugguacaucgacaaugguuuuuugacuuacccuugcccuggaccucaggggccaccacggaaaccccgacauggaacaggaaggaacuacuuguaacauucaaaaaugcucacgccaagaaacaggagguaguaguucuuggcucacaagagggagcuaugcacacugcacugacuggagccacggagauucaaaauucgggcgguaccaguaucuuugcuggccaucuaaagugccgauuaaaaauggacaaauuggagcuaaaggggauguccuacgcuauguguaccaacaccuuugugcuaaaaaaagaaguguccgagacccagcaugggaccaucuuaauuaaaguagaauauaaaggagaggauguaccgugcaaaauuccauucucgacugaagauggucaaggaaaagcacauaaugggagauugauuacugcaaauccuguugucaccaaaaaagaagaaccuguuaauauugaggcugagccaccauucggagaaucaaacaucgugauaggaauaggagacaacgcgcuaaaaauuaacugguacaaaaaagguagcucuaucggaaaaauguuugaagcuacagcuagaggggcgaggagaauggcuauacucggagauaccgcuugggauuuuggcucaguaggggguguguuaaauucguuaggaaaaaugguacaucaaauauuugguucagcuuauacagcuuuauucaguggaguuagcuggguuaugaagauaggcauaggugugcuauuaaccuggauaggguugaacaguaaaaacacgucaaugucauuuucaugcaucgcgauugguauuauaacauuauaucuuggggccguuguucaggcagacauggguuguguuauuaauuggaaggguaaagaacuuaaauguggcucaggaauuuuugucaccaaugaaguacauacauggaccgaacaauauaaguuucaagccgacucaccaaaaagacucgcuacagcuauagcaggugcgugggaaaauggcguauguggaaucagaucaacaacaagaauggaaaacuuguuauggaaacaaauagcuaacgaacugaauuauaucuuaugggaaaauaauauaaaacugaccguuguggucggagauauaauaggaguacucgaacaaggaaaaagaacccugacgccacaaccaauggaguugaaauacucauggaaaacaugggguaaagcuaagaucguaaccgcugaaacucaaaauaguucauuuauaauugacggucccaauacucccgagugccccucugcaucgagggcauggaauguuugggaagucgaagauuauggauuuggagucuucacuacaaauauaugguuaaaacugcgagaaguauacacgcaauugugugaccauagacugauguccgccgcugugaaagacgaacgagcaguccacgcagauaugggauauuggaucgaaucacagaaaaacggaaguuggaaguuagaaaaagcaaguuuaauagagguuaaaacaugcacauggccaaagucccacacacuauggucaaaugguguacuggagucagacaugauuauaccaaaaucuuuagcagguccaaucagccaacauaauuauagaccagguuaccauacccaaacagccggaccauggcauuugggcaaauuagagcuugauuuuaacuacugugagggaacaaccgucgugaucacggaaaacugcggcacccgaggccccagucuucgcacgacuacgguguccggcaaguugauacacgaaugguguuguaggagcuguacacuuccgccacugagauacaugggugaagauggaugcugguauggaauggaaauacguccuaucuccgaaaaggaagaaaacaugguuaaaucguugguuagugccgggucuggagaaguagauaacuuuaccaugggaguuuuauguuuagcaauauuguucgaagaagugaugcgugggaaauucggaaagaaacauaugauugcaggagucuucuucacauucguacuauuguuaaguggccagauaacauggagagauauggcccauaccuugauaaugaucggaucaaacgccagugacagaauggggauggguguaacuuaccuggcgcuaaucgcaacauuuaaaauucaaccuuuucuugcccuaggauucuuccuaagaaaacuaaccagucgagaaaauuuauuacuagguguuggguuagcaauggcaacgacacuucaguuaccugaagacauagaacaaauggccaauggaaucgcgcuuggguuaauggcucugaaacuuauaacccaguuugaaaccuaucaauuauggacagcacugauuagccuuacgugcucuaauacuauuuucacccucacaguggcauggagaacagcuacauugauccuagcaggaguaucauuguuaccaguaugccaaucuucaucgaugagaaaaacggauuggcugcccaugacaguugcagccaugggugucccgccucuuccuuuguuuauuuuuagucuaaaagauacacuaaagcgccgcucauggccacuaaaugaggggguaauggcgguaggauuaguuucaauauuggcaucgagucuucugcgcaaugauguuccaauggccggaccguugguugcagggggcuugcucauugcuuguuauguaaucacaggaacuucagccgacuuaacaguugagaaagccgcagauguaaccugggaagaggaagcugaacaaacaggggugucacauaaccuaaugaucacgguagacgacgacggaacuaugagaauaaaggaugaugaaacugaaaauauacuaacaguacuuuuaaagacagcauuguuaauaguuagcggaauuuuucccuacucuauucccgcaacacuuuuagucuggcauacauggcaaaagcagacucaacgcagcgggguccucugggauguucccucgccccccgaaacgcaaaaagcugaacuugaagaaggaguauaucgcaucaagcaacagggaauuuuuggaaaaacacaaguggguguagguguacaaaaagagggaguguuccacaccauguggcacgucacucgaggagcugugcucacuuacaaugggaaaagacuggaaccaaauugggcuagcgucaagaaagauuugauaucauauggcgguggguggcgacuuagugcacaauggcagaaaggggaggagguacagguaauagcgguugaaccggggaaaaaucccaaaaacuuucaaaccaugccagggaccuuucagacuacaacuggagaaauuggcgcuaucgcacuggauuuuaagcccggaacaucagguucuccuauaaucaaccgcgaaggaaagaucguaggacuguaugguaacgggguuguaacaaaaaauggaggauauguaucagggauugcucaaaccaaugcagaaccagauggaccgacaccugaacuagaggaggagauguucaagaagagaaaucucacaauuauggauuugcauccugguucagggaaaacuaggaaauacuuaccagccaucguacgagaagcaauaaaacgacgacuaagaacguugauucuggcaccuaccagaguaguggcagcagaaauggaagaggcuuugaaaggacuaccgauucgauaucaaacuacggcaacgaaaagugaacauacaggucgagagauaguggaucuaaugugucacgcaacauucacuaugagacuuuugucaccgguaaggguuccuaauuauaaccugauaauaauggaugaggcccacuuuacagacccagcguccauagcugcuagaggguacauuagcacaagaguaggaaugggugaagcagcugcaaucuuuaugacagccacgcccccaggcacugcagaugcuuuuccacaaucuaaugcuccaauacaagacgaggaacgagauaucccggaaagaucauggaacaguggcaaugaauggauaaccgauuucgcggggaaaacaguuugguucguaccguccauaaaggcgggcaaugacauugcaaauugucuccgaaaaaacgggaaaaaagucauacaauuaucacgaaaaacauucgacacagaauaccaaaaaacaaaauuaaaugauugggacuuugugguuacuaccgacauaagugaaaugggagcgaacuuuaaggccgaccgaguaauagacccacgaagaugucugaaaccagugauuuugacugaugggccagagagaguaaucuuagcgggaccuaugcccgucacagcugcuagugccgcacaacgcagagguagaguugguagaaauccucaaaaagagaaugaucaauacaucuuuacuggacaaccguugaauaaugacgaggaucacgcccauuggacagaagcaaaaaugcucuuggacaauauaaauacaccggagggaauuauaccagcccuauuugaacccgaaagagaaaaaucggcagcgauugauggagaauauagguugaaaggugaaagcagaaaaacguuugucgaacuaaugcgcagaggcgaucuaccaguuuggcuugcucauaaaguugcgucagaaggaauaaaguacacagacagaaaaugguguuuugauggucagaggaauaaucagauacuggaagaaaauauggacguagaaauauggacuaaagaaggcgagaagaaaaaacuacgacccagauggcuagaugcucggaccuauagugacccucuggcacuaaaagaauuuaaagauuucgcagcaggucguaagucaaucgcuuuagaucuaguuacugagauaggacgaguaccgacacaucuugcgcaucgcacccguaacgcauuggauaauuuagucauguuacacacaucagaacacggagggaaagcguauagacaugcaguugaagaauugccugagacaauggaaaccuugcuccuauuaggguugaugauacuacucacugggggcgcgaugcuuuuucuuauaucuggaaaaggcauagguaagacgagcauuggauugaucugcguaauagcaucuagcggaauguuauggauggcagaaauaccuuuacaauggaucgccucagcaauuguauuagaauuuuucaugaugguuuuguuaauaccagaaccagaaaaacaacgaacaccucaggacaaucaauuagcauauguuguuauaggaauccucacacuagcugcaauuauagcagcgaaugaaaugggacuuuuggaaacgacaaaacgagauuuaggaaugucaaaagaaccagguguaguaucuccuacaucuuaucucgacguggauuugcauccugcaagugcguggacacuauaugcuguugcuacaaccguuauaacaccaauguuacgucacacaauagaaaauucuaccgcaaacgucucauuagcugcuauugccaaccaagcagugguacuaauggggcucgacaagggcuggccaauaagcaagauggauuuaggaguaccacuacuagcuuuaggcuguuauucccaaguuaaucccuuaacuuuaacagcggcagucuuacuccuuauuacacacuacgcaauaauagguccgggauuacaagccaaggcaacccgugaagcgcagaaacgaacagccgccggcaucaugaaaaauccaacaguagacgguauuaugacuauugauuuagaccccguuauauacgacucaaaauuugaaaaacaauugggacaaguuauguugcucguuuugugugcuguacaacuucuguuaaugaggaccaguugggcacuaugugaggcauuaaccuuggcgacagguccaauuacaacuuuaugggagggaagccccgguaaauucuggaacacaaccauagcuguaucaauggcuaauauauuucgugguucauacuuagccggugcaggacuagcuuucucaauaaugaaaagcguuggaaccggaaagagaggaacugggagccaaggcgaaacucucggagagaaauggaagaaaaaauuaaaucaguuauccagaaaagaauucgacuuauauaaaaaaaguggcauaacagagguugauagaacugaagcaaaggagggauugaaaagaggagaaauuacgcaccaugcuguuagcagagguucugcaaaauuacagugguucguagagagaaauaugguaauuccagagggaaggguaauagaucuaggcuguggccgaggaggauggucauacuauugcgcugggcuaaaaaagguaacugaaguccggggcuacacaaaaggaggcccgggccaugaagaaccuguacccaugucaacauacggauggaauauugugaaacuuaugaguggaaaggauguauucuaucuaccaccagaaaagugugauacgcuucuuugugauauaggcgagucaucgccaagcccuacagucgaggaaucaagaacuauacguguauuaaaaaugguagaaccgugguuaaaaaauaaccaguucugcaucaaaguauuaaacccauacaugccgacuguaauagaacaccuagagagguuacaacguaaacauggcggaauguuaguuaggaacccgcuuucgcguaauucuacacacgaaauguauuggaucuccaaugguacaggaaacauugucgcaucgguaaauaugguuucgagguuacuauuaaacagauucacaaugacacaucgucgaccaacaauagaaaaggaugucgaucucggagcugguacaaggcacguuaacgcugaacccgaaacaccuaauauggacguaaucggugaaaggauaaaaagaauaaaagaggaacacaacucgacguggcauuaugaugaugagaauccauauaagaccugggccuaccauggaucauacgaaguaaaagcaacaggaucugcuagcagcaugauaaauggcguaguuaaacuacuuacaaaaccaugggaugucgucccuauggugacacagauggcuaugaccgacacaacuccguucggacagcaacgcgucuucaaagaaaaagucgacacacgaacgccuagaucaaugccggggacgcggagaguaaugggaauaacugcagaaugguuauggagaacgcuaggucgaaauaagaaaccgagacuuugcacgcgagaagaguucaccaaaaagguacgaacaaaugcagccaugggagcaguauuuaccgaggaaaaucaaugggacagugcuaaagcagcagucgaagaugaggauuuuuggaaauugguagaucgugaacgcgaguugcacaaauuagguaaaugugguucaugcguauauaacaugaugggcaaaagggaaaagaaacucggcgaauuugguaaagcgaaaggaucccgagcaauuugguauauguggcuaggcgcuagauauuuagaauucgaagcauugggcuuuuuaaaugaagaucacugguuuucuagagaaaauucguacucaggaguagaaggagaaggucuacacaaacuagguuauauucuacgcgauaucuccaaaauaccagguggagcaauguacgcagaugacacagccggcugggauacuaggauuacagaagacgauuuacacaaugaggaaaaaauuacacaacagauggacccagaacacagacaacucgcgaaugcgauauuuaaacuuacauaucagaacaaggugguaaagguccagcgaccgacuccaacagguacaguuauggauauaauaucuagaaaagaucaaagaggaagcggucaaguggggacauacggacuaaauacguuuacuaauauggaggcccaauuaauccgccaaauggaaggcgaagggguucugagcaaagcggacuuagaaaacccacacuuacccgaaaaaaagauaacccaguggcuugaaacaaaaggaguugagaggcuaaaaagaauggcuauuaguggcgaugauuguguaguaaaaccgauagacgacagauuugcuaaugcacuguuggcuuuaaaugauaugggaaaaguaagaaaagauauuccucaauggcaaccaucaaaagguuggcacgacuggcaacaaguacccuuuugcagucaucauuuccaugaacuaauaaugaaagauggccgaaaacucguugucccguguagaccucaagacgaauuaauugggcgagcaagaauuagucaaggagcuggcuggucucugcgcgaaacagcaugucuugguaaagcauaugcccaaauguggucccuaauguauuuccaccgccgagacuugcgauuagcaucgaacgcuauaugcagugccguuccaguacauuggguacccaccucuagaacuacauggucaauacacgcgcaccaccaauggaugacuacggaagauauguuaacaguuuggaaucgcguauggauugaagauaauccauggauggaagauaaaacaccugucaccacaugggaaaaugugcccuauuuaggcaagcgcgaagaucaguggugcgguucuuuaauaggacucacaagucgagcgaccugggcccaaaauaucccaacugccauucagcaaguccguucuuugaucggaaaugaagaauuuuuagacuauaugccauccaugaaacgauucagaaaggaggaggaaagcgaaggagccauaugguaa

SEQ ID NO: 23457 - RNA, 9873 nt, Artificial Sequence
  derived and/or modified CDS sequence (opt6) from DENV-3__EU529690__SS-prME
acaaguuuaugucuaaugaugauucuaccugccgcauuagcguuccacuuaacgaguagagauggagaaccacguaugauaguagggaaaaacgaaagaggaaaauccuuguuauuuaaaacagcaaguggaauaaauauguguacccuaauugcuauggacuuaggagaaaugugcgaugauacaguuacguauaaaugcccacauauaacagaagucgaaccggaagacauagauuguuggugcaaccuuaccucaacuuggguaacauacggaacuuguaaccaagcaggagaacaucgucgagauaaacgaucaguggcucuagcaccacacguggguauggguuuggauacacgaacgcaaacauggaugucugcagaaggagccuggaggcagguagaaaaaguggaaaccugggcauuaagacauccgggauuuacgauauuggcauuauuuuuggcgcacuacauuggaacuucucucacacagaaaguuguaauauuuauuuuacugaugcucguuacaccuuccaugaccaugagaugcguugguguuggcaaccgagauuuuguagaaggcuuaucgggcgcaacgugggucgauguaguacucgaacauggaggaugcgugaccacaauggcuaaaaauaaaccgacacuagacauagaauuacagaaaaccgaagcaacacaauuagcaacucugcgcaaacuaugcaucgaagguaaaauaacaaacaucacuaccgacucgagaugcccaacccaaggagaagcaguacuaccggaagaacaggaccagaacuacguuuguaaacauacguaugucgaucgcggauggggcaauggaugcggacuauucgggaaagguagcuuaguuacaugcgcaaaauuucaaugcuuagaaccuauagaaggcaaaguaguccaauacgaaaaucuuaaauauacaguaauaauaacuguacauacuggcgaccaacaucaaguuggaaacgaaacacaaggaguaaccgcagaaauuacuccccaagcaagcaccacagaggccauacucccagaauaugguacucuagggcuggaauguaguccacgaacaggccuagauuuuaaugaaaugauacuauugacaaugaaaaauaaagcguggaugguacaccgucaaugguucuuugauuugccacuaccauggacauccggugcaacaaccgaaacaccaacauggaacaggaaagaacuacucguaacauuuaaaaaugcccacgccaagaaacaagaaguuguuguacuugguucucaagaaggcgcaaugcauacagcucuaacaggagcgacugagauucaaaauagcgggggaacaucaauauucgcgggccaucucaaauguaggcuaaaaauggacaaacucgaguugaaaggaaugaguuaugcgauguguacaaauacuuucguccugaagaaagaaguuucggaaacccaacaugguacuauacuaauuaaaguggaauauaaaggagaagauguaccgugcaaaauaccauucagcacugaagauggucaagguaaggcacauaaugggagacucauaacggcaaauccuguaguaaccaagaaagaagaacccguaaauauagaggcggaaccaccauuuggagagagcaacauuguaauagggauaggcgauaacgccuuaaagauaaauugguauaaaaagggaaguaguauagguaaaauguucgaagccacagcuagaggugcgcgccgcauggcaauauuaggggauaccgcaugggauuucggcaguguaggaggaguccuuaauuccuugggaaaaaugguccaccagauauucggaagcgcauauacagccuuauuuucaggagucucuuggguuaugaaaauuggcauagguguacuccuaacuuggauaggucuaaacucgaaaaauacaaguaugucauucucauguaucgccauugguauaauuacacuauauuuaggcgcuguaguccaagcagauacggggugugucauaaacuggaaaggaaaggaacuaaagugcggcaguggcauuuucguuacaaaugagguacacacguggacugagcaguauaaauuccaagccgauagcccaaaacgucuugcaacggcaauugccggugcuugggaaaauggaguauguggaauuagaucaacaacaaggauggagaaccuacuuuggaagcaaauagccaaugaacuaaauuauauucugugggaaaacaacauaaaacuaacaguaguugugggggauauaauaggaguguuagagcagggcaaaaggacucuaacgccacaaccaauggaauuaaaauacucguggaaaacaugggggaaggcaaagauaguaacagcagagacacaaaauaguuccuuuauuaucgaugggccuaacacucccgaaugcccauccgccagcagggcguggaacguuugggaaguggaagacuaugguuuuggcguauuuacgacaaacauuugguuaaaauuacgggaaguuuauacgcaacucugugaucaucgacuuaugagugcggcaguuaaggacgaaagggccguucaugccgacaugggauauuggaucgaaucucagaaaaauggcucuuggaaauuagagaaagcaucguuaauagaaguaaaaacuuguacguggccaaaaucucauacccucuggaguaauggcguacucgaaagugauaugauaauaccaaaaaguuuggcuggaccaauaucucaacauaauuaccguccugguuaucauacgcagaccgcugggccauggcaucuuggcaagcuagaacuugauuuuaacuacugugaaggaacuacaguaguaauaacagagaauugugggacgagaggcccauccuuaagaaccacaacaguuucaggaaaauuaauccacgaauggugcugcagaucaugcacacuucccccucugagauacaugggagaggaugguugcugguaugguauggaaauuagacccauaucagagaaagaagaaaacaugguaaaauccuuagugucagcgggaaguggugaaguugauaacuuuacgaugggaguucuaugcuuagcuauucuuuucgaggaaguaaugcgaggaaaguucggcaagaaacacaugauagcuggaguauucuuuacguuugugcucuugcugucuggacaaauuacguggcgggacauggcacauacacugauaaugauuggaaguaacgccagugaccggaugggaauggggguaacauaucuugcguuaaucgcgacauucaaaauacaaccauuucuagcucucggauuuuucuuacgaaaacuuacaagccgugaaaauuuauuacuaggagucggguuagccauggcuacuacucuucaacucccggaagauauagaacagauggcuaacggaauugccuuaggauuaauggcacuaaaacucauaacacaauucgagacauaucaauuauggacagcauuaauuaguuugacauguucaaacacaaucuuuacauuaacgguugccuggagaacagcaacacuaauucuagcuggagucucacuauuaccagucugucagucaucaaguaugcgaaaaacagauuggcuaccgaugacagucgcagcuaugggggugccaccacuuccguuguucaucuuuaacuugaaagauacgcugaaaaggaggaguuggccucugaacgaaggagucauggcggucggguuaguuucaauauuagcuucgucguuguuaaggaaugaugucccuauggcagguccuuugguagccgguggauuguuaaucgcuugcuauguaauaacagguacaucagcagacuuaacuguagaaaaagcagccgauguuacaugggaagaagaggcagaacaaacuggaguaagucauaacuuaaugauaacaguagaugacgaugggaccaugcgaauuaaagaugacgaaacggaaaacauacuuacgguacuccuaaaaacggcacuauuaauuguaucagguauauuucccuauucgauaccugcuacuuuacucguauggcacacauggcaaaaacagacgcaaagaagugggguuuugugggauguccccagcccgccagaaacccagaaagcugaacuagaagaaggcguauaucguauuaaacaacaaggcauauucgguaagacccagguggguguagguguucaaaaggaaggaguauuccacacgauguggcacgugacucgaggugcaguacuuaccuacaaugguaagagauuagagccaaauugggcaucagucaagaaagauuuaauaucauauggcggagguuggaggcuuucagcacaauggcagaaaggugaagaaguacaaguaauagccguugagccuggcaaaaacccuaaaaauuuucaaacaaugccagggacuuuucagacgacaaccggagaaauaggagcgauagcucuagacuuuaaaccgggaacuucaggcagccccauaaucaaucgcgaaggcaaagucgugggguuguauggaaacggugucguuacuaagaauggcggguacguaucuggcauagcucaaaccaaugccgaaccggaugggccaacuccagaauuagaagaagagauguucaagaaaaggaaucucacuauaauggaucuccacccagguucuggaaaaaccaggaaauaucucccagcaauaguacgagaagcgauuaaacgacgucuacgaacauuaaucuuagccccaacacgagugguggcagcagagauggaagaagcgcuaaaagguuuaccaauaagauaucaaacgacugcaacuaaaagcgaacauacuggacgagagaucguagaccuaaugugucacgcaaccuuuacaaugagauuacuaucaccuguccgaguucccaacuacaacuugauuauaauggaugaagcccauuucacggacccugcuucaauagcugcaaggggcuauauuaguacucgagucgguaugggagaggcagccgcaauauuuaugacugcaacaccaccugguacugcagaugcauuuccacaaucaaaugcgccaauacaggaugaagaaagagauauaccagaacgaaguuggaauagcggcaacgaauggaucacggauuuugcaggcaaaacgguuugguuuguaccaucaauaaaggcuggaaaugauauugcuaauuguuugcguaaaaaugggaagaaaguaauucaauuaucaagaaagacauuugauacagaauaucagaaaacaaaacuuaaugauugggauuuuguugucacaacagauauaucugaaaugggugcuaauuucaaagcugauagaguaauagauccccguagaugucucaagccgguaauacuaacugacggaccagagcguguuauuuuagcaggaccuaugccaguuacugccgcaucagccgcucaacgccguggucggguaggacgaaauccacagaaagaaaacgaccaauauaucuucacaggucagccguuaaacaacgaugaagaccaugcccacuggacggaagcuaagaugcuccuggauaauauuaauacuccugaaggaauuauacccgcacuauucgaaccagaaagggagaaaagugcggcaaucgauggcgaauaucgacucaaaggagaaucucggaaaacguucguagaacucaugaggagaggagaccuaccuguaugguuggcacauaaaguagcuagugaggguauuaaauacacagauagaaaaugguguuuugauggucaacggaauaaccaaauucuugaggaaaauauggauguagaaaucuggacaaaagagggugagaaaaagaaauuacguccuagguggcuggacgcccgaacauauagugauccguuggcacuuaaagaguucaaagacuuugcugcuggccgcaaaagcaucgcuuuagaucuuguuacggaaauuggucgagugccaacccacuuagcgcaccgaaccaggaaugcccucgauaaccuaguuaugcuacauaccucugaacaugggggaaaggcuuauaggcacgcaguggaagaauuaccagaaaccauggaaacuuuacuacuccucggcuuaaugauacucuuaaccgggggagcuaugcuguuucugauauccgguaaagguauugggaaaaccaguaucggauuaauauguguuauugccucaaguggaaugcuuuggauggccgaaauuccacuccaguggauugcaucagccauuguauuggaguucuucaugaugguuuuguuaauuccggagcccgaaaaacaacgaacgccacaagauaaucaauuggcuuauguugucaucggcauuuugacuuuagccgcaauuauagcggcuaaugaaauggggcuccuagaaaccaccaagagggauuugggaauguccaaagagccugggguaguaucacccacuagcuacuuagacguggaucuacacccugccucugcuuggacacuuuacgcgguugccacaacaguuauuacgcccaugcucaggcauacgauugaaaacucaacagcuaauguauccuuggcagcaauagcuaaucaagcaguaguauugaugggccuagacaaggguuggccaaucaguaaaauggacuuaggaguuccacuauuagcucuuggaugcuauucucaagugaacccucuuacucuaacggcugccgucuuacuucuaauaacacauuaugcuauuauaggcccuggguugcaagcuaaagccacaagggaagcucagaaaagaacugcugcaggaauaaugaaaaacccuacaguggaugguauaaugacuaucgaucuagacccuguaauauaugauucaaaguucgaaaagcaguugggccaagugaugcucuuagugcuuugcgcggugcaacuuuuauuaaugcguacaucaugggcacuuugcgaagcauugacacuggccacaggaccgauuacaacauugugggaaggauccccaggaaaguuuuggaauacgacaaucgccguaucuauggccaauauauucagaggguccuaucuggcuggagcuggacuugcauucucaauaaugaaaucaguagguaccggaaaaagaggaacugggagucagggagaaacucugggcgaaaaauggaagaagaaauugaaucaauuaucccgaaaagaguuugaucuguauaagaaaucgggcaucacagaaguggauagaacggaggcgaaagaagguuuaaaaagaggagaaauaacccaucaugcuguuaguagaggcucagcuaaacuucaaugguuuguugaacgaaauauggugauuccugaagguagggugauagaccuuggaugugguagagggggauggaguuacuacugugcuggcuuaaagaaggugaccgaaguaagggguuacacaaaagguggaccaggacaugaagaacccguuccaauguccacuuacggguggaacauagucaaacuaaugagugguaaagauguauucuaucuacccccugaaaagugugacacucuauugugcgacaucggugaaucaucaccaaguccaacuguagaagaaagccgaacaauaaggguucugaagaugguagagccuuggcugaaaaacaaucaauucugcauaaaaguacuaaauccguauaugccuacaguaaucgaacaccuggaaagauugcaacguaagcauggugguaugcuaguacguaauccucuaucaagaaacagcacccacgagauguacuggaucagcaacgguacaggaaauauaguggcaagugugaauauggugucgcgccuucucuuaaauagauucacaaugacccacagacguccaacuauugaaaaagauguagauuuaggggcagguacacgacaugucaacgcagaaccagaaaccccgaauauggauguaauuggagaacgaauaaagagaauaaaagaagaacauaauucaacauggcauuacgaugaugagaacccauauaaaacuugggcuuaucauggaucuuacgaaguaaaagcuacuggcucugcuaguucuaugauaaauggaguggugaaguuauuaacuaaaccuugggauguaguacccaugguaacgcagauggcaaugacagacacuaccccauuugggcagcaaaggguauucaaagaaaaaguagacacacgcacaccccgaagcaugccagguacaaggagaguaauggguauaaccgcugaauggcuauggcggacguuaggcagaaacaagaaaccccguuuauguacccgagaagaauuuacuaagaaaguuaggacaaacgcugcaaugggugccguuuucaccgaagaaaaucaaugggauucggcuaaagcugcggucgaagaugaagacuucuggaaacuuguugaucgggagcgagagcuucacaaacuagguaaaugcggaucguguguauacaauaugauggggaagagggagaagaaacuaggcgaguucggaaaggccaaagggucacgagcuauuugguauauguggcuaggugcgagguaucucgaguucgaagcacucggauucuugaaugaagaucacugguuuagcagggaaaacagcuauucagguguggaaggugaaggguuacacaaacuuggauauauauugcgcgacauuucgaaaauacccggcggagccauguacgcggaugauacagccggaugggacacacgaaucacugaagacgacuuacauaaugaagagaaaaucacgcaacaaauggauccugagcauagacaacuugcaaaugcgauuuucaaacuaacuuaccaaaauaaagucgugaaaguucaaaggccuacucccacaggaacuguuauggauauaauauccagaaaagaccaaagagguucaggacaaguagggaccuaugggcuuaacacuuucacuaacauggaagcacaacucauuagacaaauggaaggagaagguguccuaucaaaggcagaucuagaaaacccucacuugccagaaaagaagaucacucaaugguuagagacaaagggcguagaacgauuaaaaaggauggcgauuucgggcgaugauugcguuguaaaaccgauagacgauagauuugccaacgcucuauuagcccugaacgauauggguaaaguacgcaaagauaucccccaguggcagccaucaaaaggauggcaugacuggcaacaaguuccauuuugcagccaucacuuucaugaguugauaaugaaggacggcagaaagcuaguagucccaugucgaccccaagacgaauuaauaggcagagcaagaauuucucaaggagcuggguggucguuaagagaaacugccuguuuggguaaggcuuaugcacagauguggucgcuuauguacuuucaucgaagagaccuucgacuugccaguaaugcaauauguuccgcaguucccguucauuggguuccaacaagcaggacuacguggucuauacacgcccaccaucaguggaugacaacagaggauauguuaacggucuggaacagagucuggauagaagauaacccuuggauggaggacaaaaccccgguaacgacaugggaaaauguuccauaucucgguaaacgcgaagaucaaugguguggaucgcugauaggucucacaucuagagcaaccugggcacagaauauuccuacagcgauucaacaaguccgaucauuaaucgguaaugaagaauuuuuagacuauaugccuucgaugaagcgauuccgaaaagaggaagagucggaaggagccaucugguag

SEQ ID NO: 23458 - RNA, 9873 nt, Artificial Sequence
  derived and/or modified CDS sequence (opt6) from DENV-3__EU529691__SS-prME
acuucguuaugcuugaugaugauccuaccagccgcauuagcauuucaucuuacaucgcgugacggagaaccgcgaaugauaguuggcaaaaacgaacgagguaaaucauuauuauucaaaacggcuucaggaauuaauauguguacacuaauugcaauggacuuaggagaaaugugugacgauacaguaacauauaaauguccccacaucaccgaaguagaacccgaagauauagacugcuggugcaacuuaaccuccacauggguaacuuacgggaccuguaaucaagcuggagaacaucguagagacaaaagauccgucgcacuagcaccucacguagguaugggacuagacacacguacacaaacuuggaugagugcggaaggagcguggagacaagucgaaaaaguggaaacuugggcuuuaagacaccccggguuuacaauuuuagcccucuuccuagcgcacuauauaggaaccucucuuacacaaaaagugguaaucuuuauacuauugaugcuuguuacuccaaguaugacgaugagguguguagguguuggaaauagagauuuuguagaaggauuaaguggagccacaugggucgauguaguacucgaacauggugguugcgucacaaccauggccaaaaacaaaccaacccuugauaucgaacuacagaaaacugaagcaacccaacuugcaacucuucgcaaacucuguauagaaggaaaaaucacaaauauaacaacagacagcagaugccccacccaaggagaagcgguuuuaccagaagaacaagaucaaaacuaugucugcaaacauaccuauguggaccgcggauggggaaaugguugcggucuguucgguaaaggcagucuuguuacaugugcuaaauuccaaugucuagaaccuauugaaggaaaagucgugcaguacgaaaaccuuaaauacacaguaauaaucaccguccauacaggcgaccaacaucaagucggcaaugagacccagggaguuacggcagaaaucaccccacaagcgagcacuacugaagcgauucucccagaauaugguaccuugggccuagaauguagcccacgaacgggauuagauuucaacgaaaugauauuacuuacaaugaaaaauaaagcauggaugguucacaggcaaugguuuuucgacuuaccacugccauggacaucuggugcaaccacugaaacuccuacuuggaaccggaaagaacuauuagucacauucaaaaaugcccaugcgaagaagcaagagguaguuguacuagguucgcaagagggugcaaugcauacagcccuaaccggagccacagagauacaaaacagcggaggaaccaguaucuucgccggucaucugaagugucgucucaagauggauaaguuagaacuaaaaggcaugaguuaugcuaugugcacaaauacuuucguacuaaagaaagagguuucugaaacccaacaugggacaauccugauaaaaguggaauauaagggcgaagaugcaccuuguaaaaucccguuuaguaccgaagacggccaagguaaagcacacucuggacgauugauuacagccaacccaguaguuacgaagaaagaagaaccggugaauauagaagcagaaccuccauuuggagaaagcaacaucguaauuggaauaggagacaacgcccuuaagauuaauugguacaaaaaggggaguaguauuggaaaaauguucgaagcgacagcuaggggagcacgccguauggccaucuugggcgauacagcgugggacuucggaagugucggcggcguguuaaauucacuagguaaaaugguccaucagaucuucgguagugcguauacagcuuuguucaguggaguaucaugggugaugaaaaucggcaucggaguacuacugacguggauagggcuuaacucuaaaaacacaagcaugucuuuuucuuguauugcuguaggaauaauaacgcuguaccugggugcugucguacaagcugacauggggugugugauaaauuggaaggguaaagaacuuaagugcggcagcgguauuuuuguaacaaaugaaguccacacauggacagaacaauacaaguuucaggcagacucaccaaagagauuggcgacugcaauagcuggagcuugggaaaacggugucuguggaauaaggucaacaacgcgaauggaaaaucuacucuggaagcagauugccaacgaacuuaacuacauucuaugggaaaacaacauaaaguuaacagucguuguaggugacauaauaggaguguuagaacaaggaaaacgaacacuaacaccccagccgauggaauuaaaguacucauggaaaaccuggggaaaagcuaaaauugugacugccgagacacagaacucgucguucauuauugacggaccaaauaccccagagugcccaagcgccuccagagcuuggaauguaugggaaguggaagacuacggguucggggucuuuacaacuaauaucuggcucaaacuaagagagguuuauacacaacuuugugaucaccgauuaaugucugcagcaguaaaagacgaacgcgcaguucaugcggauaugggguacuggaucgaaagccagaaaaacgguaguuggaaacucgagaaagcaucauuaauugaaguuaagacauguacauggccaaaaucccauacacuauggagcaacggaguccuagaaucugauaugauaauaccuaagagucuugcaggaccuauaucucagcauaaucauagaccaggcuaucauacucaaaccgcaggcccuuggcaccugggaaaacucgaauuagacuucaacuacugcgagggcacaacgguaguaauaacagaaaacuguggaaccagaggccccucacuucgaaccaccacuguaucggggaaauuaauccacgaaugguguugccgaucguguacacucccuccacuucguuauaugggagaagauggaugcugguacggcauggaaaucaggccaauaucagaaaaagaagagaauaugguaaagucacucgucucugcuggaaguggaaaaguggacaauuuuaccaugggagucuugugucuugccauacuauucgaggaaguaaugagaggaaaguucggcaagaaacauaugauagccggaguauucuuuacguucguucuauuauuauccgggcaaauaacauggagagacauggcacauaccuugaucaugauugguagcaacgcuagcgaccgaaugggcaugggagucacguaucucgccuuaauagccacuuuuaaaauacaaccauuuuuggcauugggauucuuucuacguaaauugacaaguagagaaaaucuacuguugggaguagggcucgccauggcgacaacacuacaguuaccagaagauauugagcagauggcaaauggaaucgcauuaggucuuauggcccucaaauugauuacacaauuugaaaccuaccaacuauggacagcacuuauaucacuuacauguucuaauacaauguuuacucugaccgucgcuuggaggacagcgaccuugauuuuagcuggaguaaguuuauuaccgguaugucaaaguucaucuaugagaaagacugauugguuaccuauggcaguagccgcaaugggaguaccuccacuaccucuguucauauucaguuuaaaagauacgcugaaacgaagguccuggccauuaaaugaaggugucauggcagucggucuaguguccauauuagccuccucauuacuacgaaaugacguacccauggcaggacccuuaguagccgguggucuuuuaauagcgugcuauguaauaacuggaacaagugcugauuugacaguugaaaaagcggccgacauuacuugggaagaagaggccgaacaaacagguguaucacacaacuuaaugauaacaguggaugacgaugguacaaugagaauaaaggaugaugaaacugaaaacaucuuaacugucuugcuuaaaaccgcacuauugauaguaaguggcguauuuccuuauucaauacccgcaaccuuacugguauggcacacauggcaaaaacaaacucagcgaucugguguacuaugggacguaccaucuccuccagaaacgcaaaaagcagaacuugaagagggaguauaccgaauuaaacaacaaggaauuuuugggaagacacaaguuggaguaggcguacaaaaggaagguguauuucacacuauguggcacguaacuagaggggcaguacuaacuuacaauggaaaaaggcuggaacccaauugggccagcgugaagaaagauuugauuucauacggugguggauggagacuaagugcacaauggcagaaaggagaggaaguucaaguaauugccguugaaccaggcaaaaaucccaaaaacuuucaaacaaugccuggaacauuccaaaccacaacgggugagauaggugccauugcacuagacuuuaaacccgguacuagcggaucuccgauaauaaauagagaggguaaggucgugggccuauauggaaaugguguaguuacuaaaaaugggggauacguaucgggcauagcucaaacuaaugccgagccggauggacccaccccugaguuagaagaggagauguuuaagaaaagaaacuuaacaauaauggauuuacacccaggaagugguaaaacacgaaaauaccuaccggcaaucguucgggaagcaauaaaacgaaggcugagaacucuaauucucgcuccaacgagaguaguagcagcagaaauggaagaggcauugaagggccuaccgauaagauaucagaccaccgcaacaaagagcgaacacacuggaagagagauuguugaucuaaugugucaugcaacauuuacaaugagacuacuaucucccgugagaguacccaacuauaacuugauuauaauggaugaagcacauuuuacagaccccgcaucuauugcugccaggggauauauaaguacuagggugggaaugggagaagcggccgccauauuuaugacggcaacuccaccagguacagcugacgcguuuccacaaucuaacgcaccaauacaggaugaagagagggacauuccugagcgguccuggaauagcgguaaugaguggauuaccgacuucgcugggaagaccguaugguucguaccaucaauuaaagccggcaacgacauagcuaacuguuuaaggaaaaaugguaagaaaguuauacaacugucuagaaaaacuuuugauaccgaauaccagaaaacaaaacuaaaugacugggauuuugucgucacaacugauauaagcgagaugggugccaacuuuaaagcggaucgagugauagacccaagacguugucuaaaacccguaauacuaacugauggucccgagaggguuauuuuagcaggucccaugccagucaccgccgcaagugcugcucaaagacgaggacguguaggacgaaauccucaaaaagagaacgaucaguauauauucacagggcaaccacuaaauaacgaugaggaucaugcgcauuggacagaagcaaagauguuacuagauaauauuaacacaccagaggguauaauacccgcucuguucgaacccgaacgagaaaagucugcagcaauagauggggaauauagauugaaaggagaaucaagaaaaacuuucguagaguuaaugaggaggggagauuuaccuguauggcuagcgcauaaaguggccucagaaggaauaaaauauacugauagaaagugguguuucgacggucaacgcaacaaucaaauacuagaagagaauauggacguugagauauggacaaaagaaggcgagaagaagaaauugaggccuagguggcuagacgccagaaccuauagcgauccacuagcacuuaaagaauuuaaagauuucgcugcaggacguaaaaguauugcuuuagacuuagucacugagauaggaaggguaccaucacaucucgcacacaggacuagaaacgcauuagauaacuuggugauguuacacacaagugaacauggggguagagcuuaucggcaugcaguagaggaauugccagagacuauggaaacucuuuuacucuuaggacuaaugauacugcugaccggaggcgcaaugcucuuuuuaauuagugguaagggaauagguaaaacuucaauaggacugaucuguguaauugcuagcagugggaugcuauggauggcugaaauaccccuacaauggauugcgagugcuaucguuuuggaguucuuuaugaugguucugcuaauaccagaacccgaaaagcaacgaacuccucaagacaaccagcuugcauauguaguaauaggcauucucacauuagccgcuauuauugcagcaaaugaaaugggacucuuggaaacuacuaaacgcgaucuuggaaugucuaaagaacccgggguugucaguccaacaucguaccuagauguggauuuacauccagcgagugccuggacgcuuuacgccguagcuacuacaguaauaacgccuauguuaaggcacacaauugaaaacuccaccgcaaacguuucacuagcugcgauugcuaaccaagcagucguguuaaugggacucgacaaagguuggccaauuucaaagauggaccugggcgugccucuauuagcacuagguuguuauucucaaguuaauccuuuaacacucacugcagccguacuauuguugauuacucauuacgcuaucauagggcccggauuacaagcuaaagcaacaagagaggcgcagaaaagaaccgcugcagggauuaugaaaaauccaacgguagacgguauuaugacaauugaucuagauccuguaauauaugauucgaaauuugagaaacaacuaggucagguuaugcucuuaguccugugcgcaguucaauuacuacuaaugaggacguccugggcacuuugugaagcccugacauuagcaacagguccuauuacaacacugugggaaggcaguccuggaaaguuuuggaauacgaccauagcaguaucaauggcaaacauauuuagagggaguuauuuggcaggagccggguuagccuucucaauaaugaagucagucggaacaggcaaacgagggacugggucucaaggggagacauuaggugagaaauggaagaagaaacuaaaucaauuaucucgaaaagaguucgauuuauauaagaaaucugggauaacugaaguugaucgaacagaagcuaaggaaggucuaaaacguggcgagacaacacaucaugcugucucaagaggaagugcaaaauuacaaugguucgucgaacgaaacaugguuauaccagaaggccgagugauagaucuuggaugcggacgaggaggcuggucguauuauugcgccggauugaagaaagucaccgaaguaagagguuacaccaagggaggaccgggccaugaggaaccagucccaaugagcacauacgguuggaauaucguuaaguuaaugucuggcaaagauguuuucuaucuacccccagagaagugugacacacuuuugugcgauauaggagaaucguccccgucaccgacagucgaagaaaguagaacaauacguguguugaaaaugguagaaccuuggcugaagaauaaucaauuuugcauuaaaguccucaaucccuauaugccaacaguaauagaacacuuagaaagguugcaaagaaaacacggcgggauguuagucaggaacccacuuucgagaaauucaacacacgaaauguauuggaucucgaacggaacagguaauauaguagcgagugucaauauggugucaaggcuauuauuaaaucgauuuacuaugacacauaggcggcccacgauagaaaaagauguagauuugggugcugguacccgucacgugaaugcugaaccugaaacacccaauauggacguaauaggggaaagaauaaaacgcauuaaagaagaacauaauucaacauggcacuaugacgaugaaaacccuuacaagacaugggcauaccauggcucauacgaaguaaaagccacaggaagcgcaucaagcaugauaaaugguguugucaaauuguuaacuaaacccugggacgucguuccuaugguuacucaaauggcaaugaccgauaccacaccguucggucagcaaagagucuucaaagaaaagguugauacaagaacaccgagaucaaugccugggacgcguagaguaauggguauaacagcugaauggcuuuggagaacauuaggucggaauaagaaaccuagacucuguacgagagaggaguucacgaagaaaguucgaacaaacgcugccaugggggcagucuuuacagaggagaaucaaugggacucugcuaaagcagcaguugaagaugaagauuucuggaaacuugucgauagagaaagggaacuacauaaauuagguaaauguggaagcuguguauauaacaugaugggaaaaagagagaagaaauugggggaguucggaaaagcgaaggguaguagagcuauaugguacaugugguugggcgcaagauacuuagaauuugaggcacuagguuuucuaaacgaagaucacugguuuaguagggaaaauucuuauuccggaguagagggagagggacuucauaaauuggguuacauauugagggauauuucuaagaucccuggaggagcaauguaugcagacgauacugcgggaugggauacucguauaacugaagaugauuugcauaaugaagaaaagauuacgcaacaaauggacccugaacauagacaacuugcaaacgccauauucaaauugacuuaccaaaauaaaguuguaaaagugcaaaggccaaccccaacaggaaccguuauggauauaauaucuaggaaggaccaacggggaucaggucaagugggaaccuaugguuuaaauaccuucacaaacauggaagcacaacuaauacgucaaauggaaggggaaggcguguugucaaaggcggaccuagaaaauccccauuuaccggagaagaaaaucacucagugguuagaaacuaaaggugucgaacgguuaaaaagaauggcaauauccggcgacgauuguguaguaaaaccaauagaugaccgauucgcaaacgcucuccuagcucuuaaugauauggguaaaguacggaaagauauuccgcaguggcaacccuccaaaggauggcaugauuggcaacaaguaccauuuugcucccaccauuuucaugaauuaauaaugaaagauggucguaaauuaguugugccgugucgcccacaagacgaauuaaucggacgcgcaagaauaagccaaggagcugguuggagcuuacgugaaacggccugucucgguaaagccuaugcucaaauguggucucuaauguauuuucauaggcgagaccuacgguuagcaucgaaugcaauuuguagcgcgguaccagugcacuggguuccaacgagcaggacgacaugguccauacaugcccaucaccaauggaugacaacagaagauaugcucacuguuuggaaccgaguuuggauugaggauaauccauggauggaagauaaaacuccggugacuacaugggagaacguaccguacuuagggaagagagaagaucagugguguggcucguuaauagggcuaacaucgcgugcgacaugggcucagaacauacccacagccauucaacaaguaagaagucuaauaggcaacgaagaguucuuggacuacaugccaagcaugaagagguuuagaaaagaagaagagucagagggagccauuugguga

SEQ ID NO: 23459 - RNA, 9873 nt, Artificial Sequence
  derived and/or modified CDS sequence (opt6) from DENV-3__EU569689__SS-prME
acgagcuugugcuugaugaugauucuacccgcugcacuagcuuuucacuugacuucaagggauggagaaccucgaaugauaguuggcaaaaaugaacgcggcaaaagucuucuauuuaaaacugcaucaggaauuaacaugugcacguuaauagcaauggauuuaggggaaaugugugaugacacaguuacauauaaaugcccgcacauaacggaaguugaaccagaggauaucgacuguugguguaaucugacuucgacuuggguuacuuacgguaccuguaaucaagcuggugaacaccgacgcgauaaaagguccguagcuuuagcaccccacguaggaaugggauuagacacuaggacccaaacauggaugucggcugaaggagcauggagacaaguagaaaaaguugaaacaugggcccuuagacacccaggauuuacaauacuagcccuuuucuuagcccacuacauaggaacaagccuaacacaaaaaguuguaauauucauuuuacucauguuaguuacuccuaguaugacaaugagaugcgucggcgugggaaaucgugacuuugucgaaggauuaagcggggccacaugggucgacguagugcuagaacauggagggugcgucacaacuauggccaaaaacaaaccaacacucgauauagaacugcagaaaaccgaagcaacccaacuugccacguuacggaaauuauguaucgaagguaaaauaacuaauauaacaacagauucaagguguccaacccaaggagaagcggugcugccugaagaacaagaucaaaacuauguuugcaaacauacguauguagaucgaggauggggaaacggaugcggacuauucggaaaagguucacuugucacuugugcaaaauuucaaugccuggaaccuauagaaggaaaagucguacaauacgaaaaucuaaaauauacagugauuauaacgguucacacaggagaucaacaucaaguaggcaaugaaacucaagggguaaccgcugaaauuacaccucaagcuagcaccacagaggcaauauuaccagaauaugguacucuaggauuagaauguagcccgagaaccggauuggacuucaacgaaaugauauuacuaacaaugaaaaauaaagcauggauggugcacagacaaugguucuuugaccuaccccugccguggacgaguggagcgacaacagagacgccuaccuggaaucgaaaagaacuauugguaacuuucaaaaaugcccacgcuaagaaacaagaaguagugguuuuagguucgcaagagggcgccaugcauacagcauuaacaggagcaacagagauacaaaauucaggaggaacaagcauuuucgccggucauuuaaaaugcagauugaaaauggacaaauuagagcugaaaggaaugucguacgcaauguguacuaauacauucguucuaaagaaagaaguuagcgagacucaacauggaacaauuuugaucaaaguugaauauaaaggcgaggacgucccuuguaaaauaccauuuuccacugaagacggucaaggcaaagcacauaacggaagacuaauaacggcaaacccuguaguuacuaagaaagaggaaccagucaauauagaagcugaaccuccuuuuggugaaucaaacauuguaauaggcauuggggauaacgcgcucaaaaucaauugguauaagaaaggaucaaguauugggaaaauguucgaagcuaccgcucgcggagcacggagaauggcaauacuuggcgauacagcaugggauuucggcucagucggugggguacuaaauaguuuggguaaaaugguacaucaaaucuuugggucggccuauacagcacuuuucaguggugucucuugggugaugaaaauagguauugguguauuacugacauggauaggccuuaauagcaaaaacacaaguaugucuuuuucauguauagccauaggaauaauaacuuuauacuuaggagcugucguucaagcagauaugggaugcgugauaaauuggaaaggaaaggaguuaaaaugugggaguggaauuuuuguuacaaaugaaguacauacuuggaccgaacaauauaaauuccaagcagauaguccuaaaagacuagcgaccgcaauagcgggcgcuugggaaaauggcgugugcggcauucgauccacuaccaggauggaaaauuuauuauggaaacagauagccaaugaacuaaacuacauucuuugggaaaauaauauuaaacuaacuguaguuguuggagauaucauaggcguccuagaacaaggaaagaggacauuaacaccacaaccuauggaacuaaaauacagcuggaaggcuugggguaaagcuaaaaucguaacagcagaaacacaaaacucuucuuuuauaauagacggcccuaacacaccugaauguccuagugcuaguagggcauggaaugucugggaaguggaagauuacggauuuggagucuuuacuaccaauauaugguuaaaauuacgugagguuuacacacaacucugcgaucaccgauuaaugucagcagcaguuaaagaugaaagggcaguacacgcugauauggguuacuggauugaaagucagaaaaauggcagcuggaaacuagaaaaagcgagcuuaaucgaggugaaaacuuguacuuggcccaaaucccauacacuuuggucuaacggggucuuagaaagcgacaugauaauaccaaaaucccuagcuggaccaauaucucaacacaacuauaggccaggguaccacacacaaacugcaggaccauggcaucugggaaagcuggaacuggauuuuaauuacugugaaggcacuacuguuguaauaacagaaaacugcgguacacgcggaccuaguuuaagaacaacaacagucucggggaaauuaauacaugaaugguguugucgaaguuguacccugccgcccuuacgguauaugggagaagacgguugcugguaugguauggaaauuagacccauaagugaaaaagaagaaaacauggugaaauccuuaguauccgcagguaguggagaggucgauaauuuuaccaugggggucuuaugcuuagcgauacuauuugaagaaguaaugcgugguaaauuugggaagaaacacaugauugcaggagucuucuuuacuuuugugcuccuuuuaagcggacaaauaaccuggcgggaucuagcccacacucuaauaaugaucgggaguaacgcaagcgauaggaugggaaugggaguaaccuaccuagcauuaaucgcgacuuuuaaaauacaacccuuuuuagcguugggauucuucuugcgaaaauuaaccucaagggaaaauuuguugcuagggguagggcuugcuauggcgacuacacuucaacuaccagaagauauagaacaaauggccaaugguaucgcccuugggcuuauggccuuaaaacugauaacacaauuugaaacauaucaacuauggacagcuuuaauaucgcuuacauguaguaacacaauauucacucucacgguagcuuggcgcaccgcaacacucauuuuggcuggagucagcuuacuaccagugugucaaaguucuaguaugcgaaaaacggacugguuaccaaugacaguagccgcaauggguguuccaccacuuccccucuucauauuuaguuuaaaagacacacugaagcgccgaucuuggccuuugaaugagggcguuauggccguagguuuagugucuauuuuagcuaguagcuuacugaggaaugaugucccaauggcagggcccuuaguagccgguggucuauugaucgcuugcuacgucauaacagguacaagugcugaucuuacaguagagaaagcggcggacgugacaugggaggaggaagcagaacagaccggaguaagccauaacuuaaugauaacuguagaugaugauggaacaaugaggauaaaagaugaugaaacagaaaauaucuugacaguauuauugaagacugcgcuacuuauugucucagguaucuuucccuauagcauaccagcuacauuacuuguauggcauacuuggcaaaaacaaacgcagcggaguggcguacucugggaugugccgucgccgccugaaacacagaaagcugaguuagaagagggugucuacagaauuaaacaacaagguaucuucggaaagacgcaaguagggguuggagugcagaaggaaggagucuuucauacgauguggcacgucacaagaggagcuguccucaccuacaacggaaaaaggcuagagcccaacugggccucuguuaagaaagaccuuaucucauacggaggcggguggagauuaagcgcccaguggcaaaaaggugaggaaguccaagucauugcaguggaaccagguaaaaauccgaagaauuuucagacaaugcccggcacguuccaaacgacaacaggugagauaggagcuauagcuuuggauuucaaaccagguacaagugggucaccuauuauaaauagagaggguaaggucguaggucuauacgggaauggaguaguuacaaagaauggcggauacguuucaggaaucgcucaaacuaacgcggaaccugaugguccaacacccgaauuagaagaagagauguuuaagaaacguaauuugacaauaauggaccuacaccccggaucagguaaaacaagaaaauaucuacccgccauaguuagagaagcuauaaaaagaagacuccgaacacuaauccuagcaccgacgcguguaguagcagcagaaauggaagaagcacuuaaaggccuuccgauuagguaucagacaacugcaacaaaauccgaacauacgggccgcgaaaucgucgacuuaaugugucacgcuacauuuacuaugagguuacugucaccuguucgaguucccaacuauaaccucauaauaauggacgaggcacacuucacagaccccgccucuaucgccgcaagggguuauauaucaacacguguuggaaugggugaagcggcggccauauuuaugacagcaacaccuccugguaccgcugacgccuucccccaaagcaaugccccaauacaagaugaagaaagagacauacccgagcgaucuuggaacucaggaaacgaauggaucacagauuuugccggaaagacgguuugguuuguaccaaguauaaaggcggggaacgacauagcgaauugucuucgcaaaaacggaaagaaaguuauacagcuaagccguaaaacguuugacacugaauaucagaaaacaaaacuuaaugacugggacuuuguaguuaccacugauauuagcgaaaugggagcaaauuucaaggcugauagaguaauagauccaagaagaugcuuaaaaccaguaaucuugaccgacggaccugaacgugugauauuggcaggcccgaugccagugacugccgccucggcagcgcaaagaagagggcgugucgguagaaacccccagaaagaaaacgaucaguacauuuucacuggucaacccuugaauaaugaugaggaccacgcacauuggacagaggccaaaaugcuguuggauaacauaaauacuccugaaggaauaauaccggcuuuauucgaaccagaacgagagaaaucugccgcuauagauggagaguauagauuaaagggugaaagucgaaagacauucguggagcugaugagaagaggagaucuacccguauggcuagcccauaagguggcuucggaaggaauaaaauauacagaccgcaaaugguguuuugacggacaacgaaacaaucagauuuuagaagagaacauggauguugaaauauggacuaaagaaggagagaagaagaaauuaagaccccgcugguuagaugcaaggacauacagugacccacuagcauugaaagaauuuaaggauuuugcagcggguaggaaguccauagcucuagaccuuguaacagaaauuggaagaguuccaacgcauuuagcccaccgaacacggaacgcccuggacaaucuuguuauguuacauacuagcgaacaugggggcaaggcuuaccgucaugccguagaagaacuuccugagacaauggaaacacuucugcuacuuggccuaaugauauuauuaacgggaggcgcaauguuauuccuaauauccgguaaagggauuggcaagacaagcauagguuuaauuuguguuauagccucaucuggaaugcuauggauggcugaaauaccccuacaauggauagcaucagcuauagucuuagaguuuuucaugaugguucuacuuauacccgagcccgagaaacaaagaaccccucaagacaaucaguuagcuuaugucguaauaggaauuuugaccuuagccgcaaucauagccgcuaaugaaauggggcuauuggaaacuacaaaaagagaucuagggaugaguaaagaaccgggaguugugucaccaacaagcuacuuggaugucgacuugcauccagcauccgcauggacauuauacgcuguagcuacaacuguaauaacuccgauguuaagacauacuauagaaaauucuacagcgaauguaagucuagcagccauugcgaaucaagcagucguguuaaugggauuagauaaaggcuggcccauaaguaaaauggacuuaggaguuccuuuacuugcgcuaggcuguuauucacaaguaaauccuuuaacauugaccgccgcuguccugcuuuugauuacucacuacgcaauuauaggcccaggacuccaggcaaaagcgacgcgagaagcccagaagcggaccgcagcaggcaucaugaaaaacccaacgguagacggaauuaugacaauugaccucgacccugucauuuaugacucaaaauucgaaaaacaacuuggacaaguaaugcucuuaguuuugugugcuguacaacuauuacucaugagaacguccugggcucuuugcgaggcacugacguuggcuaccggaccaauaacaacuuuaugggaagggaguccaggcaaauuuuggaacacgacgauugccguaagcauggcuaacauauuucgggggucuuaucucgccggcgcagguuuagcuuuuucuauaaugaaaaguguaggaacgggaaaacggggaacgggaucgcaaggugaaacauuaggagaaaaauggaagaagaaauuaaaccagcuaaguaggaaagaauuugaucuauauaagaaaagugggauaacggagguagaccgaacagaagcaaaagaagggcuaaaacgaggagaaauaacucaucaugcugugucaagaggaucugcuaaguugcaaugguuugucgagagaaauaugguuauuccggagggacgaguaauagauuugggaugugggcgcggaggauggagcuacuacugugcuggauuaaagaaaguaacagaaguaagagguuacacgaagggcggaccgggccaugaagaaccuguccccaugucgacuuauggauggaauauuguuaaauuaaugucgggaaaagauguauuuuaucugccgccugaaaaaugugauacuuuacuaugcgacaucggggagaguaguccaucccccaccguugaagaaagccgcacaauuagaguacuuaaaaugguagaaccauggcuuaaaaauaaccaauucugcauaaaaguucuaaauccauacaugcccaccguuauagaacaccuagagagauugcaaagaaagcauggcgguauguugguuagaaauccuuugagucguaauucaacucaugaaauguacuggauaucaaauggcacuggaaauauaguagccucugucaauaugguauccagacugcuucucaacagauuuacaaugacccacagacguccaacaauugaaaaggauguagauuuaggugcaggaaccagacacgucaaugcagagccggaaacuccgaauauggacgugauaggagagagaauuaaacguauaaaagaagaacacaacagcacuuggcauuacgaugacgaaaacccauacaaaacuugggcguaccacggaagcuacgaagugaaagccacaggauccgcgagcaguaugauuaacggcguugugaaacuacuuacaaaaccgugggacguaguaccuaugguuacucaaauggcaaugaccgacacgacuccauucggacaacaaaggguauuuaaggaaaaaguugauacaaggacaccaaggagcaugccuggaacaagacgaguaauggguauaacagcagaguggcuauggaggacuuuaggucguaacaaaaagccucgacuauguacuagagaagaauuuaccaagaaaguccgaacaaacgcagccaugggugcaguguucacagaagaaaaucaaugggauucagcaaaggcggcugucgaagacgaggauuuuuggaaguuaguugauagagaaagagaauuacacaaguugggcaaaugcgguucgugcguguauaauaugaugggaaagagagagaagaaauugggagaguuuggaaaagccaagggaagccgagcuaucugguauauguggcucggggcuagguauuuggaauuugaggcgcuuggcuucuuaaaugaagaucauugguuuucacgcgaaaacagcuacucuggaguugaaggggaaggacuccauaaacuuggcuauauccuucgugacauaaguaaaauaccaggaggagcuauguacgcagacgacaccgcgggcugggacacaagaauuacagaggaugaucuacacaacgaagagaaaauaacccagcaaauggauccagaacauagacaauuagcgaaugccauuuucaaacuuacauaucaaaauaaaguggucaaaguccaaaggcccacgcccacggguacaguaauggauaucauuucacgaaaagaccaaagaggcaguggucaagucgggaccuacgggcuaaacacuuuuacuaauauggaagcgcaauuaauuagacagauggaaggagaggguguguuauccaaagcggauuuagaaaacccacaccuaccggagaagaaaauuacccaaugguuagaaacuaaagguguugaacgacugaaaaggauggcaauaagcggugacgauugugucguaaagccuaucgacgaccgauuugccaaugcauuauuagcacuaaacgacaugggaaaaguucgaaaagacauuccacaauggcaaccgucgaaaggauggcaugauuggcaacaaguucccuuuuguucgcaccacuuucaugaauuaauuaugaaagacggcagaaagcuagucguaccaugucgaccacaagaugaauuaaucgguagagccaggauaagucaaggagcgggcugguccuuacgcgaaacagcgugccuuggaaaggcguaugcccaaauguggucauuaauguacuuucauagaagggaucugaggcucgcuaguaaugccauaugcucggcgguaccaguacauuggguaccgacaaguagaacaaccugguccauccaugcgcaucaucaauggaugacgacggaagauaugcuaacaguauggaacagaguauggauagaggacaauccuuggauggaggauaaaacuccugucacaacaugggaaaaugugcccuacuuagggaaaagggaggaucaauggugcgguucauugauaggacucacaaguagagcaacaugggcucaaaauauaccuacggcuauucaacaaguuagaucguugauuggaaaugaagaguuccucgacuacaugccaaguaugaaacguuucagaaaggaagaagaaagugagggugcuauaugguaa

SEQ ID NO: 23460 - RNA, 9873 nt, Artificial Sequence
  derived and/or modified CDS sequence (opt6) from DENV-3__EU482614__SS-prME
acuagccucuguuugaugaugauacucccagcagcuuuggcuuuucaccuaacaagucgcgauggggaaccacgaaugauuguaggcaaaaaugaaagaggaaaauccuuacuauuuaaaacagcaagcgggauuaauaugugcacacucauugcaauggauuuaggagaaaugugugaugauacaguaaccuacaaauguccucacauuacagaagucgagcccgaggacauugacugcuggugcaacuuaacuucuacuuggguuacuuaugguacgugcaaccaagcaggagaacaucgaagagauaaacgaagugucgcguuagcaccacacguagggauggguuuagacacccgaacgcaaacauggaugucugccgagggagcauggcgucaaguagaaaaaguugaaacaugggcgcuuagacaucccggguuuacuauucuagcgcuguuucuagcacauuacauagguacaagccuaacgcaaaaagucguaaucuuuauacucuugauguuaguaacuccuagcaugaccaugagaugcgucggagucggaaaucgcgauuuugucgaaggacuauccggagcaacuuggguagauguaguguuagaacacgggggaugcgugacaacgauggccaaaaauaaaccgacacuagacauagaacuucagaaaacggaagcaacacaacucgcuacccugcgaaaacuauguauagagggaaaaauaaccaacauaacuacagauucccgguguccgacacaaggagaagcuguucuaccggaagaacaagaucaaaacuauguauguaaacauacuuauguggaucguggaugggguaacggguguggacuguuuggaaaaggaaguuugguuacgugugcuaaauuucaauguuuagaaccgauagaagguaaagucguccaauacgagaauuuaaaauauacaguaaucauaacgguacauacuggggaccaacaccaaguagguaaugaaacucaaggugugacagcugaaauuacuccacaagccucaaccaccgaagccauauuaccugaauaugguacccuaggauuagaauguucaccaagaacuggacucgacuucaaugaaaugauccuauuaacgaugaaaaauaaagcauggaugguacauagacaaugguucuucgaucugccacuaccauggacuucgggugcaacaacagagaccccuacauggaaccggaaagaauuauuagucacauucaaaaacgcacaugcuaagaaacaagaaguuguagugcuaggaucacaagagggagccaugcacacagcauugacuggggcaaccgaaauacaaaauagcgggggaacuucaauauuugcaggacauuuaaaaugucgacuaaaaauggauaaacuagaauugaaaggaaugucuuaugcaaugugcacuaacaccuuuguccuaaagaaagagguaagcgaaacgcagcauggaaccauacuuauuaaaguugaguacaaaggagaagauguaccuugcaaaauuccauuuucaacagaagacggacaaggaaaggcccauaauggcagauugauuacugcaaauccgguaguaaccaagaaagaggaaccaguuaauauagaagcagaaccaccuuuuggagaaaguaauauuguuaucggaaucggagauaacgcacucaaaauuaacugguacaaaaaggggucuucuauagguaagauguucgaggcgacagcacguggagccagaagaauggcuauacugggggacacagcuugggauuucgggucggucggugggguauuaaauagccuagguaaaaugguucaccaaauauucgguagcgcauacacagcucuuuucucuggcgucuccugggugaugaaaaucggaauaggaguacuccuuacuuggaucggccuaaauucuaaaaauaccucgaugagcuucagcugcauagcaauuggaauaauuaccuuguaucuaggcgccguaguacaagcagauauggguugcguuauaaauuggaaaggaaaagaacuuaaaugcggaagcgguauuuucgucacaaacgaagugcauaccuggacugaacaauauaaauuccaagcagauagcccuaaaagacuagcuacugcuauagcuggcgcaugggaaaacgguguuuguggcauaaggucaaccacaagaauggaaaauuugcuauggaaacaaauugcgaacgaauuaaacuacaucuuaugggaaaauaauaucaaacuuacagugguugucggugacauaauuggaguccuugaacaagguaaacgaacacuuacaccacagccuauggaauuaaaauauaguuggaaaacaugggggaaggcgaaaaucguuacugccgagacacaaaacucgucauuuauaauugauggaccaaauacaccggaaugccccucagcaaguagagcauggaauguuugggaaguggaggauuacggcuuuggugucuuuacgacaaauauauggcuaaagcuaagagaaguauacacgcaauugugcgaucaucgauuaauguccgcagcuguaaaagaugagcgagcgguacacgcugacaugggcuauuggauagaaucucaaaagaauggcucguggaaacuagaaaaagcgucucuuauugagguaaaaacuuguacauggcccaagagucacacucuuuggucaaauggcguacuagaaucggacaugauaauucccaaaucauuagcugguccuauaagccagcauaacuacagaccaggguaccauacacaaaccgcaggucccuggcaucugggaaaauuggaacuagauuucaauuauugugaaggaacgacgguugugauaaccgaaaauugugguacacgagggccuucccuuaggacgaccacagucucagggaaauuaauacaugaaugguguuguaggucuuguacauuacccccacuaagguacaugggagaagacggauguugguauggaauggaaauucgaccaauuucagagaaagaggaaaauauggucaagucucuugucuccgcagggucaggagagguggacaauuucacuaugggaguauuaugucucgcaauuuuauuugaggaaguaaugagagguaaauuuggcaagaaacacaugauagcaggaguauucuuuacuuuuguucuccuacuaucaggccaaauaacauggagggauauggcccauacccuaauaaugauaggaagcaaugcaagcgacagaauggguaugggagugacuuauuuagcccuaauagccacuuuuaagauccaaccauuucuggcuuuaggauucuuucucaggaaacugacgagccgagaaaauuugcuuuugggagugggauuagcuauggcaaccacacugcaacuaccagaagauauugaacaaauggccaaugggauagcacuaggauuaauggccuuaaaacuaauaacucaguucgaaacuuaccaauuauggacagccuuaauaucuuuaaccugcucgaauacaaucuuuacccugacagucgcauggagaacagcaaccuuaauauuggccgguguuuccuuguugccaguuugucaaagcucgaguaugagaaaaaccgacugguuaccgaugaccguugcagcgauggguguuccaccuuuaccacuauucauauuuucucuuaaagacacacucaaacgaagaucuuggccuuuaaaugaagguguaauggcaguaggcuuagucucaaucuuggccagcagccuuuuacgaaacgaugugccaauggcuggcccuuuaguugccggcgggcuauuaauagcaugcuaugugaucacggguacgucugccgaccugaccguagagaaagcugcugacguaacuugggaagaggaagcugaacaaacuggaguaucacauaaccuaaugauaacaguugaugaugacgguaccaugagaauuaaagacgaugaaacagagaauauauuaacaguauuguugaaaacggcucuuuugauagucuccggaaucuucccauauagcauuccugcaacgcugcuggucuggcauacauggcaaaagcaaacucagcggaguggaguacucugggacguuccuaguccacccgaaacacagaaagcggaacuagaggaagguguauacaggaucaaacagcaaggcauuuuugguaaaacacaagucggugucggaguacaaaaggaaggaguuuuucauaccauguggcauguaacuaggggugccgucuugacacauaaugggaagagacucgaaccgaauugggcuagugucaaaaaggaccuaauaagcuaugggggcggauggcgcuuaagugcacaguggcaaaaaggugaagaaguccaaguuaucgcuguagaaccagguaagaaccccaaaaacuuucaaacgaugccagguaccuuucaaacuacaacaggagaaauuggagcgauagcacuugauuucaaaccaggcaccuccggaucgccuaucauaaacagagagggcaaagucgugggccuguacgggaauggaguaguaaccaaaaauggcggauaugucaguggcauagcucaaacaaaugcugaaccagacggaccaacgccugaacuggaggaggagauguuuaagaaacguaaccuaacgauuauggauuuacaccccgguucagguaaaacaaggaaauacuuaccagcuauaguacgagaagccauaaaaaggaggcuaagaacccuaauacucgcuccgacaagaguagucgcugcagaaauggaagaagcacuaaagggcuuaccaauaagauaucagacaacagccacuaaaucagagcauacugguagggaaauaguagauuuaaugugucacgcgacauuuacaaugagauuguuaaguccagucagagugccaaacuacaaucuaaucauuauggaugaagcccauuuuacagauccugcaucaauugcggccaggggguauaucucaacuagggugggaaugggagaagcagccgcaauauucaugacugcgacaccaccaggaacggccgaugcuuuuccccaaaguaaugcgccgauacaagacgaagaacgggacauuccagaaaggucguggaacuccggaaacgaguggauaaccgauuucgccggaaagaccgucugguuuguacccucaauaaaggcgggaaacgacaucgcaaauugccuaaggaaaaauggcaagaaaguuauucagcugucacgcaagacauucgauacagaauaucagaaaacuaaacuaaaugauugggauuuuguugugacaacugauauaucagagaugggagcuaauuuuaaagcagaucgaguuauagacccaagaagaugucucaaacccguuauacugacugauggaccggagagagugauauuagcaggaccgaugcccgugaccgcagcauccgccgcucaaagacgggguaggguuggaagaaauccucagaaagaaaacgaucaguauauuuucacuggccagcccuugaacaaugaugaagaucacgcucauuggaccgaagccaagaugcuacuagacaacauaaauacacccgaaggcaucauaccagcacuguuugaaccugaaagagagaaaagugcagcgaucgauggugaauaucgucuaaaaggggaaucacgaaagacauuuguggaauuaaugcguaggggugacuuaccaguguggcuugcucauaaaguagcgucugaggguauaaaguauaccgaccguaaaugguguuucgauggccagagaaauaaucagauacucgaagaaaauauggauguagaaaucuggacuaaggagggagaaaagaagaaacugagaccccgcuggcuugacgcacggacguauagugaucccuuggccuuaaaagaguucaaagauuuugcagcgggcagaaaaucgauugcccuagaccuaguaacagaaauuggucgagucccgucacaccuagcacauaggacgaggaacgcucucgacaauuuggugaugcuacauaccucugagcauggcgggaaggcuuaucgucaugcaguagaagaacugccagaaacaauggaaacacuauuauugcucggccuaaugauccuacugacagggggcgcuaugcuauuucuuauaagcggaaaagggauagggaagacaaguauagggcuaauaugcguuaucgcgucauccggaauguuauggauggcagaaauaccguugcaauggauugcuucagcaaucguuuuagaguucuuuaugaugguuuuacuaauaccggaaccagaaaaacaacggacuccacaggacaaccaauuagcuuauguagugauagguauucuuacacucgcugccauuauugcagcuaacgagaugggguuauuagaaacaacuaaaagagaccucgguaugucgaaagaacccggaguuguuucaccaacuucguauuuagacguggauuuacaccccgcaucugcauggacuuuauacgcaguagcuacgacaguaauaaccccaauguuacgccacacuauagaaaacuccaccgcgaacguaucauuagcagccauugccaaucaagcuguaguauuaaugggacuagauaaagguuggccuauaucgaaaauggacuuaggugucccguuauuagcucugggaugcuauucucaaguuaauccgcuaacguugacagcggcaguguuacugcucaucacucauuacgcuauuauuggccccggacuacaagccaaagcaacuagggaggcccaaaagaggacugcagcaggaauaaugaaaaacccgacuguggauggaauaaugacuauugaucuugauccaguuaucuaugacagcaaguuugaaaaacaguuaggucagguaaugcuucuaguucugugcgcgguacaacuuuugcuaaugcggacaucuugggcauugugugaggcacuuacauuggcaacgggaccaauuacuacauugugggaagguagcccgggaaaauucuggaauacuacuauagcuguaucuauggccaacauuuuucgaggcucauauuuagcuggagcaggauuagcauuuagcauuaugaaaucggucggcacuggaaaaagagguacugguucacaaggugagacccuaggagaaaaauggaaaaagaaauugaaccaauuaaguagaaaggaguucgaccuguauaagaaaucagguauaacagagguagaucgaacagaagcuaaagaaggacuaaaacgcggugagauaacacaucaugccgugucgcgagguucugcaaaauuacaaugguucguagaacguaacaugguaauaccagagggcagagucauagaucuuggaugcgguagaggugguuggaguuauuauugcgcaggucuaaagaaaguuaccgaaguacgaggauacaccaaagggggacccgggcaugaggaaccagucccaaugaguacguauggauggaacauagugaaacuaaugucuggcaaagaugucuucuaucucccaccagaaaaaugugauacuuuacugugugauauuggagaaaguaguccuucgccaacagucgaagaaucaagaacgauacgaguuuuaaaaaugguagaaccauggcucaaaaauaaccaauucugcauaaagguccuaaauccauauaugcccacagugauagagcauuuagaacguuugcagagaaaacauggagggauguuagugagaaacccuuugagccguaacucgacacacgaaauguauuggaucuccaauggaaccggcaauauaguagcauccgucaacaugguaucacgcuuacuauuaaauagauucacaaugacucaucgucggccuaccauagaaaaagacgucgaucuuggagcggguacaagacauguaaacgcagaaccagaaacaccaaacauggauguaauuggggagcguauaaaaagaauaaaggaggagcacaauagcacauggcauuaugaugaugaaaacccuuauaaaacgugggcauaucauggcaguuaugaggucaaagccacuggaucagccucaaguaugauaaauggaguaguaaaauuauuaaccaagccaugggacguaguuccaauggugacucaaauggcaaugacagauacgacaccauuugggcaacagagagucuuuaaggaaaagguggacacacgcaccccacgaucaaugccaggcacaagaagaguaauggguauaacagcggaaugguuauggcgaacauugggacguaacaaaaagcccagacuauguacaagagaggaguucacgaaaaaggugcgcacaaaugcugcuaugggagcgguauucacagaggagaaucagugggacucagcuaaagccgcgguagaagacgaagacuuuuggaaguuaguggacagggaacgcgaacuucacaaacucgggaaaugcgggucuuguguguauaacaugauggggaagagagagaagaaacuuggagaauuuggcaaagcaaaaggcucaagagccauuugguacauguggcugggagccagauauuuagaguuugaagcccuaggauucuuaaacgaagaucacugguuuucccgugaaaauucuuacucaggggucgaaggggaaggcuuacacaaacucggguauauucugagggauauaucgaaaauaccgggcggugcuauguacgcagacgauacugcgggaugggacacacguauaaccgaagacgacuugcauaaugaggagaaaauaacucagcagauggauccagaacauaggcaauuggcuaacgcgauuuuuaaacuaacguaccagaauaaggucgugaaaguccaacggccaacaccuacaggaaccgucauggauauuauaucgagaaaagaucaacgcgguucgggacaaguugguacuuacggacuaaauacauucacgaacauggaggcucaacuaauacgacagauggaaggagaaggaguccuauccaaagccgaucuagagaauccacaccuaccggaaaagaaaaucacccaaugguuggaaacaaagggaguagaaagacucaagcgaauggcgauauccggugaugauuguguagucaaaccaaucgacgauagauuugcaaaugcgcuacuagcacucaaugacauggggaaaguacguaaagauauaccucaauggcagccaaguaaaggauggcaugacuggcagcaagucccguuuuguucucaccacuuucaugaacuaauaaugaaagauggacguaaauuaguagugccaugcaggccgcaagaugaauuaauaggccgagcgcgaaucagccagggagcggguuggucucuacgugaaacagcuugucuuggcaaagcguaugcacagauguggagcuuaauguauuuccauagacgagaucuacguuuagcgucgaaugcaaucugcucagcaguaccaguacacuggguaccaacaucaaggaccacauggagcauacacgcacaucaccaauggaugaccacggaagauauguuaaccguauggaaccgugucuggauagaagauaacccauggauggaagauaagacaccaguaacaacaugggagaauguacccuaccuagguaaaagagaagaccaauggugcggcucauuaauugguuuaacauccagagccacuugggcacaaaauauaccaacagccauacagcaaguacggagccuaauugguaacgaagaauuucucgauuauaugccaucaaugaaacguuuucggaaagaggaagagagugaaggugcgaucugguga

SEQ ID NO: 23461 - RNA, 9873 nt, Artificial Sequence
  derived and/or modified CDS sequence (opt6) from DENV-3__EU569690__SS-prME
acuucuuuauguuuaaugaugauacuccccgcagcauuagcuuuccacuuaacaagucgagauggagaaccgagaaugauaguaggcaaaaaugaacgagggaaaagucuccuguucaaaacggcgagcgggauaaacauguguacucucauagcaauggauuuaggagaaaugugcgaugacacggugacguauaaauguccucauauuacagaaguugaacccgaagacauagacugcuggugcaaucuaacaucaaccuggguaacuuauggaacauguaaccaagccggcgagcaccgccgagauaaaagaaguguagcacuugcuccucacguuggcaugggguuagacacacguacucagacauggaugagugcggaaggcgcuuggcgccaaguugaaaaaguagaaacuugggcacuuagacauccuggcuucacuauauuagcacuauuccuagcacauuauauuggaacauccuuaacacaaaaaguaguaauauucauccuccuuauguuagugacaccuucgaugacaaugagaugcguuggaguuggcaaucgagacuucgucgaaggucuaucgggugcaacguggguagacguaguuuuggaacauggaggguguguaaccacuauggcuaaaaacaaaccuacccuagauauagaauuacagaaaacugaggcaacacaacuagcaacauuaagaaaacuauguauagaagguaaaaucaccaauauuacgacagauuccaggugcccuacacaaggcgaggccguguugccagaagaacaggaucagaauuacgucuguaaacauacauauguagauagagguuggggaaacggauguggccuauucggaaaagggagcuuagugacaugcgccaaauuucaaugcuuggagccgauagagggaaaaguaguacaguaugaaaauuuaaaauacacagugauaaucacaguucauacgggagaucaacaccaaguugguaaugaaacacaagggguaacugcugagauuaccccucaagccucgacaaccgaagcaauacugcccgaauauggaacacucggauuagaaugcucuccuagaacaggguuagauuuuaacgagaugauacuacucacaaugaaaaauaaagcguggaugguucaccgacagugguucuuugacuuaccuuuaccguggaccucuggggcuacuacugaaacaccaacauggagcagaaaagaacugcuuguuacguucaaaaacgcacaugcaaagaaacaagaaguaguaguccuaggcucacaagagggggcaaugcauacagccuuaacaggagcaacagaaauucaaaauagcggagguacgucuauuuucgcagggcaccuuaagugucgguuaaagauggacaaacuugaauugaagggaauguccuacgcaauguguacgaacacguucguacuaaagaaagagguaucagaaacgcagcauggcacuauacuaauaaaaguugaguauaagggagaagauguacccuguaagauaccauuuaguacggaagaugaacaggguaaagcccauaauggcagguuaauuacagcgaauccagugguaaccaagaaagaggaacccgugaauaucgaagcagaaccaccuuucggcgaauccaacauuguaaucgguauaggggacaaugcauuaaaaauaaauugguacaagaaagguucaucuauuggaaaaauguuugaagcgaccgcaagaggagcaaggaggauggcaauuuuaggggauacggcaugggacuuuggauccgucggugguguucuaaacagucuaggaaaaauggugcaccaaauauuuggauccgcauauacagcacucuuuucgggagugaguugggucaugaaaaucggaauuggaguguuguuaaccuggauaggcuuaaacucgaagaauacaaguaugaguuuuucuugcauugcaauugguauaauuaccuuauauuuaggugcaguuguccaagcugauaugggauguguaauuaauuggaaggguaaagaauuaaaaugcgguucuggaaucuuuguuaccaacgaaguacacaccuggaccgagcaauauaaguuccaagcagacagcccaaagagauuagcuacagcaauugcuggugcgugggagaacggcgugugcggaauuagaucaaccacuaggauggaaaaccuauuauggaaacaaaucgcaaacgaacuaaauuacauccuuugggaaaacaauaucaaacuuaccguagucgugggagauauuaucgguguucuugaacaagguaaaagaaccuuaauaccgcaaccgauggaacuuaaauacaguuggaaaacaugggguaaagccaaaauuguaacugcugaaacacagaacagcucguuuauaauagaugguccgaacacaccagaaugcccuagugcaucuagagcauggaaugucugggaaguagaagauuacggcuucggcguguucaccacuaacauuuggcuaaaauugagagaaguguauacacaauuaugugaccauagguuaaugagcgcugcuguaaaagaugaaagagcaguacacgccgauaugggcuauuggauagaaucacagaagaauggcaguuggaaguuagaaaaagcaagccucauagaaguuaagacguguaccuggcccaaaagucauacgcuauggaguaacgguguucuagaguccgauaugauaauuccaaaaagucuagcugguccaauuucucagcauaacuaucgccccggcuaccauacacaaacugcaggaccauggcauuuagggaaacuagaacuggauuuuaauuauugcgaagguacaacaguugugauuacugaaaauugcggcaccaggggcccuagcuuaagaaccacuaccguaucugggaaacuuauacaugaaugguguugucguagcuguacccuaccuccacuuagauauaugggagaagacgguuguugguauggaauggaaauaaggccaauaucagaaaaggaggaaaauaugguuaaaagucucguaagugcaggaaguggagaagucgauaauuuuacaaugggagugcuaugcuuagcgauucucuuugaggagguuaugaggggcaaguuuggaaagaaacacaugaucgcgggaguauucuuuaccuuuguauuacuucuaucaggucagauaacuuggagagacauggcucacacgcuaaucaugauaggcucaaacgcaagcgaccggaugggaaugggaguuacauauuuagcacucauagcuacguuuaaaauccaacccuuuuuagcuuuaggauucuuucugcguaaacuaacaucaagagagaaccugcuguuaggagucggcuuagcuauggcaacaacgcuacaauuaccagaagauauagaacaaauggcaaacggaaucgcguuaggccucauggcacuaaaauuaauuacacaauucgaaacguaucaauuguggacagcgcuaauuaguuugacauguaguaauacaauuuuuacacucacaguagcauggcguacagcaacucuaauucuagcaggcguaucacucuuaccuguaugccaaagcucauccaugcgaaaaacggacuggcugccaaugacgguugcugcaauggggguuccaccacugccguuauucauauuuucuuugaaagauacacuuaagcgacgaagcuggccacuaaaugaaggaguaauggcuguaggccucguuucgauuuuagccaguucccuauuaagaaaugaugugccgauggcuggaccacuuguugcggguggacuguuaauugcgugcuacgugauaaccggaacaucugcagauuuaacuguagaaaaagcagcagaugucaccugggaagaagaagcagaacaaacuggcguuagucacaauuuaaugauaacaguggaugacgacggaacuaugagaauuaaggaugacgaaacagaaaacauacuaacggugcuuuugaaaacagcgcuuuuaauugucuccggaauuuucccuuauagcaucccggcaacgcuuuuagucuggcacacauggcaaaagcagacccaaaggaguggcguacuaugggacguaccaaguccacccgaaacgcaaaaagcagaauuagaagagggaguguaccguauaaagcaacaaggcaucuucgggaaaacgcagguugggguuggaguucaaaaagaaggaguuuuccacaccauguggcacguaacacgaggggcaguauuaacuuauaacgguaaaaggcuugaaccaaauugggcaucagucaagaaagauuuaauaucauaugggggagguuggcgguuaucagcccaauggcaaaaaggcgaagaagugcaaguaauugcaguagaacccggcaagaauccuaaaaacuuucaaacaaugccuggaaccuuucaaacgacaacuggugaaauuggagcgauugccuuggauuuuaaaccagguaccucgggcucaccaaucauaaaucgagagggcaaggucguaggacuuuauggaaaugggguaguuacuaaaaacggagguuacgugaguggcauagcgcagacaaacgcggagccggauggaccaacaccagaacuugaggaggagauguucaaaaagaggaaucucaccaucauggauuugcauccaggaucaggcaagacgaggaaauaccuuccugcaauuguaagagaagcaauaaagagaagguuaaggaccuuaauucuggcacccacuagaguagucgccgcugaaauggaagaggcuuugaaaggauugcccauaagguaucaaacuacagcaacgaaaucugaacauacaggccgcgaaauaguagauuugaugugucaugccacauuuaccaugcgauuauuaucacccguaaggguaccuaacuauaaccuaauaauaauggaugaagcccauuuuacugauccugcuaguauagcggcaaggggcuacaucaguacacgaguaggaaugggagaggcugcagcaauauuuaugacagcuacuccaccugguacggcagaugccuucccucagaguaacgcaccaauacaggacgaagaacgagauauacccgagcguuccuggaacaguggcaaugaguggauaaccgacuucgcaggcaaaacaguuugguuuguaccauccaucaaagcagggaacgauauagccaauugcuuaaggaaaaauggaaagaaaguuauacaauuaaguagaaaaacauucgauacugaauaccagaaaacgaaacuaaacgauugggacuucguugucacuacugacauaucggaaaugggagcaaauuuuaaggcagaccgcguaaucgauccaagaagaugucuuaaacccguaauucucacagauggccccgaacgagucauuuuagccggacccaugccugucacggcugccagugcagcacaacggagaggccgagucgggcgaaauccucaaaaagaaaacgaucaguauauauuuaccggacaaccguuaaauaaugacgaagaccaugcucacuggacagaagcgaagauguuacuagacaacaucaauacuccagagggaauaaucccugcccuuuucgagccggaacgagaaaaaucagcugccauugauggggaauaucgucuuaaaggggagucaaggaaaacguuuguugaacugaugaggagaggggaucuaccuguaugguuagcucacaaagucgcuucugaaggcauaaaauacacugauagaaagugguguuucgacggucaaagaaacaaucaaaucuuggaggaaaauauggacgucgaaauuuggacuaaagaaggagagaagaagaaacuacguccuaggugguuagaugcacgaacauauucggauccacucgcauugaaagaauuuaaagacuuugcagcugguaggaaaaguauugcacuagaucuuguuaccgagaucggacgaguaccuacacaccuggcacacagaacucgaaaugcacuggauaacuugguuaugcuacacacaucugaacacggcggaaaagcauaccgacacgcuguugaagaacuucccgagacgauggagacguuacuacuauuaggguuaaugauuuuacuaaccggcggggcaaugcuauucuuaauaaguggcaagggaauagguaagacuucgauagguuuaaucugugugaucgcaucguccgggauguuauggauggcggaaauuccacuucaauggauagcaagugcuauaguucuugaguuuuucaugaugguauuacuuauaccagagccggaaaagcaaagaacaccccaagauaaucaacuagcauaugucguaaucggaauacuuacguuggcggcuaucauagccgcaaaugaaaugggacucuuagaaacaacgaaacgagaucugggaaugucaaaagagccgggaguuguuuccccaacaaguuaucuagauguugaucuucauccagccuccgcauggacacuauaugcuguagcaacaacgguaauaacaccaaugcuaagacacacuauugagaacucuaccgcaaaugugucacucgcagcaauugcaaaccaggcagucguguuaaugggguuggacaaagguuggcccauaucaaaaauggauuuagguguccccuuauuagcucuuggcuguuacagccaagucaauccacuaacauugacugcugccguuuuacuucuuauaacgcacuacgcuauaauaggaccgggacuacaagcaaaagcuacacgggaagcucaaaaacggacugcagcgggcaucaugaagaauccuacaguagauggaauuaugacuauagauuuagauccugucauuuacgacucaaaauuugaaaaacaauuaggccaaguaauguuauuaguacuaugugcaguucaacuguuguuaaugaggaccaguugggcauuaugugaagcguuaacauuggccacugguccuauaacgaccuuaugggaagguucuccugguaaauucuggaacacuacaauagcgguaagcauggcgaauauauuucgcggcagcuaccuagccggcgccggucucgcauuuagcauaaugaaaagcguagguacaggcaagagagguacaggaucacaaggagaaacacuuggcgaaaaguggaagaagaaacuaaaucaguuaaguagaaaggaauuugaccuauauaaaaagagugguauuacugaaguagaucgcaccgaagcuaaggagggacugaaacgaggcgagauaacacaccaugcaguaucaagaggcuccgccaaauuacaaugguuuguagaacggaacaugguaauuccagaaggaaggguaauugaucuagguuguggccgagguggauggucauacuauugugccgggcuaaagaaagucacagaaguacguggauauacaaagggaggucccggucaugaagaaccugucccaaugucgacauaugguuggaauaucguuaaauuaaugucuggaaaagauguuuucuaucucccuccggaaaaaugugacacccuacuuugcgacauaggagaaagcucccccucaccaacgguggaagagucucgaacaauacgaguauuaaagaugguugagccuugguugaaaaauaaucaauuuuguauaaaagugcuaaacccauauaugccaacagucauugagcaucuugaaagacuucaacgaaaacacggagguauguuaguacguaauccgcucuccaggaacucaacacaugagauguacuggauuucuaacgguacuggaaauauaguggcaucgguaaauaugguaucaagacuucuacuaaaccgauuuacaaugacacaucggcggccaacuaucgaaaaagacguggauuuaggagcagggacacgacacgucaaugcagaaccagaaacaccuaacauggacgugaucggcgagcguauuaaaagaaucaaagaggagcauaacucaaccuggcauuacgacgaugaaaauccuuauaagacgugggcguaucacgggucauaugaaguaaaagcgaccggcagcgccucgucaaugaucaauggcgucgugaaguugcuuaccaagccuugggaugucguacccauggucacccaaauggcuaugacagauacaacaccauuuggccaacaaagagucuucaaagaaaaaguggauacccgaaccccacggagcaugccugguacaagaagagucaugggaauaacugcagaguggcucuggcgaacucugggacggaacaagaaaccuagacuauguacucgugaagaguucacuaaaaagguaagaacgaacgcugccaugggggcaguuuuuacugaggaaaaccagugggacucagccaaagcggccguagaagaugaagauuuuuggaaguuaguggacagagaacgagaacuacauaaauuaggaaagugcgguagcuguguauauaacaugauggguaaacgagagaagaaacuaggagaguuuggaaaagcuaaagggucaagagcuauaugguauaugugguuaggagcgcgauaucuagaauuugaagcacucggauuucuaaaugaagaccacugguuuuccagagaaaacucguacucaggaguggagggagagggacuucauaagcucggauauauccuuagggauauaaguaaaauaccgggaggagcaauguaugcagacgacaccgccggaugggacacacggauaacagaggaugauuuacacaacgaagagaaaauaacacagcaaauggaucccgagcauaggcaguuagccaaugcuaucuuuaaauuaacauaccaaaacaaaguugucaaaguucaacgaccuacccccaccggaacaguuauggacauaauuagucgcaaagaucaaagaggcagugggcaaguagguaccuauggguuaaacacuuuuaccaauauggaggcucaacucauuagacaaauggagggagaagguguacucucaaaagccgacuuggagaacccacauuuacccgagaagaaaaucacucagugguuagagacuaaagggguagaaagauuaaaacgaauggcaauaucaggggaugauugcguggucaaaccaauugacgauagguuugcaaaugcguugcuggcgcuaaacgauaugggaaaaguaagaaaggauauuccucaauggcaaccaucaaaagguuggcacgauuggcagcaaguuccuuucugcucgcaccacuuccaugagcuuauuaugaaagacgggcguaaauuaguaguuccuugucgaccccaagaugaacuuauaggacgagcacgcauaucacaaggugcagguuggucauuacgugagacugcaugcuuggguaaagcauaugcccaaauguggucuuugauguacuuucauagaagggaccuaagacuagcuuccaaugcaauuuguucagcggucccgguacauuggguaccuacaagucgaacaacauggagcauucacgcucaucaucaauggaugacaacagaggauauguuaaccguauggaaucgcguauggauagaagauaaccccuggauggaagacaaaacaccaguaaccacgugggaaaacguaccguauuuagggaagcgggaggaccaauggugcggauccuuaauaggauuaaccucaagagccacuugggcacagaauauacccacggcuauucaacaaguucgcaguuugauugggaaugaggaguuccuagacuauaugccguccaugaagagauuucggaaagaagaagaaucagaaggagccauuugguag

SEQ ID NO: 23462 - RNA, 9873 nt, Artificial Sequence
  derived and/or modified CDS sequence (opt6) from DENV-3__EU569691__SS-prME
acaucuuuaugccugaugaugauccuuccagcagcuuuagcuuuccacuugacaucuagagauggagaaccacggaugauaguugggaaaaaugaacgaggaaaaucauuacuauucaaaacugcgagcggaacuaauauguguacauuaauagcuauggaccuaggagaaaugugcgacgauacuguaacauauaaaugcccucauauuacggaaguagaaccggaagauauagauuguugguguaaucucacaaguacauggguaacuuacggaaccuguaaccaagcaggggaacaucgucgcgacaaacgaucgguagcguuggcuccccauguuggcaugggguuagauacgcguacacaaacauggauguccgcugaaggugcauggaggcaaguugaaaaaguugaaacaugggcauugaggcaccccggcuuuacaauccuagcucuuuuucuagcucauuacauagguacauccuuaacucaaaaaguagucauauucauacucuuaaugcugguaacuccaucaaugaccaugcguugcgucggcgugggaaaccgagauuucguagaaggucuuucaggagcaacauggguagauguugucuuggaacacggaggcuguguaacaacuauggccaaaaauaaaccaacccuugacaucgaacuacagaaaacagaagcaacucaacuagcuacucuuaggaaauuauguauagaagggaaaaucacaaauauaacaacagauuccagauguccaacgcaaggugaagcaguucuaccagaagaacaagaucaaaauuauguaugcaaacauacauaugucgaccgagguugggggaauggaugugguuuguuugguaaagguucgcuaguaacaugugcaaaauuucagugccucgaaccgaucgaaggaaaagucguacaauacgaaaaucugaaauacacaguuauuauaacuguccacacuggagaucagcaucaaguugguaaugaaacgcaagggguaacagcggaaauuacaccucaagcaaguacaacagaagcuauacucccagaauacgguacguugggcuuggaaugcaguccaagaacaggucuggauuuuaacgaaaugauucuccuuacaaugaaaaauaaagcauggaugguccacaggcagugguuuuucgauuugccacugccguggaccaguggggcuaccaccgaaaccccgaccuggaacagaaaagaauuauuagugacauuuaaaaaugcacaugccaagaaacaagaaguagucguauuagggagccaagaaggcgcaaugcacacagcauugacaggugcgacagaaauacaaaauuccggaggcacaucuauuuucgcgggucaccucaaauguagacugaaaauggauaaguuagaacuuaaagguaugaguuacgcuauguguacaaauacuuuuguacuaaagaaagaagucagugagacacaacauggcaccauacucauaaaaguugaauauaaaggggaggauguaccaugcaaaauaccauucucaacugaagauggacaagggaaggcacacaauggaagauugaucacggcaaacccagucguaaccaagaaagaagaaccaguuaacauagaagcagaaccaccauuuggagaaaguaauauaguaauuggaauaggugacaaugcacuuaaaaucaauugguauaagaaaggaucuucgauaggaaaaauguucgaagcaaccgccagaggugcuaggcgaauggcaauuuuaggggauacagccugggauuuugguucaguaggcgggguccuuaauucucuugguaaaaugguacaucagauuuucggauccgcauacaccgcauuguucuccggcguaucauggguuaugaaaaucggaaucggaguacuuuuaacauggauaggacuuaacaguaagaacacaaguaugagcuucaguuguauugcgaucggaauaauuacccuguauuugggggcggucguucaggcugacaugggauguguaauaaauuggaaaggaaaagaacuuaagugcggaaguggaauauuuguaacaaaugaaguucacacuuggaccgaacaauacaaauuucaagcugacaguccgaaacgccuagccacagcgauagccggcgcgugggagaaugggguauguggaaucagaucuacaaccaggauggaaaauuuacucuggaaacagauagcgaaugagcuaaauuacauauuaugggaaaauaacauuaaacuaaccguagugguaggggauauaauaggaguauuagaacaaggaaagcguacacuaacgccccaaccaauggaacucaaguauuccuggaaaaccuggggaaaagcgaaaauaguuacagcagagacacaaaauucuucauuuauaauugacggcccaaauacgcccgaauguccaagugcaaguagagcauggaauguaugggagguagaagauuacggcuucggaguuuuuacaacaaacauaugguuaaaauuaagagaagucuauacgcagcucugugaucauagacuaaugucagcagcaguuaaagacgaaagagccguucaugcagauaugggauacuggauagaaucucagaaaaacggguccuggaaauuagaaaaagcaucucucauugaaguuaaaacuuguacuuggccuaaaucgcauacacuauggucuaaugggguacuagaaagcgauaugaucauaccaaaaucacuugcaggaccaauaagucaacacaauuauagaccaggauaccauacacaaacugcuggcccuuggcaccuggggaaacuggaguuagacuuuaauuacugcgaaggcaccacugucguaauaacagaaaacugugguacuagagguccuuccuuacgcacgaccacagucagcgguaaauuaauacacgaauggugcugccgaagcuguacguuacccccauuaagauauaugggagaagauggguguugguaugguauggagauccgaccgauuagcgagaaagaagagaacaugguaaagagcuugguaucugccggaucuggggaaguagacaauuucaccaugggaguuuuaugucuagcuauauuguuugaagaaguuaugcguggaaaauuuggcaagaaacauaugauagcgggaguguucuuuacauucguucuauuacucaguggccaaauaacuuggagagacauggcacauacccugauuaugauaggaaguaaugcauccgacagaaugggcaugggcguuacuuaucucgcauuaaucgcgacauucaaaauucaaccauuucuagcacuuggauucuuuuuacguaaauuaacuucuagagaaaauuuauuacucggaguaggccuggcgauggcuacaacacuucaacuaccagaagauaucgagcagauggccaauggaauagcguuaggucugauggcauugaaacuaauuacacaguucgagaccuaccaauuguggacagcacuuauaucauugaccugcagcaacacgauuuucacacugaccgucgcuuggcguacagcuacacucauacuugcuggcgucucuuuguuaccgguaugccaaagcaguucuaugagaaaaaccgauugguuaccaaugacaguugcagcaaugggagucccuccgcuaccgcuauuuauauucacccuaaaagacacccuaaaaaggagaucuuggccuuuaaacgaaggcgucauggcagucggacuugugucuauucucgcgucuaguuuacuuaggaacgacguacccauggccgggccccuaguggccggcggacuacuaauagccuguuauguaauuaccggaacaagcgcagaccucacgguagagaaagcagcugacguuacuugggaagaggaagcagaacaaacaggcguaucucauaauuuaaugauaacuguugaugacgacgggaccaugaggaucaaggacgaugagacagaaaauauacuaacaguacucuugaagacugcuuuacuuauuguaucaggcauauuccccuauagcauuccagcuacgcuucucguuuggcauacauggcagaaacaaacccaaagaagcggggugcuaugggaugugccauccccacccgaaacccaaaaagccgaauuggaagaagggguauacagaauaaaacaacaaggaaucuuuggcaaaacgcaagugggaguaggaguucaaaaggaagguguauuucauacaauguggcacgugacucgcggggcugucuugacgcauaacggaaagagacuagagccgaacugggcaucugucaagaaagaucuuauaucguauggaggcggcuggagacuaagugcacaauggcaaaaaggggaagaaguacaagucauugccguagagccuggcaaaaaucccaaaaacuuucagacuaugccgggaacguuucaaaccacuacaggagagauaggcgccauugcauuagacuuuaaacccggaacgucaggcaguccuauaaucaauagggaaggaaaagucguuggguuauauggaaauggaguuguuaccaaaaauggaggauaugucuccggcauugcacaaacaaaugcagaacccgauggcccaacaccagaacuagaagaagagauguucaagaaacgcaaccugacaauaauggaucuacacccagggucaggaaaaacccguaaguaucugcccgcuauuguaagagaggcaauaaaaagacgauugcggacgcuuauauuagcuccaacgcguguuguagcagcagagauggaagaagcucugaagggacuaccuauaagguaccaaacaacagccacaaaaucagaacacacagggagagaaaucguagaccugaugugccacgcuacauucacuaugcguuuacuaagcccgguaaggguuccaaauuauaacuugaucauaauggacgaagcacacuuuacagauccugccaguauugcugcucgaggguauauauccacucgagugggaaugggcgaagccgcugcuaucuucaugaccgcuacuccaccagggacggcagaugcguuuccacaaaguaacgcucccauccaagacgaagaaagagacauuccggaaagaaguuggaacucugguaacgaauggauaacagacuucgcgggaaaaacaguuugguuugucccgucaauaaaagcagggaaugauauagccaacugucuuaggaaaaaugggaaaaagguuauacaacuaucaagaaaaacauuugauacggaauaucagaaaacaaaauuaaaugacugggauuucgucguaacaacagauauauccgaaaugggcgcaaauuuuaaggcagaccggguuauagauccacguagaugcuuaaaaccaguaauauugaccgacggacccgaaagagugauacuagccggccccaugccugucacagcugcuucggcugcucaaagacgaggacguguuggcagaaauccacaaaaagagaaugaccaauacauauuuacgggccaaccucuaaauaacgaugaagaccaugcccauuggaccgaagcuaaaaugcuucuggacaauauuaauacacccgaaggaauaauaccugcacuauucgaaccugaaagggagaaaagcgcagcaauagauggugaauauagauugaaaggagagagucgaaaaacuuuugucgaauuaaugcgucgaggcgacuugccaguuuggcuagcacacaaaguugcgucugaagguauaaaauacacagaucgaaaauggugcuuugacggacaaagaaauaaucaaauauuagaagaaaacauggacguugaaaucuggacaaaagaaggagagaagaagaaauuacguccaagauggcuagaugcaagaaccuacuccgauccauuagcucuaaaggaauuuaaagauuuugcugcaggaaggaaaucaauagcuuuagaucuaguuacggaaauaggacgaguuccaacucauuuagcacaccgcacaagaaaugcauuggauaacuuaguaaugcuccacacaucagagcauggaggcaaagccuauagacaugcaguagaggaauuacccgaaacaauggaaacacuucuuuugcuuggacuuaugauauuacuaacaggcggcgcaaugcuuuuccuuauaucuggaaaggggauuggaaaaacuucaauaggacugauaugcgucaucgcauccaguggcauguuauggauggccgaaauaccuuuacaauggaucgcuagugcuauaguguuagaguucuuuaugaugguguuacuaauaccagaaccggagaagcaacggacaccgcaagacaaucaacuugcuuacguaguuauuggcauauugacccucgcugcaauaauugcugcuaacgaaaugggucuacuugagacaacaaaacgugauuuagguaugucaaaggaaccgggaguagucagcccaacaagcuaccucgauguagaccuacaucccgcuucagcguggacauuauacgcaguagcgacgacuguaauaacaccaaugcuucgacacacuauagaaaauagcacugccaauguuucauuagcugcaauagcaaaucaggcgguaguguuaaugggacuagacaaaggauggccuauuucgaaaauggauuuagguguuccccuuuuagcacuagguugcuacucccaaguaaauccauuaaccuuaacagcugcgguccuucuguuaauuacacacuaugcuauaaucgggccuggccuucaagcaaaagcuacuagagaggcacagaaaagaaccgcggcggguauaaugaagaauccuacuguggauggaauaaugaccauagaucucgaucccgucauuuaugauucaaaguuugaaaaacaauugggucaggucaugcuccuaguauuaugugcaguccaguugcugcuaaugcguacuucgugggcauuaugcgaagccuuaacacuugcgacagggccgauaacaacauugugggagggcaguccggguaaauuuuggaauacgacgauagcgguuaguauggcaaacaucuucagaggaucauauuuagcuggagcagguuuagccuucagcauuaugaaaucuguagggaccggaaaacgaggaaccggaagucagggagaaacauuaggcgagaaauggaagaagaaauuaaaucaauuaucgagaaaggaguucgaccuauacaaaaagagcgggauaacagagguagauaggacggaagcuaaggaaggacuaaaaagaggagaaauaacgcaccacgcuguaagucgcgguagugcuaaauugcaaugguuuguugagagaaauaugguaauuccggagggccguguaauugaucucggaugcggacguggcggauggucguacuauugugcgggucugaagaaaguaacugaaguuagagguuacaccaaggguggcccaggacaugaggaacccguuccuaugucgacuuacggauggaacauugucaaacuuaugucaggaaaagauguuuucuauuuacccccggaaaaaugcgacacacuucucugcgauauaggagaguccaguccuucuccuacugucgaagaaucccguacuauacgugucuuaaaaaugguugaaccaugguugaaaaacaaccaauucugcauaaaaguauuaaauccuuauaugccuacggugaucgagcacuuggagagauugcaacgaaaacacggcggcauguuaguccgaaacccauuaucgcguaauucaacccacgaaauguauuggauuuccaaugggacuggaaauauaguggccucgguuaacaugguaagcagacucuuauugaauagauuuaccaugacucacaggagaccaacuauugaaaaagauguagauuuaggggcaggcacucggcauguuaaugcagaaccggagacaccaaauauggaugucauuggagagcgaauaaaacguauuaaggaggaacacaauaguacuuggcacuacgacgacgagaauccauaccgcacuugggcuuaucauggcucauaugaagugaaagcaacaggaucugccaguucaaugauuaauggcguaguaaaauugcuuaccaaacccugggauguaguuccaaugguuacccagauggcaaugacagauacgacaccuuucggccagcaacgugucuuuaaggaaaaaguagacacgcgcacaccuagaaguaugccgggaacaaggagaguaauggguauuacugcugaauggcucuggaggacacuugggcgaaacaagaaaccucgccuguguacaagagaagaauuuacaaagaagguuagaacgaaugcggcaaugggagcaguauucacugaagaaaaucaaugggauucagcaaaagcugcuguugaagaugaggauuucuggaagcuagucgauagagaacgcgaauugcauaagcuagguaaaugugguagcugugucuauaacaugaugggaaaaagagagaagaaacucggcgaguucgguaaagcuaagggaaguagagccauaugguacauguggcuaggagcgagauauuuagaauuugaggcuuuggguuuccuaaaugaagaccauugguucagcagagaaaauagcuauuccgguguugaaggugaaggacuccacaaguuaggcuauauauuaagagacauaagcaagauuccagguggagcuauguaugccgacgauacugccgguugggauacgcgcauaacagaagaugaucuacauaacgaggagaaaauaacacaacagauggaucccgaacaucggcaauuagcgaaugcaauuuuuaaacuuacuuaucaaaacaaggucguaaaaguccaacggcccacacccacaggcacgguaauggacauaauuucucguaaagaccaacgagguuccggacaaguaggaaccuauggguuaaacacauucacaaacauggaagcacaauuaauccgccagauggaaggcgagggggugcuuuccaaggcagacuuagaaaacccacauuuacccgagaagaaaauaacucaauggcuugaaacuaaagggguugagcgauuaaaaagaauggcaauaucuggggaugacuguguaguuaaacccaucgaugaccguuucgcuaaugcucucuuagcauugaaugacauggguaagguacgcaaagauauaccccaauggcagccgucaaagggauggcacgauuggcaacaaguaccauuuuguucgcaucacuuccaugaauuaauuaugaaggacggacguaaguuaguaguacccuguagaccucaagaugaacugaucgguagagcgcggauaucgcaaggcgcuggauggaguuuaagagaaaccgcaugccuaggaaaggcguaugcccagauguggucacuaauguauuuccauagacgugacuuacgauuagcgucaaaugcgauaugcucagcaguaccaguucauugggugccgaccucuagaacaacguggucuauacacgcucaccaucaguggaugaccacagaagauaugcucaccguauggaaccguguauggauugaagauaauccauggauggaggacaagacuccagugacaacgugggaaaauguuccauauuuagggaaacgugaggaucaauggugcggcucguugauaggauuaacaucacgcgcuacgugggcacaaaauauuccaacagccauucaacaaguaagaucauuaauaggaaaugaagaguuccuggauuauaugcccaguaugaagcgcuuuaggaaggaagaagaaagugagggagcgauuugguaa

SEQ ID NO: 23463 - RNA, 9873 nt, Artificial Sequence
  derived and/or modified CDS sequence (opt6) from DENV-3__EU482452__SS-prME
acaagccucugucuaaugaugaugcugccagcuacauuggcguuucauuuaacaagucgugauggagaacccagaaugauuguaggcaaaaacgaacgaggaaaaucucuacuauuuaaaaccgcgagugguauaaauaugugcacucuuaucgcgauggacuugggagaaaugugcgacgauacggugaccuacaaauguccguugauagcggaaguagaaccugaagauauagacuguuggugcaaucuaacgucgacuuggguuacuuaugguacuuguaaucaagccggagaacaccguagagauaaaagaaguguggccuuggcaccccaugucggaaugggauuagauacacguacacaaacauggaugucagcggaaggagcauggaggcaaguugaaaaagucgaaacuugggcacucagacacccaggauucacuauacuugccuuauuucuagcccauuauauaggaacaucuuuaacccaaaaaguugucauuuuuauucucuugaugcugguuaccccaucuaugacgaugcgaugcgucggaguaggaaaccgagauuuuguagaaggauuaucgggugcaacauggguagacguaguacucgaacauggaggauguguaacaacaauggcgaaaaacaaaccuacauuagacauugaguugcagaaaacugaagcgacgcaacuagcaacacuccgaaaauuauguauugaaggaaaaauaacuaauaucacuacggacucaagauguccaacucaaggcgaggccauauugcccgaggaacaagaucagaauuacgucuguaaacauacauacguagacagaggguggggaaaugggugcggucuauuugguaaagguucauuaguuacaugugcgaaauuucaaugccuagaacccauugaaggaaaagucguucaauaugaaaacuugaaauauacgguaaucauaacuguacauaccggugaucaacaccagguggguaaugacacucaaggaguaacaguugaaaucaccccucaagcgagcacaguugaagcaguacuccccgaguaugguacuuugggacuagaauguucaccgaggacggggcuugauuuuaacgaaaugauucuacugacuaugaaaaacaaagcauggaugguucacaggcagugguucuucgauuuaccacuucccuggacaagcggggcuacuacugaaaccccaacguggaaccggaaagaacuacuugucacauucaaaaaugcacaugccaagaaacaagaaguuguaguuuuggggucccaggaaggugcaaugcacaccgcccuuacaggagcaacagaaauacaaaacucugggggcacuucgauauuugcuggacaccuuaaaugucguuuaaaaauggauaaauuggagcuaaaaggcaugucuuacgcaaugugucuagauacauuuguauugaagaaagaaguaagugaaacucagcaugguacuauccuuauaaaaguggaguacaaaggagaagacgcuccauguaaaaucccguuuaguacugaagauggccaagguaaagcgcacaaugguagauuaaucacugcuaacccggugguuacuaagaaagaggaaccagucaauaucgaggccgaaccuccauucggcgaaucaaacaucguaauugguaucggugauaaagcccuuaaaaucaacugguauaagaaagggucaaguauagguaaaauguucgaagccacagcaaggggcgcgcgcaggauggcaauuuugggagacacagcaugggacuucgggucagucggugguguauuaaauucacucggaaaaauggugcaccaaauauuuggauccgcuuauacugcauuauuuucagguguaucauggauuaugaaaauuggaauuggaguauugcugaccuggaucggauuaaauaguaaaaacacaucuaugucuuuuucguguauuguuauagguauaauaacgcuguauuugggugcgguagugcaagcggacaugggaugcguuauuaauuggaaagguaaagaacucaaaugugggagcgguauauuugugacaaaugaggugcauacauggaccgaacaguacaaauuucaagccgauucucccaaaaggcuugcuacagcgauugcaggagcgugggaaaaugggguauguggaauacgcucuacaacccgaauggagaaucuacuuuggaaacaaaucgccaaugaacuaaauuacauccuaugggagaauaacauaaaacuuacagucgugguaggggacguuauuggggucuuagagcaggguaaacguacucuuacuccgcaaccuauggaauugaaauauaguuggaaaacguggggaaaagcaaaaaucguaaccgcagaaacucaaaauucaucauuuauuauagauggcuugaacacccccgaaugcccaagcgccaguagggcauggaauguaugggaaguagaagauuacggauucggaguauuuaccacaaauauuugguuaaaacuccgugaaguauauacucaaaguugugaucacagguugaugagcgcggcgauuaaagaugagcgagccgugcaugcagauauggguuauuggauagaaagccagaaaaauggcucauggaaauuagagaaagcgucauucauagagguuaaaacuuguacuuggcccaaaucgcauacauuauggagcaauggcguacuggaaucagacaugauuauaccgaaaucuuuggcgggaccaaucucucagcauaaccaccgaccuggauaucauacacagacggcuggaccauggcaucuaggcaaacuagaauuagauuucaauuacugcgagggcacaacuguuguaauaacggaaaacuguggaacacguggccccucucuucgaaccacuacaguaucagggaaauuaauacacgaauggugcuguagauccugcacauugccaccauugagauacaugggagaggauggcuguugguauggcauggagauccgaccgauuaaugaaaaagaagagaauaugguaaagagcuuaguaagcgcaggaagcgggaaaguagacaauuuuacuauggguguuuuguguuuggccauacuauuugaagaaguaaugcgaggcaaguucgguaagaaacacaugauugcugguguacuauuuaccuucguauuacuacuaaguggacaaauuacuuggcgagacauggcucauacauuaauaaugauaggaaguaacgcaucagauagaaugggaaugggugugaccuaccuugcucuaauagcaacauucaaaauacaaccauuucuagcucuagguuucuuuuugagaaaauuaacaucacgugaaaauuuacuuuuaggaguagguuuagcgauggcuacaacccuucaauuaccagaggauauugaacagauggcaaacggaauagcuuuaggcuuaaugacacugaaauuaauaacucaauucgaaacauaccaauuauggacagcccuagucaguuuaacguguagcaauacaauuuuuacauugaccguugcguggcgaacugcuacucugauacuagccggagucaguuuacuaccuuuaugucagucaucgaguaugagaaaaacagauugguugccaaugaccguagcagcgaugggggugucgcccuugccuuuauuuauauuuucguuaaaggauacuccaaaacgccguaguuggccccuaaaugaagguguaauggcaguagguuugguuucaauucuagcuagcucauuauugagaaaugauguuccaauggccggaccucucguggcgggagguuuacuaaucgcgugcuauguaauuacggggacaagugcugacuuaacaguugaaaaagccgcugauguaacgugggaagaagaagcggagcagacaggugucucucacaaucuaaugauaacuguugacgaugacggaacgaugagaauuaaagaugaugagacagaaaacauuuugacaguacugcuuaaaacugcauugcuaauuguaagcgggauuuuccccuauagcauuccugcuaccuuguuagucuggcauaccuggcaaaaacaaacacaaaggagcggcguauuaugggauguaccuucgccaccggaaacgcaaaaggcagaguuagaagaggguguauaccguauaaaacaacaaggaauauucggaaaaacgcaaguaggcgucgguguacagaaggagggaguauuucauacuauguggcauguuaccaggggagcggucuugacccacaaugggaaaagacuugagccuaacugggcgucugucaagaaagaucugauaagcuaugggggaggauggagauuauccgcacaauggcaaaaaggagaagaaguucaggucauagcaguggagccaggaaagaacccuaagaauuuucaaaccaugcccggaauuuuucaaacuaccaccggagagauaggcgcaauagcauuggacuuuaaaccagggacuuccggaaguccaauuauaaaccgagagggaaaaguggucggauuauacggcaaugggguaguaaccaaaaauggaggcuacguuucagguaucgcccaaacuaacgcagagccagacgguccaacuccagaacuugaagaagaaauguucaagaaaagaaauuugaccaucauggauuuacauccagguucggguaaaacucggaaguacuugccugcgauaguacgagaagcuaucaaaaggagacugagaacgcuaauauuagccccaacgagaguuguagcagccgagauggaagaagcacuaaaggguuuaccaauacgcuaccaaacaaccgccacuaaaucugaacacacaggucgcgaaauuguugaccuuaugugucaugcgaccuucacaaugagguuauuguccccagucagaguaccgaacuauaaccuaaucaucauggacgaagcacauuucacugauccugccaguauagcagcacgaggauauauaaguacacgaguuggaaugggugaggcagcggcgauuuucaugacugccacaccaccaggaacagcugaggcuuuuccacaaucuaaugcaccaauucaagaugaagagagagauauaccugaaagauccuggaacagugguaaugaauggaucaccgacuuuguaggaaaaacggugugguuuguaccaagcauaaaagcuggaaaugacaucgcuaacugucuccggaaaaauggcaagaaagugauacaacucucacguaaaacauuugauacugaguaucaaaagacacgucuaaaugauugggacuuuguaguaaccaccgauauuagugaaaugggggcuaauuuuaaagcagacagggugauugauccgagacgauguuuaaaaccaguaauacucacggauggaccggaaagaguuauauuagcuggcccaaugccuguaacagcagcaucagcggcgcaacggcgcgggagagucggcagaaacccacaaaaagaaaaugaccaauauauauucacgggacagccacuuaauaacgaugaggaccacgcccacuggacagaagcgaaaauguuguuggauaacauaaacacaccugaagguauaauaccugcguuauucgaaccagaacgcgaaaaaucggcagccauugauggagaauauagauugaaaggagaaucaagaaaaacguuuguggaacuaaugagacgcggggauuugccaguauggcuagcccacaagguggcgagugaaggcauaaaauauacagaucguaaauggugcuuugacggagaacgaaauaaucaaauuuuagaagaaaacauggacgucgaaauauggacaaaagaaggagaaaggaagaaacuacgaccacgcuggcuugacgcacgcacguauuccgauccccuugcauuaaaagaguucaaagauuuugcugcaggacguaaaagcauagcacuagacuuaguaacggagauuggacgaguaccuucccauuuagccuacagaacuagaaaugcucuagauaauuuaguaauguuacauacaucagaacauggaggcagagcauacagacaugcggucgaggaacugcccgaaacgauggagacacuucucuuauuaggguugaugauucuacuaacaggcggugccauguuguuuuugaucucuggcaaaggaaucgguaagacaucuauugggcuaauuugugugauaguuucaagugggauguuauggauggcggauauuccauuacaguggauugcgucugccauaguguuagaguucuucaugaugguacuauuaauaccugaaccugaaaagcaaaggacaccccaagacaaucaauuagcuuacgucguaauuggaauccuaacccuugcagcuauagucgccgcaaaugaaaugggacuauuggagacaacaaaaagagacuuaggaaugucaaaagaaccaggaguaguuaguccaacauccuaucuggauguagacuuacaucccgcuuccgcuuggacacuauacgcaguggcaacaacagugauaacaccaauguuaaggcacacaauagaaaacagcaccgcaaauguuucucuagcggcgauagcuaaccaagcaguaguccuaauggguuuagacaaagguuggccaauuucgaaaauggaccugggaguuccgcuauuagcgcucgguugcuauagccaagugaacccuuuaacuuuaacagcagcaguucuccuauuaguaacgcacuaugcaaucauaggaccuggauugcaagcaaaagcgacccgagaagcucagaaaagaaccgcagccggcauuaugaaaaauccaaccgucgauggaauaaugaccauagaucuggaucccgugauauacgacucuaaauuugaaaaacaacuaggacaaguaaugcuucucguccuaugugcuguucaauuacuucuaaugcgaaccaguugggcauuaugcgaagcucugacguuagcgaccgguccaauaacaacccuuugggaagguucuccgggaaaguucuggaauacaacaauugccguuuccauggcuaauaucuuuagaggaucguaucuagccggagccggauuagcauucucgauuaugaagagugugggcacagguagacgaggaacaggaagccaaggugaaacuuugggcgaaaaauggaagaagaaauuaaaucaauugaguaggaaagaguucgaucuguauaagaaaucaggcaucacagagguugauagaaccgaggcaaaggaaggauugaaacguggcgaaacaacucaucacgcugucagcagaggaagugcaaaauuacaaugguuuguagagagaaacaugguaauaccugaaggacgaguuauagacuuaggguguggacgaggaggcuggaguuauuauugugccggauugaagaaaguaacagaaguaagaggguauaccaagggugguccuggucacgaagaaccuguucccaugucuacuuauggcuggaauauuguaaaacugaugaguggaaaagacguauuuuaucuuccaccagaaaagugugauacccuauuaugugauauuggugaaaguaguccgucaccaacaguugaagaaucuaggacaauacgaguccuaaaaaugguugaaccaugguugaaaaacaaucaguucuguauaaaaguguuaaacccauacaugccuacgguaauugaacaucuagaacgauugcaacguaaauauggagggauguuggugagaaauccgcuaucgagaaauucuacccacgaaauguauuggauaagcaacgguaccgggaauauaguaaguaguguaaacauggugucccgacuacuucuaaauagauuuaccaugacgcauagacggccuacaauagagaaagauguagauuuaggagccgguacaagacauguaaacgcagagccagaaacaccgaacauggacgugauaggugaacguauuaaaagaauaaaggaagaacauucuuccacuuggcauuaugacgaugaaaauccguauaaaacgugggcauaucacgggaguuaugaagugaaggcaacaggcuccgccucgucaaugauuaauggagugguuaaacuacuaacuaaacccugggacguagucccaaugguuacucagauggcgaugaccgacaccacgccuuucggacaacagagaguauuuaaagagaaaguugacacucgcacaccuagacccaugccuggcacuagaaagguaauggaaauaacugcagaguggcuauggcgaacacuaggaagaaauaagaagccccgauuguguacacgcgaagaguucaccaagaaagugcgaaccaacgcagcaaugggagcgguuuucacagaagaaaaucagugggacuccgcucgggcggcaguugaagacgaagaauuuuggaagcuaguugaccgcgaaagagagcugcauaaacuagggaaaugcgguucaugugucuauaacaugaugggaaaaagggagaagaaauuaggugaguucggaaaagcaaaagguucucgcgcuaucugguacauguggcuaggugcucguuaccuugaguucgaagcacuaggauuucuuaaugaagaucauugguucucuagagaaaauucauacagugguguugaaggugaaggauuacauaaacuaggauauauccucagagacauauccaagauuccaggaggagcgauguaugcagaugacacggcuggcugggauacacgaauaacagaggacgaucuacauaaugaagaaaagauuacacaacaaauggacccagaacaucgccaguuggcuaacgcaauuuucaaauuaacuuaccaaaacaagguaguuaaaguacaacguccaacucccaagggcacagucauggauauaauaucuagaaaagaccaacgagggagcggacaagugggaacauacggguuaaauaccuuuacgaacauggaggcucaacucgucagacaaauggagggcgaaggaguacuaagcaaggcagaucuggaaaauccacauuuacuagaaaagaaaauuacccaaugguuagaaaccaaaggcgucgaacgacugaaacgaauggcuaucuccggcgacgacugcguaguaaaaccgaucgaugaucgcuuugccaaugcauuauuggcacuaaacgauaugggaaagguaagaaaagacauaccccaauggcaaccgucuaaaggcuggcacgauuggcaacagguuccuuuuugcucucaccacuuccacgagcuuauuaugaaagacggacguaagcuaguuguuccuuguagaccacaggaugaauuaauagggagggcgagaauaucucagggugccgguuggucccuaaaagaaacggcaugcuuaggcaaagccuaugcccaaauguggagccucauguauuuccauaggcgugaucuucgccucgcaucaaacgcgauauguucugcaguaccuguacacuggaucccaacgagcagaaccacauggagcauucaugcccaucaccaauggaugacuacggaagauauguuaacaguguggaauaggguauggaucgaggacaacccauggauggaagacaaaacgccaguaacuacuugggaagaugugccauacuuaggaaagagagaagaccaauggugcggcagcuugaucggacugacuagcagagcaacaugggcucaaaauauacucaccgcgauacaacaaguuaggagccuaaucggagacgaggaguucuuggauuauaugccuaguaugaagcgcuuccgaaaagaagaagagucggaaggagcgauuugguga

SEQ ID NO: 23464 - RNA, 9873 nt, Artificial Sequence
  derived and/or modified CDS sequence (opt6) from DENV-3__EU482453__SS-prME
acgagcuuaugucuaaucaugauguuacccgcuacauuagcauuccaccucacaucuagagauggagaaccaagaaugauugucggcaaaaaugaaagaggaaaaucauugcucuuuaaaacagcaagugguauuaauauguguacauuaaucgcgauggaucugggggaaaugugugacgacacuguaacuuacaagugcccacuaauugcagaaguggaaccggaagauauagauugcuggugcaacuugacuucuaccugggucacuuauggaacaugcaaucaagcaggagagcaucgaagggacaagaggucuguugcucuugcuccucaugugggaauggggcuugacacccguacucaaacguggaugucagcagaaggugcauggcgacagguagaaaagguagagacaugggcgcuacgucacccgggguucacuauccuagcgcuauuucuggcucacuauauaggaacuuccuuaacccaaaaaguggucauuuucaucuuauugaugcuugucacaccuagcaugacaaugagguguguugguguaggcaacagagacuuuguggaaggauuaucuggugcaacauggguagacguggugcuugaacacggaggaugcgucaccacaauggccaaaaauaaaccaacuuuagacaucgagcuacagaaaacugaggcaacacaauuggcuacacuccgcaaauugugcauagaaggaaaaauaaccaacauuacaacugacucaagauguccuacacaaggcgaagcaauauuacccgaagaacaagaccaaaauuauguauguaaacacaccuacguagauagggguugggguaacggaugcggauuauuuggaaaaggcagcuuggucacaugcgcaaaauuucaauguuuagaaccaaucgaaggaaagguuguucaauaugagaacuuaaaauauacagugaucaucaccguacacacaggugaucaacaucaaguagggaaugacacacaggggguuacaguugaaauaacaccgcaagcaucaacuguagaagcaguacuuccagaauaugguacacuaggucuggaauguaguccaaggacaggucuagacuucaacgagaugauucuucuaacaaugaaaaacaaagcauggaugguucauagacaaugguucuuugauuugccucugccauggacuucaggugcaacuaccgaaacaccuacguggaauagaaaggagcugcuuguaacguuuaaaaacgcacaugcaaagaaacaggaagucguuguccucggcagucaagaaggugcuaugcauacugcguuaacaggagcaacagagauacaaaacaguggcgguacuucaauuuucgcuggacaccuaaaaugccgguugaagauggacaaauuagaacuaaagggaaugagcuacgccaugugcuuaaauacauucguacuaaagaaagaaguaagugagacacaacaugguacgauucugauuaaaguagaauauaaaggggaagaugcuccaugcaagaucccuuuuuccacagaagacggccaggguaaggcacauaauggacgccuuauaacagccaacccuguuguaacuaaaaaggaggaaccaguaaauauagaagcggaaccaccauucggcgagucaaacauagucauaggaauuggugauaaagcgcuuaaaauaaacugguauaagaaaggaucuaguauuggcaaaauguuugaggcuaccgcuagaggugcccggcggauggcaauacugggugauacugccugggacuucggaagcguaggagggguacuuaauucauuagggaaaaugguacaucagaucuuuggaucugcguacacugcauuauuuucaggaguauccuggaucaugaagauagggauuggaguccuguuaaccuggauaggacuaaauuccaagaauacaucuaugucauucagcuguauagcuaucgguauaauuacacuuuaucugggggcgguaguccaagcagauaugggaugugcuauaaauuggaaagggaaagaacucaagugugguucaggaauauucguaaccaacgaaguccacacauggacugagcaguauaaauuccaagcggacucucccaagagguuagccacggcgaucgcaggagccugggagaaugggguguguggaauaagauccacaacgcguauggagaauuuacucuggaagcaaauagcgaacgaacuuaauuauauuuugugggaaaauaauauaaaauugacaguuguaguaggugacauaaucggaguucuagaacaagggaaacgaaccuuaaccccacaacccauggaauuaaaauauaguuggaaaacuuggggcaaggcuaaaauaguaacagcagagacacaaaauucuucuuucauaauugauggacccaacacacccgaaugcccgagcgcaucuagagcuuggaacguuugggaaguugaagauuaugguuuuggcguauuuacaacuaauauuuggcuuaagcuaagagaaguauauacacaaaguugugaucacagauugaugucugcagcaaucaaagacgaaagagcgguucaugcagauaugggauauuggauagaaucucagaaaaauggaaguuggaaacuggaaaaagccagcuuuauagaaguaaaaacguguacuuggccaaagucacauaccuuauggaguaauggaguucuggaaagcgauaugauaauacccaagucucuagcuggaccaauaucacaacauaaucauaggcccggauaucauacgcaaacagcaggcccauggcaccuugguaaacucgagcucgacuuuaauuacugcgaagguacaacugucguaauaacugaaaacuguggcaccagaggcccaucucuaagaacuaccacaguuagcgguaagcuaauacaugaguggugcugccggucauguacccuuccaccacuuagauacaugggagaagacggauguugguaugggauggaaauuagaccaacaaacgagaaagaggaaaauaugguuaaauccuugguaucagcgggaagugggaaagucgauaauuucacaaugggaguacuaugcuuggcaauauuauuugaagagguuaugaggggcaaauucgggaagaaacauaugauagcaggaguacuguuuacauuuguacuacuucuuucugggcaaauaacauggagagauauggcucacacguugauaaugaucgguucaaacgccagugaccgaaugggcaugggagugacuuacuuagcguugauagccacuuuuaaaauacaaccauuucucgcauugggauuuuucuuaagaaaguugaccagucgagaaaacuuauuacuaggcguagggcuagcaauggcaacaaccuuacaacuaccggaagauauugaacaaauggcaaacggaauugcacuugguuuaaugaccuuaaaacuuaucacacaauuugaaacauaucaacuguggacagcgcuaguuucacuuacgugcuccaauacuaucuuuacacugacgguagcauggagaacugcuacacucauuuuggccggugucucgcuuuuaccgcugugucagucaucaagcaugcgaaaaacagauuggcugccaaugacaguugccgccauggguguacccccauugccucucuuuauuuucucacuaaaggauacaccaaaacgucgcucuuggccauuaaaugaaggaguaauggcugucggcuuaguaucaauauuagcguccagucugcuaaggaacgauguaccaauggcagggccgcuaguagccggugguuuguugauagcauguuauguaauaacaggaacuucagcagaccugacuguugaaaaagcugccgaugucacaugggaagaagaagcggaacaaacuggugucagucauaauuugaugaucacaguagacgaugauggaacaaugcguauaaaagaugaugagacugagaauauacuaacaguucuauuaaaaacagcguuauuaauaguuuccgggauauuuccauauucuauacccgccacguuauuaguguggcauacguggcagaaacaaacacaaagaaguggaguucuaugggauguuccgucaccuccagaaacccaaaaagcggaacuggaggaaggugucuaucguauaaagcaacaaggaaucuucgguaaaacgcaaguugggguuggcgugcaaaaagagggaguguuccauacaauguggcacgucacaagaggugccguacuaacacacaacgggaaacgucuugaaccuaauugggcgucuguuaagaaagaccuuauaucguauggagguggguggcgccuuucggcacaauggcaaaaaggugaagaaguucaggugauugcaguagaaccagggaaaaacccuaaaaacuuucaaacuaugccaggcaucuuucaaaccaccacaggcgaaaucggagcaauagcauuggauuuuaaaccaggcacaagugguagcccaauaauuaacagggagggcaagguuguggggcuuuauggaaacgguguaguaacuaaaaaugguggguauguaucuggcauagcacaaacuaaugcugaaccagaugggcccacucccgaauuggaggaagaaauguucaagaaacgaaaucuuaccauaauggauuuacauccagggucagggaaaacuagaaaauauuuaccggcuaucguucgcgaagcaauuaagagaagguuacggaccuugauucuggcaccuacccgcgugguugcagccgaaauggaagaagcauuaaaggguuugccaauaagauaucaaacgacagcaacuaaaagugagcauacaggaagagagauugucgaucuuaugugucaugcgacauucacaaugagacuauuguccccaguuagaguaccaaauuauaaucuaauaauuauggaugaagcucacuuuacugacccggcaaguaucgcagcuagaggguacauuuccacacguguggggaugggagaagcagcagccauuuuuaugacagcaaccccuccuggcaccgcggaagcauuuccucagucaaaugcucccauccaagaugaagagagggauauuccagaacgcucauggaauaguggaaacgaguggaucacugacuucguaggcaaaacagugugguuuguccccucaauaaaagcuggcaacgauauugcuaauugccuucgaaagaauggcaagaaaguuauccaauuaagucggaaaaccuucgacacagaauaccagaaaacuagacuaaaugacugggauuuuguaguaacgacugauauauccgagaugggagcaaauuuuaaggcggauagaguuauagauccgcgacgcugucugaaaccgguaauacucacagauggaccagaacgaguaaucuuagcuggaccaaugccugugaccgcggcaucagcugcgcaaagacgugggcguguagggaggaauccgcaaaaagagaaugaucaauacauuuucacgggacaaccucuaaauaaugacgaagaucaugcacacuggacagaagcaaaaaugcugcucgauaacauuaacacuccagaaggaauuauccccgcuuuauucgaaccugaacgugaaaagucugcagcaauagacggcgaauaucguuuaaagggagaaucucgaaaaacguucguagaauugaugcggagaggcgaucuucccgucuggcuugcgcacaaaguagcaucagaagguauuaaauacacugacagaaaauggugcuucgauggugaacguaauaaccaaauucucgaagagaauauggacguugaaaucuggacuaaagagggagagaggaaaaaguugcgaccccgaugguuggacgcaaggacauauucagaucccuuagccuugaaagaguuuaaagacuucgcagccggucguaaaucaauagcguuagaccugguaacggaaauaggacggguuccaucccaucucgcauauaggacccgaaaugcguuagauaauuuaguaaugcuacacacaagugaacauggagggagggcauaccgacaugcaguagaagaguugccggaaacaauggaaacacuacuacuacugggauuaaugauacuuuuaacaggcggugcgaugcuauuucuaauauccggaaaggggauagguaaaaccucaauaggccugaucuguguaaucguaagcucagguauguuauggauggcagacguuccucuacaguggauugcaucugcuaucguauuagaguucuucaugaugguucuacuaaucccggagccugagaagcagaggacuccacaagauaaucaguuagcauauguagucaucgguauccuuacacuggcugcuauagucgcagcaaaugagaugggacuacucgaaaccacuaagagggaucuugguaugagcaaagaaccaggaguuguaagccccacaagcuacuuagacgucgaucuacaucccgcaucagcauggacauuauacgcuguugcaacgacagugaucacacccaugcuccgacacacgauugaaaauaguacugcgaauguaagucuagccgcaaucgcaaaucaggccguggucuuaauggguuuagauaaagguuggcccauaucgaaaauggaccuaggggugccauuacucgcuuuaggcugcuacucccaagugaauccauuaacacuuaccgccgcagugcuucuuuugguuacacacuaugcgauaauaggaccggguuugcaggcuaaggcuacgcgugaagcacagaaaagaacggccgcaggaauaaugaaaaacccuacuguagacggcauuaugaccaucgaccuagaucccgucauauaugauucgaaguuugaaaaacaauuaggacagguuauguuauuaguucuuugugcuguacaauuacuguuaaugcgaaccagcugggcucuuugugaagcacuaacacucgcaacaggacccauuacgacacuaugggaaggcaguccagguaaguuuuggaauacgacaauugcaguaagcauggcuaauauuuuuagaggcucauaucuagcuggugcuggauuggcuuuuaguaucaugaaaaguguugguacugguagacguggaacugggagucagggagagacgcugggggagaaguggaagaagaagcuaaaccaacuaucaaggaaagaauuugaucuauacaagaaauccggaauuacagaaguagaucguacugaagcuaaagagggauugaaaagaggugaaacaacacaucaugcaguaagcagaggaucggcaaaauuacaaugguuuguagagagaaacauggugaucccugaaggaaggguaauugauuugggauguggaagaggagggugguccuacuacugugcuggacuaaagaaaguaacggaggugagaggguauacaaaaggagguccagggcaugaggaaccgguuccuaugucgaccuauggguggaacauugucaaauuaaugaguggaaaggaugucuuuuaucucccuccugagaaaugugauacauuauuaugcgauaucggggaaucuucucccucgccuacaguagaagagaguagaaccauaaggguucuaaagaugguugaacccuggcucaaaaacaaccaguucugcaucaaggucuuaaacccuuacaugccaacagucaucgaacauuuagaaagguuacaaaggaaguauggaggaaugcucguacguaauccucuaucuagaaauagcacucacgaaauguauuggauuucaaauggaacaggcaauauaguaucgaguguuaacauggucucaagacuucuucuuaauagguucaccaugacccauagacgcccuaccauagaaaaagacguugauuuaggcgcgggcacuaggcaugucaaugcugagccagagacaccgaauauggacguaauaggagagagaauuaaaagaauaaaagaggaacauaguaguacauggcauuaugacgaugaaaacccauauaagacgugggcguaucauggauccuaugagguaaaagcuacgggaucugcaaguucgaugaucaaugguguaguuaagcugcuuaccaagccuugggacguaguaccuaugguuacacaaauggcgaugacugauacaaccccuuucggacaacaaagaguauuuaaggaaaaaguagauacucgaacuccaaggccaaugccagguacuagaaagguaauggaaauaacagcggaguggcuguggcgaacacuagggcgaaauaagaaaccacgccuguguacaagagaagaauuuacgaagaaggugagaacaaaugcagcaaugggugccguuuucacagaagaaaaucaaugggauucugcuagagcggccguugaagaugaagaauuuuggaaguuaguagauagagaaagagaguuacacaagcucggaaaauguggaagcugcguauacaauaugauggguaaacgggagaagaaacuuggagaguucggcaaagccaaaggaucacgagcgauaugguacaugugguuaggagcacgauaucuugaguuugaagcgcucggguuuuuaaaugaagaucacugguuuagucgugaaaacaguuauaguggaguagagggugaggguuuacauaaacuaggauacauuuuaagagauauuucgaaaauaccagggggagcaauguaugcggacgacacagcuggaugggacacacguauaacggaggacgaucuacacaaugaagagaaaauuacucagcaaauggauccugaacauagacaacuagcaaaugccauuuucaaacuaacguaucagaauaaggugguaaagguacagagacccacuccaaaaggaacuguuauggauauaaucagccgaaaggaucaacguggcucuggacaaguuggcacauacggauuaaacacuuuuacaaacauggaggcacagcuaguaagacaaauggaaggagaaggcgucuuaucuaaagcagaucuugaaaacccucacuuauuagagaagaaaauaacucaaugguuggaaacaaaaggaguggaaagauugaaaaggauggcaauaaguggugaugacugcguugucaaaccaaucgacgacagguuugcaaaugcgcuucuagcgcuaaaugacauggguaaaguuagaaaagacauuccgcaauggcaacccucgaaaggauggcaugauuggcagcaaguuccguuuugcucucaccauuuccaugaacuaauuaugaaggauggucgaaaacucguaguuccaugcagaccccaagacgaauuaauuggucgagcacgaaucucacagggugcgggguggaguuugaaagagacugcgugcuuagguaaagcauaugcacagauguggucgcuaauguacuuucaccgucgagaucuaagauuagcuucaaacgcuaucugcucagcuguaccuguacauuggauaccaacgucaagaacaacauggagcauacaugcacaccaucaguggaugacaacagaagauaugcucacgguauggaaucguguauggaucgaagauaacccauggauggaagacaagacuccugucacgaccugggaagaugucccauacuuaggaaaaagggaagaucaaugguguggcaguuuaauuggacuaacaaguagagcaacgugggcgcaaaauauacuuacugcaauccaacaaguaagaucgcuaauaggugaugaagaauuuuuagacuauaugcccucgaugaaacgauuuaggaaagaagaagaacuagaaggggcgauuugguaa

SEQ ID NO: 23465 - RNA, 9873 nt, Artificial Sequence
  derived and/or modified CDS sequence (opt6) from DENV-3__EU482454__SS-prME
acgucguuguguuuaaugaugaugcuuccggcaacguuagcuuuccacuuaacuagccgagacggggaaccaaggaugaucguuggcaaaaaugagcgcgguaaaucuuuacuauuuaaaacagccaguggaauaaacauguguacccucauugcuauggaucuaggggagaugugugaugacacuguuacuuacaaaugcccauuaauugccgaaguagaaccggaagacaucgacuguugguguaauuugacaaguacuuggguaaccuacggaaccuguaaucaagcuggugaacacagacgugacaaaagaucuguggcccuggcuccccacguugguauggguuuagauacucgaacacaaacuuggauguccgccgaaggagccuggagacaaguagaaaaaguggagacgugggcucucagacacccggguuuuacuauacuugcguuauuccuagcccacuauauuggaacgucacuaacacagaaaguuguuauauucaucuuauuaaugcucgucaccccgucgaugacaaugcguugcgucggagucggaaauagggauuuuguggaaggacugaguggugcuacauggguugauguuguccuggaacaugguggaugcguuacaaccauggcgaaaaauaaaccgacgcucgauauagaauugcagaaaacagaagccacacaacuggcaaccuuaagaaaauugugcauagaagguaaaauuaccaacauaaccacagacucacgauguccaacacaaggggaagcaacguuaccagaagaacaagaccaaaauuacguauguaaacauacauauguagauagagggugggguaacggaugcggguuauuuggaaaagguuccuuaguaacgugcgccaaauuucaaugccuagaacccauugagggaaaaguuguccaguacgagaaucuuaaauacacgguuauuaucacgguacauaccggagaccagcaucaggucgguaacgacacacaaggaguaacaguugagauuacaccacaagcauccaccguggaggcgguacuuccggaauacggaacucugggccuugagugcucaccacgcacaggauuagacuuuaacgaaaugauacuuuuaacuaugaaaaauaaagcauggaugguacaccgacaaugguucuuugacuugccucuuccguggacaucaggagcaacuacugagacaccaacauggaaucgaaaagaacuauuaguuacuuucaaaaaugcccaugcuaagaaacaagaaguaguuguacuggggucacaggaaggagcaaugcacaccgccuuaacaggagcuacagaaauacaaaauucugguggaacgucaauauuugcaggccauuuaaaaugcaggcuuaaaauggacaaacuagaauuaaaaggaaugucguaugcgaugugucuaaauacauuuguccuaaagaaagaaguaagcgaaacccaacauggaaccauucuuauaaaaguagaguacaaaggagaagaugcgccuuguaaaauaccuuuuaguacugaagauggucaagggaaagcucacaacggacgauuaauuacugcaaacccuguggucaccaagaaagaagaaccaguaaacauagaagcagagcccccguucggcgaaucaaacauuguuauagggauuggagauaaagcguuaaaaaucaauugguacaagaaagguuccucaauuggaaaaauguuugaagccacugcaaaaggugcgcgcaggauggcuaucuugggggauacagccugggacuuugguucaguaggcggggucuuaaauucucuuggaaagaugguacaucagauuuucgguagcgcauauacagcauuauuuucagggguaucauggauaaugaaaauugggauuggggugcuacuaacguggauaggacuaaauagcaaaaauacaucuaugaguuuuucaugcauaguuaucggcaucauaacuuuauaucugggggcaguugugcaagcagauaugggcuguguaauuaauuggaaagguaaagaacuuaaauguggaagcggcauuuuugucacaaaugaaguucauacauggacagaacaauauaaauuucaagccgauucgccuaaacgacuggcaacagcaauagcaggagcuugggaaaauggaguaugcggaauuagaaguacgacgcgaauggagaaucuacuauggaaacaaauugcaaaugagcuaaacuauauucucugggagaacaauauuaaauugacagugguuguaggugauauuauugguguucuggaacaaggcaaacgaacccuaacaccacagccgauggaguuaaaauauagcuggaaaacauggggcaaggcgaaaauaguaacggcagaaacgcaaaauagcagcuucauaauugacggcccaaacacacccgaaugucccucagcaagccgggcauggaauguuugggaggucgaagauuacgguuuugggguauucaccacuaacauaugguuaaaguuacgugaaguuuauacacaaaguugugaucacagguuaaugagugcagcgauaaaagaugaaagagcgguacaugcagacauggguuacuggauagaaucucagaaaaacgggucauggaaacuugaaaaagccaguuucauagaaguaaagacuuguacauggccaaaaucacacacacuauggagcaauggaguauuagaaucugauaugauaauuccgaaaucucucgcagggccaauaucccaacauaaccaccguccgggguaucauacacaaacagcggguccuuggcaucuagggaaacucgagcuagacuucaacuauugugaagguacuacuguagugaucacugaaaacugugguacaaggggaccuagucuuagaacaaccacuguuucgggaaaauuaauccaugaaugguguuguaggaguuguacauugccaccgcuucgauauaugggagaagacggaugcugguaugguauggaaauacgcccuaucaaugagaaagaggaaaacaugguuaagaguuuaguaucagcuggaucuggaaaaguugacaauuucacgaugggaguccuuugucuagcaauacuguucgaagaagugaugcgagguaaauucgggaagaaacacaugauagcagggguuuuguuuacuuuuguacucuuacuaucgggccaaaucaccuggcgcgacauggcccacacauuaauuaugauaggaagcaacgcaucggaccgaauggguaugggagucacuuauuuggcuuuaaucgccacuuuuaaaauucaaccguuccuugcccuaggguucuuucuaaggaaacucaccaguagagagaacuuacuacuuggagucggcuuagcuauggccacaacauuacaacugccugaagauauagagcaaauggcaaacggaaucgcacucggauuaaugacucugaagcugauaacacaauuugagaccuaucaacuuuggacagcucuaguuucgcugacguguagcaauacuauuuuuacacuaacaguagcguggcgaacagcaacucucauuuuagccggugucagccuacuucccuuaugccagucuucaaguaugagaaaaacugacuggcuaccgaugacggucgcggcaauggguguuccaccauuaccucuauuuauauucucuuuaaaagacaccccaaaacgccgcucauggccuuugaacgaaggagugauggcaguaggcuuagucucuauacuugcuaguagccuccuaagaaaugacgugccaauggcuggaccguuaguagcugguggacuacugauagcaugcuacguaauuacuggaaccucggcagacuuaacuguugaaaaagcggcggaugugaccuggguugaagaggcagaacaaaccggugugucacacaaucuaaugauaacuguggacgacgauggaacgaugaggauuaaggaugaugaaaccgagaauaucuugacaguauuacugaaaaccgcauuguugaucgucucuggaauauuuccauauucaaucccagcaacguuauuaguguggcauaccuggcaaaaacaaacgcagcgcagcgguguacuaugggacgucccaucaccaccugaaacucaaaaagcagaguuggaagaaggcguauaccguauaaaacaacaaggaauauuugguaaaacgcagguuggaguaggcguacaaagagaaggcguauuucauacaauguggcacguaacaagaggggcaguauugacacacaacggcaaaagacuagaacccaauugggcaucaguuaaaaaggaucuaauaucauauggaggaggauggagacucuccgcacaauggcagaaaggggaagaaguacagguaauagcaguggagcccggcaaaaaucccaaaaauuuucagaccaugccuggaacuuuccaaacaacaaccggcgagauuggagcuauagcacuugauuucaagcccggcacgaguggaucucccauaauaaauagagaagggaaagucgucggacuauacgguaauggcguuguaaccaaaaacggagguuacguaucaggcauagcccaaacaaacgccgaaccagaugguccaacaccagagcuugaagaagaaauguucaagaaacgaaaucuaacaauuauggaccuacacccaggcaguggaaagacaagaaaguaccuaccugcuauaguaagggaagcaauaaaaaggagauuaaggacacuaauauuagcgccuacaaggguggucgcagcugaaauggaggaagcacuaaagggacucccuauuagguaccaaacuacagcaaccaaguccgagcauacgggccgcgaaauuguagaucuaaugugccacgccacauucacaaugcgccuccuuagcccgguucgcguaccgaauuauaacuugauuauuauggacgaagcucauuuuacggacccagcuagcauagcagcacgcgguuauauuaguacaagaguggggaugggagaggcggcugcaaucuucaugacagcgacaccuccagggacagcugaagccuucccacagaguaaugccccgauucaagaugaagaacgcgauauuccugaacguucauggaacucuggaaaugaauggauuacagauuucguugggaaaacuguaugguuuguaccaaguauuaaagccggaaacgauaucgcaaacuguuuaagaaagaacggcaaaaaggucauacagcucucuagaaaaacuuuugauacagaauaucagaaaacaagacuaaacgauugggauuucgugguaacaacagauauaagugagaugggggcaaauuuuaaagcggauagagugauugacccucgacgcugucuaaaaccggucauucuuacggauggcccugagcgugugauucuagccggcccuaugccuguaacggcugcaagcgcagcccaacgaagaggaaggguugguagaaauccacaaaaagaaaaugaucaauauauauucacaggccaaccauuaaauaacgacgaagaucacgcucacuggacugaggcaaaaaugcuuuuggacaauauaaacacuccagaaggaauuauaccagccuuauuugaaccagagcgagaaaagucugccgcaaucgacggagaauauagacuaaaaggcgaaucgagaaaaacguuuguggaauugaugcgucgaggcgauuuaccaguauggcuagcccacaagguagcauccgaaggaauaaaauauacugacaggaaauggugcuucgacggagagcgcaauaaucaaauucuugaagaaaacauggacguagaaauauggacuaaggaaggagaacgcaaaaaguuaagaccaagauggcucgacgcacgaacauauagugauccacuggcucucaaagaauuuaaggauuucgcagcggggcgcaaaucuauagcgcuggauuuggucacugaaauaggucguguuccaucacaucuagcccauagaacgcggaaugcuuuagacaaccuaguaauguuacacaaaagugaacacggugggcgagcguaccggcaugccguugaagaacucccagagaccauggagacauuacugcuauuaggccuuaugauacucuuaaccggaggugcaauguuauuuuugauaucaggaaaaggaauaggaaaaacaagcaugggccugauuugcgucaucgugucuucaggcaugcuuuggauggcagauguaccauuacaauggauagcaucagcaauaguauuagaguucuuuaugaugguacuacuaauaccagaaccagaaaagcaaagaacuccccaggacaaccagcuagcuuauguuguaauaggcauucugacauuagcagcgauaguggcugcaaacgaaaugggcuuacucgagacaacuaaaagagauuugggaauguccaaagagccaggcguuguuagccccacuucauaccucgauguugaucuacacccagccagugccuggacucuauaugcuguagcgacaacuguaauaacacccauguuacgacauacgauagaaaauucgacugcaaacguaaguuuagcagccauugcaaaccaggcaguagugcuuaugggauuagauaaagguuggccgauuaguaaaauggacuuaggugugccccuauuagcucugggcuguuacagucaaguuaauccccuaaccuugaccgcagcaguauuauuacuugucacucacuaugcgauaauaggcccgggccuacaagcgaaagcaacacgagaggcacagaagcgcacugcugcaggcauaaugaaaaauccaacaguagauggaauuaugacaauugauuuagaccccguaauauaugauaguaaauuugaaaaacaauuaggacaaguuaugcugcucguccuaugugccgugcaguuacuauuaaugaggacuucuugggcuuuaugugaggcuuuaacauuagcaacuggucccauaacaacgcuaugggaaggcucuccagguaaauuuuggaauacuacuauugcggucucaauggcaaacauauucaggggcucuuaccucgcgggagcugggcuagcauucucuauuaugaaaucagucggcacugguaggcgaggaacaggaucacaaggagaaaccuuaggugagaaauggaaaaagaaauugaaucaacuaaguagaaaagaauuugauuuguauaaaaagucuggaaucacggaaguagaccgcacagaagccaaagaaggccuaaagagaggagagacaacacaucaugccgugucucgugguuccgcaaagcugcaaugguuugucgaacguaauaugguaauacccgaagguagaguaauagacuuaggaugcggucgaggaggguggaguuauuauugcgccggacuaaagaaaguaaccgagguucguggguauacuaagggcgggccaggacacgaagaaccagugccaaugucgaccuauggguggaacauaguaaaacuaaugucaggcaaagauguguuuuauuugcccccagaaaaaugugacacgcuacugugcgauauuggugaaaguucaccgagcccgaccguggaggaaucccgcacgauaagaguccucaaaaugguggaaccauggcucaagaacaaccaauuuuguauaaaaguguuaaauccuuacaugccgacaguuauugagcaucuagaaagacuucagcguaaguauggcgguauguugguccgaaaccccuuaucuagaaacucaacccaugaaauguauuggaucucgaaugguacuggaaacauagucucaagcguuaauauggucucaagacugcugcugaauagguucacgaugacacacagaagaccaacaauagagaaggacguugaucugggugcgggaacuaggcacguaaaugcagaaccagaaacuccgaauauggaugugauuggcgaacgaauuaaaaggauaaaagaagaacauucuucgacauggcacuaugaugacgaaaaccccuauaagacaugggcuuaucaugggucguacgaaguaaaagccacugguucagcaucaucaaugauaaauggcguugucaaacucuugaccaaaccuugggauguuguuccaaugguuacccaaauggcaaugacagauacaacuccguuuggacaacagaggguauuuaaggaaaagguagauacacgaacuccgcgaccaaugccgggcacuagaaaaguaauggagauuacagcugaguggcuauggagaacucucggacgaaacaagaaaccgagacuuuguacaagagaggaguucacuaaaaagguacguacgaaugccgcaaugggggcuguauuuacagaagaaaaucaaugggauucagcaagagcggcaguagaggaugaagaauuuuggaaacugguagacagggagagggaauuacacaaacucgggaaaugcgguucuuguguauacaauaugauggguaagcgggagaaaaagcuaggugaauuuggaaaggcaaaagguucuagagcuauaugguauaugugguuaggagcgcgauaccuugaauuugaggcacuuggguuucuuaacgaagaccacugguucucuagggaaaauucuuacucaggaguugaaggcgaaggauugcacaaauuaggcuacauacugagggauauaucuaagauaccaggaggggcgauguacgcagacgacacagcgggcugggauaccagaauaaccgaagaugacuuacauaacgaagagaaaauuacacaacagauggacccugagcauagacaauuagcuaaugcgaucuuuaaacucacuuaccaaaacaaaguaguaaaagugcaacgaccuacgcccaaaggcacaguuauggauauuaucucaagaaaagaucaacgagggagugggcaagugggaacguacggacucaauacguucaccaacauggaggcucaguuaguccgucaaauggaaggcgaggggguauugaguaaggcugaucuggagaauccacauuugcuagaaaaacggaucacacagugguuggaaacaaaaggagucgagagacuaaaaagaauggcgaucuccggcgaugacugugugguaaagccaauugaugacagauuugcaaaugcccuacucgcguugaacgauaugggaaaaguaaggaaagauauaccacaauggcagccaucaaaaggauggcacgauuggcagcaaguuccuuuuugcucacaucauuuucaugaauuaauuaugaaagauggucgaaaguuaguaguuccguguagaccucaagacgaauuaauaggcagggcacguaucagucagggagccggauggucgcuaaaggaaacggcauguuuagguaaagcauaugcccaaauguggucccuaauguauuuucacagacgagacuuacgguuagcgaguaaugcaauaugcagugcugucccugcacauuggauuccgacuucacggacgacuuggaguauccaugcacaucaucaauggaugaccacugaggauaugcucaccguguggaaccgcgucuggauagaagacaaccccuggauggaggacaaaaccccuguaacuacaugggaggacguaccauaucucgggaaacgugaagaucaauggugugguagcuuaauaggacuuacgucuagggcuacgugggcgcaaaauauccuaaccgcaauacaacagguaaggucauuaauuggagacgaagaauuuuuagauuacaugccaucaaugaaacguuuuagaaaagaagaagagucagaaggcgccaucugguga

SEQ ID NO: 23466 - RNA, 9873 nt, Artificial Sequence
  derived and/or modified CDS sequence (opt6) from DENV-3__EU482455__SS-prME
acaucgcuuuguuuaaugaugaugcuuccagcaacauuagcuuuccaucuuacuagccgagauggugaaccucgaaugauaguggggaaaaaugaaagaggaaagagcuugcuuuuuaaaacagcaucaggaauaaauauguguacacuuauagcuauggaccucggagaaaugugcgacgauacagugacguauaaauguccauuggucgcagaaguagaaccagaagauauagauuguugguguaacuuaacaagcacuuggguuacauacggaacguguaaccaagccggagaacacagaagagauaagcgaucaguagcauuagcaccgcacgugggaaugggucuagauacgcguacgcaaacauggaugagcgcagaaggagccuggagacaaguagaaaaaguagaaacuugggcuuugcgacacccaggguucacuauauuggccuuguuccuagcacauuauaucgguaccagcuugacucaaaaagucguaauauucauauuacucaugcuaguaacgccaaguaugacuaugcgaugugucgguguaggaaaucgggauuucgucgaagggcuaucaggagcaacguggguugacgucgugcucgaacaugguggaugcguaacgacaauggccaaaaauaaaccaacauuagacauagaacuacagaaaacugaagccacacagcuugcuacacuuagaaaauuaugcauagaaggaaaaauuacuaauauuacaacugacaguagguguccaacucaaggugaggccauacugccagaagaacaggaccaaaauuaugugugcaaacacacuuacgucgauaggggcugggguaauggauguggauuauucgguaaagggagucucguaacgugcgcaaaauuccaaugucuagagccuauagaaggaaaaguuguucaguaugagaauuuaaaauauacagucauaauaacuguucauacaggagaccaacaccagguuggcaaugauacgcaggggguaacuguggaaauuacaccacaggcaucuacaguagaagcaguauugccggaauacggcacguuaggucuggaaugcagcccacgcacaggacuggauuuuaaugaaaugauucuacugacaaugaaaaauaaagcauggauggugcaccgacaaugguuuuucgaucuuccgcuaccguggacaagcggagcuaccacugaaacaccaacguggaacaagaaagaacuauuaguuacauuuaaaaaugcucacgccaagaaacaagagguuguuguucuaggcagccaagaaggagcuaugcauacagcauuaaccggggcaacagaaauucaaaacucgggaggaacaucuaucuucgccggucaucucaaaugucgucuaaaaauggacaaacuugagcuuaaaggaaugaguuaugcuaugugccuaaauacguuuguauuaaagaaagagguaagugaaacacagcaugggacaauucugauuaaaguagaauacaaaggagaagacgcuccaugcaaaaucccuuuuucaacagaagauggacaagguaaagcucauaaugguagacucauaacagcaaacccaguuguuacaaagaaagaagaacccguaaauauagaggcggagccaccguuuggagagaguaacaucguaauugguauaggagauaaagcauuaaaaauaaacugguauaagaaaggcagcucaauugguaaaauguuugaggcaacugcuagaggagcgcgucgaauggcaauauuaggagauaccgcaugggacuuuggaaguguaggagggguguuaaacuccuuaggcaaaaugguacaucaaauauucggaagcgcuuacacagcccuauuuuccggggugucauggauaaugaaaauugggaucggcguauugcuuacauggaucggacuaaacucuaaaaauaccuccaugucauucuccugcauagucauagguauuauaacacuauaucuaggagcuguuguacaagcggauauggguugcgcaauaaauuggaaagguaaagaauuaaagugcgggagcgggauuuuuguaacaaaugaagugcauacuuggaccgagcaauacaaauuucaagcugauaguccgaaacgccuugcaacagcgauugcuggagcuugggagaacggugucuguggcauaagaaguacuacccgcauggaaaaucuucucuggaagcaaauagcuaaugaacugaauuauauauuaugggaaaauaauauaaaacugacuguggugguaggggauauuauagguguauuagagcagggcaagcgcacccucacuccccagccuauggaauuaaaguacucuuggaagacuuggggaaaagcaaaaaucgucacugcagaaacacaaaauucaaguuuuauaauugacggcccaaacacuccggaaugcccgucugcuucacgagccuggaauguuugggagguagaagauuauggguucgguguuuucacuacaaacauaugguuaaaacugcgggaagucuauacucagucaugugaucaccgacuuauguccgcugcaauaaaagaugaacgggcgguacaugcagauaugggguauuggaucgaaucucaaaagaauggaagcuggaagcuggagaaagccagcuuuauagaaguaaaaacaugcacuuggcccaaaucacauacauuaugguccaauggaguuuuggagagcgauaugauaauaccgaaaagccuagcaggcccaauaagccagcacaaccacaggccuggauaucauacacaaacagccgggcccuggcauuuagggaagcuagaguuagauuuuaauuauugcgaagguacaacaguaguaauaacugaaaacuguggaacccgagggccaucucuacgaacgacgacaguuucggguaaauugauucaugaauggugcuguagaucauguacguugccuccccuacgauacaugggagaggauggaugcugguaugguauggaaaucaggccaauuaaugaaaaggaagagaauauggugaaaagucuaguuucagcagggucuggcaaggucgauaacuucacaauggggguccuuugucuugcaauucuauucgaagaggugaugcgggggaaauucgggaagaaacacaugauugccggcguacuuuuuacuuuuguucugcucuuauccggacaaaucacuuggcgagauauggcacacaccuuaaucaugauaggaucaaacgcuucugaccggaugggaaugggagucacuuauuuggcucugauagccacauuuaaaauucaaccauuuuuagcauuaggauuuuucuugaggaaacuaaccagccgagaaaacuuauuacuaggugucgggcuagcuauggcaacgacacuacaacucccggaagacauagaacaaauggcgaacgguauugcucugggcuuaaugacucuuaaacuaauuacacaauuugaaaccuaccaacuguggacagcauuaguaucguugacuuguucaaauacuauuuuuacacuaacgguagcauggagaacugccacuuuaauuuuagcgggaguuucccuuuuaccuuugugucaaaguagcucgaugaggaagacugauugguuaccuaugacggucgcagcaaugggaguuccaccacuuccucuauuuauauuuaguuuaaaagacacaccaaaaagacgaaguuggccacuaaaugagggaguuauggccgucggauuagucucaauacucgcaucaucauuacuuagaaaugacguaccgauggcaggcccacucguugcuggaggauuacuuauagcuuguuaugucauaacuggaacaagugcugaucucacaguagaaaaggcggcagacgucacuugggaagaagaagcugaacagacuggaguuucacauaacuuaaugaucacuguggaugacgauggcacaaugagaauaaaagacgaugaaacagaaaacauuuugacuguauuacuaaaaacugccuuguuaauaguaaguggcauuuucccauauucuauacccgcuaccuuacucguauggcauacauggcagaaacaaacucagaggaguggcguccuaugggaugucccaaguccacccgaaacgcagaaggcggaacuagaggagggagucuacagaaucaaacaacaaggaaucuuugguaaaacgcaaguuggaguaggaguucaaaaagagggaguauuucauacaauguggcaugucacaagaggagcaguguuaacacauaauggaaaaagacuagaaccuaauugggcuucagugaagaaagaucucaucucauacggaggaggguggcgacuaucugcacaguggcaaaagggcgaagagguucagguaauugcaguugagccaggcaaaaaucccaaaaacuuucaaacgaugccggguauauuccaaacuacaacaggagaaauaggugcaauagcccucgauuucaagccagguacaagcgguucgccuauuauuaauagggaagggaagguuguugguuuauaugguaacggcguaguaaccaaaaauggaggauaugugucaggaauagcacaaacuaacgcagaaccugacggaccaacaccagaacuagaggaagaaauguucaagaaaaggaaccuuacaauaauggauuuacacccgggaucugguaagacuagaaaauauuugccagcgaucguucgagaagcuaucaaacgacgguuacggaccuuaauucucgccccaacacgcgugguggcagcggaaauggaggaggcauuaaaaggccugcccauaagauaucaaacgaccgccacaaagucggagcacacaggcagagaaaucguagaccuaaugugccacgcuacauucacuaugcgacuacucucaccaguaagaguaccaaacuauaacuuaaucauuauggaugaggcacauuuuacagauccugcaucaauugcagcacgagguuacauuagcacuagaguuggaaugggagaagcagcagcaauuuuuaugacggcaacacccccugguacggcagaagcguuuccucaaaguaacgcaccgauucaggacgaagaacgcgauauaccagagagaucuuggaacaguggcaacgaguggauaacagauuucgucgguaaaacaguuugguuuguuccaaguauaaaagcggguaaugacauugccaacugccuuaggaaaaacggaaagaaagugauacaauugagccgaaagacauuugacacagaauaucaaaagacuagauuaaacgauugggacuucgugguaaccacggauauuagugagaugggggccaacuuuaaggcagaucgcguaauugacccaagacguuguuugaaaccaguaauacugacugauggcccugaacgaguaauucuagccggaccgaugccaguaaccgcugcuucagcagcucaaaggagaggaaggguuggaagaaauccccaaaaagaaaacgaucaauauauauucacaggucaaccccuuaacaaugaugaagaucacgcucauuggacggaggcaaaaaugcuacucgauaauauuaauacgccagaggguauuauaccagccuuauucgaaccugagcgagagaagagugcagcuauugacggugaauauagacuuaaaggcgaaagccguaagacuuuuguggaacuaaugagacgcggagaccuuccugugugguuagcacacaaaguagccucagaagggauaaaauauacagacagaaagugguguuucgacggagagagaaauaaucaaauuuuagaagaaaacauggacguagaaauauggacaaaggaaggggaaagaaagaaacuacgaccuagguggcuggaugcaaggacguacucggaccccuuagcucugaaagaguucaaggacuucgcagcgggucgaaagaguauagcauuugaucuaguaaccgaaauuggacgcguucccucucauuuagccuaucgcacaaggaaugcccucgauaaucucgucaugcuacauacaucagaacacggagguagggcuuaucgacacgcgguugaagaacuuccggaaacuauggaaacuuuacuacuccuaggccuuaugauacuccuuacagguggggcaauguuauucuugauuuccggcaagggaauagggaagacaucuaucggcuuaauaugcguaauuguuagcaguggaauguuauggauggcagacguaccucugcaauggauugcaagcgcuauagugcucgaguuuuucaugaugguccuucuuauaccggagccugaaaaacaaagaacuccgcaggauaaccagcuggccuauguagucauaggaauauuaacauuagccgccauuguagcugcaaacgagaugggauugcuagaaacuacgaagagagauuuaggaaugaguaaagagccaggugucguuaguccaacaucguaucucgauguugaucuacacccugcaucggcauggacuuuauacgcaguagcuaccacgguaauaacaccaauguuacgccauacaauugaaaauagcacggccaauguaaguuuagcagcaauagcaaaucaagccguuguacugaugggacuagacaaaggauggccaaucucaaaaauggacuuagguguuccuuugcuugcauuaggguguuacagccaaguaaacccccucacguuaaccgcagccgucuuacuauuaguaacacauuaugcaauuauagguccaggccuucaggcgaaagcaacgagggaggcgcaaaagcguacggccgcugguauaaugaagaauccgacaguagacggaauaaugacaaucgaccuagauccaguuauuuaugauaguaaguuugaaaaacaacuuggucaaguaaugcugcuuguauugugugcaguccaacuucuguuaaugaggacuagcugggcgcuaugugaagcacuaacgcuagcaaccggccccauuacgacauugugggaaggaaguccugguaaauucuggaacacuacaaucgccguaaguauggcuaacauuuuuagaggaagcuauuuggcaggagcagggcuagcauuuagcauuaugaaaucuguaggaauagguagacggggaacuggaagccagggggaaacccuaggggaaaaguggaagaagaaauugaaccaacuuagucgaaaagaguucgauuuauauaagaaaagcggaauaacugaagucgaucgaacagaagcgaaggaggggcuuaagcgaggagaaaccacacaccaugccgucagccgggggucagcaaaauuacaaugguucguugaaaggaacaugguaauaccugaaggaagaguaaucgacuuaggaugcggacgaggagguuggucauauuacugcgccggauugaagaagguuacagaaguuagaggguacaccaaggguggaccuggacaugaagaaccgguuccuaugagcacguacggauggaauauagugaagcugaugucuggaaaagauguguuuuaucugccuccagaaaaaugcgacacauuacuaugcgacauaggggagucaucgccuucgccaacaguugaggagucuaggacaauacggguuuuaaagaugguagagccauggcucaaaaauaaucaguuuuguaucaaaguccuaaacccguauaugccaacuguaauagaacacuuggaacgucuccaaagaaaguacggugguaugcugguaaggaacccacuaagucgcaauucgacacaugaaauguauuggauaagcaacgggacuggaaauauuguaagcucaguaaauauggugagucguuuacuacugaauagguuuacgaugacacauaggagacccacaauagaaaaggauguggaucuaggugcagguacgcgucacgucaacgccgaaccagaaacgccaaauauggauguaauaggagaaagaauaaaacguauaaaagaagaacauaguucaacguggcauuaugacgaugaaaauccauauaagacaugggccuaucauggcucuuaugaagucaaagccacagguagugcgaguaguaugaucaacggaguagugaagcuguuaaccaaacccugggaugucgugccuauggucacacaaauggcuaugaccgacaccacuccauuuggccaacaacguguguuuaaagaaaagguagacacaagaacuccucgacccaugccagggacgcgcaaagugauggaaaucacugcagaaugguuauggcgcacacuggguagaaauaagaaaccacgcuuauguacacgggaagaguucacgaagaaggucaggaccaaugcagcgaugggugcaguguuuacugaagagaaccaaugggauagcgccagggcagccguagaagaugaggaauuuuggaaauuagucgaccgcgaacgugaacugcauaaguuaggaaaaugugguucuuguguauacaauaugauggguaagcgcgagaaaaaguuaggagaguucgggaaagcuaagggaucacgagcuauaugguauauguggcucggagcaagauaucucgaauuugaagcguuaggguuuuugaaugaagaccacugguuuucaagagaaaauucauauuccggaguugaaggagaaggacuccacaaauuaggauacauauuaagagauauaucuaagauacccggcggugcuauguacgcugacgacacugcagguugggauacgagaauuacagaagaugauuuacacaaugaagagaaaauaacccaacaaauggauccagagcauagacaguuagcgaaugcaauauuuaaacuuacauaccagaacaaaguaguuaaaguacaacguccaacuccaaaagguacugucauggauauuauaaguagaaaagaccaaaggggaucagggcaaguuggaacguacggguuaaauaccuuuacuaacauggaagcacaacuuguaagacaaauggaaggagaaggugugcuuaguaaagcagaccuugaaaauccacaucuucuagagaagaaaauuacacaaugguuagagacuaaagggguagaacggcuaaaacguauggcaauaucuggagaugauugugucguuaagccaauagaugaccgauuugcuaacgcucuguuagcguuaaaugauaugggaaaggucaggaaagacauuccccaauggcagccaucuaagggcuggcacgacuggcaacaaguuccauuuugcagucaccauuuucacgaacucauuaugaaggacggaagaaaguugguaguuccaugucggccccaagaugaauugauuggccgggccagaaucagccaaggcgcaggauggucguuaaaagaaacggcaugucuuggaaaggcuuacgcacaaauguggucucucauguauuuucauagacgagaucuacguuuggcaucuaaugcaauuuguagcgccguuccaguacauuggauuccuaccagucgaacaacauggaguauacaugcgcaucaccaauggaugacaacagaagacaugcuuaccguauggaaccguguuuggaucgaggauaacccuuggauggaagacaaaacuccaguaacgacaugggaggacguccccuauuuagggaagcgugaagaucaauggugugggucucuaaucggauugacgagucgcgcaaccugggcacaaaacauuuuaacugcaauacaacaggugagaucuuuaauuggagacgaggaauuuuuagacuacaugccgagcaugaaaagauuuagaaaagaagaagaaucagaaggagcgaucugguag

SEQ ID NO: 23467 - RNA, 9873 nt, Artificial Sequence
  derived and/or modified CDS sequence (opt6) from DENV-3__EU482456__SS-prME
acuucucuaugucuaaugaugauguuaccagccacacuagccuuucaucucaccaguagagauggagaaccaaggaugauugucggcaaaaaugaacgagguaaaucacuuuuauucaaaaccgcuucuggaauaaauauguguacucugauugcgauggaccuaggcgaaaugugugaugauaccguuacauauaaaugcccguuaauugcagaaguagaaccagaagacauagacuguugguguaauuuaacgucaacauggguaacguacgguacaugcaaucaagcaggcgaacaucgaagagauaaaagaucaguggcguuagcaccacaugugggaaugggguuggacacucggacgcaaacguggaugucugcugagggagcuuggcgacaaguugagaaaguggaaacuugggcucuaagacacccaggauuuacaauauuagcguuauuuuuagcgcauuauauaggaacuuccuuaacacaaaaaguggucauuuuuauccucuuaaugcuggucacgccaaguaugaccaugcgauguguaggcguaggaaauagagauuucguugaggguuuaucaggugcuacguggguagacgugguguuagaacauggaggauguguuacgacuauggcgaaaaauaaaccaacauuagauauagaauuacagaaaacagaagcaacacaauuagcuacuuugagaaaauuaugcaucgaaggcaaaauaacaaacauuacaaccgauuccagguguccaacacagggagaggccaucuugccggaagaacaagaccaaaacuacguaugcaaacauacguauguugauagggguuggggaaacggauguggacuauucggaaaaggaagccuaguuacuugugcgaaauuucaaugucuggaaccaauagaagggaaaguugugcaguaugaaaaucuuaaauauacaguaaucauaaccguucauacuggugaucaacaucaaguaggcaaugauacucaagguguaaccguugaaauaacaccacaggcaaguacuguugaagcggucuugccugaauacggcacccuaggauuagaguguaguccuagaacuggccuagacuuuacugagaugauacuacugacuaugaaaaacaaagcguggaugguucauagacagugguuuuucgaucuaccgcugccguggacaaguggggcaaccacagaaacaccuacguggaauagaaaagaacuacuggugaccuuuaaaaacgcucaugcuaagaaacaggaaguaguugucuuggggagucaagaaggagcaaugcauacggcauugacaggcgcaacagaaauacaaaauagugguggaacaaguauauucgcgggucaccuaaaaugccgacuaaaaauggauaaacuagaauugaaagggaugaguuacgcaauguguuuaaacacauuuguacuuaagaaagaaguuucggaaacccaacauggaaccauacuuauuaaagucgaauauaaaggagaagaugcgccauguaaaauaccuuuuaguacggaagacggacaagguaaagcacacaauggcagauuaauuacagccaauccagugguaacaaagaaagaagaaccaguaaauauagaggcugaaccaccauuuggagaaucaaacauuguaauuggaauaggagauaaagcauuaaaaaucaauugguauaagaaaggaagcucuauuggcaagauguuugaagcaaccgcuaggggagcaaggcguauggccauacuuggagauacagcaugggauuucggcaguguuggugguguauuaaauucauuagguaagaugguccaccaaauauuugguucugcauauacagcauuauuuucuggaguaagcuggauaaugaaaauuggcaucggggugcugcucacguggauaggacuaaacagcaaaaacacaaguauguccuucucauguauagugauaggaauaauuacuuuauaucuaggagcuguaguccaagcagacaugggauguguaauuaacuggaaaggcaaagaacucaaaugcgguaguggaauauuuguuacuaaugaaguucauacauggacugaacaguauaaauuucaagcggacucgccaaaacgauuggccacugcaauugcaggagcgugggaaaauggaguuugcggaauuagaagcaccaccaggauggagaauuuauuauggaaacagauugccaacgaauuaaauuacauauugugggaaaacaacauuaagcugacaguggucguuggggauacgauagggguacuagaacaagguaagcggacacugacaccucagccgauggagcugaaauauagcuggaaaacaugggggaaagcaaagaucguuaccgcugaaacgcagaacuccucauucauuauagauggaccuaauacgccggaaugcccaucagcaagccgggccuggaacgugugggaagucgaagacuauggguuugguguguuuacuacaaauauauggcucaaauuacgggagguauauacacaaaguugcgaucauagauuaaugagugcagcaauaaaggaugagcgagcuguacaugcagacaugggcuauuggaucgagucccagaagaaugguagcuggaaacuagaaaaagcaucuuuuauagagguaaagacuuguacauggccaaagucccacacccuauggucuaauggaguauuagaaucugacaugauaauuccgaaaucauuggcugggcccaucagucaacacaaccauaggccaggauaccauacccaaacggcgggaccauggcacuuggguaaacuagaauuagauuucaauuacugugaagggacgacuguagugauaacagagaacuguggaacacggggucccucccuaagaaccaccacgguaucagguaaauuaauacacgaaugguguugucggucauguaccuugcccccacuacgauacaugggcgaggacgguuguugguacggcauggaaauucgaccaauuaacgaaaaagaggaaaacaugguaaaaaguuuaguuucugcagguaguggaaagguggacaauuuuacuaugggcguacuuugucuagccauacuauuugaagaagugaugcgaggcaaauuuggaaagaaacacaugauagcuggaguccucuuuacguucguacuacuuuuaaguggccaaauaacuuggagagauauggcacauacuuugaucaugauugguagcaaugcaagugauagaauggguaugggcguaaccuaccuagcgcuuauagccacuuucaaaauucagccauuuuuagcucuaggauucuuucuaaggaaauuaacauccagagaaaaccuucuguuagguguaggacuagcaauggcuacaacauuacaacucccagaagauaucgagcaaauggcaaauggaaucgcgcuugguuuaaugacacugaaauuaauaacccaauuugagacauaccagcuauggaccgcacuuguuucacuuacuugcucgaauacuauauuuacucuaaccguggcuuggagaacagcuacauugauacuugccggaguuagccuccuaccucuaugccaaucuaguuccaugaggaaaacugauuggcuaccgaugacgguagcugcgauggguguaccgccacuaccgcuuuucauauucucgcuaaaagacacuccgaaaaggagaucguggccacuuaaugaagguguaauggcuguaggucuaguuagcauccuagcaucaucguuguuaagaaaugacgucccaauggcagggccucuaguugcggguggucuacugaucgcuuguuauguaauuacaggcacuucagcagaucugacuguugagaaagccgcagacguuacaugggaggaagaagccgaacaaacgggcguaagccacaauuuaaugaucacaguagaugaugacggcacgaugcgaaucaaagaugaugagacagaaaacaucuugacuguccuucuuaaaacagcucuauuaauugugagcggaauuuuuccuuauucaauaccagcgacguugcucguguggcauacauggcagaaacaaacccagcguucgggaguacuaugggacguaccuucuccacccgaaacucaaaaagcagaacuagaggaaggugucuacagaauuaaacaacaaggcauuuucggaaaaacacaaguagguguuggagugcaaaaagaaggaguguuccacacaauguggcaugugacaagaggagcgguacuuacucauaacggaaaaagacuagagccaaauugggccaguguuaaaaaggaccuuauuagcuacggagggggauggcgucuuucugcacaguggcaaaaaggggaggagguccaagucauugccguugaaccaggcaaaaaccccaaaaauuuccaaacaaugccugguaucuuucaaacaacgacgggcgagauaggagcaauugcucucgacuuuaaaccagggaccuccggaucaccuauaaucaacagagagggaaaaguuguuggacucuauggcaauggaguuguaacgaagaauggcggcuauguaagcggaauagcacagaccaacgcagaacccgaugguccaacaccggagcuugaagaagagauguuuaaaaagagaaaucugacgauaauggaccugcacccagguucuggcaaaacucgaaaauacuuaccagcaauuguaagggaggcaauaaaaagacgacucagaacccucauauuagcuccaacaaggguuguagcagccgagauggaggaggcuuuaaagggucucccuauuagauaucaaacgacagcuacaaaauccgaacacacaggucgggaaauagucgaucugaugugucaugcuacuuuuacaaugcgcuugcucucuccaguucgaguaccuaauuauaauuugaucauaauggacgaagcccauuuuaccgacccugccagcauugccgccagagguuauauuuccacaagagucggaaugggagaagccgcagcgauauucaugacagccacaccuccugguacagcagaggcauuuccccaaaguaaugcccccauacaagacgaggagagggauauaccggagcgcagcuggaacucugguaaugaauggauuacggacuucguugguaagacaguaugguucgucccgucuauaaaggcagggaaugauauagcaaauuguuuaaggaaaaauggcaagaaagugauucaacuuagcagaaaaaccuucgacacugaguaucagaaaaccagauuaaacgacugggauuuuguagugacaacagacauaucggaaaugggugcaaauuuuaaagcggauagagucauugauccacgacgaugucuuaaaccagucauauugacggauggaccugaacgaguaauccuagccgggccuaugccaguuacggcagcuagcgccgcucagagaagagggcgaguagguagaaauccacaaaaagaaaacgaucaauauauuuucacuggccaaccacuaaauaaugaugaggaccacgcucauuggacugaagcaaagauguuauuagauaauauuaacacuccagaagggaucauaccagcguuauucgaaccagaacgugaaaagagcgcagcaauagauggcgaauacaggcucaaaggagaaaguagaaagacauucgucgaacuaaugcguagaggggaucuuccaguaugguuagcgcacaaggucgcuucugaaggcaucaaauauaccgaucguaaaugguguuucgacggcgagagaaauaaucaaauuuuggaagaaaauauggacguagaaauauggacaaaagaaggagagcgaaagaaauuaagaccuagauggcucgaugcgcgaaccuacucagacccccuagcuuugaaagaguuuaaggauuuugcagcuggcagaaaaagcauagcauuggaucucgucacagaaaucggacgggugccaucccauuuagccuaucguacacgaaaugcgcuagauaauuuaguuaugcuacauacaucugaacauggaggaagggccuacagacaugcaguugaagaguuacccgaaacaauggagacacuauuacucuugggguuaaugauccugcuuaccgguggugcuaugcuauuuuugauaucgggaaaaggcauaggaaagaccucuauagguuugauauguguuauugucucaagcggaaugcucuggauggcugauguuccauuacaauggauagccucugccaucguauuagaguucuuuaugaugguacuauuaauaccggaaccagaaaaacaaaggacaccacaagauaaucaguuggcguauguggucauagggauuuuaacacuugcugcaauaguggcggcaaacgaaauggguuugcucgagacaacgaaacgggaccugggaaugaguaaagaaccuggaguuguuaguccgacgaguuaucuggacguagaccugcauccugcuagugcuuggacguuguacgcgguggccacuacaguuauaaccccuaugcuaagacauacaauagaaaacaguacagcaaacgucagccuagcugccauugcaaaucaagcuguaguacuuaugggacuggacaagggguggccaauaagcaaaauggaccuaggaguaccccuucuugcccuaggaugcuacucccagguuaacccucuaacauuaacggcugcuguacuacuccuuguaacacauuaugccauuaucggcccggguuuacaagcaaaagcgacaagagaagcucaaaaacgaacagcagcagguauaaugaagaauccaacuguugacggaauaaugacaauagaucuggacccuguuauuuacgauucuaaguuugaaaaacaauugggucagguaaugcuucuuguccucugcgcuguacaacuucuccuuaugcguacauccugggccuugugcgaagcacucaccuuagcaaccgggccuauuacaacgcuaugggaagggucaccaggaaaauuuuggaacacuacaaucgcuguaaguauggcgaacauauucagaggaucauauuuagcgggcgcuggguuagcauuuucaauaaugaagucaguaggcacagguagaagagguacaggcagucagggggaaaccuuaggugaaaaauggaagaagaaauugaaccaauuaucuagaaaagaauuugauuuauacaagaaaaguggaaucacagaaguagacagaacggaagcgaaagagggauuaaaacguggggagacgacucaucaugcaguaucacgaggaagugcaaaacuacagugguucguugaacgaaauauggucaucccagaaggacggguaauugaccucggauguggccggggagguuggaguuauuacugcgcagggcucaagaaaguuaccgaagugcggggauacaccaaaggcggaccuggacacgaagaaccagucccgaugucaacauauggguggaauaucguaaaauugaugucagggaaagauguauuuuauuuaccaccagaaaagugugauacccuuuugugcgauauaggggaaagcucaccaagcccgacaguagaggaaagccgaacaaucagaguauuaaaaaugguugaacccuggcucaaaaacaaucaguucuguauuaaaguauuaaauccguauaugccgacugucaucgaacaucuugagagacugcaaagaaaguauggaggcauguuaguaagaaauccccugaguagaaauagcacacaugagauguauuggauuucgaacgguaccgguaacauaguguccagugugaauaugguaucuagguuguuauugaauagauucacaaugacacauagaagaccaacgauagaaaaggauguagacuuaggagcaggaacuagacauguuaacgcugaacccgaaacaccaaauauggacguaauaggggaacguauaaaaagaauuaaagaagaacacaguuccaccuggcauuaugacgacgaaaacccauacaagacaugggcuuaccaugggaguuacgagguaaaggcuacagguucagcaagcaguaugauaaacggagucguaaaauuauuaacaaaaccgugggacgugguccccaugguuacgcagauggcaaugacugacacaacacccuucggucaacagagaguuuuuaaagaaaaagucgauacuaggacgccaagaccgaugccugguacacguaaaguaauggaaauaaccgcugaauggcuauggagaacguuggggcgaaacaagaaaccaaggcucuguacgcgggaagaauuuaccaagaaagucagaaccaaugcugcuaugggagcuguauucacagaagaaaaucagugggacucagcuagagcagcaguagaggaugaagaguuuuggaaauuaguggaccgggaaagagaauuacauaaacucgguaaauguggaaguuguguguauaauaugaugggaaagcgcgagaagaaauugggggaguuuggaaaagcaaaaggaagcagagccauuugguacaugugguugggagccagguaucuugaguucgaagcacugggauuuuuaaacgaagaucauugguuuagcagggaaaacagcuacaguggggucgaaggggaagggcugcauaaacucgguuauauuuuacgagacaucuccaaaauuccuggcggggcaauguaugccgacgacacagcuggcugggacacgaggauaacagaggaugacuuacauaacgaagagaaaauaacccaacaaauggacccagagcauaggcaacuagcaaaugccauuuuuaagcuaacauaccagaauaaagugguaaaaguacaaagacccacuccuaaagggacgguaauggauauaauaucacgcaaggaucaaagaggcucuggucagguugggacuuacggucuuaauaccuuuaccaacauggaagcgcaauuaguucgccaaauggaaggagaaggaguacugagcaaagcggauuuagaaaauccgcacuuauuagaaaagaaaaucacacaaugguuagaaacaaaggguguugagagauuaaagcgaauggcaauuaguggggaugacugcguaguuaaaccaauagaugaccgguucgcaaaugcauuacuagcuuuaaaugacauggguaaaguuagaaaggauauaccccaauggcagccaagcaaaggguggcaugauuggcaacaaguuccauuuuguucacaccauuuccacgaacuuauuaugaaggacgggcggaaauuaguugugccaugcagaccacaggacgaauugauuggucgugcaagaaucucgcaaggagcgggguggucuuuaaaggaaacagcgugccuaggaaaagcauacgcucaaauguggucauuaauguauuuucaucgacgugacuuacgauuagccagcaaugcuauauguagcgcaguaccgguacauuggaucccuaccagcagaaccaccuggucaauacacgcucaccaccaauggaugacuaccgaagacauguuaacgguauggaacagaguauggauugaagacaaccccuggauggaagauaaaaccccagugacaacuugggaggacguaccguaucucgguaaaagagaagaucaauggugugguucacuaauuggauuaacaagccgugccacaugggcacaaaauauacucacggcaauacagcaaguccgcagcuuaaucggugaugaagaguuucuugacuauaugccgaguaugaagagguuuagaaaagaagaagaaagcgaaggagccauuugguaa

SEQ ID NO: 23468 - RNA, 9873 nt, Artificial Sequence
  derived and/or modified CDS sequence (opt6) from DENV-3__EU482457__SS-prME
acaucauucuguuuaaugaugaugcuacccgcaacccuagcuuuucauuuaaccucccgagacggugaaccucgaaugauagugggcaaaaaugaacgcgggaaaagucuuuuguuuaaaacagcaagugguauaaauauguguacacuuaucgcaauggacuugggggaaaugugcgacgauacugucacauauaaaugcccacuuauagcagaaguugaaccagaagacaucgauuguugguguaauuuaacaucuacuugggugacauacggcacauguaaucaagccggugaacaucgaagagacaaacguuccguugcucucgcaccacauguggguaugggucuugacacacgaacucaaacguggaugucggcagaaggugcauggcgacaaguagaaaaaguagaaaccugggcacuacgacauccgggcuucacgauacuugcacucuuucuugcacauuauauaggaaccagcuuaacacaaaaaguaguuauauuuauuuuacugaugcucguaacuccaucaaugacaaugagauguguugggguaggcaauagagauuuuguagaagggcugucuggcgcaacuuggguagacguuguacuugaacacggggguugcguaacuaccauggccaaaaauaaaccgacuuuagacauagaacuacagaaaacagaagcaacacaauuagcuacacuaagaaaacuuuguauagaagggaaaaucacaaauauuacgacugauuccagauguccaacacaaggagaagcuacccucccggaggaacaagaccaaaacuauguguguaaacacaccuacguagaucgggguugggggaauggaugcgggcucuuugguaaaggcagccuaguaacuugugcgaaauuucaauguuuagaaccuaucgaagggaaagucguccaauaugagaaccuaaaauauacuguaauuaucacaguucacacuggugaccaacaccaaguugguaacgacacucaagggguaacaguugagauuacaccccaggcuucuacaguagaagccguccuaccagaauauggcaucuugggacuugaauguuccccgcgaacgggacucgauuucaaugaaaugauuuuacuaacaaugaaaaacaaggcuuggauggugcacaggcaaugguucuucgacuuaccuuugccuuggacguccggugccacaaccgaaacacccacuuggaacagaaaagaacuacuugucacuuucaaaaacgcgcacgcaaagaaacaggaaguggucgucuugggaagccaagaaggagcgaugcauacggcgcuaacaggugcaacugagauacaaaacaguggaggaacgucgauuuucgcgggacaccuuaaauguaggcuaaaaauggaucgcuuagaacuuaaaggaaugagcuaugcaaugugucuuaauaccuucguguuaaagaaagagguaucagaaacucagcauggcacaauacuaauaaaaguagaauacaaaggagaagaugcaccaugcaaaauacccuucagcaccgaggauggacaagggaaagcucauaacggacguuuaaucacagcaaauccaguaguuacgaagaaagaagaacccguaaauauugaagcggagccacccuucggggaaucaaacaucguaaucgggauaggagauaaagcauugaaaauaaacugguauaagaaagguucaucuauaggcaaaauguucgaagcaacagcucguggugcaagaagaauggccauuuuaggagauaccgcuugggacuuugguaguguaggaggaguacugaacucacuagguaaaaugguccaucagauuuuugguucagcuuacacugcacuuuuuaguggcguaagcuggauuaugaaaauuggaauaggaguacuuuuaacauggaucggucucaauaguaaaaacacaucaaugucguucaguuguaucguaauaggaauaauaacacuauaucuaggugcagugguacaagcugauauggggugugugauuaacuggaaagguaaagaauugaaaugcgggagcggaauauucgugacuaaugaaguacacacguggacagaacaauauaaauuucaagcagauucuccuaaaagguuagccacggcgaucgcaggggcuugggaaaacgguguuugugguauucggucuacuacaaggauggagaacuuacuuuggaaacagauugcaaacgaacugaauuauauacuuugggaaaauaauauaaaauuaacaguaguaguaggugauaccauaggcguucuagagcaggguaaaaggacacuaacuccgcagccuauggaauuaaaauauaguuggaaaaccuggggaaaagcgaaaauaguaacagccgaaacucaaaauucuucauuuaucauagacggaccuaacacaccugaaugcccauccgcuucaagagcuuggaaugugugggaaguagaagacuacgguuucgggguuuuuacuacaaauaucuggcucaaacuaagagaaguguacacccagagcugcgaucaccggcuaaugagugcagcuaucaaggaugagagagcaguccacgcugauaugggcuacuggauugagagucagaaaaacggaucguggaaacuugagaaggcuagcuucaucgaagugaaaacuuguacuuggccaaagucucauacucuauggagcaauggagucuuagaaucagauaugauuauaccuaagagucuugcggggccaauuucucaacacaaccaucgaccaggauaucacacgcagacagcuggcccuuggcaucuaggaaaauuagaacucgauuucaauuauugcgaagguacgacagucguaauaaccgaaaauuguggaaccagagggcccaguuugcguacaacaacgguaucaggaaaauuaauacacgaauggugcugcaggaguugcacuuugccaccucuaagauauaugggggaggauggauguugguaugguauggaaauaagaccaauaaaugaaaaggaagaaaauauggucaagagccugguaagcgcggggucggggaaaguugauaauuuuacuaugggcguacuuugucuugcuauauuauuugaagaaguuaugcgugguaaauuugggaagaaacacaugauagcuggaguacucuuuacguucguuuugcuuuuaucuggucagaucacauggcgcgauauggcacauacucucauaaugauuggcaguaacgcuagcgaucgaaugggaaugggaguuacuuacuuagcgcuaauagcuaccuucaaaauacaaccauuuuuggcacuaggauucuuuuugagaaaacuaacaucuagagagaaucuacuccuugguguaggauuggcaauggccacgacacuucaauuaccggaggauauugaacaaauggcuaacgggauagcucuuggauugaugacgcugaaacucaucacucaguucgagacguaucaacuguggacagccuuggugaguuuaacauguaguaauaccauuuucacgcuaaccguugcguggaggacugcuacacugauauuagcugguguaucucuacuaccauugugccaaagcucaaguaugagaaaaacagacuggcuaccuaugacaguggcugcgaugggcguacccccauugcccuuauucauauuuuccuugaaagacacaccuaagcggagaucguggccgcucaacgaaggcgucauggcagugggcuugguuaguauacucgcaucgucuuuauugaggaaugauguaccaauggcuggucccuuaguggcagggggacuauuaauagcauguuauguaauaacugguacuucagcggauuugaccguagagaaggcagccgauguuaccugggaagaggaagccgaacaaacgggggugucgcacaacuugaugguuacuguagaugaugauggcacaaugaggaucaaagaugacgaaacagaaaacauauuaacaguacuacugaaaaccgcacuauuaauaguuuccgggauauucccguauaguauaccagcgacauuacugguauggcacacuuggcaaaaacagacgcaacguucagggguccuaugggaugugcccagcccacccgaaacucaaaaagcugaguuagaagaggggguauaccgaauaaaacaacaaggaaucuucgguaagacacagguggguguaggcgugcaaaaagaagguguauuccacacaauguggcauguuacucgcggagcagucuuaacucacaauggaaagagauuagaaccaaauugggcaucagugaagaaagaucuaaucagcuauggagggggauggcgcuuaagugcucaauggcaaaaaggggaagagguucaaguuaucgccguagaacccgggaaaaacccuaaaaauuuucaaacaaugccagggauauuccaaacgacaacgggcgaaauaggcgccauugcucuagauuuuaaaccgggcacgaguggaagccccauuauuaauagagaagguaaaguaguaggacuuuauggaaauggcguagugacaaagaauggcggauauguaucugggaucgcccaaaccaacgcggaaccugacggaccaacaccagaguuggaagaggaaauguucaagaaacguaacuuaacaaucauggacuuacacccgggaucugggaaaacaagaaaauacuugccggcaauaguacgagaagcaaucaaaagacgucuaagaacacuaauuuuggcgccuacccgaguuguugcagcagaaauggaagaggcuuuaaaaggucuuccuauucguuaucagaccacugcaaccaagagugagcauaccgggcgggaaaucgucgacuuaaugugucaugccacauuuacuaugaggcuacuuagcccaguaagagugccaaacuauaaccuaauuauaauggaugaagcucacuuuacugauccugcaucaauugcagccagaggauacauaaguacgagaguagggaugggagaggcggccgcuauauuuaugacugcaaccccaccaggaacggcagaagcauucccgcaaagcaacgcuccaauccaggaugaagaaagggacauucccgagagaaguuggaacucgggcaacgaauggauuacagacuucguagggaaaacagucugguuuguaccuucaauaaaagcaggcaaugauauugcuaauuguuuaaggaaaaacgguaagaaaguaauacaacucagcagaaaaaccuucgauacagaguaucagaaaacacgucuaaacgauugggauuuuguuguaacuacugauauaucugaaaugggagcuaacuuuaaagcugauagaguaauagauccaagacgcugccuaaaaccagugaucuugacagacggaccagagagaguuauauuggcaggacccaugccagugacugcggcaagcgcagcccagagacgcggacgagugggaaggaauccucaaaaagaaaaugaucaauacauauucaccggucaaccgcucaauaaugaugaagaucaugcucacuggacagaagccaagaugcuuuuagacaauauaaacacuccggaggggauuaucccagccuuauuugggcccgaaagagaaaagagugcugcaauagauggggaauaucgacuaaaaggagaaagccggaaaacauuugucgaguugaugcggcgaggcgaccuacccguuugguuagcguacaaagucgccagcgaagguauuaaauauaccgaccguaagugguguuucgacggugaacgaaauaaucaaauauuagaagagaauauggauguagaaauuuggacaaaggaaggugaaagaaagaaauuaagaccucguuggcuagaugccaggaccuauagugauccauuagccuuaaaagaguucaaggacuuugcagccgguagaaaauccauagcgcucgauuuaguaacugagauugguagaguaccuucucaccuggcacacagaacacgaaacgcauuggacaaucuagugauguuacauacaucagagcauggugggagagccuaucggcaugcaguagaagaguuaccagaaacaauggaaacgcuuuuacucuuaggcuuaaugauauuacuaacugguggggcaauguuauuuuugauaagugguaaaggaauagggaagacaaguauaggacucaucugugugauaguuaguucuggcauguuauggauggcugacgucccucuccaauggauugcaagcgcuauaguauuagaauuuuucaugaugguguuacuaauaccagaaccagaaaagcaaagaaccccgcaggauaaucaacuagccuauguagucauaggaauacugacuuuagcugccaucguagcagcgaaugaaaugggauugcuugaaacaacgaaacgagauuuaggaaugucaaaagaaccagggguuguaucuccuacaagcuaccuagaugucgauuuacauccagcuucagcauggacauuguacgcuguagcaacaacuguaauuacaccuauguugaggcacacuauagaaaauucuacggcaaaugugaguuuagccgcgaucgcgaaucaggcuguuguacuaaugggccucgauaaaggauggcccauuucuaagauggauuuagguguaccucuuuuagcucugggauguuacucgcaaguaaauccgcuaaccuuaacugcagcugugcuccuauuaguuacacauuaugcgauaauuggacccggucugcaagcaaaagcaacacgugaggcacaaaagagaacagcagcuggaauaaugaaaaacccaacaguggauggaauaaugacuauagaucuggaccccguuaucuaugauucuaaauuugaaaagcaguugggacaagucaugcuauuaguucuaugcgcgguacaacuacuguuaaugagaaccucgugggcacugugcgaagcauuaacuuuagcuacuggcccaauuacuacuuugugggaaggauccccaggcaaauucuggaacacaaccauagcaguuaguauggcaaauaucuuuaggggaagcuaucucgcaggcgccggacuggcguucagcauaaugaaaagugucgguaccgguagaagggguacgggaucccaaggagaaacacuaggugaaaaauggaaaaagaaauuaaaucaauugucccgaaaagaguuugauuuauacaagaaaaguggaauuacagagguggauagaacagaagcgaaagaaggauuaaaaagaggugagacuacacaucacgcuguuagucguggaucagccaaacuacaaugguuuguagaaagaaauauggucauuccagaaggacgagucauugaucuggguuguggacgggguggguggaguuauuauugugcuggacuuaagaaagugacugaggugagagguuacacaaaaggaggaccgggacaugaagaaccggugccuaugucaacuuauggcuggaacauaguaaaacucaugucuggaaaagauguauuuuauuuaccacccgaaaaaugugauacacugcuuugcgacaucggcgagaguucucccucaccaaccguggaagaaucuagaacaauacgcguuuugaagaugguagaacccuggcugaaaaauaaccaauuuugcauuaaaguacuaaacccauauaugccaacaguaaucgaacacuuggaacgucuucaaagaaaguauggagguaugcuuguaagaaauccuuuaaguagaaauaguacgcaugagauguauuggauuucaaauggaacagggaacauaguaucaagugucaauaugguuucaaggcuauuguugaaccguuuuacgaugacacauagacguccuacaauagagaaagaugucgacuuaggagcaggcacgagacacgucaacgcagaaccugaaacaccgaauauggacguaauuggcgagaggauaaaaaggauaaaggaagaacacucaucaacauggcauuaugacgacgagaauccuuauaaaaccugggcuuaccauggaucauaugaaguuaaagcuacaggcagcgcgaguaguaugauaaauggagugguaaaguuacugaccaagccuugggacguuguacccauggucacacaaauggcuaugaccgacacaacaccguuuggucaacaaagaguauucaaggaaaaaguugauacacggacgccucguccgaugccagguacgagaaaaguaauggaaauaacagccgaaugguuauggcggacauuaggaagaaauaagaaaccgcgauuaugcacaagggaagaauuuacgaagaaaguucgaacuaaugcugccaugggagcaguauuuacggaagagaaccaaugggacaacgccagagcagcugucgaggaugaagaauuuuggaaauuaguugauagagaaagagaacuacacaaacuaggaaaauguggcaguugcguauauaacaugaugggaaaaagggagaagaaauuaggugaguuugguaaagcaaaagggucucgggcaauaugguauaugugguuaggagcgagauaccuugaauuugaagcucuaggauuuuugaaugaagaccauugguucaguagagaaaauucuuauagugguguggaaggugaaggguugcauaaacuaggauauauuuuaagagacauuucgaaaauaccaggaggggcaauguaugccgaugauaccgcgggaugggacacgcggauaacggaagaugaccuucauaacgaagagaaaauuacacaacaaauggauccagaacaccggcaauuagcaaacgcaauuuuuaaauuaaccuaucagaacaaagucgugaaaguccaaaggccaacaccuaaaggaacugucauggacaucauuucgagaaaagaucaacguggaucuggacagguagggacauaugguuugaauacguuuacaaauauggaagcacagcuaguaagacaaauggaaggugaagggguacuaucgaaagcagacuuagaaaauccgcauuuacuugagaagaaaauuacucaaugguuggaaacaaaggguguagaacgauuaaaaagaauggcaaucucaggagaugauugcgugguuaagcccauagaugauagguuugcaaacgcauuauuagcacucaaugacauggggaaaguuagaaaagacauaccucaguggcagccaucgaagggauggcaugacuggcaacaaguucccuucugcucccaucacuuucaugagcuaauaaugaaagacgggagaaagcuaguuguaccaugucgaccccaagaugaauuaauaggcagagcaagaauuagucagggagccgguuggucccuaaaggaaacagcuugcuuagguaaggcguaugcacaaauguggaguuuaauguauuuccaccgcagagauuuaagacuagccucaaaugcaaucuguucggcagucccggugcauuggaucccuaccucacgaaccacauggucuauacaugcgcaucaucaguggaugaccacagaggacauguuaacaguauggaauagagucuggaucgaggauaauccauggauggaggauaaaacgccgguaacgaccugggaagacgugccguaccuagguaaacgagaggaccaauggugcggaucucuaaucggcuugacaucacgugcaacgugggcacagaacauucugacagcaauucaacaagucaggaguuuaaucggggacgaggaauuuuuggauuauaugccgucaaugaaaagauuucgaaaagaagaagagagcgaaggagcgauuugguaa

SEQ ID NO: 23469 - RNA, 9873 nt, Artificial Sequence
  derived and/or modified CDS sequence (opt6) from DENV-3__EU482458__SS-prME
acuucguugugucuaaugaugaugcugcccgcaacauuagcguuucaucugacuucgcgcgacggcgaaccgcgaaugaucguagggaaaaaugaaagggggaaaaguuugcuguuuaaaacagcgucagguaucaacauguguacguuaaucgcuauggauuuaggugaaaugugugaugacacugucacguacaaauguccauuaaucgccgaagucgaacccgaagauauugauugcugguguaauuugacaucuacauggguaacauauggcacuugcaaucaagccggagaacaccggagagacaaaagaucaguagcguuggcuccacauguaggaaugggccuagauacgagaacgcaaacguggaugucagcggaaggagcguggagacagguggaaaaaguagaaacaugggcccuacgacacccuggguuuacaauauuagccuuguuucucgcacacuauauaggcacaagucugacgcaaaaaguaguuauauuuauauuacuuauguuaguuacaccuaguaugacaaugagauguguuggaguagggaacagagauuuuguugaaggacuauccggggccacauggguagacgucguucuagaacauggcggaugcguuacaacaauggccaaaaacaaacccacauuagauauagaacuucagaaaaccgaagcgacacaauuggcuacgcucagaaaacuauguaucgaaggaaaaauaacgaauaucaccacagacucaagaugcccaacucaaggcgaagcaauuuuacccgaagaacaagaucaaaacuaugugugcaaacacacuuauguugacaggggcugggguaauggauguggucucuuuggaaaagggucccuagucacaugugcaaaauuucaguguuuagaaccaaucgaaggaaaagugguucaauaugaaaaucuaaaauauacagugauuauuacaguucauacuggagaccaacaccagguuggaaaugauacacaaggcguuacaguagaaauaacuccucaagcguccaccguugaagcagugcuaccggaauaugguacacuugguuuagaguguucaccaagaacagguuuagacuuuaacgagaugauucuacugacgaugaaaaauaaagcauggaugguacaucgucaaugguucuuugaucuccccuuacccuggacaucuggugcuacgaccgaaacacccacauggaacaggaaagaauuauuaaccacauuuaaaaaugcacaugcuaagaaacaagaaguaguugucuuaggaagucaagaaggagcuaugcauacugcacugacuggcgcaacugaaauacaaaauucugguggaacaucuaucuucgccggacaucuaaaauguagauuaaaaauggacaaacuugaguuaaaaggaaugaguuaugcaaugugcuugaauacguuugugcuaaagaaagaaguuucugaaacucaacacggcacuauccucauaaaaguugaauauaaaggagaggaugccccuuguaaaauuccuuucuccaccgaagauggccaggguaaagcucauaacgggcgccuuauuaccgccaacccaguagugaccaagaaagaagaaccaguaaauauugaagcugaaccaccguucggggaauccaauauaguaauagguaucggcgacaaggcuuuaaaaaucaauugguauaagaaagguaguuccauaggaaaaauguucgaagcaacagcgcguggggcaaggagaauggccauucuuggagauacagcaugggauuucggaucagucggcggaguccuaaacaguuuaggaaaaaugguccaucaaauauuuggaucagcauacacugcguuauuuagcggcgugucauggaucaugaaaaucggcaucggaguucuucuaacuuggauaggucuaaauagcaaaaauacaucaaugagcuucagcugcaucguuaucgguauuaucacucuauaucuuggagcuguaguacaagcagacaugggaugcgcuaucaacuggaaagguaaagaauuaaaauguggaucaggaaucuuuguuacaaaugaaguacauaccuggacugagcaguacaaauuucaagccgacucgccaaaaagacuagccacagcuauugcgggugcaugggagaauggcguauguggaaucagaucaacaacgaggauggagaaucuccuuuggaaacaaaucgcaaacgaauugaacuacauauugugggaaaacaauaucaaacuuaccguaguuguaggugauauaauuggaguacuagagcagggaaaaaggacauuaacaccacagccgauggaauuaaaauauucauggaaaacaugggguaaagcuaaaauagugaccgcagaaacccaaaacagcuccuuuauaauugauggccccaacacaccagaaugcccgucugcaagucgagcuuggaacgucugggagguagaagauuauggguucggugucuuuacuaccaauauaugguugaaacuuagggaaguguacacacaaucuugcgaucauagauuaaugucugcagccauaaaagacgaaagagccguccacgcagauaugggcuauuggaucgaaucccagaaaaacgguuccuggaaauuagaaaaggcuucauucaucgaggucaaaacaugcacguggccuaaaucacauacccuauggaguaauggcguacucgaaucggauaugaucaucccaaaaucacuugcugggccuaucucacagcauaaccaccgcccuggauaucauacucagacggcgggaccauggcauuugggaaaguuagaauuggacuucaacuauugugaaggaacaacuguaguuauaacagaaaacugcggaaugcgaggaccuucacuacgaacuacgacagugagugguaaauuaauucacgagugguguugcagaagcuguacacugccaccauuaagauauaugggagaagacggaugcugguacgggauggagauacggccaauaaaugaaaaagaagaaaauaugguuaaaucauuaguaagugccggaucagguaaaguagacaauuucacgaugggaguuuuaugcuuggcuaucuuauucgaagaggucaugcgagguaaauucggaaagaaacauaugauagcgggagugcuauuuacguuuguacugcuauugagcggucaaaucacuuggcgugacauggcccauacauugauaaugaucgguucgaacgcaucggauagaauggggaugggaguuacauauuuagccuugauagcaaccuuuaaaauacaaccguucuuggcuuuaggauucuuucuaaggaaacugacaucgagagaaaacuuguuguugggaguugguuuagcaauggcuaccacccugcaacugccggaagauauugaacagauggcuaauggcaucgcuuuagguuuaaugacccuaaaauuaauaacacaauuugaaaccuaccaguuauggacagcccucgucagcuuaacaugcucuaauacaaucuuuacccuaacaguagcuuggagaaccgcgacgcuaauauuagcagggguuuccuugcuaccgcuaugccaaucaaguagcaugagaaaaacugacuggcuuccgaugacggucgccgcaaugggggugccaccguuacccuuauucauauuuucacuaaaagacacaccaaaaaggagaaguuggccuuuaaaugaaggaguuauggcuguuggacuggucagcauauuggcaucaucccuucuacgaaaugacguaccgauggcuggcccacugguugccgggggccuacugauugccuguuacgugauaacaggcaccuccgcugauuuaacaguagaaaaagcggcagacgugacgugggaggaggaggcggaacaaacgggaguaucccauaaccugaugauaaccguagaugaugauggcacaaugcgaauuaaagaugaugaaacugaaaacauucucacggucuuguuaaaaacugcccuucuuauaguaagugggauauucccauacucuauaccugccacacuauuaguauggcauacguggcaaaagcaaacacagagaucaggaguucuaugggacguuccauccccaccugagacucaaaaggcagaacuagaagaaggaguuuaccggauaaaacaacaaggaauauuuggcaaaacucaaguugguguaggcgugcaaaaggaaggugucuuucacacaauguggcauguaacaaggggagcaguacuuacacauaacgggaaaagauuagaaccaaacugggcgucagucaagaaagauuugauaagcuaugguggaggauggcgacuaagugcgcaauggcaaaaaggagaagagguacaaguaaucgcugucgaaccugguaaaaauccuaaaaacuuucaaacaaugccuggaauuuuccagacaacaacgggggagauaggugcaauagcccuagacuuuaaacccgguacaucgggaucacccaucauaaaucgugaaggaaaaguagucggcuuauauggcaacggcguagucaccaaaaauggaggcuauguuagcggcauagcgcaaacgaacgcagaaccugauggaccaacaccagaauuggaagaggagauguuuaaaaagcgaaaccuaaccauaauggaucugcauccaggcucugguaaaacaaggaaguacuuaccagcuauagugagagaagcuauaaaacggagguuaagaacccuuauauuagccccgacaagaguuguagcagcugaaauggaagaagcacuuaaaggucuaccuauucgauaccaaacgacggcuaccaagucugaacauaccggaagggaaaucguagaccugaugugucacgcgacguuuacaaugagauuacuuaguccugugagggugccgaacuacaauuuaauaauaauggaugaggcccauuuuaccgacccugcuucaauugcagcuagaggcuauauaaguaccaggguaggcaugggggaagcggcagcaauauucaugacugcaaccccgcccggaacagcugaagcauuuccccagagcaaugcuccuauucaagaugaagagagagauauuccggagaggucuuggaauagcggaaaugaauggauuacggacuuugugggcaaaacugugugguuuguuccuucaauaaaggcagggaacgauauugcuaauugucuacggaagaacgggaagaaaguaauacaacuuucuaggaaaacauuugacacggaauaccaaaagacgcgacucaaugauugggauuuuguuguaacgaccgauaucucagagaugggagcgaacuucaaagcugacagaguuauagauccaagaagaugucuaaaacccguaauucucaccgauggaccggaaaggguaaucuuggcagggccaaugcccguaacugcagcaagcgcagcgcaaaggaggggaagagugggaaggaauccacaaaaggagaacgaucaguauaucuucacaggucaaccacuaaacaaugacgaggaccaugcucacuggacugaagcaaagauguugcuagauaauaucaacacgccagaaggaaucauaccggcgcuguucgaaccagaaagagagaaaucugcagccaucgauggagaguauagacuuaaaggggaaagucgaaaaacuuuuguggagcuaaugaggcgaggugaucucccgguauggcuggcacauaaaguggcuagcgaggguaucaaauauacggauagaaaaugguguuucgauggggaacgcaauaaucaaauauuagaggaaaauauggacguugagauauggacuaaagaaggcgaaagaaagaaauugcggccaagguggcucgaugcaaggacguauagcgacccauuagcccucaaagaguuuaaggacuuugcagcuggaaggaaaagcauagcucuagaucuugucacagaaauagguagaguaccaucucauuuggcguaucgaacgcguaaugcauuggacaaccuaguaauguuacacacuucugaacaugguggaagggcuuaucggcacgcaguagaagaacuaccggaaacuauggagacuuugcuucugcuuggacuaaugauacuacuuaccggaggagcaaugcuuuuccucauaucuggaaaaggaauuggaaaaacuagcaucggacuaaucugugugauagugucuucugguauguuauggauggcugacguaccuuuacaauggauugcaagcgcaauugucuuagaauuuuucaugauggucuuguuaauuccugaaccggagaaacaaaggacgccccaagauaaucaacucgcuuacguuguaauaggcauacuaacgcuggcagccauagucgcugcgaaugaaaugggauuacuugaaaccacgaaacgagauuuaggaaugucaaaggaaccuggaguuguaucuccuacgaguuacuuagacguugaccugcacccagcuagugcauggacacucuaugcaguggccacaacaguaauuacacccaugcuaaggcacacgauagaaaacagcacagcgaacguaucauuggcagccauagccaaucaagcggugguuuuaaugggucuagacaagggauggccaauuaguaaaauggauuuagguguaccauuguuagcauuaggcuguuauucucaaguuaauccauuaacacuaacggccgcgguauuauuauuagucacucauuacgcuauaauuggaccaggauuacaagccaaggcaacaagagaagcgcaaaagcggacagcugcagggauaaugaaaaauccaacgguggaugguauuaugacaauagaccuugaccccguuauauacgacaguaaguuugaaaagcaacuuggacaagucaugcucuuaguucuuugcgcuguccagcuccuauugaugagaacgucgugggcguuaugcgaagccuuaacuuuggcaacaggaccaauuacuacacugugggaaggaucuccuggaaaguuuuggaacaccacaauagcuguaagcauggcuaacauauuucgagguucauaccuagcaggcgcagguuuagcauuuuccauuaugaaaucuguuggcacggggagacgagguacaggaucacaaggagaaacucucggggaaaaauggaagaagaaacuuaaucaguuaucaaggaaagaguucgacuuauauaagaaaagugggaucacagagguugaucgcacugaggcuaaagagggauugaaaagaggggaaacgacacaccacgcggucaguaggggaucagcuaaacuacaaugguucguagagagaaacaugguaauaccagaagguaggguuauugaucuagguugcggacgcggaggguggucuuacuacugugcagguuuaaagaaaguaaccgaagugagaggguacacaaaaggaggaccugggcacgaagaaccugugccaaugucaaccuacggauggaacauaguuaagcuaaugagcggaaaggauguuuucuaucuaccaccugaaaaaugugauacucuguuaugugacaucggugaaucuucaccaucuccaacuguugaagaaaguagaacaauacguguauuaaagauggucgagccauggcucaaaaacaaccaguucuguauuaaaguuuuaaaccccuacaugccaacagucaucgaacacuuggaaaggcuccaaagaaaauauggcggaaugcuuguacgaaaucccuuaucuagaaacucaacacacgagauguauuggauauccaauggaacugguaacauagucagcagcguaaacaugguaagcagauuacuacuuaacagguuuacaaugacgcaucgucgaccaacaauugaaaaggauguagacuuaggggccgguacuaggcacguaaaugcggagccagaaacaccaaacauggauguaaucggagaacgaauaaagagaauaaaggaagaacacucaagcacauggcauuacgacgacgagaauccauacaaaacgugggcauaucauggcucuuacgagguaaaagcaacagggucugcauccucaaugauaaacggggugguaaaguuauugacaaagccaugggauguugucccaauggugacacaaauggcuaugacggacacaacaccauuuggacaacaacgaguuuucaaagaaaagguugauacgcguacuccaagacccaugccgggcacuagaaaggucauggaaauuacagcugaaugguuauggagaacacuaggcagaaauaagaaaccucguuuauguacucgugaagaauuuacuaagaaggucagaacuaaugcugcaaugggcgcugucuuuaccgaagagaaucaaugggauagcgcaagagcagccguagaagaugaggaguucuggaaguugguugaccgugagagagaauuacacaaacucggaaaauguggaucaugcguauauaacaugaugggaaaaagagagaagaaauugggggaguucggcaaagccaaggguuccagggcaauaugguacauguggcuaggugcgagauaccucgaguucgaagcauuaggauuuuuaaacgaagaucacugguucucaagagaaaauagcuauagcgggguagagggugaaggucuacacaaauuaggauacauauuaagagauaucucuaagauccccggaggcgcgauguaugcugaugauacugcuggcugggacacucguaucacugaagaugauuuacacaaugaagaaaagaucacgcaacagauggauccggagcaucggcaauuagccaacgcaauauucaaauuaacauaccagaacaagguggucaaaguucagagaccgaccccaaaggguacaguaauggauauaauuucacggaaagaucagcgaggaaguggucaagucgguacauacggcuuaaauacauucacuaauauggaagcccagcucguuaggcagauggaaggggaaggggucuugagcaaagccgaucuagaaaauccacaucuauuagaaaagaaaauaacccaaugguuggaaacuaaaggagucgagagacuuaagcgaauggcaauaucaggggaugauuguguaguaaagccuauagaugauagauuugccaaugcauuguuagcauuaaacgacauggguaaaguuagaaaagauaucccacaguggcagccgaguaaagguuggcaugacuggcaacagguaccauuuuguucacaucauuuccacgaacugauaaugaaggacggaagaaaacuuguaguuccuugcaggccccaggacgaacuaaucgguagagcacggauaucacaaggagcuggauggagcuuaaaagaaacugcauguuuagguaaagcguaugcucaaauguggucacucauguauuuccaucgacgugacuugcgucuugcaaguaacgcgauuuguucagcaguuccuguacacuggauucccacaucccgaacaacauggaguauucaugcgcaccaccaauggaugaccacggaggacaugcuaacagucuggaauagaguauggauugaagacaauccuuggauggaggauaaaacaccaauuacuacaugggaagauguaccauaucuuggcaaacgagaagaccaguggugcgguucauuaauuggucuuaccucgagagcuacuugggcacaaaacauacugacagcaauacaacaaguaagaucguuaaucggggacgaagaauuucuggacuauaugccguccaugaaacgauuuagaaaagaggaggaaucugaaggagcgauuugguga

SEQ ID NO: 23470 - RNA, 9873 nt, Artificial Sequence
  derived and/or modified CDS sequence (opt6) from DENV-3__EU482459__SS-prME
acaagccuuugucuaaugaugauguuaccggcaacauuagcauuucaccuuacuucgcgcgauggagaacccagaaugauaguagguaaaaacgaaagaggaaaaucuuuauuauucaaaacugcaagcggaaucaacaugugcacuuuaauugcaauggaucuuggggaaaugugcgaugacacugugacauauaaauguccucuaauagcagaaguagaacccgaagauauugauugcugguguaacuuaacaagcacuuggguaacauacgguacuuguaaucaagcgggagaacaucggcgcgacaaaagaaguguugcacuagcaccccaugucgguauggggcuagacacacgcacacaaacauggaugagugcugaaggagcguggcgucaaguagaaaaaguggaaaccugggcacuucgucacccaggauucacaauacuagcacuauucuuagcucauuauauagggacaaguuuaacgcaaaaaguagucaucuucauacuauugaugcuaguaacucccaguaugacgaugcgaugcgugggcguagguaacagagacuuuguggaaggucuaaguggggccacaugggucgacgucguuuuggaacacgggggcugcguaacaacuauggcgaaaaauaaacccaccuuggauaucgaauuacagaaaacugaagcaacacaacuagcuacacuucgcaaauuguguauagaagguaaaaucacaaauauuacuacggauucgagauguccuacucaaggggaagccauucuaccagaagaacaagaucaaaauuauguuugcaaacacacguauguggaucgggguuggggaaauggcugcggacuguuugguaaggguucguuagucacuugugcuaaauuucaaugccuugaacccauagaaggaaagguagugcaguacgaaaacuugaaauacacuguaaucaucacagugcauacaggggaucaacaccagguugggaacgauacucagggaguuacgguugaaauaacuccucaggcuucgacaguagaagcaguccuaccugaauacgggacccuagguuuggaaugcucaccuagaaccggcuuagacuuuaaugaaaugaucuugcucaccaugaagaauaaagcauggaugguacauagacagugguucuuugauuuaccauugccauggacuucaggugccaccacggaaacuccaacauggaaucgaaaagaacuauuagucacauucaaaaaugcacaugccaagaaacaggaaguagucguucuaggaagccaagaaggagccaugcacacggccuugacuggugcuacagagauacaaaacucgggagguacaucgaucuucgcaggacaccuuaaaugcagacucaaaauggauaaacuagaguuaaaagguauguccuaugccaugugcuuaaauacauucguacuuaagaaagaaguaucagagacucaacauggaacaauccuuauuaaaguggaauacaaaggagaagacgcaccauguaaaauucccuucagcaccgaggauggucaaggcaaagcacauaauggaagauuaauaacggcaaaucccguaguuaccaagaaagaggaaccaguaaacauugaagcugagccacccuucggagaaagcaacauugucauaggaauuggagauaaggcgcuuaaaaucaauugguauaagaaaggcaguuccauaggaaaaauguucgaagccacagcgaggggagcgcgacgaauggcaauacugggggauacagcaugggauuucggaucaguaggcgguguauuaaauaguuuagggaaaaugguacaccagauauucggaucagcauacacugcacuauuuuccgggguaagcuggauaaugaaaaucgggauaggaguacuuuuaacauggaucgggcuaaauagcaaaaauacaaguaugucuuucuccugcaucguaauaggaauaauaacacuauauuugggagcaguuguucaagcagacaugggcugcgcgauaaacuggaaagggaaagaauuaaagugcggaucgggaauuuucguuacuaaugaaguucauacauggacagaacaauacaaauuucaggcagauaguccaaaacgauuagcuacagcaauagccggugcgugggagaacggaguaugugggauucgaagcacgacuagaauggaaaaucuucucuggaaacaaaucgcgaacgagcucaauuauauacuaugggaaaacaacauaaaguuaacagugguaguuggcgauauaauaggaguacuagagcaggggaaacguacacuuacgccacaaccaauggaacuaaaauacagcuggaaaacuugggguaaagcgaagauaguuacugcugaaacucaaaacucuucauuuaucaucgacggccccaauaccccagaguguccgucagcuagcagagcuuggaacguuugggaagucgaagauuaugguuucggagucuucaccacaaauauaugguuaaaacuucgcgaaguguauacucagucuugcgaucaccgucucaugucagcagcuauaaaagacgaacgagccguccaugcggauaugggauacuggaucgaaucucagaaaaaugggagcuggaaauuagaaaaggcauccuucauugaaguaaaaacuugcacauggccuaaaucgcacacuuuauggucaaauggggugcuggaaagcgauaugauaaucccgaaaucguuagcuggccccauuagccaacacaaucacaggcccggcuaucacacucaaacagcagggccauggcaucuagggaaacuagaacuugauuuuaauuacugcgaaggaaccacuguuguaauaacagaaaacugugggacgagaggaccuucccuccgaacaacuacggucucagguaaacugauacacgaguggugcuguagaagcuguacccuuccuccgcuuagauacaugggggaagacgguugcugguacggcauggaaaucagaccuauuaaugaaaaagaagaaaauauggugaaaucgcuggucagugcuggcagcggcaaaguagauaauuuuacuauggguguccucugucuugcuauauuauucgaagaagucaugcgaggaaaauucgguaagaaacauaugauagcaggagucuuguucaccuuugugcuccuauugucaggacagauaacauggagagacauggcucauaccuuaauaaugauagguucaaacgccucagaucgcauggguauggguguuaccuaucuggcuuuaauagcgacauucaaaauucaaccguuucucgccuuaggauucuuuuugagaaaauugacgucucgggaaaaucuauuacucggagucggcuuagcuauggcaaccacacuacaacuuccagaagacauagaacaaauggcuaacgggauagcauugggacugaugacacuuaaacuuaucacucaauuugagacuuaccaacuauggacagcuuuagugagccuuacguguagcaauacaauauuuacacugacugucgcauggcguacagcaacccuaauauuagcugggguauccuugcugccccuaugucaaucaaguaguaugcguaaaaccgacuggcuaccaaugaccguggcagcaaugggugucccgccauuaccgcuauucauauuuucacuaaaagacacacccaaacgacgaaguuggccccuuaaugagggcguaauggcagugggucugguuagcaucuuagcaucuucgcuuuuaagaaaugacgucccuauggcaggaccacucguggccggugguuugcuaauagcauguuacguaaucacuggcacaucagccgaucugacuguugaaaaagcagcagacguaacgugggaagaagaggcugagcaaacuggagucucucacaaccuuaugaucacgguugacgacgauggcacuaugcgcaucaaagaugacgagaccgagaauauauuaacggugcuguuaaaaaccgcguuacugauaguaucaggaauauuuccguauucuauucccgcaacgcucuuggucuggcauaccuggcaaaagcaaacucaaagaucagguguauugugggaugugccuucaccacccgaaacacaaaaggcugaguuggaagaagggguauaucguauuaaacaacaagguauauuugggaaaacacaggucgguguuggcguacaaaaagaggggguauuucauacuauguggcauguaacaagaggcgcaguuuugacacacaauggaaaaagacuugaaccaaauugggcaucaguaaagaaagacuuaauuucauacggcggcggauggagacuaucagcacaauggcaaaaaggagaagaaguucaaguuauagcaguagaacccggcaaaaacccuaaaaacuuccaaacgaugccuggaauauuucagacaacaacaggcgagauaggcgcaauagcauuagauuuuaagccuggaaccagcggaucucccauuauuaaccgagaaggaaaggucguagguuuauaugggaauggcguagucaccaaaaaugguggauauguuuccgggauagcccagacaaaugcggagccggacgggccuacgccugaauuagaagaagagauguucaagaaacguaaccucaccauaauggauuuacaucccggcucagggaagacucgaaaauauuugccagccauuguaagggaagcuaucaaaaggcgauuaaggacuuuaauuuuagcaccaacccgcguaguggcagcagaaauggaagaagcacuuaaaggucuccccauaagguaucaaacaacggcaacaaaaucugagcauacuggaagagaaauaguagaucuaaugugucaugcuacauuuacaaugcgacuauugucaccuguaagaguucccaacuacaacuugauuauuauggacgaggcacauuucaccgauccagcaaguaucgccgcacgugguuauauuaguacucgcgugggcaugggugaagcugcagcuaucuucaugacugcaacaccucccgguacugcugaagcguucccucaaucaaaugcccccauccaggacgaagaaagagacauucccgaaagaucguggaacuccggaaacgaauggauuacugacuuugugggaaaaacugugugguucguuccaagcauaaaagcaggaaaugauauagcuaauugcuugaggaaaaaugguaagaaagucauucaacugagucgaaagacauucgauacggaauaucagaagacucgacuaaaugauugggacuuuguaguaacaacggauauaucagaaaugggcgcaaauuuuaaagcagacagagucauagauccuaggagauguuuaaaaccaguuauucuuacugauggaccagaaagaguaauccuagcugggccuaugccaguaacugcagccagugcagcgcagcgacguggucgaguagguagaaacccucaaaaagagaacgaucaauauaucuuuacaggucaacccuuaaauaaugacgaggaucaugcucauuggacggaagcgaaaauguuguuagauaauauuaauacgccggaggguauuauacccgcguuauuugagccggaaagagagaaaagugcggccauagacggcgaauacagguuaaaaggggagucaagaaaaacuuucguagaauuaaugagacgaggagaucugccagucugguuagcacacaagguugcaagugaaggaaucaaguauacagauagaaaaugguguuuugauggcgaacguaauaaccagauacuagaagaaaacauggauguagaaauuuggacuaaagaaggcgaaaggaaaaagcuaaggccaagauggcucgaugcccgaaccuauagcgauccucucgcacuaaaagaauuuaaagauuuugcugcgggaagaaagucaauagcgcuggaucuaguuacagaaauaggaaggguuccaucacaccucgcauauagaacccgaaaugcacuagauaaucuaguaaugcuacauacaagcgaacauggaggcagagcguaccgacaugcaguugaggaauuaccagagacaauggagacacuauuacuacucggacucaugauuuuauuaaccggcggagcgauguuauuccugauuuccggcaaaggcauugggaagacaaguauuggccuaauauguguaauaguuagcucugguaugcuauggauggccgacguaccauuacaauggauagcauccgcgauaguucucgaauuuuucaugaugguuuuacugauuccagaaccagaaaagcaaagaacuccgcaagauaaccaacuagcuuaugucgugauagggauacucacauuagcagcgaucguggcugcuaaugaaaugggucugcucgaaacaaccaagcgcgaccuagggaugucuaaggagccagggguaguuagcccaacgucauaccuagauguugauuuacaccccgcaucagcauggacgcucuaugccguugcuacuacagugauuacaccaauguuaagacauaccauagaaaauagcacagcuaacgucagcuuagcggccauagcaaaccaggcuguuguucugaugggccuggacaagggauggccaauaucaaaaauggaccuaggaguuccacuacuagcacuagggugcuacucucaaguaaacccacuaacacuaaccgcggccguauuauuacucgugacacauuaugccauaaucggaccgggauuacaagcgaaagcgacaagagaggcacaaaaacgaacugcugcaggaauaaugaaaaacccaaccguagacgguauaaugacuauugauuuagacccuguaauauaugacucuaaguuugaaaaacagcuggggcaagucaugcuccuaguguuaugcgccguccaacuauuacuaaugcgaaccucgugggcauuaugcgaggcauugacccuagcuacaggaccaauaacaacuuuaugggaaggaucuccagguaaauucuggaauacgacaauugcuguuucuauggcuaacauauuuaggggaaguuacuuagcaggggcaggacucgcauucucuauaaugaaaaguguaggaacaggcagaagagguacagguucucaaggagagacguuaggagaaaaguggaagaagaaacuuaaucaauuaucgcgcaaagaauuugaucuuuauaagaaaucgggaauaacugaaguagaucggacggaagccaaagaaggccuaaaaagaggagagacaacucaccacgccguuucacgugguucagcaaaacuacaaugguuuguagaaagaaauaugguaauaccggaggggcgugucauugaucuaggauguggaagagguggguggucguacuauugcgcuggacucaagaaaguaacagagguacgcggauauacgaaaggcgguccuggacacgaagaaccaguaccaauguccacauauggauggaaucuagugaaauuaaugagugggaaggacguauuuuaccucccgcccgaaaaaugcgauaccuuacuaugcgauauaggcgaaucuaguccaagucccacggucgaagaaucgcgaacaaucagaguucuaaaaaugguagaacccuggcucaagaauaaccaauuuuguauuaaaguccuaaacccauacaugccaacaguuaucgaacauuuggagcguuuacaaagaaaauauggcggaaugcuuguaagaaacccacuaucgaggaacucaacacacgaaauguacuggauuucgaacggcacagguaauauugugucaagcguuaauauggucucacgcuuauugcugaauagguuuacaaugacacaucgucgcccuacuauugaaaaggacguagauuuaggagcggguacacgccaugucaaugccgagcccgaaacaccaaauauggacgugauaggggaaagaauaaaacgaauuaaagaagaacacaguagcacauggcacuacgaugacgaaaauccauauaaaaccugggccuaccacggcaguuacgaaguaaaggcuacggguuccgcaucaucuaugauuaauggaguaguaaaauugcuaacaaaacccugggacguuguuccaauggugacccaaauggcuaugacugacaccacuccuuucgggcaacaacguguauuuaaagaaaaaguagacacuagaacaccuaggccaaugcccggaacuagaaaggucauggaaauaacugcagaauggcuauggcgaacacucggacgcaacaagaaaccgagacuauguacaagggaagaauuuaccaagaaaguuagaacaaacgcugcuaugggagcaguuuucacggaagaaaaucaaugggauucagcacgagcagcaguagaggaugaagaguucuggaaacuuguugaucgagagcgcgaacuacauaaacuugguaaaugcgguagcugcgucuacaauaugauggggaaaagagagaagaaauuaggugaauuugguaaagcaaaagguucccgugcaauaugguauaugugguuaggugcaagauauuuagaguucgaagcucucggcuuucuaaaugaagaucauugguuuucaagagaaaauagcuacucagggguugaaggagaaggucuacacaaacucgguuauauacuaagagauauaagcaaaauaccuggaggugccauguacgcggacgacacagcagguugggauacuagaaucacggaagacgacuugcauaaugaagagaaaauuacgcaacaaauggauccugaacaccgacaauuggcaaaugcgauuuucaaacuuacuuaucaaaacaagguaguaaaaguacaaagaccaacaccuaaaggaacaguuauggacauaaucagccggaaagaccagagagggagcgggcagguaggaaccuauggcuuaaauacauucacaaauauggaagcccaauugguacggcagauggagggugaagguguucugucaaaggcagauuuagaaaauccgcauuuauuagagaagaaaauuacccaaugguuggaaacaaaagguguagaacgauugaaaaggauggccauaucgggggacgauugcguagugaaaccaauugaugaccgguuugcaaacgcuuuauuagccuugaaugacaugggcaaaguacgcaaagauauuccgcaauggcagccuucaaaagguuggcacgauuggcaacaagugccauuuuguucacaccacuuucaugaacuaauuaugaaagauggcagaaaguuaguagucccaugucgcccccaggaugaguugauaggacgugcaagaaucucgcaaggugcaggcuggagcuuaaaagaaacggcauguuuagggaaggccuacgcccagauguggucgcuuauguacuuucaucgacgugacuuacguuuagcuaguaaugcaauauguucagccgucccggugcauuggauacccacaagucguacgacauggaguauacacgcucaucaucaauggaugacaacagaggacaugcuuacaguauggaaucggguauggauugaagacaauccauggauggaagauaagacgccugucacuacuugggaagacguuccauaucuaggaaaacgagaagaucaauggugcggcagccuuauaggacuuacaagccgcgcaacuugggcucagaauauccuaacugccauucaacaaguaagaucccugauaggcgacgaggaauuucuagauuauaugccaucgaugaaacguuuuaggaaagaagaagaaucugagggugcuauuugguaa

SEQ ID NO: 23471 - RNA, 9873 nt, Artificial Sequence
  derived and/or modified CDS sequence (opt6) from DENV-3__EU482460__SS-prME
acaucacucugucugaugaugaugcuaccugcgaccuuugcuuuucaccugacuucaagagacggugaaccucgcaugauagugggcaaaaacgaaagagguaaaagucuacuauucaaaacugcaucagggauaaacaugugcacgcucauagcgauggauuuaggagaaaugugcgacgacacuguaaccuacaaaugcccuuuaauagcagaaguugaaccugaggacauugacuguuggugcaaucucacgagcacaugggucacguacgggaccuguaaucaagcaggggagcacagacgugacaaacgauccguugcucuagcaccacacgucggaaugggacuagauacacgaacgcaaacuuggaugucggcggaaggagcguggcgccaaguagaaaaagucgaaacaugggcauuacgacacccagguuuuacuauucuagcgcuauuccuugcucacuauaucggaacgucauuaacccaaaaaguuguaaucuuuaucuuacucauguuaguaacuccuaguaugacaaugcgaugugugggaguuggaaaccgagacuucguagaagguuuaagcggggcaacuuggguggauguuguccuugagcacgggggaugcgucacaacuauggcuaagaauaaaccgacacuugauauugaguuacagaaaacugaggcuacgcaacuagcaacauugcgaaaauuaugcauagaagguaaaauaaccaauauaacuacagacucaagauguccgacucagggugaagcuauacuacccgaagaacaagaucaaaauuauguaugcaaacacacguacguagacaggggauggggaaacgguuguggacuauuugggaaaggcagccuaguaacaugcgcuaaauuccaaugccuagaacccauagaagguaaaguaguucaauacgaaaaucuaaaauauacaguaauuauuacaguacauaccggggaucaacaucaagucgguaacgauacccaggguguuacaguagaaauaacaccacaggccaguacgguagaggcaguccucccggaauaugggacauuaggacuagagugcucaccaagaacuggucuggauuucaacgagaugauuuuauugacuaugaaaaauaaagccuggaugguacaucgucagugguuuuucgacuugccacuuccauggacuagcgguacuacaacugagacuccuacauggaaucgaaaagagcuauuaguuacuuucaagaaugcacaugcuaagaaacaagagguugugguucucgggucgcaagaaggugcaaugcacacugccuuaacaggugcgaccgaaauacaaaacucagguggcacuucgauauuugcuggucauuuaaaaugucgacuaaaaauggacaaauuagaacuaaaaggaaugagcuaugcaaugugcuuaaauacauucgugcuaaagaaagaaguguccgagacucaacauggcacaauacuuauaaaaguggaauacaaaggagaagaugccccuuguaaaauacccuuuucuacagaagacggacaaggcaaagcgcauaaugggaggcugauuaccgcaaacccaguaguaacgaagaaagaagaaccugucaauaucgaggccgagccaccauuuggagaaaguaacauagugauaggaaucggcgauaaagcucuuaaaauuaauugguacaagaaaggcucgucaauuggaaagauguucgaggcaacugcaagaggugcacgucguauggcuauucuuggagauacugcaugggacuucgggagcguuggcgggguccuuaauagccuagguaagaugguccaccagaucuucgguagcgcauacacugcguuauuuaguggagugucauggauuaugaaaaucgguauugguguauuacuaaccuggauaggauuaaauaguaaaaacacuuccaugucauuuagcugcauaguaaucggaauaauuacucuuuacuuaggcgccguuguacaagcugauauggguugugcaauuaauuggaaagguaaagaacuuaagugcgguucaggaauauuugucacaaaugaaguacauaccuggacggaacaauaccgauuucaagcggauucacccaaaagauuggcuacggcaauugcuggagcuugggagaaugguguauguggaauacguuccaccacaagaauggaaaaccuucuuuggaaacagauagccaacgaguugaacuacauauugugggagaauaauauaaaacuuacaguuguugugggggauaucauaggaguauuagagcaagggaaacgagcacuugccccacaaccaauggaacuaaaguacucuuggaaaaccuggggaaaggcuaagaucguuaccgcggaaacccaaaauaguucauuuaucauagacggaccaaauacuccggaauguccaucagcuucuagagcuuggaauguaugggaaguggaggauuauggguucggaguguucaccacgaacauauggcuaaagcugagggaagucuacacucaauccugugaucaccgacuaaugagugccgcuauaaaagacgaaagagcaguacacgccgauauggguuauuggauugaaagucagaaaaacgggucauggaaauuagaaaaggccagcuuuauugaaguaaagacguguacauggccuaaaucucacacgcucuggucaaacggagucuuagaaagugauaugauaauuccuaagagccuagcagguccuauaucgcaacauaaucaccggccagguuaccauacucaaacugcggguccguggcaccugggcaaacuagagcuugauuucaacuacugugaggguacaacuguaguaaucaccgaaaacugcgguaccagagggcccucacuuaggaccacgacuguaucuggcaaacuaauucaugaguggugcugucgcuccuguacauugccaccgcuaagauauaugggagaggauggcugcugguaugguauggaaauuaggccaauaaaugaaaaagaggaaaacaugguuaaaucccucguaucugcagggucuggaaaggucgauaacuuuaccauggguguacuauguuuagccauucuuuucgaagaaguaaugcguggaaaauuuggaaagaaacauaugauagcaggaguccuauucacauuuguuuugcuucucucuggccaaaucaccuggcgugauauggcacacacacucauuaugauagguucaaaugccucagacagaauggguaugggugucacauaucuugcacucauugcuacauucaaaauacaaccuuuccuugcgcucggauucuuuuuacgaaaauugaccucuagagaaaacuuauuauuaggugugggguuggcaauggcaacgacacuucaacucccagaagacaucgaacaaauggcaaacggaauugcacucggccuaaugaccuuaaaacuaauaacacaauuugaaaccuaccaacucuggaccgcacuugugucacuaacaugcucaaauaccauuuuuaccuugacaguggcauggcgaaccgccacucuuauuuuagccgguguaucuuuauuaccgcuaugccaauccucuucaaugcgaaaaacagauugguuaccgaugacaguagccgcaaugggagucccgccucuaccuuuauuuauauucagcuugaaagauacuccaaagcggcggagcuggccucuaaaugaaggaguuauggcuguuggacugguaaguauacuggcaucuaguuuacuaagaaaugauguuccuauggccgguccucuaguugcagggggcuuacuaauugcaugcuaugucauaacagguacaucagcagaucugacggucgagaaagcugcugacguuacuugggaagaagaagcagaacaaacagguguuagccacaaucuaaugauaaccguagaugacgacgggacuaugcgaauaaaagacgaugaaacugaaaauauccugacaguauuauuaaagaccgcgcuauuaauugugucgggcauauuuccuuauagcauaccugcaaccuugcucgucuggcacacauggcaaaaacaaacccaaagaucuggggucuugugggaugucccaagcccaccugaaacccaaaaagccgaacuggaagaaggcgucuaucguauaaaacaacaaggaauuuuuggaaaaacgcaaguaggagugggaguccaaaaggaaggcguauuucacacaauguggcacguaacacgaggugcuguucugacgcacaauggaaaaagacuugaaccaaacugggccagcguaaagaaggauuuaaucagcuacgggggaggauggagacuguccgcgcaguggcaaaagggagaggaaguucaaguuauagccguagagcccggaaagaauccgaaaaacuuccaaacaaugccaggaaucuuucaaacgacuaugggagaaaucggggcaauugcacuagauuuuaaaccaggaacuucaggaaguccaauuauuaacagagaggggaaaguggucggauuauacggaaauggaguaguuacuaaaaauggggguuauguuuccgguauagcucaaacgaaugcugaaccagacggaccgacaccagaauuagaagaagaaauguuuaaaaagcguaaucucacaauaauggauuuacauccgggaagcggcaaaacaaggaaguaccuucccgcuauugugagagaagcaauaaaaaggcgacugcgaacgcuuauauuagcgccaacgcguguaguagcagcagaaauggaagaggcuuuaaagggauuaccaauuagguaccagacuaccgcuaccaagagugagcacacuggaagagaaaucguagauuugaugugccacgccacauuuacaaugagauugcuuucgccagugagagucccuaauuauaaucuuauaauuauggaugaagcucauuucacagauccagcauccaucgccgcaaggggauauauaagcacccguguagguaugggcgaagcagcugcaauauucaugacugcuaccccgccagguacagcagaggcuuucccucaaucaaaugcuccaauacaagaugaggagagagauauaccagaacgcucauggaacucaggaaaugaauggauaacagauuuuguaggaaaaaccgugugguucguaccaucgauaaaagcaggaaacgauauugcaaauugucugaggaaaaauggcaagaaagugauacaauuaucucguaaaaccuucgacaccgaauaccaaaagacucgauugaaugacugggauuucguaguaacaacugauaucuccgaaaugggcgcaaacuucaaagcagacagaguaauugacccaagaagauguuuaaagccaguuauuuuaacugauggcccagagaggguuauacuugcugguccaaugccgguuacagcggcuagugcugcacaaagacgaggaagaguaggcaggaacccucaaaaagaaaacgaucaguauauauucacagggcagccacuuaauaaugacgaagaucaugcucauuggaccgaggcaaaaaugcuucuugacaauauaaauacuccagaaggaauuauaccagcucucuuugaacccgagagggaaaaguccgcggcuauagacggagaauaucggcucaaaggcgaaucacgcaaaacauucguagaacuaaugagacguggugaucuaccaguguggcuagcacauaaagucgcaucggaagggauaaaauacacugacaggaaaugguguuucgauggagagcgcaauaaucaaauccucgaagaaaacauggauguggaaauauggacuaaagaaggcgaacgaaagaaauuaagaccaagauggcuagacgcccguacguauucagacccacucgcacuuaaagaauuuaaagauuucgcggccggucggaaaaguaucgcgcuagaucuagucacugagauagguagggugccuucacauuuagcauacagaaccagaaacgccuuggauaaucugguuauguuacauacaagugaacauggaggcagagccuauaggcaugcgguggaagaauuaccagaaacaauggagacacugcuuuugcuuggcuugaugauauuauugacagguggagcuaugcuauucuuaauaucuggaaaaggcauaggaaaaacuuccauagguuuaauaugcguaaucguaagcucagggaugcuguggauggccgacguaccacuucaauggauugcuucagcaauuguacucgaguucuuuaugaugguuuuauuaauaccggaaccagaaaaacaaaggacuccacaagauaaccagcucgcauacgugguuaucgguauauugacacucgccgccauuguugcagcaaaugaaaugggguuacuagaaacaacaaaacgugaccuaggcaugucuaaagaaccugguguaguaaguccuaccagcuaucuugauguugaucuacauccggccucagcauggacacuguacgcuguagcuacuacaguuauuacuccaaugcuaaggcacacaauagagaacucgacugcaaacgucucguuagccgcuauugccaaucaggccguaguauugaugggacuagacaaaggauggccuauaaguaaaauggaccuuggagucccacuucuggcauuggguugcuauucccaaguaaacccauuaacgcuuacugcagccguacugcuccuggucacucauuacgcuaucauagguccuggguuacaagcuaaagcaacucgcgaagcacaaaaacgcacagcugcggguaucaugaaaaauccaacaguugauggaauuaugacaauugaucuagauccugugauuuacgauccaaaguucgagaaacaacugggacaaguaaugcuuuuaguucuaugcgccguacaacuuuuauuaaugagaacuucaugggcccuuugugaggcauuaacccuggcaacagguccuauaacaacacucugggagggcucaccagguaaauuuuggaacacgacaauagcugucucuauggccaacauauuuagaggauccuaucucgccggugcaggauuggcuuuuucuauaaugaaaaguguagggaccggcaggagaggcacaggcagucagggagagacgcugggggaaaaauggaagaaaaagcugaaccaacucaguaggaaagaguuugaucuauauaaaaagucugggauuacggaagucgacagaacggaagcgaaggagggacuaaaaagaggugaaacgacacaccacgcagucucacgaggaagugcgaaguuacaaugguucgucgaaagaaacauggugauaccagagggaagaguaauugaucuuggcugcggucgugguggauggucuuacuacugcgcgggauuaaagaaagugacggaaguuagggguuauacuaaaggagguccaggacacgaggaaccuguucccaugucaacuuacggauggaauauagucaaauuaaugucaggaaaagauguauuuuaccuaccuccugaaaaaugugauacucuauugugugacauaggagaaucuucgccaucaccaacuguagaggaaucaagaacaauacgcguucucaaaaugguagagccuuggcucaaaaacaaccaauuuugcaucaaaguauuaaauccauauaugccaacaguuaucgaacauuuagaaagauugcagagaaaauauggagguauguuaguccgaaacccucuaagucgcaauucaacgcaugagauguacuggaucagcaaugguaccggaaacauagugagcucuguaaacauggugucaagacuacucuuaaaucgauuuacgaugacccacagaagacccaccauugaaaaagacguagaccucggugcaggaaccaggcauguaaacgccgaaccugagacgccaaauauggacgugauaggagaacggaucaaaaggauuaaagaggaacacucgaguacauggcauuaugacgaugagaauccauacaaaaccugggccuaccacgguucuuacgagguuaaggcuaccgguagcgccagcucaaugauaaauggagugguuaaacuacuaacuaagccuugggacgugguaccaauggucacgcagauggcaaugaccgauacgacuccauuuggccaacaaagaguguuuaaagaaaaaguugacacgaggacuccgcggccaaugccagggacuaggaaagugauggaaaucacagcggaauggcucuggagaacucucggcagaaacaagaaaccuagauuauguacgagggaagaauuuacaaagaaaguccggacaaaugcagcuaugggagcgguauucacagaggaaaaucaaugggauagcgcucgagcugcaguagaggacgaggaguuuuggaagcuaguugacagagaaagagaacuacauaaacuuggcaaguguggaucuuguguauauaacaugaugggaaagagggagaagaaauugggagaauuugguaaggcaaagggaucuagagcuauaugguacaugugguuaggugcucgauaccuagaauuugaagcucuuggauucuuaaaugaagaucauugguucagucgagaaaauuccuacaguggaguugagggagagggucuacauaaacuagguuacauucuaagagacauaaguaagauccccggcggagcgauguaugcagacgacacagcagggugggacacacgaauuaccgaagaugacuuacacaacgaagagaaaaucacacagcagauggaccccgagcacagacaauuagcgaacgcaauauucaaauuaacauaucaaaacaaaguaguaaaaguacagagaccaacgccaaaaggcacagugauggacaucauaagcaggaaagaucaacgagguaguggucagguaggaacauauggacuuaauacuuucacgaacauggaagcacaacugguaagacagauggagggcgaggguguguugucaaaggccgauuuagaaaauccacaccuccuagagaagaaaaucacucaguggcucgaaacuaaaggugucgaaagauuaaaacggauggcaauaagcggggaugauugcgucguaaagccaauugacgaucgcuucgcgaaugcauuauuagcgcugaaugacaugggaaagguucgaaaggacaucccgcaguggcaaccuagcaaaggguggcacgauuggcaacaaguuccuuucuguucacaccacuuucacgaauugauaaugaaggacgggagaaaguuaguaguacccugucgaccacaggaugaauuaauagguagggcuagaauuagccaaggugcagguuggucacugaaagagacggcaugcuuagguaaagcauacgcgcaaauguggucuuugauguauuuucacagacgugaccugcgauuagcgucgaacgcgauuugcagcgcagucccaguccauuggauaccaacaucaaggaccacauggucaauacaugcacaccaucaauggaugacgacugaagauauguuaacaguauggaauagagucuggauugaagacaacccauggauggaagauaaaacgccuguaacgaccugggaggaugugccauauuugggaaaacgagaggaccaaugguguggcagcuuaaucgguuuaaccagucgggcaaccugggcacaaaauauacuaaccgcgauacaacaaguuagaaguuugauuggugaugaagaguuucuugauuauaugcccuccaugaaaagauuuagaaaagaagaagaaagugaaggagcuauaugguaa

SEQ ID NO: 23472 - RNA, 9873 nt, Artificial Sequence
  derived and/or modified CDS sequence (opt6) from DENV-3__EU482461__SS-prME
acaucgcuuugcuuaaugaugauguugccagcgacauuggcauuucaccuaaccaguagggauggggaaccaagaaugauaguagguaaaaaugaaaggggaaaaagucuacuauuuaaaacagcuagcgguauuaauauguguacauuaauagcuauggaucuaggugaaaugugugaugauacagucaccuauaaauguccuuuaaucgcagaaguugaaccggaagauauagacugcugguguaauuugacaucaacaugggugacuuacggaaccuguaaucaagcuggugaacaucgaagagacaaaagguccguagcauuagcaccgcacguggggaugggcuuagauacucgaacucagacauggaugagugcagaaggagcguggagacagguggagaaaguagaaaccugggcauuaagacaucccggauuuacuauacuggcauuauuuuuagcucauuauauuggaaccucucuaacacagaaaguugugauauuuauauuauuaaugcuaguuacuccaucuaugacuaugcgcuguguuggcgucggaaaccgugauuucguugaggguuuaagcggagcaacuuggguggauguugucuuggaacacggaggauguguaacgaccauggccaaaaauaaaccaacauuggacauugagcuacagaaaacagaagcuacacaauuggcgacacuuagaaaauuauguaucgaaggaaaaaucacgaacauaaccacagauagucgauguccgacacaaggagaagcaauauuaccagaagaacaagaucagaauuacguaugcaaacacacauauguagacagaggguggggaaaugguugcggacuauucgggaaaggaucuuuaguaacuugcgcuaaguuucaaugccuagaaccaauugaagguaaaguuguccaauaugaaaacuuaaaauauacaguaauaauaacaguccauaccggagaucaacaucaaguuggaaaugauacccaaggaguuacaguugaaauuacuccccaagccagcaccguugaagcaguauuaccagaguaugguacacugggucuugaaugcagccccaggacaggauuagauuucaacgaaaugauucuauuaacaaugaagaacaaagccuggaugguccaccgacagugguucuuugacuuaccauuaccguggacaucgggagcaaccacggaaacgccaacauggaaucguaaagagcuguuagugacauuuaaaaacgcccacgcuaagaaacaagaaguaguaguauuagggucacaagaaggggccaugcauacggcucuuacaggggcgacugagauucaaaacaguggagguacuucgauauuugcaggucaucuaaagugucgauugaaaauggauaagcuagagcucaaagggaugaguuacgccaugugccuaaacacuuuuguccucaagaaagaaguaucagaaacacaacauggaacuauauuaauaaaagucgaauauaaaggagaggaugcuccauguaaaauaccauuuaguaccgaagaugggcaagguaaggcccacaacgggcgacuuauaacugccaauccaguagucacuaagaaagaagaaccagugaauauugaagcugaaccaccauuuggcgaaagcaauauaguaauuggaauuggggauaaagccuuaaagauaaacugguauaagaaaggcucaucaauugggaaaauguuugaggcaacagcaagaggggcgaggaggauggccauacugggugacacugcuugggauuuugggagcguagguggggugcuaaauucuuuaggcaaaaugguacaccaaauauucggaagcgcauauacagccuuauuuucgggugugucguggaucaugaaaauaggaauugggguucuauugacauggauaggguugaauaguaaaaauacuagcaugucuuuuagcugcauuguaauugguaucauaacauuguaucugggggcuguaguacaggcggacaugggaugugcaauaaauuggaaagggaaagaacucaaauguggaucugggauauuugugacgaacgaaguucacacauggacugagcaauacaaauuucaagcagauucuccaaagagauuagcuacugcuauugccggugcaugggagaacggcgucuguggaauaagguccaccacaagaauggagaaucuacucuggaaacaaauugcuaaugaauuaaauuauaucuuaugggaaaauaacauaaaauuaacgguuguaguaggcgauauaauugguguccuugaacaaggaaagaggacauuaacuccacagccuauggaacucaaauauagcuggaaaacuuggggaaaagccaaaauuguaacugcagagacacaaaacagcucauucaucauugacggccccaacacgcccgaauguccgucagcaucaagagccuggaauguaugggagguagaggauuauggguuuggcgucuucacuaccaacaucuggcuaaaguuaagagaaguuuacacucaaagcugcgaucaccgacucaugucggcagcuaucaaggaugaaagagcgguccaugcugacauggguuacuggauagaaucccagaaaaaugguucuuggaaauuggagaaggcauccuucaucgagguuaagacguguacauggccaaagagucacacuuuauggaguaaugguguauuagaaucugacaugauaauuccaaaguccuuagcaggcccgauaagucaacacaaccaucggccggguuaucauacacaaacugcagggccuuggcaccuaggaaaguuagaacucgauuuuaauuauugugaagggacgacagucgugauaacugaaaauugcgguacccgagguccauccuuaagaacgaccacuguaucaggaaaacuaauacaugagugguguugccgcaguuguaccuuaccaccuuuaagauacaugggcgaagauggcuguugguauggaauggaaauacgaccaaucaaugagaaggaagaaaacaugguaaagagcuuagucagugcuggcagugguaaaguugauaauuuuacaauggguguucuuugucuagcuauucuuuuugaagaaguuaugcguggaaaauuugggaaaaagcacaugauagccgggguacucuuuacauuuguucuucuauuaaguggacaaauaacauggagagauauggcacacacacuaaucaugauaggcucaaacgccucugauagaauggggaugggcguuacguaccuagcauugauugcuacguucaaaauacagcccuuccuugcacuaggauucuuucucagaaaacuuacuucuagggaaaaucucuuguuaggaguaggauuagcaauggcaaccacguugcaacuuccugaagauauagagcaaauggcuaacggcauagcucuagguuuaaugacacuuaaauuaauaacccaauuugagacauaccaacuauggacggcccuaguaucacuaacgugcucgaauaccauuuucacauugacaguugccuggagaaccgcaaccuuaauacuugcgggagucucgcuauugccacugugucaaucuuccucgaugcguaagacugauugguuaccaaugacuguugccgcaaugggaguaccuccauuaccccuauuuauauucagcuuaaaggauacacccaagcguagaaguuggccguuaaaugaaggcguuauggccgucggguuaguaucaauauuggcuucuucacuuuuaagaaacgacguaccaauggcuggaccccuaguugcaggaggguuauuaauugcauguuauguaauaaccggaacaucggcggauuuaacuguggaaaaagcagcugauguuacaugggaggaggaagcagaacagacaggaguuagucauaaccuuaugaucacaguugacgaugauggaacuaugcgaauaaaagacgaugaaacagaaaacauucucacuguucuccuuaaaacagcacuucugauagucucaggaauauuccccuacagcauacccgcuacccucuuaguauggcacacauggcaaaagcagacgcaacguucaggcgugcuuugggacguuccaaguccaccagaaacucaaaaagccgaguuagaagaaggaguguaucgaaucaagcagcaagggauuuucggaaaaacucaaguuggcgucgguguucaaaaggaaggagucuuucauacaauguggcacguaacuagaggagcugugcuaacacauaauggaaaaagauuagagccaaauugggccuccgucaagaaagaucuaauuucguauggagguggauggagacuuuccgcacaauggcaaaaaggagaagaggugcaagucauagcagucgagccuggcaaaaauccgaaaaauuuucaaacgaugccaggcauuuuucagaccacuacaggugaaauaggcgcaaucgcacucgacuuuaaaccggguacuagcggaucaccaaucauaaaucgugaaggcaaggucguuggucuauacggcaacggaguuguaacuaaaaacggagguuauguaucagguaucgcacagaccaaugcagaaccagauggaccaacaccugaauuggaagaagaaauguuuaaaaagagaaaucucacaauuauggauuuacaccccgguagcggaaaaacucguaaauauuuaccugcaauagucagagaagccauuaaaagacgucuacgaacguuaauacuggcuccaacaagaguaguagcggcggaaauggaagaagcccuuaaggggcuaccaauacgguaccaaacuacugcgacuaaaucugaacauacagguagagagauaguagacuugaugugucaugcgacauucacaaugagacuuuuaucaccugugagaguuccgaauuauaaucuaguaauuauggaugaagcacacuuuacagacccugcaucuauugcggcucgaggcuacauaagcacgagaguuggaaugggagaggcugcagcuauuuucaugacagcgacaccaccuggaaccgcagaagcauuuccacaaaguaaugcgccaauccaagacgaagaacgagauauaccagaacgaucauggaacucaggaaaugaguggauuacggauuucguagggaaaacggucugguucguuccgucgauuaaagcuggaaaugauauagccaauugucucagaaagaauggaaagaaagugauucaacuaagcagaaaaacuuuugacacagaauaccagaaaacacgccuaaaugauugggacuucguaguaacaacagauauaucagaaaugggugcgaauuucaaagcugaccggguuauugaccccagaagguguuuaaaacccgugaucuuaacagacggaccagaacgagucauucuggccggucccaugccaguaacagcggccagcgcagcacagaggagaggacgaguaggacgaaacccucaaaaagaaaaugaucaguauaucuuuacgggccaaccgcucaauaaugaugaggaccacgcgcacuggaccgaggcgaaaauguuacuagacaacauaaacacuccagaaggaauuauuccggcauuauuugaaccagagcgugaaaaauccgcugcuauugauggugaguacagguuaaaaggugagucacgaaaaacauuuguagaauuaaugagaagaggggaucugccuguaugguuggcccauaaagucgcuucugaggguauaaaauacaccgaccggaaaugguguuucgauggagaaaggaacaaucaaauacucgaagagaauauggauguagaaaucuggaccaaggagggugagcggaagaaauuaagaccaagguggcuggaugcuagaacguauucagacccuuuagcuuuaaaagaguucaaagacuucgcggcagggcgaaaaaguaucgcuuuagauuuaguaacggaaauuggacggguuccaucucacuuagccuaucgaacgagaaaugcucuagacaaucuuguuauguugcauacgagugagcauggaggcagagcuuaucgacacgcaguagaggagcuaccagaaacgauggaaacucuauuauuacuuggacugaugauauuguuaacuggcggugcuaugcuuuuucuuauuucagguaaaggaauaggcaaaacaaguauagguuuaauuugcgucauaguuucaagugguaugcuauggauggcggauguaccauugcaauggauagccagcgcaaucguuuuagaguucuuuaugaugguacuucugauuccagaaccagagaagcaaagaacuccgcaagacaaucaguuagccuauguugucauaggaaucuuaacacucgccgcaauuguagcugcgaacgaaaugggucuucuagaaacuaccaaacgugauuugggcaugucuaaggaaccaggaguagucaguccaacaucauaucuagauguugaucugcauccggcaucagccuggacuuuauaugccguagcaacaacaguaauuacucccauguuacgacacacuauagaaaacaguaccgccaacguaucauuagcagcaauagccaaccaggcugucguucugaugggucuggauaaaggguggccgaucagcaaaauggacuuaggagugccacuguuggcauuaggaugcuauucucaagucaaccccuuaacccucacagccgccguuuuauuacuuguuacucauuaugcaaucauugguccaggauuacaagcuaaggcuacccgagaagcgcagaaacgcacggcagcaggcauaaugaaaaacccaaccguagaugguauuaugaccauagauuuagaucccguuauauaugacagcaaauucgaaaaacaacuaggccaaguuauguuauuaguucugugcgcaguccagcuauuacuuaugagaacuucaugggcauuaugcgaagcauuaacacuugcuacaggaccuaucacuacauugugggaaggaucaccugggaaguucuggaauaccacgauagcaguauccauggcaaacauauuuagggguucuuaccuagcaggggcagguuuagccuucuccaucaugaagaguguugguaccggaagacggggcaccggaagucagggcgaaacccugggugaaaaguggaagaagaaacuaaaucaacuaucacguaaagaguucgaucuauacaagaaaucgggaauaacugaaguagauagaacugaagcaaaagaaggguuaaaaagaggugaaacgacacaucacgccgugaguagaggcagugcgaaacuacagugguuuguggaaaggaacaugguaauaccggaagguagagugauagaccucgguugcggacguggcgguuggucuuauuacugcgcgggccuaaagaaagucacugaaguacgcggguacacaaaaggagggccaggucacgaagaaccugugccgaugaguacguauggauggaaucuuguaaagcuaaugagcggcaaggacgucuuuuaucugccaccagaaaaaugugauacgcugcugugcgacauuggggaauccucaccaucaccaaccguugaggaaucgaggacgauaagaguacuaaagauggucgaaccaugguugaaaaauaaucaguucuguauaaaaguucuaaauccguauaugcccacuguuauugagcauuuagaacgucugcaaagaaaauauggggguauguuaguucgaaauccacuuucaagaaauaguacgcaugaaauguauuggauuaguaaugggacuggaaacauagucucuuccguuaacauggugucuagauuacuauuaaacagauucacuaugacacaccgacgcccaacaaucgaaaaagacguugaucuaggggccgggacacgacaugugaaugcagaaccggaaacaccaaacauggaugucauuggugagcgaauaaaaagaauaaaagaagaacauucaaguacauggcauuacgaugaugaaaaucccuauaaaacgugggcuuaucauggaaguuaugaaguuaaagcgaccggcuccgcauccucaaugauaaaugguguuguuaaacucuuaacuaaaccaugggacguagugcccaugguuacgcaaauggcaaugacggacacgacgccguuugggcaacaacguguauucaaagaaaaggucgauacgcgaaccccgaggccuaugcccggaacgcgaaagguuauggaaauuacugccgagugguuguggagaacauuaggacguaauaagaaaccucgauuguguacaagggaagaguucacaaagaaagucagaacuaaugcagcaaugggagccguuuuuacugaagaaaaccaaugggauucagcaagagcggcgguggaagaugaagaauuuuggaagcuaguugauagagagagagaacuccauaaauugggaaaguguggcagcugugucuauaauaugauggggaagagagagaagaaacuaggagaguucggaaaagcaaaagguucgagggcgauaugguacauguggcucggcgcgagauacuuggaguucgaagcucuaggauuuuugaaugaggaucacugguuuaguagagaaaauaguuauucagggguagaaggagaaggcuuacauaaacuaggcuauauacuacgagauaucucuaaaauuccagguggugccauguaugcagaugacacggccggaugggauacgagaauaacagaggaugaccuucacaacgaggaaaagauuacacaacaaauggaccccgaacaucgacaacuagccaaugcuauauucaaacugacuuaccagaauaaagucguaaaaguucagcgucccacacccaagggaaccguuauggauauuauaucuagaaaggaucaacgaggauccggacaaguaggaacauaugggcuaaauacauuuacuaauauggaagcacaguuagugcggcagauggaaggagaaggaguuuuaagcaaagcugaucuagaaaacccucaccuauuagaaaagaagauaacacaauggcuggaaacaaaagguguugagagauugaagagaauggcaauuucuggagacgacuguguugugaagcccaucgaugaucguuucgccaaugcacuacuagcacuaaacgacauggguaaggugcguaaagauauaccacaauggcaaccgaguaaagguuggcacgacuggcagcagguucccuuuuguucucaucacuuucaugagcugaucaugaaagacggcagaaaguuaguagugccauguagaccgcaagaugaauugauuggacgcgcaagaauaagccagggcgccgguuggucuuuaaaagaaacugccugucuuggaaaagcauaugcacaaauguggagucuaauguauuuucaucggcgagaccuaagguuggcuucuaacgccauauguucagcaguaccaguacauuggauuccgacaagccguacuacauggaguauacacgcucaucaccaguggaugacuaccgaagauaugcuuacaguuuggaaucguguuuggaucgaagauaauccauggauggaggacaagacaccggucacgacaugggaagauguuccauauuuagggaaaagagaagaucaauggugugguagcuugaucggauuaacaucccgagcgacaugggcucaaaauauauugacugcaauccaacaaguccgcucgcuaauaggcgaugaggaauuucuagauuauaugcccucaaugaaacgguucaggaaagaggaagaaagcgaaggcgccauaugguaa

SEQ ID NO: 23473 - RNA, 9873 nt, Artificial Sequence
  derived and/or modified CDS sequence (opt6) from DENV-3__EU482462__SS-prME
acgagcuuaugcuuaaugaugaugcuaccugcgacucuagcuuuccacuuaacaagccgagauggggaaccaaggaugauuguaggaaagaacgagaggggcaaaucgcuacuauucaaaacagcgagugggauaaacaugugcacccuaaucgcgauggaccuuggugagaugugcgacgacacgguuaccuacaaaugccccuuaauugcagaaguugagccagaagauauagauugcuggugcaaucucacaaguacuugggucacguauggaacaugcaaccaggccggcgagcauagaagggauaaacgcaguguagccuuagcuccacaugucggaaugggacuagacacacguacccaaacguggaugucagcagaaggcgcguggcgccaagucgaaaaaguagaaacaugggcacuuaggcaccccggguuuacuauauuagcccucuucuuagcacacuauauugguacuucauuaacgcaaaaaguuguaauauuuauacuauuaaugcuaguuacgccaucaaugaccaugcgaugcgucggcguugguaaucgagauuuuguugagggccucucaggagcaacauggguagaugucguuuuagaacauggaggcugugucacaaccauggcacggaauaagccaacccuagauauagaacuccaaaagacggaagccacacaauuagcaacguugagaaaguuaugcaucgaagguaaaauuacuaacaucaccacagauagcagaugcccaacacaaggagaagcaauucucccggaagaacaagaucaaaauuauguuugcaaacauacuuacguugacagggguuggggaaacggauguggauuauuuggcaaaggcucguuaguuacaugugcaaaguuccaaugucuugaaccuauagaaggcaagguagugcaauaugagaauuuaaaauauacuguuauaauuacgguccacacaggugaucaacaccaaguaggaaacgauacccaaggaguuacaguggaaauaacuccacaagcuucgacgguagaagccguuuugccugaauacggcacgcuggggcuagagugcaguccgcgaacaggacucgauuucaacgagaugauacuacuaacuaugaaaaacaaagcauggaugguacaccgccaaugguuuuucgaccucccuuuacccuggaccucgggugccacaaccgaaacaccgacuuggaauaggaaggaacuauuagugacauuuaaaaacgcacacgcgaaaaaacaggaagucguagugcuuggcagucaagaaggggccaugcauacggcuuuaaccggcgcaacugaaauacaaaauucggggggcacaucuauauucgcaggacaucuaaaaugcagguugaagauggacaaauuggaacucaaaggaaugucguacgcuaugugucugaacacauucguccuaaaaaaggaaguaucagaaacccaacauggaacaauccuaaucaaaguugaauauaaaggcgaagacgcaccauguaaaauuccguuuagcacagaagacggacaagguaaagcacacaauggacggcucauaaccgcaaauccaguuguuacuaaaaaagaagagccuguuaauauagaggcagaaccgccuuucggagaguccaauauuguaauaggaauuggugacaaggcauuaaagauaaacugguacaagaaaggcucaucaauugguaagauguuugaagcgacagccagaggagcaagaagaauggcuauacuaggagacacggcuugggauuucgggucuguaggaggaguuuuaaauucacuaggaaaaaugguucaccaaaucuucgguucagcguauacagcguuauucucaggcguuucauggauuaugaaaauuggcauaggaguucuacuuacauggauugggcuuaauuccaaaaacacaucgaugagcuucuccugcaucguaauuggaauaauuacacuuuacuuaggagcaguuguucaagcagacauggggugcgcaauuaauuggaaagggaaagaacucaaauguggaagcgguauuuuuguaaccaacgagguucauaccuggacagaacaauauaaauuccaggcagacucaccuaaacgauuagcgacugcuauugcuggagcuugggagaauggagucuguggaaucagaucaacgacgagaauggaaaauuuauuauggaaacaaauagcgaacgaauuaaacuauauacucugggaaaacaauauaaaauuaacuguugucguaggcgauauaaucggaguauuagagcaaggcaaacgaacgcucacaccacagccgauggaucuuaaauauagcuggaaaacgugggggaaagccaaaauagugacugcugagacgcaaaauucaucguuuaucauagaugguccgaacaccccagagugucccagcgccucacgagcauggaauguaugggagguagaagauuauggauucggugucuuuacaacaaacauauggcuuaaacugagagagguauauacucaaucaugugaccacagauuaaugagugccgcaaucaaagaugaaagggcuguacaugccgauauggguuauuggaucgaaucgcaaaaaaauggaucguggaaauuagaaaaagccucuuucauagagguaaaaacauguaccuggccaaaaagucauacuuuguggucuaaugggguacuagagucagauaugauaauaccaaaaaguuuagccgggccaauaucacaacacaaucaucguccugguuaucauacacaaacagcuggaccuuggcaccuagggaaguuagaguuagacuuuaauuacugugaagguacuacgguuguuaucaccgaaaauugcggaacacggggaccaagccucagaacaacgacagucucaggcaaguuaauccaugaaugguguuguagaucauguacacugccaccucucagauauaugggagaagaugguugcugguauggaauggagauaaggccaaucaacgaaaaggaagaaaauaugguaaaaucuuuggucagcgcggguagugguaaggucgauaauuucaccaugggaguacucuguuuagcaauacuguucgaagaaguaaugcgggguaaauuugguaagaaacauaugaucgcaggaguauuauuuacuuucguacuucuccuaucaggacaaauaacauggaaagacauggcacacacuuuuauaaugauuggaucaaacgcuagugaccggaugggaauggguguuacguaucuggcucucauagcaacauuuaagauacaaccuuucuuggcgcugggguuuuuucugaggaaauugaccagucgugaaaaucuguuacuagggguaggccucgcaauggccaccaccuugcaacucccugaggauauugagcaaauggcaaacgguauagcauuaggacuaaugacucucaaauuaauuacucaguucgagacguaccaacuuuggacagcauuagugagucuaaccugcagcaauacaaucuucacguuaacaguagcuuggcggacagccacgcugguucuugcaggaguuucccuucuuccccuuugccaaucuaguuccaugcguaaaacagacuggcuaccgaugacggucgcagcaauggguguucccccguugccacuuuuuauuuuuagucuuaaagauacaccaaagcgccgaucuuggccacuaaaugaaggcguuauggcuguaggacugguaucaauucuagcauccucacuacuccgaaaugacguaccgauggcuggcccacucguagcaggaggacuucuuauugcgugcuacguuauuacaggaacuagcgcugaucuuacuguugaaaaagcagcagauguaacuugggaagaggaagcggaacagaccggagucucacacaaucugaugaucacgguagacgaugaugggacuaugagaauuaaagaugaugaaaccgaaaauauucuaacaguucuuuugaaaacagccuuacuaauugugucaggaauuuucccauauaguaucccugccacacugcuaguuuggcacacuuggcaaaaacaaacucaacgaagcggggugcuuugggaugugcccucaccaccagagacgcaaaaagcagaacuagaggaagguguauaucggauuaaacaacaaggaauuuuuggcaagacgcaggugggcguagguguacaaaaagaaggaguauuccauacuauguggcauguuacccgaggcgcaguucugacacauaaugggaaacggcucgagcccaauugggccucgguuaaaaaagaucucauaucauauggcggagguuggcgauuauccgcacaauggcagaaaggugaagaaguacagguaauagcagucgaaccgggaaaaaacccaaagaauuuucaaacaaugccuggaauuuuucaaacuacuacaggagaaauaggagccauugcacucgauuuuaaaccuggcacuagcggcucacccauuaucaaucgagaaggcaagguaguaggguuguacgguaaugguguaguaaccaagaauggaggauauguaucgggaaucgcacaaaccaacgcagaaccagaugggcccacuccagaguuagaagaagaaauguuuaagaaacgcaaccuaacuauaauggauuuacauccaggauccggaaaaacucgaaaauauuuacccgcaaucguacgcgaagcuauaaagagaagacuacgaacguuaauccuggcuccaacaagggucguugcagcugaaauggaagaggcucugaaagguuuaccaaucagauaucaaacaacagcuacgaagucagagcacacuggccgagaaauaguggacuuaaugugucacgcgacauuuaccaugcguuuacuaaguccgguacggguuccaaacuauaacuuaauuauaauggaugaagcacacuucacggacccugcuaguauugccgcaagaggcuauauuagcacuaggguaggaaugggagaagccgccgcaauauucaugaccgccacccccccagggacagcagaagcuuuuccacaaucaaaugcaccaauacaggaugaggaaagggacaucccagagagaagcuggaauucuggaaacgaguggauuacagacuuugugggaaagacaguaugguuugucccaucaaucaaggcgggaaaugacauugcuaacugucuccgaaaaaacgggaaaaagguaauacaauuguccagaaagacguucgacacagaguaucaaaaaacacgacuaaacgauugggacuucgugguaaccaccgauaucagcgaaaugggggcaaauuucaaggcggauagagucauagaucccagaaggugucuaaagccagucauauugacugacggaccagaacgagucauacuagccggacccaugccuguuacugccgccagcgcugcgcaaagaagaggucguguaggccggaauccacaaaaagaaaaugaccaauauauauucacaggucaaccgcuaaauaacgacgaagaucacgcacauuggacugaagcgaaaaugcuauuggacaacauaaauaccccggaaggaauaauaccggcucuauucgaaccugaacgugaaaaaucggcugcaauagauggggaauaccgcuuaaaaggggaaagucggaaaaccuucguagaauuaaugcgaagaggagaccuacccguaugguuagcacacaaaguggcuagugaagggauaaaauauacugaucgaaagugguguuucgacggagaacguaauaaccagauucuagaagagaacauggauguagaaauauggacgaaagaaggagaaagaaaaaaacuccgcccacgaugguuagaugcccgcacuuauuccgacccacucgcgcugaaggaauuuaaagauuuugcugcaggaagaaaaaguauagcauuggauuuaguuacugaaauaggaaggguucccagucacuuagcuuaccgaacccgaaaugcucuggacaaucuaguaauguuacacacaagugagcacggaggaagagcauaucgccaugcuguugaagaauugccugaaacgauggaaaccuugcuucuuuugggacuaaugauauuacuuacugguggagccaugcuauuucuaauuucgggaaagggaauugggaaaacaagcauugguuuaauauguguuauagugagcucugggauguuauggauggcugaugucccgcuacaauggauagcgagugcgauuguacuagaauucuuuaugaugguacuacucauuccugagccagaaaagcagagaacuccacaagacaaccagcuagcuuauguugucauaggaauacugacccuugcagcaauaguggccgccaacgagaugggccuacuagaaacuacaaaacgugaccuaggcauguccaaagaaccaggcguaguuagccccacuucauaucuugauguggacuuacauccggcaucagcuuggacccuuuaugcaguagcgacuaccgucauaacaccuaugcugcgacauacgauagaaaauaguacagcaaaugucucucuagcggccaucgcaaaccaggcaguaguacuaaugggacuagauaaaggguggcccauauccaaaauggauuuagguguacccuuauuggcacucggauguuauucucagguuaacccauuaacuuuaacagccgcaguacuacuuuuaguaacucauuaugcaauaauuggacccggguuacaagcuaaagcaaccagagaagcccaaaaacguaccgcagccggaauaaugaaaaauccaaccgucgauggaauuaugacaaucgacuuagaucccguaauauacgacaguaaguuugaaaaacaauuagggcagguuaugcuacuuguauuaugcgcuguucaauugcucuuaaugagaaccucuugggcucuaugcgaggcauuaacauuggcaacaggcccaaucacgacacuuugggagggcucuccagggaaauucuggaauacuacaauagcaguuuccauggcaaacauuuucaggggaaguuauuuagcaggggcuggcuuagcuuuuucgauaaugaagucgguagguacaggaaggaggggaaccggaagccagggagaaacacuuggggaaaaauggaagaaaaaauugaaucaacuuucucguaaagaguuugaccuauauaaaaaaucaggaaucacagagguugauagaaccgaagcuaaagaaggcuuaaaaagaggggagacaacgcaucacgcgguaaguagaggaagugcaaaacuacaaugguuuguagaacguaacaugguaauaccagaaggacguguaauagaccuaggaugcggccgagguggcuggucuuauuauugcgccggacuuaaaaaggugaccgaaguaagaggauacacuaaaggaggaccuggacaugaagaaccuguaccuaugaguacguacgguuggaacauuguuaaacugaugucagggaaagacguuuuuuauuugccuccagaaaagugcgauacauugcuaugcgacauaggugaaagcucuccaucacccacagucgaggagucgaggacaauaaggguacucaaaaugguugaacccugguuaaagaauaaucaauuuuguauaaagguuuuaaaucccuacaugcccacagugauagagcaucuggagagauuacagaggaaauaugguggaaugcuaguacguaauccguuaaguaggaauuccacacaugaaauguacuggaucucgaaugguacggggaauauaguaaguucggucaacaugguaagucguuuacugcuuaaucgauucacaaugacgcacagacgcccgacuaucgaaaaagauguagacuugggggcugguacacgccauguaaaugcagaaccugaaaccccuaacauggaugucauaggggaaaggauuaaaaggauuaaggaggagcauagcaguacguggcauuaugaugaugaaaacccauauaagacaugggcguaucaugguaguuaugaaguaaaagcuacuggaagugcuucaagcaugauuaacggagucgucaaauuacuaacgaaaccgugggauguagugccgaugguaacucaaauggcaaugacagacaccacacccuucggccaacaaagaguuuuuaaagaaaaaguagauacuagaacaccgagaccaaugccuggaacacgaaaaguaauggaaauuacggcagaaugguuauggagaacuuuaggacguaauaagaagccaaggcucugcacucgugaagaauucacuaaaaaggucaggacaaaugcagcaaugggagcgguauuuacugaggaaaaccaaugggauucugcgagagcggccguagaggaugaagaauuuuggaaacuaguggacagggaaagagaacuacauaaacuuggcaagugcgguaguugcguauacaacaugaugggaaaaagagaaaaaaaauuaggugaauucggaaaagccaaaggcagccgagccauaugguacauguggcuaggggcuagguacuuagaauuugaggcacuaggcuucuuaaaugaagaucauugguuuucuagagaaaauuccuauucaggggucgaaggggaagguuuacacaaacucggguauauacucagagauauuucgaagauaccggguggggcaauguaugccgaugauaccgcugguugggauacgaggaucacagaagacgacuuacauaaugaagaaaagauaacucagcaaauggauccagagcaucgccagcucgcaaaugcuauuuuuaaauugaccuaucaaaacaaaguuguaaaaguacaaagaccuacgcccaaaggcacuguaauggauauuauaagucguaaagaucaaagggggucaggccaggugggcacauacgguuugaauaccuuuaccaacauggaagcucaacucguacgucaaauggaaggcgagggaguacuaaguaaagcagaucuugagaacccgcaucugcucgaaaaaaagauaacacaguggcucgaaacaaaagggguagaacgcuuaaagagaauggcaauuucaggagaugacuguguaguuaaaccgauagaugaccgguuugcaaaugcacuucuggcgcucaaugauaugggaaaaguaagaaaagauauaccccaguggcagcccucuaaaggauggcaugauuggcaacaaguaccuuucugcagucaucacuuucacgaacuaauuaugaaagacggaaggaaacuggugguuccaugucggccccaagacgaauugauagggcgcgcaagaauuucacaaggcgcaggcuggucacuuaaagaaaccgcgugccucgggaaagcauaugcacaaauguggucauugauguauuuccauaggagggauuuacgucuggcuucaaacgcaauaugcuccgcugugccgguacauuggaucccgauaaguagaacaaccuggagcauucaugcgcaucaccaguggaugacgacagaggacauguuaacaguguggaaucgaguauggaucgaagauaacccauggauggaagacaagacacccguaacuacaugggaagauguaccguauuuagggaaacgcgaggaccaauggugcggaagucucauaggccuaacgucaagagcaacgugggcccaaaauauccugacagcuauacaacaaguaagaucauuaauuggugacgaagaauucuuagacuauaugccaaguaugaagagguuuagaaaagaagaagaaucugaaggggcuaucugguaa

SEQ ID NO: 23474 - RNA, 9873 nt, Artificial Sequence
  derived and/or modified CDS sequence (opt6) from DENV-3__EU660407__SS-prME
acaagucuuugcuugaugaugauguuaccagcaacacuugcauuucauuuaaccagucgagacggagaaccgagaaugaucguagggaaaaaugaaagaggcaaaucgcuauuguucaaaaccgcuucggguaucaauauguguacgcuuauugcaauggaucucggggaaaugugcgaugauacagugacauacaaauguccacucaucgcggaaguggaaccggaagacaucgauuguugguguaaucuaacaagcacuugggugacguauggcacuuguaaccaagcaggcgaacauagacgagauaaaagaagcguagcauuggcgccacaugucgguauggguuuggacacucggacgcaaacauggaugagugcagaaggugcauggagacaagucgaaaaaguagaaacaugggcacugagacauccuggauuuaccauccuagcacucuuucuugcacauuauauuggaaccagucuaacgcagaaagugguaauauuuauacuacucauguuagucacuccuagcaugacgaugagauguguagguguuggcaauagggauuucgucgaaggacuauccggagcuacauggguagauguuguccucgaacaugggggauguguaacaacaauggccaaaaauaaaccaacucuagacauagaauugcagaaaaccgaagcaacccaauuagcaacacuacgaaaauuauguauagaagguaaaaucacgaauauuacaacagauucacguuguccaacucaaggagaagcaauacugccugaagaacaagaccaaaacuaugucuguaaacauacauacguugauagaggguggggaaauggcugcggacucuuuggcaaagggucacugguaacgugugcaaaauuucaaugucuagaaccaauugaagggaaaguuguccaguacgaaaacuuaaaauacacugugaucauaaccguucacacaggagaucaacaucaaguuggcaaugauacucaaggaguaacgguagaaauuacuccucaagcaaguacugucgaagcaguccuuccugaauaugggacucucggacuagaauguaguccaagaacuggguuggacuuuaaugaaaugauuuugcuuaccaugaaaaacaaggcuuggaugguacaucgacaaugguucuuugauuuaccuuuaccguggacaucaggggcuacgaccgaaacaccaacuuggaaccgaaaagagcuucuaguaaccuuuaaaaaugcacaugccaagaaacaagaaguuguaguucuugggagccaggaaggcgcaaugcauacagcacuuacaggggcuacagaaauucaaaauaguggcgggacgaguauauucgcaggucaccuaaaaugucgauuaaaaauggacaaacuggaacuaaaagggaugucuuaugcaaugugucugaauacauucguacuuaagaaagagguguccgaaacacagcauggaacaauauugauaaaaguagaauacaaaggggaggacgcaccauguaaaauaccuuuuagcaccgaagacggacagggaaaagcucauaaugguagacugauaacugcaaauccgguaguaaccaagaaagaagaaccagugaauaucgaagccgagccaccuuuuggagagucgaacauagugauagguauaggggacaaagcauugaaaauuaacugguauaagaaaggaucuagcauuggaaaaauguuugaggcaacagcccgcggugcuagaaggauggcuauacucggagauacggcaugggacuuuggguccguaggcgggguuuuaaauucgcuaggcaaaaugguucaccagauauuuggauccgcauacacggcauuguucaguggaguuaguuggauuaugaaaauaggaauaggagucuugcuaacguggauagguuugaauagcaaaaauacaucuaugaguuucuccuguaucguuauugguauuaucacuuuauaucucggagcaguaguacaagcugauaugggaugugucauaaauuggaaggggaaagaguuaaaaugugggagugguauauuuguuaccaaugagguccacacuuggacugaacaauauaaauuucaagcugauaguccaaaaagacuagcuacggcgauagcaggagcaugggaaaauggcguuugcggcauaagaucuacaacacggauggaaaaucuauuauggaaacaaauagcuaaugaacuuaacuacauuuuaugggagaauaauauaaaauuaacgguuguaguuggggauauuauagggguguuagaacaaggaaagcgaacacucacaccacagccaauggaauuaaaauacagcuggaaaacuugggguaaagcaaaaauaguuacggcagagacccaaaacuccucauucauaaucgauggaccgaauacaccagaauguccuucggcgaguagggcauggaaugucugggagguagaagauuacgguuuugguguauuuacgacaaacauauggcugaaacuacgagaaguauacacucagaguugugaucaucgauuaaugucagcagcuauuaaagaugaaagggcagugcaugcugauauggguuauuggauagagucucagaaaaaugggucuuggaaacuugaaaaagcaucguuuauugagguaaagacgugcacauggccuaaaagccauacgcucuggucuaauggcguguuagagaacgauaugauaauuccuaagagcuuggcaggaccaauaucgcaacauaaucauagaccaggauaucacacgcaaacagcaggaccauggcaucuagggaaauuagaacuggacuuuaauuauugcgagggaacuacgguggucaucacugagaauugugggacgcgggguccauccuuacgaacuacgacagugucaggaaaauuaauacaugaauggugcuguagauccuguacauuaccuccuuuaagauauaugggagaagaugguuguugguacgggauggaaauaaggccuauaaaugaaaaggaggaaaauaugguuaaaagucuaguaucagcuggcagcggaaaaguggauaacuuuacuaugggaguuuugugccuugcaauacuauucgaagaaguuaugagagguaaguucggcaagaaacauaugauagccggugugcuauuuacuuucguacuucuuuugucgggacagauuacuuggagagauauggcacauacuuuaauuaugauaggaaguaaugcuuccgaccggauggguauggggguuacuuaucuagcacuaauagcaacuuuuaaaauucaaccauuccuagccuuaggauucuuuuuaagaaaguuaacguccagagaaaaucuucuguuaggagugggucuugcuauggcuacuaccuugcaacuaccagaagauauagaacaaauggcaaacgggaucgcacuaggauugaugaccuugaaacuaaucacccaauuugaaacauaucaacuuuggaccgcauuaguaucucuaacuuguagcaauacuauauuuacgcuuacuguugcguggcgcacggcuacucucaucuuagcgggggugagcuuguuacccuuaugucagagcucgucaaugcgaaaaaccgacugguugccgaugacaguugccgcuaugggcguuccuccauuaccuuuauucauauuuucacugaaagauacgccuaaacgucguaguuggccguugaaugaagggguaauggcuguagggcuagugaguaucuuggcuaguagccuucugagaaacgaugugcccauggcuggcccucuaguugcugguggacuacuaauagcgugcuaugugaucaccggaaccucagccgaccucacuguugaaaaagccgcggacguaacgugggaggaggaagcggagcagacuggaguaucacacaauuuaaugauaacaguugacgaugauggaacuaugcguauaaaagaugacgaaaccgagaacaucuuaacaguacuccuuaaaacugcuuuguuaauuguuagcgguauauuuccauacucgauaccagcaacauuauuaguuuggcacaccuggcagaagcaaacacagagaagcggaguuuugugggacgucccaucaccgccagaaacucaaaaagcagaacuagaagagggagucuaccgaauuaaacaacaagggauauuugguaagacacagguaggaguaggugugcagaaagaaggcguuuuccacacuauguggcacgucacucggggugcaguccucacacacaaugguaaacgacuugaacccaacugggcaaguguuaagaaagacuugauuagcuacggugguggauggcgacucagcgcccaauggcagaaaggagaagaaguccaaguuauagcaguugagccugguaagaaucccaaaaacuuucagacaaugccaggaauuuuucaaacaacuaccggugaaauaggagcgauugcucuugauuuuaagcccgguacauccgggagcccuauaauuaaucgagaaggaaaagucgucgggcuauauggaaaugggguagugacuaagaacgggggauauguaucaggaauugcacagacuaacgccgaaccugacggaccuacuccagaauuagaagaagagauguuuaagaaacguaacuuaacuauaauggaucuacacccaggaucagggaaaaccagaaaauaucuaccagcgauaguacgggaagccauuaaaagacguuuaagaacccuaaucuuagcgcccacacgaguaguugcagcagaaauggaggaagcauuaaaaggucuuccgauucgguaccagacgacugcgacaaaauccgagcauacugggagggagauugucgaccuaaugugccacgcaacauucacaaugcgacuguuaucaccuguaagaguuccaaacuacaaucuaauaaucauggaugaagcacacuuuacagacccugcuagcauagcagcacgcggauauauaaguacaagaguagggaugggggaggcugcugcgauauuuaugaccgcgacuccgccgggaacggcagaggcguuuccccaaaguaaugcgccaauacaagaugaggagcgagauauaccagaacgauccuggaacucagguaacgaauggauaacagauuucgugggaaaaacagucugguucguaccaucgaucaaagcaggaaaugauauagcaaacugcuuaaggaaaaauggcaagaaaguuauacaacuaucgcgaaaaacguuugauacugaauaccagaaaacaaaacuuaaugacugggauuucguuguaacuacggauaucagcgaaaugggcgcgaacuuuaaagcggaucgaguuauugaccccagacgaugcuugaaaccagucauuuuaaccgauggaccugaaaggguaauacuugcaggcccaaugccaguuacagcagcuagcgcagcucaaagacggggacgagugggaagaaauccccagaaagaaaaugaucaauauauauuuacaggucaacccuuaaauaaugacgaagaucaugcccauuggacagaagcaaaaauguugcuugacaacauuaauacccccgaaggaauuauuccagcauuauucgaaccagagagagaaaagucugcugcuauagauggagaauaucgacugaaaggcgaaucucgaaaaacuuuuguagaacuaaugagacgaggcgauuuaccuguuuggcuugcacacaaaguggcuagugaagguaucaaauauacugauaggaaauggugcuuugauggagaaagaaacaaccagauccuagaagagaacauggauguagaaaucuggacaaaggagggcgaaaggaagaaacugagaccaagguggcuugacgcucguacauacucagauccacucgcauugaaagaauuuaaagacuuugcagcuggaagaaaaucaauagcauuagaucuuguaacugaaauuggucgagugccgagucaucuagcauaucguacacgaaacgcuuuagacaaucuaguuauguuacauacgagcgaacacggcgggagggccuacagacacgcuguugaggaacucccagaaaccauggaaacccuucuguuauuaggauuaaugauacuacuuaccggaggugcuaugcucuuuuuaauaucgggcaaagguauaggaaaaaccucuauaggucuuauuuguguuauuguuucaagcggaaugcucuggauggcugacgugccacuccaauggauagccucagcaauuguuuuagaguucuucaugaugguacuauuaauuccagaacccgaaaagcagcgcacuccgcaagauaaucaguuagccuacgugguuauaggaauuuuaacacuugccgcaauagucgccgcgaacgaaaugggucuuuuggagacgacuaaaagagaucuaggaaugucaaaagaacccggaguugucucaccaacaucauacuuagauguagaccugcacccugcaucagcuuggaccuuguaugccguagccacaacagucauaacuccaaugcuaagacacacaauugaaaacucgacagcaaauguuucacuugcagcuauagcaaaucaagcggucguguuaaugggacucgacaaaggauggccaauauccaaaauggaucuagguguaccucuacuggcauuagguugcuacagccaggugaauccuuuaacacugacagcugcgguuuuacuacucguuacccauuaugcuaucauaggacccggucuacaagcuaaagcuacacgagaggcccaaaagcgaacugcagcaggaauuaugaaaaauccaacuguagauggcauuaugacaauagaucuggacccagucauuuaugauaguaaauucgaaaaacaauugggacaaguuauguuacucguuuugugugcgguccaacuacuacuaaugagaacauccugggcacuaugugaggcacuaacauuggcuacggguccuauaacaacucuuugggagggcucuccgggaaaguucuggaauacaacuaucgcaguuucaauggcaaauaucuucaggggaucauauuuagcaggcgcaggauuagcuuucucgauaaugaaaucaguugguacgggucgaagaggaacgggaucccagggagagacccuaggagaaaaauggaagaagaaacuuaaccaauuguccagaaaagaauuugaccuguacaaaaaguccgguauaacagaagucgauagaaccgaggcgaaagaaggacuaaagcguggagaaacaacccaccacgcaguauccaggggcucagcuaaguugcaaugguuuguggaacguaauauggugauuccagaggguagaguaauugaucuuggcugcggacggggcgguuggaguuauuacugcgccggucuuaaaagagucacugagguaagaggauauacaaaagggggaccaggucaugaagaaccgguacccaugaguacauaugguuggaauauuguaaaauugaugucagguaaagacguauucuaucuaccuccagagaaaugugauacauuacugugcgauauuggggaauccucgccgagcccaacuguagaagagagcaggacaauuagaguguuaaagaugguagaaccuugguuaaagaacaaccaauuuuguauuaagguauugaauccauacaugccaacaguuauagaacaccuagaacgacuccagcgaaaauauggagguauguugguaagaaauccauuaaguagaaauucaacacacgagauguauuggauaaguaaugguacaggaaauauuguaucuaguguuaacauggugaguagacuacugcuaaacagauuuacaaugacacaccggaggccuaccauagagaaagauguugacuugggagccgggacucgucacguaaaugccgaaccagagacgcccaacauggauguaaucggggaaaggauaaagaggauaaaagaagaacauucuucgacguggcacuaugaugaugaaaacccauauaagacaugggcguaccauggaucuuacgaagucaaagcuacuggaucagcauccucuaugauaaacggugucgucaaauuacuaacuaagccaugggauguggucccaauggugacacaaauggcuaugacagacacaacuccuuucggacaacaacgcguguucaaggaaaaaguagauacuagaacaccgcguccaaugccuggcaccagaaaaguaauggaaauuaccgccgaaugguuauggcgaacccugggacgaaacaaaaagcccagacucuguacgagggaagaguucaccaagaaaguucgaacaaacgcagcuaugggggcgguguuuacagaagaaaaccagugggauucggcaagggccgcagucgaagaugaggaguucuggaagcucguagauagggaacgagaacuccauaaacucggaaaaugcgguagcugcguauacaauaugaugggaaaacgagagaagaaacuuggggaauuuggaaaagcgaaagggagcagagcaauaugguauauguggcucggagccagauaccuagaguucgaagccuugggauuucugaacgaagaucacugguuuagcagagagaacuccuauaguggaguggaaggagaagggcuacacaaauugggauauaucuugcgagacauuucaaagauaccaggaggagccauguacgcugacgauacugcaggaugggauacuaggauaacugaagaugaucuacauaaugaagagaaaaucacccaacaaauggacccugaacaccgacaauuagcaaaugcuaucuucaaauugacauaccaaaacaaaguugugaaaguacaacgucccacaccuaaaggcacaguaauggauauuauaucaaggaaagaucaacgagguaguggacaagucggcaccuacggucuuaacacuuuuacaaauauggaagcacagcuaguuaggcaaauggaaggagaagguguuuuaaguaaagcagaucuagaaaacccucaccucuuggagaagaaaauaacacaguggcuagaaacuaaggggguggagcgauuaaaaagaauggcaauaucaggcgaugauugcgugguaaaacccaucgacgaucguuuugcaaaugcgcuuuuagcccuuaaugauauggggaagguuagaaaagauaucccacaauggcagccaucaaaaggauggcacgacuggcaacagguuccguucugcagccaucauuuucacgaauuaauaaugaaagacggccguaagcucgucguaccgugucggccucaagacgaauuaauaggacgcgcucguaucagccaaggagcagguuggucacuuaaagaaacagcaugcuuaggaaaagccuacgcacaaauguggagucuaauguacuuccauaggagagaucuaagacuagcuucuaaugcuaucuguagugcgguaccugugcauuggaucccuacaagucgcacuacauggagcauacaugcccaccaucaauggaugacaacggaggacauguugacaguauggaacagagucuggauagaggauaacccuuggauggaagauaaaacucccguuacaacgugggaggauguaccguauuuagguaaaagggaagaucagugguguggaucuuuaauaggauuaacaagucgagcaacaugggcccaaaacauuuugacggcuauacaacaagugcgaucucuuaucggagaugaggaauuucuugacuacaugcccaguaugaaaagauuccgcaaagaggaggaaucugagggagcaauaugguga

SEQ ID NO: 23475 - RNA, 9873 nt, Artificial Sequence
  derived and/or modified CDS sequence (opt6) from DENV-3__EU660409__SS-prME
acgagucucuguuuaaugaugauguuaccagcaacccuugcauuccaucuaacuucaagagauggggaaccaaggaugauuguugguaaaaacgaacgagggaaaucauuacuguuuaaaacugcaucaggaauuaauaugugcacuuuaauagcaauggaccuaggggaaaugugcgacgauaccguuacguacaaauguccauuaauugcugaagucgaaccugaagauaucgauugcuggugcaacuugacgucgacuuggguaaccuacggaaccugcaaucaagccggugaacaccguagggacaaacgaucuguagcauuggcaccacauguagggaugggucucgacacgcgaacgcaaacguggauguccgcagaaggggcguggagacagguagaaaaaguugaaaccugggcauugcgucauccaggauuuacgauccucgcuuuauuccuagcgcauuauauuggcacaagucuaacgcaaaaaguaguaauauuuauacucuugauguuggugacacccaguaugacuaugcgcugcguuggagugggcaaucgggauuuuguagaaggguuaucgggggcaacauggguugauguaguauuagaacauggcggauguguuacaacaauggcuaaaaacaaaccgacguuggacaucgaacuacagaaaacugaagcaacacgacuagcaacauuacggaaacugugcauugaaggaaaaauaacaaauauaacaacugauagccggugcccaacacagggagaagcaauauuacccgaggaacaggaccagaauuacguguguaaacauacuuauguggauagaggauggggcaaugggugugggcuuuucggaaaagggucucuaguaacuugcgcaaaauuucagugucuagaauuaauugaagguaaaguuguucaauaugaaaaccuuaaauauacgguaauaauaacaguacauacuggugaucagcaucagguuggaaacgauacacagggcgcaaccguagaaauuacaccacaggcuucaacagucgaagcggugcuaccggaauacggaacacuaggauuagaauguucaccaagaacgggcuuagacuucaacgaaaugauacuuuuaacaaugaaaaacaaggcuuggaugguacaucgucaaugguucuuugaucuaccucuccccuggaccagcggagcgacaacggagacacccaccuggaauagaaaagagcucuuggucacuuuuaaaaacgcacaugcuaagaaacaagaaguaguaguuuuaggaucacaggaaggagcaaugcacacggcacuaacuggugcuacugaaauccaaaacagugggggaacaaguauauuugcaggacacuuaaaauguagauugaaaauggauaaauuagaauugaaaggaaugagcuaugcaaugugcuuaaauacauucguuuuaaagaaagaaguaucagaaacucaacacggaacuauacugaucaaaguggaguauaaaggagaagaugcaccuuguaaaaucccauuuagcacagaggauggacaaggaaaagcgcacaauggacgacuaauaacggcgaacccuguaguaacgaagaaagaggaaccaguuaauauagaagcugagccgccauucggugaaucaaauaucguaauaggaaucggagauaaagcacucaaaauuaauugguauaagaaagguucaucgauagggaaaauguuugaagcaacagcacggggcgcaagaagaauggcgauuuugggggacacugcaugggauuuuggcucuguaggaggaguauuaaacuccuuaggaaaaaugguacaccaaauuuuugguuccgcguauacagcacuguuuagcggcguuaguuggauuaugaaaauagggauaggcguacuucucacuuggauaggauuaaauucuaaaaauacaucuaugagcuuuaguuguauagcuauagggauaauaacacuauauuuaggugcagucguacaagcugauauggguuguguuauaaacuggaaagguaaagaauuaaaauguggcucugguauauucgucacaaaugaaguacauacauggacggaacaguauaaauuucaagcggauucgccaaaacgacuagcgacagcaauugcuggggcaugggaaaauggagucugugguauaagguccacuacgagaauggaaaacuuacuguggaaacaaauugcuaacgaauuaaacuauauauuaugggagaauaacauaaaauuaaccgucgugguuggagacauuauagguguucuagagcaagggaaacgaacccucacuccacagccgauggaauuaaaauauucguggaaaaccuggggaaaagcuaaaaucguaacugcagaaacucaaaauuccaguuucaucauagauggcccuaauaccccggaaugcccuagcgccagccgcgcuuggaacgugugggaaguugaagauuacggauuugguguauuuacaacuaacaucugguuaaaacuccgcgagguuuauacgcaauccugcgaucauagacugaugagcgcugcaauaaaagaugagagagcaguacacgcugacaugggcuacuggauagagucucagaaaaauggcaguuggaaacuagaaaaggcuucauucaucgaagugaaaaccugcacuuggccuaaaagucacacacuguggucaaauggaguuuuagaaagugauaugauaaucccaaaauccuuggcaggacccauuucacaacauaaccaucggccuggcuaccauacgcaaacugcagggccuuggcaucuagggaaacucgaguuagacuuuaauuauugugaggggacgaccgugguuauuacagaaaauugcgggacccgugguccuagccugcgaacuaccacagucucaggaaagcuaauacaugaauggugcugcagaucauguacuuuacccccauugagauauaugggagaggacgguuguugguaugguauggagauacguccuauuaacgaaaaagaagaaaauaugguuaagucccuugucagugcuggaagugguaaaguagauaauuucacgaugggggccuuaugccuggcgauacuguuugaggaagugaugagggguaaguuuggcaagaaacauaugauugcaggaguacuguuuacauuuguacugcuucuaucaggacaaaucacguggcgugauauggcacauacguugauuaugauaggauccaacgcuucugacaggauggguaugggugugacauauuuggcccuuauugccacguuuaaaauacaacccuuucuagcucuaggauucuuucuccgcaaguuaacaagccgggaaaaucuuuugcuaggugugggacuagccauggcgacaacccugcaauuaccggaggacauugaacaaauggcaaaugguauugcacuaggcuuaaugacacuuaaauuaaucacucaauucgaaacauaucaguuguggacugcccuaguaucguugaccuguagcaauaccaucuucacguuaacaguagcuuggagaacggcuacccucauuuuggcaggggugucguugcuuccauuaugccaaucaaguaguaugcggaagacagauuggcuaccgauggcgguggcagcaaugggaguacccccacuaccgcuuuucauauuuucauugaaagauacuccaaaaaggcgaaguuggccacuaaaugaaggaguaauggcugucggacucguuaguauacuugcaaguucguuacugagaaacgauguaccaauggcagguccguuagucgccggugguuuacuaauugcuuguuauguaauuacaggaaccagcgcagaccucacuguugaaaagguugcugaugugacaugggaagaagaggcagaacaaacugggguuagucacaaccuaaugauaacaguugaugacgaugggacaaugcggauaaaagacgaugagacugaaaacauauuaacuguacuguuaaaaacagccuuauuaauuguuagcggcauauucccuuauaguauaccagcgacacuucuaguauggcacaccuggcagaaacaaacacaaaggucaggaguacuuugggauguaccaaguccucccgaaacacagaaggcagagcucgaagaaggcguguaucguauaaaacagcaggguauauucggaaagacacaggugggagugggcguacaaaaagaaggcguauuucauacaauguggcauguuacacgcggugccguacugacccauaacgguaagagacucgaaccaaauugggcaucagucaagaaagaucuaauaucauauggaggggguuggagacuuucugcucaguggcagaaaggugaggagguccagguuauagcaguagaaccaggaaagaacccuaaaaacuuucaaacaaugccuggaauuuuccaaaccacuacaggugaaauaggagcgaucgcuuuagacuuuaagccugggacaagugggaguccaauaauaaacagagaagguaaaguuguaggcuuauaugggaacgguguugugacaaagaacggagguuauguaaguggaauagcacaaacaaaugcugaaccagaugguccgacgccggaauuagaggaggaaauguuuaagaaaagaaaccuuacaaucauggaucugcaccccggaucggguaagacccguaaauauuuaccugcaauaguaagagaagcuauuaagcgucgccuccggacauugauacuugcacccacacgaguuguagcagcagaaauggaggaggcuuugaagggauugccaauccgcuaccaaacuacagcaacuaaaucggaacacacaggaagggaaauuguagauuugaugugccaugcuacguucacaaugagacugcucucaccuguucguguuccaaauuauaacuuaaucauuauggacgaagcacacuucacugaucccgcgucgaucgcagcaagaggcuacauaucuacucguguagggaugggagaagcggcagcgauauucaugacagcgacaccaccuggcaccgcagaagccuucccacaaucuaaugcuccgauucaagaugaagaacgagacaucccggagagaaguuggaacucugguaacgaauggauaaccgauuucguaggaaagacaguaugguucguuccaucgauuaaagcuggaaacgacauagcuaacugccucaggaaaaaugguaaaaagguuauccagcuaucucgaaagacuuuugauacagaauaucagaaaaccagacuaaaugauugggacuucguuguaacaaccgauauuucggaaaugggagcuaacuucaaagcagauagagucauugaucccaggagaugcuugaaaccaguaauucuuacagauggccccgagagagucauucuugccgggcccaugccagugacugcugcgucggcggcgcaacgucgaggacgagucgggcgaaauccucagaaggaaaacgaccaauacauuuuuaccggccaaccacuuaacaacgaugaggaucacgcacauuggaccgaagcuaaaauguuacuugauaacauaaacacuccggaaggcauaauacccgcacuauucgaaccugaaagagaaaaaucugcggcuauugauggggaauaccgccuuaaaggggaaagcagaaaaacguucguagaauuaaugcgucgaggggaccugcccguauggcuagcucauaaggucgcuucagaaggaauuaaauacacagacagaaaaugguguuuugauggagaacgaaauaaccaaauccuagaagagaauauggacguagaaaucuggacuaaagaaggggaaaggaagaaacuaaggccaaggugguuagaugcgaggacuuacagugacccgcuugcacuuaaagaauuuaaagacuuugcagcaggacguaaaucaauagcgcuagaucugguuacugaaauaggcaggguaccuagucacuuagcauaccggacucgcaacgcacuagacaauuuaguaaugcuucauacaagugagcauggugggagagccuauaggcaugcaguugaagaacugccugaaacuauggaaacucucuuauuauuaggcuuaaugauauuacuaacuggaggggcuaugcuauuccuuauuaguggaaaaggaauaggcaagacgaguauaggacuuauaugugugacagugaguaguggaauguuguggauggcagacguuccacugcaauggaucgccucugcaauugucuuggaauuuuucaugaugguguugcugauaccggaaccugagaaacaaagaacaccacaagauaaccaacuagccuaugugguaaucgguauacugacgcuagcagcaauaguugcagcaaacgaaauggguuuacuugaaacaacaaagagagaucuagguaugagcaaggaaccagguguuguuucgcccaccagcuaucuagauguagaccuucaccccgcaucggcguggacacuauacgcaguugcuaccacgguaauaacuccuaugcuucgacauacgauugaaaauuccacggcaaauguuucacuggcggcaauagcgaaccaagcagugguauuaaugggacuggauaaaggauggccaauaucaaaaauggacuuaggaguucccuuacucgcuuuaggaugcuacucccaaguaaauccguuaacccugacagcugcaguacuacuucucguaacccacuacgcaauaauagguccaggacuacaggcaaaagccacucgugaggcucagaaaagaacagcagcgggcauaaugaagaauccaaccguggaugggauuaugacuaucgaccuugauccaguaaucuacgacucaaaauuugaaaaacaauuaggucaagugauguuauuagucuuaugugcuguccaacuacuacuaaugaggaccaguugggcguuaugugaagcucuaacuuuagcgacuggcccuauaacaacacuuugggagggcagccccgggaaauuuuggaauacuacaauagcaguuaguauggcuaauauuuuucgagguaguuaucuagccggagcagguuuagcguuuucaauaaugaaaucaguaggaacuggucgaaggggaacugguucccaaggcgaaacacuaggcgaaaaauggaagaagaaauuaaaucaacuaagccguaaagaauuugauuuauauaaaaagucugguauuacugaaguagaccgaacugaagcaaaagaagggcuaaagcgaggcgaaacgacccaccaugcuguuaguagaggaucagcuaaguuacagugguuuguugaaagaaauauggucauacccgaaggucguguuauagaucucggauguggacgaggcggcuggaguuacuacugugccggucuaaagaaaguaaccgaaguacgaggcuacaccaaggguggaccuggccacgaagaaccaguaccaauguccacauacggauggaauaucguaaaauugaugucuggaaaagauguguucuacuuacccccggaaaagugugauacguugcucugugauaucggugaaucgaguccuagcccaacgguagaagaaucgaggacaauaagaguucuuaaaaugguugaaccuuggcuuaaaaauaaucaauucuguauaaaaguacugaauccuuacaugccgaccguuauagaacauuuagagagauuacaaagaaaguauggaggaaugcuaguucguaaccccuuaucuagaaacuccacacaugagauguacuggauaagcaauggcaccgggaacauagucucaagcguaaauauggucuccagauuauugcuaaauagauucacuaugacccacagacgaccgacuaucgagaaagacguagaucugggugccgggacgagacacgucaaugccgaaccggaaacgccaaauauggauguaauaggagaaagaaucaaaagaauuaaggaagaacacagcaguacauggcauuacgaugaugaaaauccauacaaaaccugggcguaucacgguucguaugaggucaaagccacugguucggccucuucaaugauaaauggcguuguuaaauuauugaccaaaccaugggauguaguuccaaugguuacgcagauggcuaugacagacacuacucccuuuggucagcaaagaguauuuaaagaaaagguugacacaagaaccccuagaccaaugcccggaacuagaaaaguuauggagauaacugcagaauggcucuggaggacuuuagggaggaacaagaaaccucgucucuguacucgggaggaauuuacgaagaaaguacgaacaaaugcggcaaugggagcaguguucacugaggaaaaccaaugggauucugccagggcagcagucgaagacgaagaguuuuggaaguugguagacagagaaagagaguuacacaaacuagguaaguguggaucuuguguauauaauaugauggggaaacgagaaaagaaacucggagaguucgggaaagcaaaggggaguagagcuauaugguacauguggcuaggcgcacgcuauuuggaauuugaggcacuaggcuuucuuaaugaagaucauugguuuucgcgggagaauaguuauuccggaguggaaggagaaggacuacauaaguuaggauacauucucagagauauaucaaaaaucccggguggagcgauguacgcagaugauacagcuggaugggauaccagaaucaccgaagacgauuugcauaacgaagagaaaaucacucagcaaauggauccagaacauaggcaauuggcaaacgcuauuuuuaaacuuacauaucaaaauaaaguagucaaaguacaaagacccaccccgaagggaacugugauggacauuaucagcagaaaagaucagagggguucgggucagguaggcacuuacggacugaauacauuuacgaauauggaagcccaacucguaagacagauggaaggagaagguguauuaucaaaagcugacuuagagaauccccaucuauuggagaagaaaaucacacaauggcuagagacuaaaggcguagaacgacuaaagcgaauggccauuucgggcgaugauugugugguuaaaccuauagacgaucgcuucgccaaugcacucuuagcccuaaaugacauggggaagguaaggaaagauauuccgcaauggcagccaaguaaggguuggcacgauuggcaacaagugccguucugcagucaucauuuucacgagcuaauuaugaaagacgguagaaaguuagucguucccugccguccucaagaugaauuaauaggacgggcacgaauaucacagggagcagguuggucccuaaaggaaaccgccugucuggggaaggcauaugcgcagauguggagucuaauguauuuccauaggagagauuugagauuagcuucaaaugcaauauguucggcgguuccaguucacuggauuccgacgaguagaacaacguggagcauccacgcacaucaucaauggaugacgacugaagauaugcuaacgguauggaaccguguuuggaucgaagauaauccauggauggaagauaaaaccccgguuacgacuugggaagauguaccauaccugggaaaacgagaagaccaaugguguggaucacuaauaggucugacuucaagggcaacaugggcacaaaacauuuugacugcaauucaacaaguuagaagucugauaggagacgaggaguuccuugacuauaugccgucgaugaagagauuuaggaaagaagaggaaucggaaggugcuauaugguga

SEQ ID NO: 23476 - RNA, 9873 nt, Artificial Sequence
  derived and/or modified CDS sequence (opt6) from DENV-3__EU660410__SS-prME
acaaguuuaugccuuaugaugauguuacccgcaacucuugcguuccaucuaacaagucgagacggggaaccaagaaugauagucgguaaaaaugaaaggggaaaaucacuguuauuuaaaaccgcgagcggaaucaauaugugcacuuuaauagcuauggaucuaggggaaaugugugaugauacaguaacauauaaaugucccuuaauugcagaaguggaaccugaagacauagauugcugguguaaucuaaccaguacuuggguuaccuauggaacauguaaccaagcuggugaacacagacgagauaaaagaagcgucgcccuugcuccgcacguuggaauggguuuagauacaagaacccaaaccuggauguccgcugaaggagcguggcgacaaguugaaaaaguagaaacaugggcauuacgacacccagguuucacgauccuugcgcucuuuuuggcccauuacauuggaacaagucuaacacaaaaaguaguaauauuuauauuauuaauguuaguaacaccuucuaugacuaugcgcugugucggcgugggaaacagggauuucguagagggauugucaggagcuacuugggucgauguaguucuggaacacggcggaugcguuaccacaauggcgcggaacaaacccacuuuagauauugaauugcagaaaaccgaagcaacccaacuggcaacccugagaaaacuaugcaucgaaggaaaaauuacgaacauaaccacugauucacguuguccuacucaaggugaagcuauacuaccugaggagcaagaccaaaauuauguaugcaaacauaccuacguugauagagggugggguaauggaugcggacuauuugguaaaggcagucucguuacaugcgcgaaauuccaaugcuuagaaccuauagaaggaaaagucguccaauaugaaaauuuaaaauauaccgugaucauaacagugcauacgggagaccagcaucaaguaggaaacgauacccaaggagucacaguagagauuaccccacaagcaaguaccguagaagcaguacuuccagaguacgguacauugggcuuagaaugcaguccaagaaccggacuugacuucaacgaaaugauacucuuaacgaugaaaaacaaagcauggaugguacacagacaaugguucuuugaccuuccccuuccuuggacgaguggugcaacuacugaaacccccacauggaauagaaaagagcuauuggugacauucaaaaaugcccaugcgaagaaacaagaaguuguuguuuuaggcucacaagaaggggcgaugcacaccgcauuaacaggggcaacggagauccaaaacucuggcggaacgucaauuuuugcgggccaccuaaaaugucggcucaaaauggauaaacuagaauugaaagguaugucuuaugcaauguguuuaaauacauuuguuuuaaagaaagaaguaucugaaacucaacacgguacuauucuuauuaaaguagaauauaaaggagaagaugccccuuguaaaaucccuuuuucaacagaagauggacaaggaaaagcucacaacgggcguuuaauaaccgcaaacccuguugucacuaagaaagaggagccaguuaauaucgaagcagaaccuccguuuggcgaauccaauauuguuauaggaauaggagauaaggccuuaaaaauuaauugguauaagaaaggaucuucaauugguaaaauguuugaggccaccgcacguggagcccgcagaauggcuauucuaggcgacacugcaugggacuucggaucaguugguggagucuuaaauucucuuggaaaaaugguccaccaaauauuuggaagugcauauacugcucuguuuagcggaguuagcuggaucaugaagauaggcauugggguacuacucacguggaucggcuugaauagcaaaaauacaaguauguccuuuucauguauaguaauaggaauaauuacacuuuaccuuggagccguuguacaagcugacaugggaugugcgauuaacuggaaaggaaaagaauuaaagugugggucgggaauauuuguaacuaaugaaguucauacuuggacugagcaguacaaguuccaggcggauucaccaaaacguuuggcuacggccauagccggugcaugggaaaauggaguuuguggaauaagauccacuacucgaauggaaaaucuacuguggaaacaaauagcgaacgaauuaaauuauauacuuugggaaaacaauauuaaacuaacuguuguuguuggagauauaauaggagucuuagaacaaggcaaacgcacacuaacuccacagcccauggagcuaaaguacucauggaagaccuggggcaaagcaaaaauaguaacggcagaaacacaaaauucaucauucaucauagauggaccuaacacucccgaauguccuucagcgucaagagcguggaauguaugggaaguagaggauuaugguuucgggguuuuuacaacuaacaucuggcuaaaacuaagggaagucuauacacaaucuugugaucauagauuaauguccgccgccauaaaagaugaaagggcaguacaugccgacaugggcuauuggauagaaucacagaaaaauggaagcuggaaguuagaaaaagcgucguuuauagaaguaaaaacguguacguggccgaaaucucauacguuguggucaaauggaguacuugaaucugauaugauuauacccaagagcuuagcgggaccaauaagucaacacaaucauagaccaggguaucauacucagaccgcuggcccguggcacuuagguaaacuagaacuugauuuuaauuacugugaagggacgacgguagugauuacugagaauugcggcacccgaggaccauccuuacgaacaacaaccguuagugguaaacugauucaugagugguguuguagaagcugcacuuugcccccuuuacguuauaugggagaagaugguuguugguauggcauggaaaucaggccaauaaacgagaaggaagaaaacauggugaaaagccuaguaagugcaggaucagguaaggucgacaauuucacgauggggguacuuugucuagcgaucuuauuugaggaaguaaugaggggcaaauucggcaagaaacacaugauagcaggcguccuuuucacauucguauuacuauuauccggccaaauaacauggagagauauggcgcauacuuucauaaugauuggcucuaaugccucagacagaaugggaaugggcguuacauauuuagcccuaauagcuacauucaaaauacaaccauuuuuggcacuaggauucuuucuccgaaaauuaacuucaagagaaaaccuacuauugggaguagggcucgcuauggcaacaacacuacaauuacccgaagacauagaacagauggccaacggcauugcucuuggucuuaugacauuaaaacuaauaacgcaauucgagacauaucagcuguggacugcauugguuucauuaacauguucgaauaccauauucacacuaacaguagcguggagaacagcaacccuuguucucgccgguguuucccuucucccacuaugucaaaguucgaguaugcguaaaacugacugguuaccgaugacaguagcagcaauggggguaccaccuuuaccauuguuuauauuuucacuuaaagacaccccaaaaagaagaucguggcccuugaaugaaggcguuauggcugugggccuagucaguauauuagcuucgagucuuuuacggaacgaugugccgauggcugggccauuaguggccgguggucucuuaauugcuugcuauguuauaacagguacaucugcggaucucaccguggaaaaggcagcugacguuacaugggaagaagaagcagaacaaacgggaguaucucauaauuuaaugauuacaguagaugaugacggcacuaugagaaucaaagaugaugagacagaaaauauuuuaacaguuuuauugaagacugcccuguugauagucuccggaauauuuccauacaguauuccugcuacucucuuaguguggcauacuuggcaaaaacaaacacagaggaguggaguccuuugggacguaccaucaccgccugagacccagaaggcagaacuggaagagggcguauauagaauaaaacaacaaggaauauucggcaaaacacagguaggagucggaguucaaaaggaaggugucuuccacacaauguggcauguuacuagaggagcaguauuaacgcacaaugggaaaagguuagagccgaacugggcuucugugaagaaagaccuuauuagcuauggggguggauggcgauuaagcgcucaguggcaaaaaggagaagaaguacaaguuauugcaguggaacccggcaaaaaccccaaaaauuuccaaaccaugccuggaaucuuucaaacaacaacaggagaaaucggggcgauugcacuggauuucaaaccagguacaucagguucgcccauuauaaauagggaaggcaaagucguagguuuguaugggaauggcguuguaacuaaaaacggaggcuaugugagcggcauagcgcagacuaaugcagaaccugacggcccaacgcccgaauuagaagaggagauguucaagaaacgaaacuugacgauuauggacuugcacccgggaucgggcaaaacucguaaauacuugccagccauaguuagggaagcuauaaaaagaagguuaagaacauuaauauuagccccaacgagaguagucgcugcggagauggaagaggcauuaaaaggguuaccuauaagguaccaaacaacagcuacuaaaucugagcauacuggaagagaaauuguggaucucaugugucacgcuaccuucacaaugagauuacuauccccaguuagaguaccaaacuauaauuugauaauuauggacgaagcgcacuuuaccgauccagcuucaauagccgcaagaggauauauaucuacacgcguuggaaugggcgaagcggcagcaaucuucaugacagcgacgccuccugggacagcagaagcguuuccgcagaguaaugcacccauucaagacgaggagcgugacauaccugaaagaagcuggaacaguggaaaugaauggauaacugacuucguaggaaaaacgguaugguucguucccucgauaaaagcagguaaugauauugcgaacugucuccgcaaaaauggaaagaaagucauacaacuaaguagaaaaacauuugauacugaguaucagaaaacuagauugaacgauugggacuuuguaguuacaacagacauuucagaaaugggcgcaaacuuuaaggcagacagggucauugauccaagacguugccucaaaccaguaauccuaacagaugguccagaacgaguuauauuagccggacccaugccaguaaccgcagcuucagcagcucaacggagaggccggguaggaagaaacccccaaaaggaaaacgaucaguacauauuuacaggucaacccuuaaauaacgaugaagaccaugcacauuggacggaagcaaaaauguuauuagacaacauuaacaccccagagggaauaauaccggcucuuuuugaaccagagagagagaaaagugcggccauagauggugaauauagacuaaaaggugagagucgaaaaacuuuuguugaacugaugagaaggggcgauuuacccguauggcuagcacauaaagucgcaagugagggaauaaaauacacagaccgaaaauggugcuucgauggugaacggaauaaucaaauauuagaagaaaacauggauguagaaaucuggacuaaagagggugagcgaaagaaauugagacccagaugguuagacgcuaggacauauucggauccgcuagcguuaaaagaguuuaaggauuucgcggcgggcaggaagucgaucgcguuagaccuaguaacagaaauagggagaguuccaucucacuuggcauauagaacacgaaaugcacuugauaacuuggugauguuacacacaagcgagcacgggggaagggcuuacaggcaugcuguugaggaauuacccgagacuauggagacuuuauuauuauuaggauuaaugauauuauuaacaggaggagcaaugcucuuucuuauuaguggaaaagguauugguaaaacaagcauagggcuaauaugcguaauagugucgucgggaaugcuauggauggcugauguaccccuucaauggauugcgagcgcaaucguauuagaguucuucaugaugguauuauuaauaccggagccagaaaaacagagaacaccccaagacaaucaacuugcauaugucguuauugguauucuuacacuagcugccaucgucgcugcgaacgaaauggggcuucucgaaacgacgaaaagagaccuuggaaugaguaaagaaccggguguaguaucaccaacgagcuauuuagauguugaccuucacccugcaucagcauggacauuauaugcaguggcuacaacagugauaacaccuaugcugaggcacacuauugaaaauagcaccgccaacguuucauuggccgccauagcuaaccaggcuguaguacuuaugggacuagauaaaggauggccaaucaguaagauggaucuaggagcaccuuuacuagcucuaggauguuacucccaaguuaacccucuaacauugacagcagcaguguuauuacugguaacucauuacgcuauaauaggaccuggauuacaagcgaaggcaacucgagaggcucaaaaacguacagcagcaggaauaaugaagaauccgacaguugauggaauaaugacuauagauuuggacccaguaauuuacgauucuaaauuugaaaaacaauuaggucaagucaugcuauuggucuuaugugcggugcaacucuuacuaaugagaacaucuugggcauuaugcgaagcacuaacgcucgcuacaggcccaauuaccacucuuugggaagguucgcccggcaaauuuuggaacacuacuauagccgugagcauggccaauaucuucagagguaguuacuuagccggcgcaggccuugcuuuuuccauuaugaaaaguguaggaacggguaggagagggacaggaucccagggagaaacacucggcgaaaaguggaagaagaaacuaaaccagcucucaagaaaagaauuugaucucuacaagaaaucaggaauuacagagguugaucgaacugaagcuaaagagggauugaagagaggagagaccacacaucaugcgguuagucgcgguucugccaaacuccaaugguucgucgaaaggaauaugguaauacccgaagguagggucaucgacuuagguugcggacgaggugguuggucauauuacugugcaggacuaaagaaaguaacugaaguacggggauauacaaaaggaggaccaggacacgaagaaccaguuccaaugucgacauacggcuggaacauaguuaaacuaaugagcggaaaggauguauuuuacuuaccaccugaaaagugugauacacuguuaugugauauuggagaaaguucuccaucuccgacgguugaagaaucccgaacuauacgcgugcugaagaugguagagccuuggcucaaaaauaaccaguuuuguauaaaaguccuaaacccuuauaugccuaccguuauagagcaucuggaaagacuacaacgaaaauacgggggcaugcuaguccggaacccauugagccgaaacaguacucacgagauguauuggauuaguaacggaaccggaaacauuguaaguuccguaaacauggucucgcgacuuuuauuaaauagauuuaccaugacucaucggcgacccacgauagaaaaggacguagaccugggagcaggaacccggcacgugaaugcggaaccagaaacuccgaacauggaugugaucggagaacgaauaaaaaggauaaaagaagaacacagcucgacauggcauuacgaugacgaaaauccauauaaaacaugggccuaucacggaucauaugaagucaaggcaaccgggucagcgucaaguaugauaaacggaguaguaaaauuauuaacaaaaccuugggaugucguuccgaugguuacgcaaauggcuaugacagauacaacaccuuucggccagcaacgugucuuuaaagagaaaguugauacaagaacgccaagaccuaugccgggaacaagaaaaguaauggaaauuaccgcggagugguuguggaggacuuuaggacggaauaagaaaccaaggcuuuguacacgggaagaauuuacgaagaaaguacgaaccaaugcugcaaugggugccguauuuacagaggaaaaucaaugggacagcgcuagagcugcuguugaggaugaagaauuuuggaaacugguagacagagaaagagagcuccauaaacuggguaaaugcggaucauguguuuauaauaugaugggaaaacgcgagaagaaacuaggagaguucgggaaagcaaaaggcucaagagcuauaugguacauguggcuaggagcacguuaucuagaguuugaagccuuaggcuuuuugaaugaggaucacugguuuaguagagaaaacucguauucgggcgucgagggggaaggccuccauaagcuaggauacauuuuaagagauauaaguaagauaccaggcggugcuauguaugcagaugauacagcggggugggauacacggauaacagaagaugaccugcauaaugaagagaaaaucacacagcaaauggauccagaacauagacaacuggcuaaugcuaucuuuaaacuuacauaucaaaauaaaguggucaaaguccaacggcccacgccaaaaggaacaguuauggauaucaucagucggaaggaccaaagggguuccggacaagugggaacauacggucugaacacuuuuacaaacauggaagcacagcuuguaagacagauggaaggcgaggguguauugucaaaagcggaucuagaaaacccacaucuauuggagaagaaaaucacucaguggcuagaaacaaaaggaguagagcgacucaaacgcauggcuauauccggcgacgacugcguuguaaagccgaucgaugaucgcuucgcaaacgccuugcucgcauugaaugacaugggaaaggugcgaaaagauauaccacaauggcaaccuaguaaagguuggcaugauuggcaacagguaccauuuuguagccaucacuuccacgaauuaaucaugaaagacggaagaaagcucguaguuccaugucgcccucaagaugaauuaauugggagagcuagaauaagccaaggagcaggauggucgcuuaaagagacggcauguuuagggaaggcuuaugcucaaauguggagucuaauguacuuucacaggagagaccuucgccuagcuaguaaugcgaucuguuccgcaguaccaguucacuggaucccuauaucacguacgacauggaguauccaugcccaucaucaauggaugacaacagaagacauguuaacaguauggaauagaguuuggauugaagacaauccguggauggaggauaagacaccgguaacgacgugggaggauguuccauacuugggcaaacgagaggaccaguggugcgguuccuuaauaggauugacuagcagagcaacaugggcucagaauauauugaccgcaauccagcaagucagaucauuaauuggugacgaagaguucuuagauuauaugccuucaaugaagagauuccgcaaagaagaggaaucugaaggagcaauaugguaa

SEQ ID NO: 23477 - RNA, 9873 nt, Artificial Sequence
  derived and/or modified CDS sequence (opt6) from DENV-3__EU660411__SS-prME
accagucucugccugaugaugaugcuacccgcgacccuagccuuucaccuaacgucaagagacggggaacccagaaugauagucggaaaaaacgaacgugguaagucuuugcuauuuaagacagcaucagguaucaacaugugcacuuuaauugcaauggaccuaggugaaaugugugaugacaccguaacuuacaaguguccccuaaucgccgaaguggaaccagaagacauugauuguugguguaaucuaacuucaacauggguaacuuacggaaccuguaaucaagcgggagagcauaggagagacaaacggucaguggcccuugcgccacacguuggaaugggguuagauaccagaacacaaacuuggaugagcgccgaaggagcguggcgccaaguugaaaaaguagaaacaugggcguuaaggcauccagguuuuacaauuuuagcacuuuuuuuagcucauuauaucggaacaaguuuaacucaaaaaguaguaauuuucauccuacucauguuaguaacuccuagcaugaccaugcgaugugucgguguaggaaaucgggauuuuguggaaggauugucaggcgcuacauggguggacguaguccuggaacacggaggaugcguaacgacuauggcuaaaaacaaaccaacacuugauauagagcuacagaaaaccgaagcaacacaauuggccacccuacggaaacuauguauugagggaaagauuaccaacauuacaacagauucccggugcccgacacaaggggaggcuauucuaccagaagagcaggaccaaaauuauguauguaaacacacuuaugucgaccguggaugggguaacggauguggucucuuuggcaaagguucgcuagucacaugugcaaaauuccaguguuuagagccuauugaaggcaagguaguccaguaugaaaaucuaaaauacaccgugauuauaacaguucacaccggugaucagcaccaaguagguaaugacacucagggcguuacaguagaaaucacuccccaggcaucaacggucgaggccguacucccagaauacgguacucugggguuagaguguucgccaagaacaggguuagacuuuaaugagaugauauuacugacaaugaagaauaaagcuuggaugguccauagacaaugguucuucgauuuaccauugccuuggacaucaggagcaacaacugaaacaccaacuuggaaucgaaaggaauuacuagucacuuuuaaaaaugcccaugcuaaaaaacaagaaguaguugugcuuggcucucaagaaggggcaaugcacaccgcauuaacaggcgcaacugaaauucagaacucaggagggacuucaaucuuugcagggcaucugaaauguaggcuaaagauggauaaguuagaacuuaaaggaaugagcuaugccaugugcuugaauacguucguauuaaaaaaagaaguuucggaaacacaacauggcacaauccuuauaaaaguagaguauaaaggagaagaugcgccaugcaaaauuccguuuuccacagaagauggucaagggaaagcacacaauggaagacuaauaacggccaauccgguuguaaccaaaaaggaggaacccgugaacauagaagcggaacccccguuuggggaaucuaacaucguuaucggaauaggugauaaagccuugaaaauuaauugguacaagaaggguucgucgauaggaaaaauguucgaagccacugcuagaggagcgagaagaauggcgauuuugggugacaccgcaugggacuuugggucugugggugggguucucaacaguuuaggcaaaaugguucaccaaauauuugguucggcuuacaccgcacuauucucuggaguauccuggauaaugaaaauagggauaggaguccuucucacuuggauaggacugaacucuaaaaauacgucuaugagcuucucguguauuguuaucggaauaauuacucuuuaucuuggugcuguuguccaagcggauaugggaugugucauuaauuggaaagguaaagaacuaaaauguggauccggaauauuuguuacgaaugaaguucauacguggacagaacaguauaaauuucaagcugacucaccuaagcgucuggcuaccgcgauagcgggcgcuugggaaaauggggugugugguauccgaucaacuacacggauggaaaaucuucuuuggaaacaaaucgccaaugagcuuaauuauauauuaugggaaaauaauauaaaauugacaguagugguuggcgauauaaucggaguacuugaacaggguaagagaacauuaacgccccagccaauggaauuaaaauauuccuggaaaacauggggaaaagccaagauaguaacagccgagacucaaaacaguucauucauaaucgacgggcccaauacaccugaguguccauccgcaaguagagcuuggaauguaugggaggucgaagauuauggguuuggaguauucacaaccaauauaugguuaaagcugcgagaaguauacacacaaucaugcgaccauagacugaugagcgcagccaucaaagacgaacgggcuguccaugccgauaugggguacuggauagagucccaaaagaauggaagcuggaaauuagagaaagcaaguuucauagaagucaagacguguacuuggccaaaaucacacacuuuauggagcaacggaguauuagaaagugauaugauaauacccaaaagucuagccggcccuauaagucagcacaaucauaggcccggcuaccauacacaaacugcaggcccauggcauuuagguaaacuggaguuagauuuuaacuauugugaagggacaaccguuguaauaacggaaaacugugguacacguggucccucauuacgcacaacaacugucucugguaaauuaauucacgagugguguugcagaaguuguacacuucccccacuuagguauaugggugaagacggcuguugguacgguauggagaucaggcccauaaaugaaaaggaggaaaacaugguaaaaagcuuggugucagcuggaucggggaaaguugacaauuuuacaauggguguauuaugucuugcaauucuauucgaagaggucaugagagguaaauucggcaaaaaacacaugauagcagguguacuauuuacuuuuguucuauuacuaucaggucaaaucacuuggcgggauauggcacauacuuugaucaugauaggaucaaaugcuucagaccggaugggaaugggaguaacauaccuggcauuaauagcuacauuuaaaauucaaccauucuuagcccuuggcuuuuuucuccgaaaguuaaccucccgagagaaucugcuccuagggguagguuuagcaauggccacaacacuacagcuuccagaagacauagaacagauggcgaaugguauagcacugggacuuaugacccucaaauuaauuacccaauuugagacauaccaacuauggacagcacuagucucacugacauguuccaacacaauauuuacacuuacaguagcguggagaacugcgacauugauuuuggcaggaguaagucuuuugccuuugugucaaucuucuagcaugcgaaagacugauugguuaccaaugacaguagcggcaaugggagucccuccacuacccuuauuuauauucucucugaaagacacuccaaaacguagaagcuggccacugaaugaggguguaauggcagucggccuaguaucuauauuagcaucaucauugcuuagaaaugaugucccaauggccggaccucuaguugcgggaggucuccugauagcuuguuauguuauaaccgguaccucagcagacuuaacuguugaaaaggcugcagacguaaccugggaagaagaagcugaacaaacaggagucucucauaauuuaaugauuacgguugacgaugaugguaccaugcgaauaaaagaugacgaaacagaaaacaucuuaacaguacuacucaagaccgcguuacucauuguuaguggaaucuuuccuuauucaauuccagcgacucuguuaguuuggcacacuuggcagaaacaaacucaaagaucgggagucuuaugggauguaccaucgccuccugaaacccaaaaggcagaacuugaagaagggguuuauagaauaaaacaacaaggaauuuucgguaaaacccaaguaggggugggggugcaaaaagaaggagucuuucauacgauguggcaugugacacggggagcaguacuaacgcacaacgguaagaggcuagaacccaauugggcgaguguaaaaaaagaucuaauuagcuacggugguggcuggagauugucagcucaauggcaaaaaggugaggaagugcaagucauagcgguggaaccaggaaaaaacccaaaaaacuuucaaacaaugccggggauauuccaaacuacuacaggcgaaauuggugcaauagcacuugauuuuaaaccaggaacaaguggaaguccaauuauuaaccgugaagggaaaauaguuggauuauacgguaacggagucguuaccaagaauggcggauaugugucaggcaucgcacaaacgaaugcagagccggacggcccuaccccagaauuagaagaagagauguuuaaaaaacgaaaucuaacaaucauggaccuacauccugguucuggaaagacuaggaaauauuuaccggcuaucguacgagaagcuauaaaaaggagauuacgaacacuuauauuggcuccaacucgaguaguugcagcugagauggaggaagcauugaagggacucccgauacguuaucagacgacugccauaaaaagcgaacauacugggagagaaauugucgaccuaaugugccaugcgacuuucacuaugagacuauugucaccaguccgcguuccuaauuauaauuuaauuaucauggacgaagcccacuucacugauccagccucgauugcugccaggggauauaucucuacgcgggucggcaugggagaagcagcugccaucuuuaugacagccacaccgccggggaccgcagaagcauucccgcaaucaaacgcaccuauucaagacgaagaaagagacauacccgaaagaucauggaauucgggcaaugaauggaucaccgacuuuguuggaaaaacaguaugguuuguacccucaauaaaggccgguaacgacauagcuaacugucugcgaaaaaaugguaaaaaaguaauacaacuuucuagaaaaacauuugauacagaauaccaaaaaacccgauuaaacgacugggauuucguagugacaacugauauaucagaaaugggugcaaauuuuaaagcugauagagucaucgauccgcgccgaugcuuaaagccaguaauacucaccgaugguccugagcgcguaauuuuagcaggacccaugcccgugacggcagccagcgcugcgcaaagaagaggacguguagggcgaaacccacaaaaagaaaaugaucaguacaucuucacaggccaaccauugaacaaugaugaagaucaugcucauuggacggaggcuaaaaugcuuuuagauaacauuaauaccccugaaggcauaauacccgcucuuuuugaaccugaaagagaaaaaagcgccgcaauugauggagaguaccgacuuaaaggagaaagccguaaaacuuuuguagaauuaaugagacguggagaucuaccagucugguuagcacauaaaguagcuagugaaggaauaaaguacacugaucgcaaaugguguuuugacggagaaagaaauaaucagauuuuagaagaaaacauggacgucgaaaucuggacuaaagaaggggaacgaaaaaaauuacgcccuagauggcuagacgcgcggacuuacagcgacccauuagcauugaaagaauucaaagauuucgcagcaggaaggaaaucaauugcacuagacuuggucacugagauaggacguguaccgucccauuuagcauacagaacuagaaaugccuuagauaaccucguaaugcuccauacuuccgaacaugguggacgagcguaucggcacgccguggaggaacuaccagagacuauggaaacauuacuacugcuaggauuaaugauucuacuaaccggcggugcaauguuguuccuuauaagcggcaaaggaauaggcaaaacguccauagggcuuaucugcgucauaguuucgagcggaauguuguggauggcagauguucccuuacaauggauagccucagccaucguacucgaauuuuucaugaugguccuacuaauaccagaaccagaaaaacaacguacaccucaagauaaccaauuagcguauguugucauuggcauuuuaacucuugcugccauaguugccgcgaacgaaauggguuugcuugaaacuacaaagagagaucuagggaugucaaaggaaccaggugucgucucaccuacaucauaccuagauguagaccuccauccagcaagcgcuuggacguuauaugcugucgcgacuacggucaucacuccgaugcuuagacacacuaucgaaaacucaacugcuaacgucucacuugcugcaauugcaaaucaggcgguaguauuaaugggguuagauaaaggauggccaauuaguaaaauggaucuaggcguaccgcuuuuggcucucggcugcuauucccaagucaacccucuaacacuaacagcugcaguucuauuauuagucacccauuaugccaucauaggcccuggucuccaagcgaaagccacaagggaggcccagaaaagaacagcagcgggcaucaugaaaaaucccacuguagauggaauuaugacaauagaucuugauccgguaauuuacgacaguaaauucgaaaaacaacuuggacaaguaaugcuucuuguacugugugcagugcaauugcuacuaaugagaacaaguugggcguuaugcgaagcccuaaccuuagccaccgggccaauuacuacauuaugggaggguagcccugguaaauuuuggaacacaaccaucgcaguuagcauggccaauauuuuucguggcucguacuuagcuggcgcaggguuagcuuuuucaauaaugaagucaguuggcaccgguagaagggggacaggaucacaaggcgagacacucggugaaaaauggaaaaagaaauuaaaucaacuuagccggaaagaguuugaucuuuauaaaaaauccggaauuacagaaguggacagaacagaagcuaaagaaggcuugaaacgaggcgaaacuacccaucacgcuguaucuagagguagugcgaaauugcaaugguuugucgaacgcaauauggugauucccgaaggacguguuauagaucucggcuguggcagagguggauggagcuauuauugugcaggacuuaaaaaaguaacggaaguaagaggcuacacgaaaggcggaccugggcaugaggagccaguuccuaugucgacuuacggauggaauauaguaaaacuaauguccggaaaagacgucuuuuacuuaccuccagaaaagugugauacauuauuaugugauauaggugaaucauccccaaguccaacagucgaagaaagccggacuauacgcguauugaaaaugguugagccuuggcugaagaacaaucaauucugcauuaagguuuugaacccauacaugccgacaguuaucgaacauuuagaacgcuuacagcguaaauacggcggaauguugguuaggaacccgcuuagucguaauagcacgcaugaaauguauuggauaucaaacggaacaggaaauauugugucaagugucaauaugguuucucgcuuacugcugaauagauuuacuaugacacaucgaagaccaacuauagaaaaagacguagacuugggugcuggaacuaggcauguaaacgcggaaccggaaaccccaaauauggaugugauuggugaacgaaucaaaaggauuaaagaggagcauuccucuaccuggcacuaugacgacgagaacccauauaaaacaugggcauaucacggaucguacgaaguaaaagcaaccgguucagcuuccucuaugauuaacggaguugugaaacuauuaacuaaaccaugggaugucgucccuauggugacccaaauggcaaugacggacacgacuccuuucggacagcaacguguuuuuaaagaaaagguagauacccggaccccaagaccuaugccugggacccggaaggucauggaaauaacugcagaauggcuauggcgcacacugggaagaaacaagaaacccaggcuguguacccgugaagaauuuaccaaaaaaguaagaaccaacgccgcaaugggagcuguauuuacggaagagaaucaaugggauagugcucgugcagcuguugaagacgaagaauucuggaaacuaguagaccgggaacgggaacuucauaaguuaggaaagugugggagcugugucuacaauaugaugggcaagagagaaaaaaaacuuggagaguuuggaaaggcuaaagggucaagagcgaucugguacauguggcucggugcccgauaucuagaguuugaagcauuaggauuccuaaacgaagaccauugguuuagucgugaaaauucuuauucuggaguugaaggagaaggacuccauaaauuagguuauauauuacgcgauauaucaaaaauaccgggcggugcuauguacgcagaugauacugcaggaugggacacgagaaucaccgaagaugaccuacauaaugaagagaaaaucacucaacaaauggaccccgaacaccgacagcuagcgaacgcaauauuuaaauuaacauaucaaaacaaaguaguaaagguacaaagaccaacacccaaaggaacgguaauggauaucauuucaagaaaggaucaaagggggagcggacaaguaggaacauauggauugaauacauuuacaaacauggaagcccaguuagugagacaaauggagggagagggcguccuauccaaagccgacuuagaaaauccacacuuacuagaaaaaaaaauaacacaaugguuagaaacgaaaggaguagaacguuuaaaacggauggcaauaucgggugaugauuguguaguuaaaccaauugaugaucguuucgccaaugcuuuauuagcgcuaaacgacaugggaaaagucagaaaagauaucccacaguggcaaccaucgaaaggcuggcacgauuggcaacaggucccauuuuguucgcaccacuuccaugaauugaucaugaaggaugggcgaaagcuagucgucccauguagaccccaagaugaacuuaucgggagagcgagaaucagccagggagcaggcuggagccuaaaggaaacagcaugccugggaaaagcguaugcacaaauguggucguuaauguacuuucaucguagagauuuaagauuagccucuaaugccaucugcagcgcuguuccuguacauuggauuccgacuucuagaaccacauggucuauacacgcucaccaccaauggaugacaacagaagacauguugacagucuggaauagaguauggauagaagauaaccccuggauggaagauaaaacaccgguaacaaccugggaagauguuccuuaucuagguaaacgagaagaucaguggugcggaucacuaauuggguugacgucacgagcaacaugggcucaaaauauauugacggccauucaacagguacgaucguugauaggugaugaagaauuucuagauuacaugccaaguaugaaaagauuuaggaaagaagaagaaagugaaggagcuauuugguga

SEQ ID NO: 23478 - RNA, 9873 nt, Artificial Sequence
  derived and/or modified CDS sequence (opt6) from DENV-3__FJ432722__SS-prME
acaucauuauguuugaugaugauguugcccgcaacacuugcguuucacuugacaucaagagauggugaaccucgaaugauaguagguaaaaaugaacgaggaaaaucgcugcuauucaaaacagcauccggaauuaauauguguacucuaauugcuauggauuuaggugaaaugugcgacgacacaguuacauauaaaugcccacuaauugcugaaguagaaccugaagacaucgauuguuggugcaauuuaacaaguacauggguuacauauggaacguguaaucaagcaggagaacacagacgagacaaacgaaguguggcguuggcgccgcacguuggcauggggcuagauacccguacgcaaacauggaugagcgcagaaggggcuuggagacaaguagaaaaaguugaaacuugggcuuugaggcauccaggauuuacaauacuagcacuguuuuuagcgcauuacauaggcacgaguuuaacccaaaaaguaguaaucuucauauuacucauguuaguuacgccgaguaugacaaugcgguguguggggguaggcaauagagacuuuguugaaggauugucaggggcgacauggguggacguuguuuuggaacacgguggaugcgugacuacgauggcgaaaaacaaaccaacucuugauauugaauuacagaaaacagaagcaacccaauuagcaacacuaaggaaauuauguauagaagguaaaauuacuaauauaacgaccgauucuagauguccgacacaaggcgaagcuauccuacccgaggaacaagaucaaaauuacgucugcaaacauacuuacguagacagaggcuggggaaauggaugcggacucuuugguaaaggaucccucguaacuugcgcuaaauuucaaugcuuagaaccuauagaaggcaaaguaguucaauacgagaaucuuaaauauaccguuauaauaacgguccauacuggugaucaacaucagguaggaaaugauacacaaggcguuacagucgagauuacaccacaagcgagcaccguugaagcaguacuuccagaauacggaacauuaggguuagaaugcuccccaagaacaggguuagauuuuaaugaaaugauccuauuaaccaugaaaaacaaagcauggaugguacauagacaaugguuuuucgaccucccguugccauggaccuccggcgcuacgacugaaacaccuaccuggaacagaaaagagcuguuaguaacuuuuaaaaacgcgcaugcuaagaaacaggaagucguaguacuaggaagucaggaaggagcuaugcacaccgcuuuaacuggagccaccgagauacaaaacaguggagggacgucuaucuucgcaggucacuuaaaauguagguugaaaauggacaaacuugaacuaaaagggaugaguuaugcuaugugucuuaauaccuuuguacuaaagaaagagguaucugaaacccagcacgguacaauauugaucaaaguggaauacaaaggagaagaugcacccugcaaaauaccauuuucaacagaagauggucaaggaaaagcgcauaacggaagacucauuacugccaaucccguaguuacaaagaaagaagaaccggugaauauagaagcagaacccccauucggagaauccaacauaguaaucggaauaggugauaaagcacugaaaauaaauugguauaagaaaggaucauccaucggaaaaauguucgaagcaacagcuagaggagcacguaggauggcaauccugggugauacagcgugggauuucgguaguguaggcggggucuuaaauucccucggaaaaaugguacaccagauauuuggaagcgcauauacggcacuauucagcggagugucuuggaucaugaaaauagggauaggaguauuauuaacauggaucggucuaaauucuaaaaauacgaguaugucauucaguuguauagugauagguauaauuacccucuaucuaggggccguuguucaggcugauauggguuguguaauaaacuggaaaggcaaagaauugaaauguggaucggguauauuuguuaccaaugaaguacauacuuggacagagcaauacaaauuucaggcugacagucccaaaaggcuugcaacggccauagccggugcaugggagaacgguguaugugguauuagaucaacaaccagaauggaaaaucuacuauggaaacagauagcaaaugaauugaauuauauuuugugggagaacaauauaaaacugacuguaguagugggcgauauaauaggaguauuggagcaggguaaaaggacacuaacgccacaaccgauggaauuaaaauauagcuggaaaacgugggggaaagcuaaaaucguaacggcugaaacacaaaacaguagcuucauuauugauggaccgaauacgccggaaugcccuagugcaucaagggcauggaauguaugggaaguagaagacuauggcuucgggguguuuacaacaaacauauggcuuaaauuacgugaaguauacacacaaucaugcgaccauagacuaaugucugccgcuauaaaagaugaaagggccguucaugcggauaugggauauuggaucgagucacagaaaaauggcucauggaaauuagagaaggcuucuuuuauugaaguuaaaacaugcacauggccgaaaucacauacauuaugguccaaugguguucuagagucugacaugauuauaccaaaaaguuuagcggguccaauaucacaacauaaccaucgcccaggauaccauacacaaaccgccggcccguggcauuugggcaaacuugaguuagacuucaauuauugcgaggggacuacaguaguuauaacagaaaauugcggaacucgcgguccaagucuucguacaaccacuguuagcggcaagcucauucaugagugguguugccgaucauguacuuuaccaccauuaagguauaugggggaggauggauguugguaugguauggaaauacguccgaucaaugagaaagaagaaaauaugguaaaaagucuaguauccgcagguuccggaaaaguagauaauuuuaccauggguguccuaugucucgccauuuuauuugaagaagugaugagagguaaauucggaaagaaacauaugauagccggugugcuauuuacauuuguccuacuuuuaagcggacaaauaacauggcgcgacauggcucauacacugauaaugauaggguccaaugcauccgaucgcauggguaugggaguaacauauuuagcacugauagccacauucaaaauacaaccauuucuagcucugggauucuuccugcgaaaacuaaccucccgagagaauuuacuucuaggcguuggguuggcaauggcgacaacacugcaacuuccugaggacauagaacaaauggcgaauggcaucgcacuaggacuaaugacauuaaagcuaaucacgcaauuugaaacauaucaacuuuggaccgcguuagucagcuuaacaugcuccaauacgauuuuuacgcuaacaguggcauggcgaacugccacguuaauauuggcggggguuagucuucuuccacuuugccaaucaaguaguaugagaaaaacugauugguuaccgaugacgguugcagcaauggguguuccuccccuaccccuauuuauauucagcuuaaaagauacgccuaaaagaaggaguuggccauugaacgaaggaguaauggcaguaggauugguuaguauacucgcaucuagccugcuuagaaaugacgugcccauggcaggucccuuaguagcagggggucuauuaauagcauguuacguaaucacugguacgagugcagacuuaacaguggagaaagcagcagacguuacaugggaagaagaggcagaacaaacaggcguaucucauaauuuaaugauaacuguagaugaugacggcacuaugaggauaaaggaugacgaaacugaaaacauauuaacuguuuuauuaaaaacugcacugcuuauuguaaguggcauauuuccauauucuauuccagcgacucuguugguuuggcauaccuggcaaaagcagacccaacguagugguguguugugggauguaccgaguccgccugagacucaaaaggcagagcuugaggagggaguauaccguauaaaacaacaaggaauauucggaaaaacgcaaguuggaguaggcguacaaaaagaaggcguauuccauacaauguggcacgugacgagaggagcuguccuaacacacaacgguaagcguuuagaaccaaacugggcaagugugaagaaagaccuaauauccuaugguggaggauggaggcuuagugcucaauggcaaaagggcgaagaaguacagguuauagcuguagaaccugguaaaaacccgaaaaacuuucaaacaaugccggggauauuccaaacaaccacuggagagauaggagcuauagccuuagacuucaagccugguacuucagguucuccaauuauaaauagggagggaaaagugguuggauuauaugguaauggaguuguuacuaaaaauggcggcuaugucucuggaauagcacaaacgaacgcagaaccagaugguccgacaccggagcucgaagaagaaauguuuaagaaaaggaaccuuacaauuauggacuuacacccagguagcggaaaaacgagaaaauaucuacccgcaauaguucgagaagcuauuaaacgaagacugaggaccuuaauucuagcaccgacccguguaguugccgcagaaauggaagaagcucuuaagggcuuaccaauacguuaucaaaccaccgcuacaaaaagcgaacauaccggaagagaaauagucgaucuuaugugucacgcuacauuuacaaugagacuccucucaccaguucgcguccccaauuauaaccuaauaauaauggaugaggcacauuucacagauccagccucaaucgccgcuagaggcuacauuucgacacgaguaggaaugggagaggcggcggcaauauuuaugacugcuacaccaccaggcacagcagaagcguuuccucagucaaacgcgccaauucaagacgaagaacgggacauaccugagcggucuuggaacucgggaaaugaauggaucacagacuuuguaggaaaaacagugugguuuguaccaaguauaaaggcgggaaaugacauagcgaauugccuacgcaaaaaugggaagaaagugauucaauugagcagaaaaacguuugauacggaguaucagaaaacgaaauuaaaugauugggacuuuguuguuacgacagauauuucggaaaugggagcaaacuuuaaagccgaucgaguaauagauccuagaaggugcuugaaaccaguuauacucacagaugguccugaacguguaauucucgcugguccaaugccagucaccgcugccuccgccgcacaaagacgaggcagaguagggaggaacccucagaaagaaaacgaccaauauauauuuacaggacagccuuuaaauaacgacgaggaucacgcgcauuggaccgaagcaaaaauguuacuugauaacaucaauacuccggaagggauaauucccgcccuauuugaaccagaaagagagaaaagugcagcaauagauggggaauauagacuaaaaggcgagagucgcaagaccuuugucgaacuaaugcgcagaggugaccucccugugugguuggcucacaaaguagcaagcgagggaauaaaauauacugacagaaaaugguguuuugauggcgagagaaauaaucagauauuggaagaaaauauggauguagaaauuuggaccaaagaaggcgaacgaaagaaauuacgaccgagauggcuagaugcgcgcacuuacagcgauccacuagcacuaaaggaauuuaaggacuuugcugccgguaggaaaagcauugcuuuagaucuuguuacagaaauuggaagagugccuucacauuuggcuuaucgaacucguaacgcauuagauaaccuagugaugcuucauacgucagaacacggcggacgggccuaucgacaugcaguagaagaauuaccagaaacuauggaaacgcuucugcuauugggauugaugauacuguuaaccggaggagcuauguuguucuugauaucugggaaagguauagguaagacaucaauuggacuuauaugugucaucguuaguaguggaaugcucuggauggcugauguuccauugcaauggauagcgagcgccaucguguuagaguucuucaugaugguucuacugauaccagagccugagaaacaacgcacgccccaggauaaucaauuagcuuauguaguuauugguaucuuaacgcuagcggcuauaguugcagcgaacgaaaugggacuacuagaaacgaccaaaagagaucuggggaugaguaaggaaccaggcguuguuucuccaaccucauaccuagacguagaucuccauccggcaucugcuuggacuuuauaugccguagccacgacuguuauaaccccaaugcucagacacacaauagaaaauucuaccgcgaacgucucacuagcagccauagccaaucaggcagugguccuaaugggacucgauaaaggcuggccgauaucuaaaauggauuuaggcgugccucuacuggcacuaggguguuacucacaaguaaauccuuuaacgcuaacagcggcggucuugcucuuaguuacucacuaugcaauaauaggcccaggacuucaggcaaaggcaacaagagaagcacaaaagagaaccgcagcaggcaucaugaaaaacccaacaguagauggcauuaugacuaucgauuuggacccuguaaucuacgauucuaaauuugagaaacaacugggucaaguaauguugcucguuuugugcgcaguucaauuacuacuaaugagaacgagcugggcucuuugugaagcauugacuuuagccacaggcccaauaacgacgcuuugggaaggaaguccugguaaguucuggaauacgacaaucgcaguuaguauggcuaauauauuucgaggaucuuaucuagcaggcgcuggauuagcauuuucuaucaugaaaagcgucggaacaggucguagggguacggggucucaaggcgaaacgcucggagaaaaauggaagaaaaagcuaaaucagcuuucacguaaggaguucgaccuuuauaagaaaagcgggaucacagaagucgaucguacugaggcaaaagagggguugaaacguggugagacuacgcaucaugccguuucuagagggucugcgaaauugcaaugguuuguggaaaggaacaugguaauccccgagggccgagucauagaucucggguguggucggggaggauggaguuauuauugugccgggcugaagaaagucacagaagugaggggauacacuaaaggaggaccaggacaugaagaaccggucccaaugucaacauacggauggaauaucguaaaauugaugucgggaaaagauguauucuacuuaccucccgagaaaugugauacacuucugugugacaucggggaaucaucaccgucacccacaguagaggagucgcgaacuauacggguucuaaaaaugguggaaccaugguuaaagaauaaucaauuuuguauaaagguuuuaaauccguacaugccuacuguaauugaacaccuagaacgacuacaaagaaaauacggagguaugcucguacgaaacccauuaucaagaaacucgacacaugaaauguauuggauaaguaacggaacuggaaacauugugaguucuguuaacaugguaagccgcuuguuacuaaaccgauuuacuaugacucacaggagaccuaccaucgaaaaggaugucgauuuaggggcggguacucgacacguaaacgcagaaccagaaacacccaauauggauguaauuggggaaagaaucaagaggauaaaagaagaacauucgucaacuuggcauuacgaugaugaaaauccauauaaaaccugggcauaccacggcucuuaugagguaaaagcaacuggaucugcaagcaguaugauaaauggcgugguaaagcuacuaacaaaaccgugggauguaguaccaauggugacucagauggcaaugacagauacaacuccauuugggcagcaacgagucuucaaagaaaaaguggauacacguacccccaggccuaugccuggaacaagaaagguaauggaaauuaccgccgaguggcucuggagaaccuugggcagaaauaagaaaccacgacuuugcacuagggaagaauuuaccaagaaaguaagaacuaaugcggcuaugggugcaguguuuacagaagaaaaccaaugggauagugccagggcggcaguagaggacgaagaguucuggaaguuaguugacagggaacgugaacuccauaagcuggggaaauguggaaguuguguauauaacaugauggguaaacgugagaagaaacuaggugaguuugggaaagcaaagggaucgcgugcaauuugguauauguggcucggggcccgauauuuagaguuugaagcccuagguuucuugaaugaggaccauugguucaguagagaaaacucauacagcggggucgaaggggaaggacuccauaagcuaggauacauucuucgggacaucuccaaaauuccaggaggagcuauguaugcggaugacacugcgggcugggacacuaggauuacagaagacgaucuacacaaugaagaaaagauaacacaacaaauggacccggaacaucgacaacucgcaaaugcuauuuucaaacuuacuuaucaaaacaaaguuguuaaaguacaaagaccaacuccuaaaggaacuguaauggacaucauuucccgcaaagaucagcgagggagcggucagguaggaacauacggacuuaauacuuuuacaaauauggaagcacaacucguuaggcagauggagggugaagggguacuaucgaaagcagaucuagaaaauccgcaucuacuggagaagaaaauaacucaauggcuagagaccaaagguguugagcguuuaaaacgaauggcgauuucgggcgaugacuguguuguaaagccaauagaugaccgauuugcaaacgcauuauuggcuuuaaacgauauggguaaagucagaaaagacauaccacaauggcagcccucaaaagguuggcaugauuggcaacaggugccguuuugcucacaccauuuucacgaauuaauaaugaaagauggacgaaaacucguugucccuugccguccgcaagaugaacugauaggacgagcacgaauaagucaaggagccgguuggagccucaaagaaacugcuugccuuggaaaagcauaugcccaaauguggucucucauguacuuucaccgaagagaucuacgucuagcuucgaacgcaauaugcagugccgucccuguccacuggaucccaacaucucgaacgacuuggagcauucaugcacaccaccaauggaugacgacggaagauaugcucacagucuggaauagagucuggauagaagacaaucccuggauggaagauaaaacaccggucacaacaugggaagauguuccauacuugggaaagcgggaagaucaauggugcggaaguuugaucggucuaacaucaagagcaacuugggcacaaaacauucuuacugcgauacaacaaguucguucccucauaggggacgaagaauuucuugacuacaugccaagcaugaaacgauucagaaaagaagaagaaucggaaggagucauaugguag

SEQ ID NO: 23479 - RNA, 9873 nt, Artificial Sequence
  derived and/or modified CDS sequence (opt6) from DENV-3__FJ432728__SS-prME
accuccuuaugccuaaugaugaugcucccagcuacuuuagccuuucauuuaacuucaagagauggggaaccucggaugauuguggggaaaaaugaaagagggaaaucauuacuguuuaaaacugcaucagguauuaauaugugcacccuaauagcuauggaucugggagaaaugugugaugauacaguuacauauaaaugccccuugauugccgaaguagaaccugaagacauagauugcuggugcaaccucacgucuacuuggguaacauauggaacuuguaaucaagcaggagaacacagaagggacaaaaggucuguugcauuagcuccccacguggguaugggacuggacacucgaacucaaacguggaugucggcugaaggggcguggcgucaaguugaaaaagucgaaaccugggcauugaggcacccuggauuuacaauucuagcguuauucuuggcacauuauaucggaacaucauuaacgcaaaaaguuguuauuuuuauauuguugaugcugguaacaccuucaaugacaaugaggugcgucggaguggguaaucgagauuuugucgaaggguuauccggagcuacauggguugauguagucuuagaacacggaggcugugucacgacaauggcgaaaaacaaaccuacacuugacauugaauuacagaaaaccgaagcaacacaacuggcuacucuaagaaaauuauguauagaaggaaaaauaacuaauaucacgaccgauucaagauguccuacacaaggagaagcaauauuaccagaagaacaagaccaaaauuauguaugcaaacauacguacgucgacaggggauggggaaauggaugugggcuuuuuggaaaaggaagccuaguaacaugugcuaaauuccaaugucuugaaccuaucgaaggcaaagucguccaauacgaaaaucugaaauauacgguuauuauaacgguacacacgggggaccaacaucaagugggaaacgauacgcaaggaguaacaguggaaauuacaccccaagcgagcacaguagaagcgguucuacccgaauacgguacauugggguuagaaugcucuccgcgaacaggacuugacuucaaugaaaugauccuacuaacaaugaaaaacaaggcauggauggugcaccggcaaugguucuucgaccuaccauuaccguggaccuccggugcuacaacagaaacgccaacauggaacaggaaagaacucuuaguuacuuuuaaaaaugcacacgcuaaaaagcaagaaguaguaguacuaggaucucaagaaggagcaaugcacacugcuuuaacuggagcaacugaaauacaaaauuccggagguacaaguaucuuugcgggccacuugaaaugucgauugaagauggauaaacuugagcuaaaggguauguccuacgcuaugugcuuaaauacauuuguuuuaaagaaggagguuucugagacccaacaugggacaaucuuaaucaaaguagaauacaaaggagaggacgcgccuuguaaaauuccuuucaguacugaagauggacaagguaaagcucauaaugggagauugauaacagccaaccccguaguaacaaagaaagaagaacccgugaauauugaagcagagccgcccuuuggugaaucaaacaucguaauaggcauaggggacaaagcacuuaagaucaacugguauaaaaagggaaguaguauugguaagauguuugaggccaccgcucgaggugcaagaagaauggccauucuaggagauacagccugggauuucggaucaguuggugggguccucaauucccuugguaaaaugguccaucagauauuuggcagugcuuacaccgcauuauucucuggcgucaguuggauaaugaaaauaggaauagguguccuccucacguggauuggucuuaacagcaaaaacacaucgaugucauuuucuugcauagucauaggaauuauaacgcuauauuuaggagcuguaguccaagcggacauggggugugcaaucaacuggaagggcaaagagcuaaaaugugguuccgguaucuuuguaaccaacgaaguccacacguggacagaacaauacaaauuccaagcagauucgcccaaaagauuagcuacagccauugcuggugcuugggaaaacggcguuugcggaaucagguccacaacacgcauggaaaaucucuuauggaaacaaaucgcgaacgagcuuaacuacauucuaugggaaaacaacauaaaauuaacaguugucgucggcgauaucauaggaguccuggaacaaggcaagagaaccuuaacaccacaaccaauggaauuaaaauacucauggaagacuuggggaaaggcaaaaauaguaacagcagagacucaaaauaguucuuuuauaaucgacggcccaaacacaccugaguguccuagugcguccagagcauggaacgucugggaaguggaagacuacgguuuuggaguauuuacuacaaacaucuggcuaaaacucagagaagucuauacacaaaguugugaucauagacucaugucggcagccauaaaggacgaacgagcgguucaugcugauaugggcuauuggaucgagucacagaaaaaugguucauggaagcuagaaaaagcaucauuuaucgagguaaaaacaugcacauggccaaaaagccacacccuuuggucaaauggcguacuugagagcgauaugauuaucccaaaaucauuagcagguccaaucagccaacacaaucacagaccaggauaccauacucaaacagcuggaccauggcacuuaggaaaauuagaguuagauuuuaacuacugugaagggacgacuguugugauaacggaagacuguggcacaagaggcccaucacuaagaacaacaacagucucuggaaaauuaauucacgaaugguguugccgaaguugcacgcuacccccgcuucgguacaugggagaagauggauguugguauggaauggaaauucguccaauaaaugagaaggaagaaaacaugguaaaaucacuuguuagugcuggaucagguaaaguggauaauuuuacaauggguguguuaugccuugccauauuauucgaagaagugaugagaggaaaauuugggaagaaacauaugauagcggggguuuuauuuacauucguucuacuuuugaguggucagaucacauggagagauauggcacacacucuaaucaugauaggaucaaaugcguccgauagaaugggaaugggcgugacguauuuggcgcugauugccacguuuaaaauucagcccuuuuuagcacuuggauucuuucuacgaaaguuaacaucucgagaaaaccuacuacugggagugggauuagcgauggcaaccacacuccaauuaccugaggauauugaacagauggcaaauggcauagcucuuggucucaugacccuuaaauugauaacacaauuugagacauaccaacuguggacagcgcuagucucguuaacguguuccaauacuauauuuacauuaacuguagcauggagaacagccacguugauacuagcaggaguauccuuauuaccgcucugucaaagcucuagcaugcggaaaacagacuggcuaccuaugacagucgcagcaaugggaguacccccuuuaccacucuucaucuuuagcuuaaaggauacaccaaagcggagauccuggccucuuaacgagggcguaauggcgguuggccuuguaucuauucuagcaucuucccuacugcgaaaugacgugccuauggcuggcccguuaguagcugguggguuacuuauagcuuguuacgucauuacuggaacaagugcagaucuuacggucgagaaagccgcggauguuacuugggaagaagaagcggaacaaacgggcguaagucauaacuuaaugauaacuguagaugacgacgguacaaugagaauuaaggacgaugagacugaaaauaucuuaaccguuuuauuaaaaacagcauuauuaauagugaguggcaucuuuccauacaguauccccgccacgcuacugguuuggcacacauggcaaaaacagacucaacgcaguggcguccugugggauguaccuagcccgccagagacacaaaaagcggaauuagaggaaggcguauaucgaauaaaacaacaggggauuuuuggcaaaacacaaguaggcguaggcguucaaaaagaaggaguauuucauacaauguggcacguaacacguggcgccguguuaacgcacaacgggaaaaggcuagaaccaaauugggcaucagucaagaaagauuugaucucauauggagggggauggagauuauccgcucaauggcaaaaaggugaagaaguccaagucaucgccguagagccgggcaaaaaccccaaaaauuuucaaacaaugccaggcauauuccaaaccacgaccggcgagauaggugcuauugccuuagacuuuaaaccugggaccucaggcaguccaauaauuaacagagaaggcaaaguuguuggauuguaugguaauggcguuguaacgaagaauggagguuauguaaguggaauagcgcaaacaaaugcugaacccgacggaccaacaccagaacucgaagaagagauguuuaagaaaagaaauuuaacaauaauggaccuacauccuggguccgguaaaacgagaaaauacuugccagccauuguaagagaagcgaucaagcggagguuacgcacauuaauuuuggccccaacaagaguagucgccgccgaaauggaagaagcccugaaaggacuaccuauuagauaucaaacaaccgcgacaaaaucugaacauacugggcgugaaauaguugacuugaugugucaugcaacuuucacaaugagacuccuuaguccaguucgcguaccaaauuacaaccucauaaucauggacgaagcacacuuuacugacccagcaucuauagcagcaagaggcuauauuucuacacgaguaggaaugggagaagcagcagccauuuucaugacagcgacaccaccgggaacagcagaagcauuuccucaaucgaacgccccuauucaagaugaggagagagauauacccgagcgaucuuggaacagcggcaacgaguggauuacugacuucguuggaaaaacuguuugguuuguacccaguauaaaagcaggaaaugacauugcaaauuguuugagaaagaacgguaagaaggucauacaacugucacguaagacauucgauacagaauaccaaaagacaagacuuaaugauugggauuuuguuguuacuaccgauauaagcgaaaugggugccaauuuuaaagccgaccggguaauagauccgcgucguugccugaaaccuguaauacucaccgacggaccagagagaguaauuuuagcaggaccaaugcccguaacugcugcaagcgccgcucagagaagggggagagugggacgaaacccucagaaagaaaaugaucaauacauauuuacaggucaaccucucaacaaugaugaggaucacgcgcauuggacagaagcuaaaauguuacucgauaacaucaauacuccagaggguaucauaccagcacuguucgaaccugaacgagagaaaagugcggcaauagacggggaauaucgacuuaagggugaaucucgaaagacguuuguagaacuaaugcgccguggugacuuaccaguaugguuagcgcacaaaguggcauccgaggguauaaaauacacugacagaaaaugguguuucgacggagaaagaaauaaucagauacuugaggaaaauauggaugucgaaauauggaccaaagagggcgagaggaagaaauugagaccucgaugguuagacgccaggaccuauagugauccucuagcauuaaaagaguucaaagacuuugcagcgggacgaaaaucuauagcucuagauuuaguaacagagauuggcagagugccaucucauuuagcauaccgaaccaggaacgcucucgauaacuuggucauguuacauacaagcgaacauggcggacgggcguauagacacgcagucgaagaacugcccgaaacuauggagacucuccuccuacuaggucuaaugauuuuguugaccggaggagcuaugcuuuucuuaauuucagguaagggaauugggaaaacaagcauuggacuuauauguguuauaguaucuagcgggaugcuauggauggcagaugugccucuacaauggauugcaucagcaaucguguuggaguucuucaugaugguauuguugaucccugaaccagaaaaacagcgcacuccgcaagacaaccaauuagcuuauguugucauuggcauacuuacguuggcggccauagucgcugcaaaugaaauggggcucuuagaaacuacaaaaagagauuuggguauguccaaagaaccuggaguaguuucgccuacaucauaucucgauguagaucuucauccugcaucagcauggacacuuuaugcaguagcuacgaccguaauaacacccaugcuccgacauacgauugaaaauucuacagcaaacguuuccuuagcagcaauugcaaaucaagcuguuguucucauggguuuagacaaagguuggccgaucucgaagauggaccuugguguaccccuuuuggcgcuuggaugcuauagccaaguuaauccauuaacguuaacagcagcaguauuacuccuaguuacacauuacgccauaaucggcccagguuuacaagcuaaagcaaccagagaagcucaaaaacgaacagcggccggaauaaugaaaaauccaacaguggaugguaucaugacgauugaccuagaucccguuauauaugauuccaaauuugagaaacagcuaggccaggugauguuauugguuuuaugcgcaguacaauuacucuuaaugagaacaucuugggcauugugcgaagcguuaaccuuagcgacgggaccuaucacaacacuaugggaagggaguccugggaaauuuuggaacacuaccaucgcugucucaauggcuaauauuuucaggggauccuacuuggcaggggcgggucucgcauuuaguauaaugaagucaguagguacaggaaggcgugggaccggaucacaaggcgaaacacucggggaaaaauggaagaagaaauuaaaccaacugaguagaaaagaguuugauuuguacaagaaaagcgguauuacagaaguagauagaacagaagcuaaagaaggacuaaagaggggugaaacaacacaccaugccgucucaagggguucugcuaaacuucaaugguuuguugaaagaaauauggucauacccgaggguagaguaauagacuuaggcugugggaggggaggguggaguuauuacugcgcuggacuaaagaaaguaacagaaguucgggguuauacuaaaggaggucccggccacgaggaacccguacccaugaguacuuacggauggaacuuagucaaacuaauguccggaaaagauguauuuuaucuacccccugagaaaugugacacauugcuaugugauauaggugaaagcaguccaaguccaacaguugaagagaguagaacaauaagaguuuuaaaaaugguugaaccguggcugaaaaacaaucaguuuuguauuaaaguccugaauccuuacaugcccacaguaauugaacacuuagaaagguuacaaagaaaauaugguggaauguuaguuagaaauccccugagccggaauaguacccacgaaauguauuggauaagcaaugguacagggaauauuguaagcaguguuaauaugguaucuaggcuucuauugaacagauuuacuaugacucauagacgaccaacuauugaaaaagauguagaccugggagcaggaacaagacauguuaaugcggaaccagaaaccccuaauauggacguaauuggagaaagaauaaaaagaauuaaagaagaacauucuaguacuuggcauuacgacgaugaaaauccguacaaaacaugggccuaucaugguucuuaugagguuaaggcuacagguucagccucaaguaugauuaauggagucguuaaacuacugacuaaaccuugggacguuguuccgaugguaacacaaauggcuaugacugauaccacgccuuucggucaacagagaguauuuaaggaaaaaguugacacaaggacgccaagaccaaugcccggcacacguaaggucauggaaauuacggccgaaugguuauggcgcacucucgggagaaacaagaaacccaggcuguguacaagagaagaguuuacuaaaaaggucagaacuaaugcagcgaugggcgcuguuuuuacggaagaaaaucaaugggacagugcacgugccgcagucgaagacgaagaguucuggaaauugguagaucgagaacgagaacugcacaaacugggaaagugcgggucguguguguauaauaugaugggaaaacgagagaagaaauuaggagaguucgggaaagcgaagggaaguagagcaaucugguacauguggcuaggggcccgcuaccuagaguuugaagcccuugguuuccuaaaugaagaucacugguucagucgagaaaacucuuacucaggcguggaaggagaaggccuucauaaauuaggcuauauucuucgcgacauaaguaaaauaccagguggagccauguacgcagaugacacugcagguugggauacucguauaaccgaggaugaucuacauaaugaagagaagauaacgcaacaaauggauccugagcacagacaacuggccaaugcaauuuuuaaauugacauaucaaaauaaagugguaaaaguucaaagaccaacgcccaagggcaccguuauggacauaauaucaaggaaagaccagaggggcagugggcaggucggcacauacggacucaacacuuucacaaauauggaagcgcaauugguacgacaaauggagggagaagguguacuaagcaaagcugaucuugaaaacccucaccuucuugagaagaaaauuacacaaugguuagaaacaaaagguguagaaaggcuuaaacgaauggccauuucuggcgaugacugcgucguaaaaccuauagacgauagauuugcaaaugcacuacuugcgcuaaacgauaugggaaaagucaggaaagacauuccgcaauggcagccaagcaaaggcuggcaugacuggcagcaggucccguuuugcagucaccacuuccacgaacuaauaaugaaagacgguagaaaauuaguaguacccugcagaccucaagaugaacucauagguagagccaggauuucccaaggugccggguggucuuugaaggaaacagcaugucucgguaaagcauaugcgcaaauguggucuuugauguauuuucaccgacgggaccuacgccucgcuagcaacgcgaucugcucagccgugccaguacacuggauuccuacauccaggacgacuuggucuauucacgcgcaccaucaguggaugacuacagaagauauguugacuguuuggaaccgggucuggauugaagacaacccauggauggaggauaagacgccggucacaacuugggaggaugucccauaccuaggaaagagagaagaccaauggugcggcucuuuaauaggcuugacaucacgugcuaccugggcacaaaacauucugaccgcuauucaacaaguaagaagccucaucggagacgaagaguuccuugauuacaugccuucgaugaaaagguuuagaaaggaggaagaaagcgagggagcaauuugguaa

SEQ ID NO: 23480 - RNA, 9873 nt, Artificial Sequence
  derived and/or modified CDS sequence (opt6) from DENV-3__FJ432731__SS-prME
acuucacucugucuaaugaugauguuaccagcaacccuagcauuucaccuuacaaguagagacggugaaccaagaaugauaguggguaaaaaugaacgcggaaaaucucuauuauuuaaaacugcuaguggaauaaauauguguacuuuaauugcgauggaucugggagaaaugugugaugacacuguaacuuacaaaugcccgcuuauugcagaaguugagccagaagauauagacuguugguguaaucugacuagcacaugggucacuuacggcacgugcaaucaagccggugaacaccgacgagauaaacggucaguggcauuggccccucaugucgggaugggccuagacacaagaacacaaacauggaugagcgcagaaggagcuuggagacaaguugaaaaaguagaaacaugggccuuacgacaccccggauuuacuauacucgcauuauucuuggcacauuauauagguacaaguuuaacucaaaaagucguuauauuuauauuauuaauguuagucacaccuucaaugacuaugagauguguaggaguuggaaaucgugacuucguagaaggauuaucgggagcaacauggguagauguggugcuugaacauggagguuguguuacaaccauggcuaaaaacaaaccgacuuuagauauagaauuacagaaaaccgaagcuacacaacuggcaacccucagaaaacuaugcauugaaggcaaaaucacuaauauuaccacggauucgagaugcccuacacaaggagaagcuauauugcccgaagaacaagaccaaaacuauguaugcaaacacacguauguagacagagguuggggcaauggauguggcuuauucggaaaagguagcuuggugaccugcgcaaaauuucaaugucucgaaccuauagaaggaaaaguaguucaauacgaaaaucuaaaauacacagucauaauaacgguccacacuggcgaccaacaucaaguggguaaugauacccaagggguaacaguugaaauaaccccucaagccagcacagucgaggcagugcugccugaauauggaacauuaggcuuagaaugcucucccagaacgggauuagacuucaaugagaugauccuccugaccaugaaaaauaaagcauggaugguacaccgacagugguucuuugaucuacccuuaccuuggacgucuggagcuacuaccgagacgccgaccuggaaccguaaagaauuauuagugacauuuaaaaaugcgcacgcgaagaaacaggaaguaguuguucuagguucgcaagaaggggcgaugcauacugcccuuacuggugcaacagaaauccaaaacaguggcggaacaaguauauucgcaggccaucuaaaaugucgauuaaagauggauaaauuggaacucaaagguaugucauacgcaaugugcuugaacacguuugugcucaaaaaggaagucagugagacucaacaugguacaaucuuaauaaagguggaauacaagggugaagacgcaccauguaagauaccauucucgacggaggauggucaaggaaaagcacauaaugggcgacugauaacagcuaaccccgucgucaccaagaaagaagaaccugucaauauugaagcagaaccacccuuuggagagucuaauauaguuauagguauuggcgacaaggcccucaaaauuaauugguacaagaaagggucaucgauugggaaaauguuugaagcaacagcacgaggagcaagaagaauggcaauacuuggugacaccgcaugggauuucggaagcgugggaggcguccuuaauaguuuagguaaaaugguccaucaaauuuuugguuccgcauacaccgcauuauuuucagguguuucauggauuaugaagauaggaauuggcguuuugcuaaccuggauaggacuaaauaguaagaacacgucaauguccuuuucgugcauuguaaucgguauaauaacucuauaccuuggugcuguugugcaagcagacauggguugcgcgauaaacuggaaaggcaaggagcuaaaaugcgggucaggaauuuucguaacuaaugaagugcacacuuggacagaacaauauaaauuucaagcagacagcccgaaaagguuagcaacggcaauagccggcgcgugggagaacggaguaugugguauacgaucaaccacaagaauggaaaaucuauuauggaagcaaaucgcaaacgaauuaaacuacauuuugugggaaaauaacauaaaacucacugugguaguuggagacauuauaggaguauuagaacaagguaaacguacuuuaaccccacaaccgauggaguuaaaguauucuuggaaaacaugggggaaagcgaaaaucgucacagcagaaacacaaaacaguagcuuuaucauagauggaccgaauacuccagagugucccagugcgucgagggcauggaauguaugggagguagaagacuacggauuuggaguguucacuaccaacauaugguugaagcugagggaaguauacacucagagcugugaccacagauuaaugucagccgcgauuaaggacgaacgagcgguacacgccgauaugggauacuggauagaaucccaaaagaauggaucauggaaauuagaaaaagccuccuuuauugaaguuaagacuugcacuuggccaaagucacauaccuuauggucgaauggaguacuagaaagugacaugaucauaccuaagagucuugcaggaccgauaucacagcauaaucaucgcccgggauaucacacacaaacugcagguccauggcauuuaggaaaguuagaacuagauuuuaacuauugugagggaacaacugucguuauaacagaaaacuguggaacuaggggaccaucacuuagaacaaccacuguauccgguaaauugauacaugaauggugcugucgcaguuguacacuuccaccccucagauacaugggugaagacggcugcugguauggaauggagaucagaccaauaaacgaaaaggaagaaaacauggucaaaagucuaguaucagcaggguccgguaaaguugacaauuuuacgauggguguccucugucucgcaauuuuguuugaagaaguuaugagaggaaaauuuggaaagaaacacaugauagcaggaguucucuuuauguuuguacuuuuauuaagcggacaaauaacuuggagagacauggcacaaacguuaauaaugauaggcucuaaugccagcgacagaaugggaaugggugugacauauuuagcuuuaauugcuacauuuaagauccaaccauuccuugcacuaggcuucuuucuacgaaaauugaccaguagagagaaucuauuauuaggugugggauuggcaaugacaacgacauugcaacucccggaagauauagaacaaauggccaauggaaucgcucuuggccuaaugacccuaaagcugauaacacaauuugaaacauaccaacuuuggacagcucuuguaucauuaacuugcucuaauacaauauuuacauuaacugucgccuggcgaacagcuacacuaauuuuagcugguguaagccuauuaccacuaugucagagcuccuccaugcggaagacagauuggcugcccaugacaguagcugcgaugggcgugccaccuuuacccuuauuuaucuucucacuaaaagacacaccaaagcgaagaucauggccucucaaugaaggagugauggcugucggauuaguuaguauauuagcaaguagcuuguuacgaaaugacguaccaauggcuggaccucuaguugcuggaggacuuuuaauagcuuguuaugucauaaccgguaccucagcugaccugaccgucgaaaaggcagcugacguaacaugggaagaggaagccgaacaaacagggguaagucacaaucucaugauuaccguagaugaugacggcacgaugaggauaaaggaugaugaaacggagaauauucuaacaguauuacuaaaaacagcauuacuaauuguaagugguaucuuuccuuauaguauucccgcgacucuucuagucuggcauacuuggcagaagcaaacucaaaggaguggaguccuaugggauguaccguccccuccugagacccaaaaggcagaguuagaagaaggcguguauaggauuaaacaacaaggaauuuucggcaaaacacagguugguguagggguacagaaggaaggaguuuuucauacuauguggcauguaacaagaggcgcaguucuaacucauaaugguaaacggcuggaaccaaauugggcguccgucaagaaagauuuaauaucuuauggaggugguuggagguuaagcgcacaauggcagaaaggggaagagguacaagucaucgcuguugaaccugggaaaaaucccaaaaauuuucaaacgaugcccggaauauuccaaacuaccacaggugaaauaggcgcaauugcucuugauuuuaagccuggaacuagcgguucuccaauaauuaauagagaaggaaaagucgugggccuuuauggcaacggcguugucacuaaaaauggcggguauguaaguggaauugcccaaacaaaugcagagcccgaugggccaacucccgaacuagaagaagaaauguucaagaagaggaacuuaacuauaauggaccuucacccugguagcgguaaaacgagaaaauaucuucccgcgauuguacgugaggcaaucaaacgccgucuccgaacauuaaucuuagccccgacaagggucguugcagcugagauggaagaagcgcuaaagggucuuccgaucagguaucagaccacagcaaccaagucugaacauacggggagagaaauaguagauuuaaugugccacgcuacguuuacgaugcgccuuuuaucuccagugagagugcccaauuacaaucuaauuaucauggacgaggcgcacuucacagaccccgccucgaucgcggcgagagguuauauaaguacgcgcguaggaaugggcgaggccgccgccauauucaugacggcuacaccuccggguacggcagaggccuucccccaaucgaacgcaccaauacaagaugaagaacgagauauaccugaacguucuuggaacucugggaacgaauggauaacugauuucguaggaaaaaccgugugguucguuccgaguauaaaggcgggaaaugauauugcuaauugccucaggaaaaacggcaagaaagugauccaauugucacguaaaacauuugacacagaauaccagaaaaccagacugaaugacugggauuucguaguaacuacggacauuuccgaaaugggugcuaauuucaaggcugaucguguaauagacccacgaaggugucuaaaaccugucauacucaccgaugggcccgagcgcguaauuuuagcagggccuaugccaguaacugcagccagugccgcgcaacggagaggcagaguugguaggaauccccagaaagagaaugaccaauauauauuuacuggacaaccccuuaacaaugacgaagaucaugcccauuggacagaagcaaaaaugcuccuggauaacauuaauacaccagagggaaucauaccugcccucuuugaaccagagcgagagaaaucggcagcuauagacggugaauaucguuuaaagggggaaagcagaaaaacauuugucgaauuaaugagaagaggugaccugccugugugguuagcccauaaaguggccucugaagggauaaaguauacugacaggaaguggugcuucgacggcgaacgaaauaaccaaauuuuagaggaaaacauggacgucgaaaucuggacaaaagaaggcgaacggaagaaacuuagaccucgauggcuugaugcaagaacuuauucagacccguuagccuugaaagaauuuaaagauuuugcggcaggccgaaaaaguauagcacucgaucuugugacugaaauaggacgggucccaagucaccucgcuuacagaacuaggaacgcacuggacaauuuaguaauguugcauacuuccgaacacggugggcgugcauacagacacgcggucgaggaguuaccagaaacgauggaaacucuuuuauuguuggguuuaaugauuuuauuaacugguggagcaaugcucuuucugaucucugggaaaggcauuggcaaaacaaguauugguuuaaucugugugauugugaguaguggaauguuauggauggccgacguaccauugcaguggauagcuucggcaauuauauuagaguucuuuaugauggucuuacuuauucccgagccggaaaaacaaagaacaccacaagacaaccaguuggcauaugucguaauagggauucugaccuuagccgcgauuguagcugcaaaugaaaugggacuauuagagacaaccaaacgagaccuagguaugaguaaggaaccaggaguagugucuccuacuuccuaucuagacguagauuuacaucccgccagcgcguggacacuguaugcaguugcuacuacagucaucacaccaauguuacgucacacaauagaaaauaguacugcgaauguuagucucgcggccaucgcaaaucaagcuguaguauuaaugggauuagacaaagguuggccuauaucaaaaauggaucuaggugugcccuuauuggcgcuaggauguuacagucaaguuaacccuuugaccuuaacugcagcagucuuacuauuaguaacgcauuacgcaaucauuggcccaggauuacaagccaaagcgacucgggaggcgcaaaaacgaaccgcggccggaauaaugaagaauccaacgguagacggaauaaugacuauugaccuugaccccguuauuuaugauucgaaauucgagaaacagcucggacaggugaugcuauuaguacuuugcgcgguacaauugcugcuuaugagaaccucaugggcacuuugugaagccuuaacccuagcaaccggcccuauaacuacacugugggaaggaucaccaggaaaauucuggaauacgaccauagcagucagcauggcgaacauuuuccgaggcagcuaccuagcuggcgcaggguuggcuuucuccauuaugaaaaguguuggcacugggagaagaggaacaggcagucaaggagaaacacuaggagaaaaauggaagaaaaagcucaaucaauuaucccgaaaagaauuugaucucuauaagaaauccggaauaacagagguugaccggacagaagcuaaagagggccuaaaaagaggugagacuacgcaccacgccgugucacgaggcucugcaaaacuccaaugguuuguugagagaaauauggucauacccgaaggacggguaauugauuuggguugcgggcguggugguuggucauauuauugugcaggucuaaagaaaguaacagaaguccguggguauacuaaaggagggccaggucaugaagaaccaguuccuaugucaacuuacggguggaaccucgucaaacuuaugagcgguaaagauguguuuuaucugcccccugaaaaaugcgacacuuugcuuugcgauauuggugaguccucacccaguccaacuguugaggagucuaggacaauuagaguucucaaaaugguggagccauggcuuaaaaauaaccaauuuuguaucaaaguacuuaacccuuacaugccaacaguaauagaacaucuagaaaggcuacaacggaaauauggaggaaugcuaguuagaaauccccuaaguagaaacucaacacaugaaauguauuggauuagcaacggaacugggaauauugugucaucagugaacaugguuucacgccuuuuacugaaucguuuuaccaugacacacagacguccaacuauagaaaaagacguagacuugggagcaggaacucgacauguaaacgcggagccagaaacgccaaauauggaugucauaggagaaaggauuaaaagaauaaaagaagaacacagcucuacguggcauuacgacgaugaaaauccguacaaaacaugggcauaucaugggucauacgaagucaaagcaacagguucagcaagcagcaugauaaauggagugguaaaacuccuaacuaaaccaugggacguuguuccgauggucacacaaauggccaugacagauacaaccccguuuggucagcaacguguuuuuaaagaaaagguagauacacggacuccacgaccgaugccagggacuaggaaagucauggaaaucacagcggaaugguuguggcguacacuuggucgaaauaagaaaccacgccuguguacacgagaagaguuuacgaaaaagguaaggacuaaugcggcaaugggugcaguauucacggaagaaaaucaaugggacucugcaagagcggcaguggaagaugaggaguucuggaaauuaguagaccgagaacgcgagcuucauaaacucggcaaaugcggaucaugugucuauaauaugaugggaaaaagagagaaaaaguuaggagaguucgguaaagcaaaaggaagcagagcuauuugguacauguggcuuggugcaagauacuuggaguuugaggcauugggguuccucaaugaggaucacugguuuucgagagagaacagcuacagugguguagaaggagaaggcuuacauaaacugggauacauacugagggauauuaguaaaauaccagguggagccauguacgcagacgauacggcaggcugggacacacguauaaccgaagaugauuuacacaacgaagagaaaauaacacaacagauggaucccgaacauagacaacuugcuaaugccauauuuaaauuaaccuaccaaaacaaaguugugaaaguucagaggccaacucccaaggguacaguaauggacaucauaucucgaaaagaucagagagguuccgggcaaguaggaacguacggacugaacacuuucacaaauauggaagcgcaacuuguaagacaaauggaaggagaagggguauuaaguaaagcggauuuagaaaauccccauuugcuugaaaagaaaauaacacaaugguuagaaacaaaaggaguagaaaggcuuaagagaauggcaauaucaggagaugauugcguaguuaagccaauagacgauagguucgccaacgccuuauuagcguuaaaugacauggguaaaguucguaaagauauuccccaguggcagccauccaaaggcuggcaugacuggcaacaaguuccuuuuuguagucaucauuuccaugaacucauaaugaaagauggacgaaaacuuguagucccguguaggccgcaagacgaacuuauuggucgagcaagaauaucacaaggggcuggauggucacuuaaagaaacugcuuguuuaggaaaggcguaugcacagauguggucguuaauguauuuucacagaagagauuuaaggcuugcaagcaaugccauaugcagugcugugccugugcauuggauaccaacuucuagaacuacuuggucaauccaugcacaucaccaauggaugacuacggaggacaugcucaccgucuggaacagagucuggauugaagacaauccuuggauggaggauaagacuccuguuaccacaugggaagacguaccauauuuaggaaaacgugaagaccaaugguguggaucccuuauuggauugacaaguagagcaacgugggcgcaaaauauucuaaccgccauccaacagguaagaagucugauuggagacgaggaauuucuagauuauaugcccucaaugaaaagauuuagaaaagaggaagagagugaaggugcaauaugguaa

SEQ ID NO: 23481 - RNA, 9873 nt, Artificial Sequence
  derived and/or modified CDS sequence (opt6) from DENV-3__FJ562097__SS-prME
acgucuuuaugucuaaugaugauguuaccugccacucuagcuuuccauuugacuuccagagauggagaaccuagaaugauuguaggcaaaaaugaaagagggaaaagccugcuguuuaaaacggccucuggaauuaauaugugcacacuaauagcuauggaucuuggagaaaugugugacgauacaguaacauauaaauguccgcuaauugccgaaguggaaccagaagauauugacugcugguguaaucucacuuccacuuggguuacauauggaacguguaaucaagcgggugaacaccgccgagacaaaaggaguguagcacuggccccacauguaggaaugggacuggacacacgaacucaaacauggaugagugcagaaggagcuuggcgacaaguagaaaaaguggagacaugggcuuuaagacacccgggguuuacaaucuuggcacuauuucuagcacauuauauugggacaucacucacgcaaaaagucgugaucuucauauuauuaaugcucguuacccccaguaugacuaugcguugcgugggagucggaaacagagauuucguagaaggauugaguggagcaacuugggucgacguaguccucgaacauggagguugugucacaacuauggcgaaaaauaaaccgacgcuggacauugagcuacagaaaacugaagcaacgcaacuggcaacguugagaaaauuaugcauagaagguaaaauaacaaacauaacuacagauucacgauguccuacucaaggagaggcgauacuuccugaagaacaagaucaaaauuauguguguaaacacacuuacguagaccgaggauggggaaacggauguggauuauuuggaaaagguaguuuagucacuugugcaaaauuccaaugccuugaaccuauugagggaaaaguaguccaauaugaaaacuuaaaauauaccguuauaauuacugugcacacaggagaccaacaucaaguagguaacgauacacaaggaguaaccguggagaucacuccacaggcuucaacgguagaagcggugcuaccggaauacggaacuuuaggauuagaaugcagcccucggaccggacucgauuuuaaugaaaugauucugcuuacaaugaaaaacaaagcauggaugguccacaggcaaugguuuuucgaucuuccacuaccuuggacaucuggagcuaccaccgaaacaccaacuuggaauagaaaagaacuauuagugacauuuaaaaacgcacaugccaagaaacaggagguuguaguuuuaggaucacaagagggugccaugcacacugcuuuaaccggagcgacagaaauucaaaauucagggggaaccucuauuuucgccggacaucucaaauguaggcuuaaaauggauaaauuggaguugaaaggaaugagcuaugcuaugugccucaauacauucguccucaagaaagaaguuucugaaacccaacacggaacaauccugauaaaaguagaguacaaaggggaagacgcuccauguaaaauaccguucucuacagaagaugggcaaggaaaagcccauaauggccgguugaucacagccaacccgguuguaacaaagaaagaagaaccagugaacauagaagcagaaccuccuuucggagagucuaacauuguaaucggcauaggcgauaaagcacuaaaaauaaauugguauaagaaaggcagcucaauaggaaaaauguucgaagcuacggcgaggggcgcgcgaagaauggcuauauuaggcgacacugccugggauuuuggaagcgugggaggaguuuugaacucacuaggaaaaaugguacaccaaauuuucggaagcgccuacacagcuuuauucaguggaguaucguggaucaugaaaauugguauaggcgugcuccuaacauggauaggacucaacagcaaaaauaccucaauguccuucucuugcauuguuauugguaucauaacccucuauuuaggcgcugugguccaggcagacauggggugcguaauaaacuggaaaggaaaagaauugaaauguggaagcgguauauuugugacaaacgagguacauaccuggacagaacaauauaaguuucaggccgacucucccaaacgacuugcuacagcuauagcaggagccugggagaacggagucugcggcauacguagcacaaccaggauggaaaacuuacuuuggaaacaaaucgcaaacgaacuaaacuauauuuuaugggaaaauaauauaaagcugacaguaguagugggugacauuauaggcguguuggaacaaggcaaaagaacgcuaacaccucagccaauggaauuaaaguauucauggaaaacaugggguaaagcuaaaauagucacagcggaaacucaaaacucaaguuuuauaauagacggacccaacacaccggaauguccaagugccucucgagcguggaacguaugggagguggaagauuacgguuuuggcguauucacaacaaacauauggcuuaaacuaagagaaguuuauacgcagucaugcgaucauagacugauguccgccgcgaucaaagacgaaagggcaguacaugcggacaugggauauuggauugaaagucagaaaaaugggaguuggaaauuagaaaaggccucauuuauagaaguaaaaaccuguacguggccgaaaucacauacacuguggaguaaugggguacucgagagugauaugaucauaccaaaaucacuagcaggaccaauuucacagcacaaucaccgcccuggguaucauacucaaaccgcaggucccuggcaucuaggaaagcuagaacuagacuuuaacuauugcgagggaacaaccguagugaucacagagaauuguggaacacgcggaccuucccugcguacaacuacaguaucgggcaaguuaauacaugaaugguguuguagaucauguacauuacccccuuuacgguauaugggugaagauggauguugguauggaauggagauucgcccaauaaacgagaaagaagaaaauaugguuaaaagucuagucuccgcuggauccgguaagguugauaauuucacaaugggcguucucuguuuagcgauacuauuugaagaagugaugcguggcaaguuuggcaagaaacauaugauagcggguguacucuuuacguuugugcuacuacugucaggucaaaucacguggcgagauauggcucauacucuuauuaugauaggaucuaaugcuucugaccggaugggaaugggugugacuuaccuagcucuuauagccacuuucaaaauacaaccauuucuggcguuaggauucuuuuuaagaaaacuaacaucuagggaaaauuuacuccuuggaguugggcuagcgauggcagcuaccuuacaauuaccugaagacauagagcaaauggccaaugguauugcccucgguuuaaugacucuuaaauuaaucacgcaauuugaaacauaucaacuuuggacggcacuuguaaguuuaacauguucgaauacgauauuuacacuaacaguagcauggcguacagcgacccugauuuuagcaggaguaucccuccuaccucuaugccaaucaaguucaaugcguaaaacugauuggcuuccgaugacagucgcagcaaugggaguaccuccgcuuccccuauuuauauuuucauuaaaagauacuccgaaaagaagaagcuggccacucaaugagggagugauggccguaggauuagugucaauucuagcuucgucuuugcuacgaaacgauguucccauggcaggcccucuaguggcagggggucuauuaauagcgugcuacguaauuacaggaacaucugcagacuugacaguagaaaaagcagccgauguaaccugggaagaagaggcugaacagacagguguaagucauaacuuaaugauaaccguagacgaugauggaacuaugcgaauaaaagaugaugaaacggaaaacauccuaaccgugcuccucaagacggcgcuauuaauugugagugguguauuuccauauucaauuccagcaacucuacucguauggcacacauggcaaaagcaaacacaacgauccgggguuuuaugggauguaccaucaccaccagaaacucagaaggccgaauuagaagaagguguauaucgaaucaagcaacagggcaucuucgguaagacucaagugggagucggcguucaaaaggaagguguauuucauaccauguggcaugugacuagaggugccguucuuacucauaacggcaaaagauuagaaccaaacugggcuuccgucaagaaagacuuaauuucguacggagguggauggcgacuaucugcgcaauggcaaaaaggggaggaaguacaaguuauagccguugaaccaggcaaaaacccuaaaaauuuucaaacaaugccuggcauauuccaaacaacuaccggggaaauaggagcaauagcucuugauuuuaaaccaggaacaucuggaucacccauaauaaaucgagaaggaaaaguuguagguuuguaugguaacggaguagugaccaaaaauggcggauacguaagugguaucgcucaaacuaacgcggagccggaugggccgacacccgagcuugaggaggaaauguucaagaaacguaaucuaacgauaauggaucuacauccgggcuccgggaaaacuagaaaauaccuuccagcaauaguuagagaggccauaaaacgacgacuccggacacuaaucuuagcaccaacccgaguggucgcagcagaaauggaagaagcacugaaagguuuaccuauacgauaccaaacuacagccacuaaauccgagcauacuggucgcgagaucguagaccuaaugugccacgcuacuuuuacgaugcgacuauuaagccccguaagaguucccaacuauaacuuaaucauuauggaugaagcgcacuucacagauccagcaucgauugccgcacgaggcuauaucagcacgcgcguuggaaugggagaagcggcagcuaucuuuaugacggcuacgcccccgggcacagcagaggcguuuccccaaucaaaugcaccaauccaggacgaagaacgggauauuccugaaaggucguggaacuccgguaacgaauggauaacugauuuugugggcaaaacaguuugguucguuccaucaauaaaagcagggaaugacauagcaaauugccuaaggaaaaaugguaagaaaguuauacaacuaagucgaaaaaccuuugacacagaauaccagaaaacuaaauuaaaugauugggacuucguaguaacaacagauauuagugaaaugggagcgaauuuuaaagcagaucgcguaauagauccucgcagaugccuaaaaccaguuauucuaaccgauggcccagagagaguaauucuugcaggcccgaugccggucaccgcagcuucggcagcucaaagaagaggccguguaggacgaaauccacaaaaggaaaaugaccaauauauuuucacugggcaaccucuaaacaaugacgaagaccacgcgcacuggacagaggcgaaaauguuacucgauaauauuaauacaccggaagggauuauuccggcccuauucgaaccagaacgcgaaaaguccgcggccauagauggagaauaccgauuaaaaggugaaucaaggaaaacuuuuguagaguuaaugcgaagaggagaucuuccaguguggcuagcccauaaaguagcaagugaagguaucaaauauacagaucggaaauggugcuucgacggggaaagaaauaaccaaauucuagaagaaaacauggacgucgagauauggacaaaagagggugaacgcaagaaauugagaccacgcugguuagaugcaagaacuuacagugauccuuuagcgcuuaaagaguuuaaagauuucgcagcggggcguaaguccauugcuuuggaccuuguuaccgagauugggcgcguaccuucccaucuagcuuacaggacucguaaugcacuagacaaucugguaauguuacauaccucugaacaugguggucgagcguaccggcacgcgguagaagaacucccugagacaauggaaacguuguuguuguuaggacucaugauacuacugacaggaggugcgaugcuuuuucuuaucucagguaaaggaauuggaaaaacgucaaucggguuaauuugcguaauuguuucuagugguauguuauggauggcagauguuccuuugcaauggauagcauccgcaaucgucuuggaguucuuuaugaugguucugcuuaucccagagccugaaaaacaaagaacaccacaggacaaucaauuagccuacguaguaauaggcauucuuacauuagcagcaauaguagcagcaaaugaaaugggccuucuggagacaacaaaaagagaccuaggcaugaguaaagaaccagguguuguuucuccaacaucauaccucgacguagaucuucacccagcaucagcauggacacuauacgccguagcaacgaccguuauaacaccuauguuacgacacacuauagaaaauaguacggcgaauguaucccuagccgcgaucgcaaaucaagcuguaguucuaauggguuuagauaaaggguggccaauuucuaaaauggaucuaggaguaccacuuuuagcacucggguguuauucacaggucaauccacuuacauugacggcggcuguuuuauugcuagugacgcauuaugccauuauagguccaggacuacaagcaaaagcgacaagagaagcacaaaaacgaacggccgcaggcaucaugaaaaauccuacuguagacggaauaaugacaauagauuuggacccuguuauauaugauucaaaauuugaaaaacagcuuggacaaguaaugcuucucguauuaugugcaguacagcuucuacucaugcguacgucgugggcauugugugaggcuuuaacucuugcaaccggaccaauaacaacauugugggagggaaguccggguaaguuuuggaauacaacuauagccguaagcauggcaaacaucuuucgagguucuuauuuagcuggggcugguuuagcuuuuucaauuaugaaauccguaggcacaggccgucggggaacagggagccaaggggagacauuaggagaaaaauggaagaagaaacugaaccaauugaguaggaaagaguuugauuuguauaagaaauccggaauaaccgagguggacagaacggaagcaaaggaggguuuaaagagaggcgaaaccacgcaucaugccgucuccaggggcagugcaaaauugcaaugguuuguugaaaggaauauggucaucccugaaggccgcguaauugauuuagggugugggaggggaggcuggaguuauuacugcgccggacucaagaaaguuaccgaaguucgcggauacacaaagggcggaccaggacaugaagaaccugucccaaugucaacauacgguuggaacaucguaaaauugaugagugguaaagauguguucuaucuaccuccugagaaaugugauacacuacuaugcgauauaggugaauccucaccaaguccaacuguagaagaaucaagaacuauacgcguuuuaaaaaugguugaaccuugguuaaagaauaaccaauuuuguaucaaaguauugaacccuuauaugccaaccguaaucgagcaucuugagagacuucaaagaaaauacggggguauguugguaaggaauccgcuuucccgcaacucaacacacgaaauguauuggauaaguaaugguacugggaacauugucaguagcguuaacauggugucaagacuacuacugaauagauuuaccaugacucauagaagaccuacgauagaaaaagauguagaucugggugccgguacacgacauguaaacgcggaacccgaaaccccaaacauggacgucauaggagaaagaauuaagagaauuaaagaagaacacucauccacuuggcauuacgaugacgaaaacccauauaaaaccugggcuuaccacgguuccuaugaaguaaaggcgacugguagugcgucaucaaugauaaacggugucgugaaguuauugacaaagccaugggauguugugccuaugguaacucaaauggcuaugacagauacaacuccuuucggacaacaaagaguuuuuaaagaaaaaguagauacacguacgccgagaccaaugccaggaacucgaaaagucauggaaauuaccgcggaauggcuuuggcgcacgcucggaagaaauaagaaaccaaggcuguguacacgggaagaguucacaaagaaaguucgaacgaacgcagcgaugggcgcagucuuuacggaagagaaccaaugggauuccgcaagagcagccguugaagaugaagaguucuggaagcuaguagaccgugaacgggaguuacacaaauuaggaaaaugcggaucgugcgucuauaacaugaugggaaaaagagagaagaaauuaggcgaguucggcaaagcgaaaggaaguagagcaauaugguauaugugguuaggggcaagauauuuagaauuugaagcgcuuggguuucuaaaugaagaccauugguucaguagagaaaauucuuacucaggaguagagggggaaggacugcacaaauuaggauacaucuuaagggauauaucaaaaauaccaggaggcgccauguaugcugaugacacggcagggugggauacacguauaacugaagaugaccuucauaaugaagagaaaaucacacagcagauggauccagaacauagacagcuagcuaaugcgauauuuaaguuaaccuaccaaaacaaggucgugaaaguucagcgcccaacccccaaaggaacugugauggacauaauaagucgcaaggaccagcgaggaagcgggcaggucggaacguacggucuaaacacauuuacaaauauggaagcucagcuagugagacaaauggaaggcgaggguguauuauccaaggcagacuuagaaaauccacauuuauuagagaaaaagauaacacaaugguuagaaacaaaaggaguagaacgcuugaaaagaauggccauaucaggagacgauugugucgucaaaccuauagaugauagauucgccaacgcacuuuuagcuuugaacgauaugggaaaaguucguaaggacauuccacaauggcaaccaaguaaaggauggcaugauuggcaacagguuccuuucuguucccaucacuuccacgaacuaauaaugaaagauggacggaaacuuguuguuccuuguagaccacaggaugaacuaauugggcgggcaaggauaagucaaggagccggcuggucgcucaaagaaacugcuugcuuaggaaaggccuacgcacagauguggucgcugauguacuuucauagaagagaccuucgcuuagcuucaaaugcgauuuguagcgcuguuccuguacacuggauaccaaccucaagaacaacuuggucaauacacgcgcaucaucaauggaugacgaccgaagauauguuaacgguuuggaauagaguauggaucgaagauaauccauggauggaggauaaaaccccaguaacaaccugggaagacguaccuuauuuaggcaaacgagaagaucaguggugugggucguuaaucggauugacgucucgagccaccugggcacaaaacauuuuaacggcgauccaacaaguacguaguuuaauuggcgacgaagaauuuuuagauuauaugccuaguaugaagagguucagaaaggaagaagaaucggaaggugccauaugguag

SEQ ID NO: 23482 - RNA, 9873 nt, Artificial Sequence
  derived and/or modified CDS sequence (opt6) from DENV-3__FJ432741__SS-prME
accucucuaugcuuaaugaugaugcuacccgcaacauuagcuuuccaucuaacaagccgggauggagaaccuagaaugauagugggcaaaaacgaaaggggcaaaucacuucuauuuaaaacugcaucaggcauaaauauguguacgcuaauagcaauggaccucggugaaaugugcgacgauacagucacguacaaaugcccccucauugcggagguagaaccagaagacaucgacuguuggugcaaucugacgaguacuugggucacuuaugguacaugcaaccaagcgggugaacacagaagagacaaacggucaguagcacuagcuccccauguggggaugggacuagacacacggacacaaacuuggaugucagcagagggugcguggagacaaguagaaaaagucgaaaccugggcauuaagacauccaggguuuacaauuuuagcgcuuuuucuugcacauuauauuggaaccucacugacucaaaaaguuguaauuuucauauuacucauguuagugacgccuagcaugacaaugcguugcguaggaguagggaacagagauuuugucgaagguuugaguggugcuaccuggguagacgucguauuagaacauggagggugcgugacgacgauggccaaaaacaaacccacauuagauauagaauuacagaaaacagaagcaacucaauuagcuacguuacgaaaacuaugcauagaaggcaaaauaaccaacauuacgacggacucaagguguccgacucagggagaagcaauacuaccagaagaacaagaucaaaacuacguaugcaaacauacauauguagaucgcggguggggaaacggguguggucuguucggcaaaggaucacuggucacuugugcaaaauuccaauguuuagaaccaaucgaaggaaaagugguacaauacgaaaauuugaaauacacaguuaucauuacaguacacacaggugaccaacaucaaguaggaaaugauacacaagguguuacgguggaaauaacaccccaggcuucgacgguagaagcaguucugcccgaauaugggacguugggacuagaguguuccccuagaacuggauuggauuucaaugaaaugauauuguuaacaaugaaaaacaaggcuuggaugguacaucgucaaugguucuuugaucuaccuuuaccuuggaccucaggagcaacaacugaaacuccgaccuggaacaggaaagagcuccuagugacauucaaaaaugcgcaugcuaagaaacaagaaguuguuguauuaggcucacaagaaggagcaaugcacacagcgcuaaccggcgcgaccgaaauucaaaacucaggagguacuagcauauuugcaggacauuugaaaugucgcuuaaaaauggauaaauuggaguuaaaaggcaugagcuaugcgaugugucuaaacacauuugucuugaagaaagaagugagcgagacccaacauggaacuauauugauaaaagucgaauauaaaggcgaagaugcuccauguaaaauuccuuucaguacagaagauggucaagguaaagcacacaauggucgucuaauaacagcaaauccagugguagccaagaaagaagaaccaguaaacauugaagcggaaccaccguuuggcgaaucgaacaucguuaucggaauaggagauaaagcacuuaaaauuaauugguauaagaaagguaguuccauuggaaaaauguuugaagcaacagcaagaggcgcuagaagaauggcaauuuuaggugauaccgcaugggacuuugggucaguuggugggguacuuaacucauuagguaaaaugguucaccaaauauucgguucugcauacacugcacucuuuucuggugucuccuggaucaugaaaaucggaauaggagugcuauugacuuggauuggcuuaaacucuaaaaauacuagcaugagcuucaguuguauagugauagguauaaucacauuauaucuuggcgcggugguacaagcagacaugggcugcgcaauaaauuggaaagguaaagaauuaaaauguggaucgggaauuuuuguaacgaaugaaguucauaccuggacggaacaauacaaauuucaagcagacaguccaaaaagauuagcaaccgcaaucgcaggagcaugggagaauggcguuugcggcaucagaucaacaacacgaauggagaaucuguuguggaaacaaaucgcgaaugaauugaauuacauauuaugggagaacaauaucaaacugacaguggucgugggugauauaaucgggguuuuggaacaaggcaagcggacgcugacuccacaacccauggaauugaaauauagcuggaaaacuuggggcaaagcuaagaucguaaccgcugaaacacaaaacucuucguucauuaucgauggaccgaauacaccagaauguccgagugccucgagagcauggaacgucugggaaguagaagauuauggcuuuggaguuuucaccacuaauauauggcucaagcugagggaaguacacacacaaaguugugaccaucgacuaaugagugcagcaaucaaagaugaacgugcagugcaugcugauaugggcuauuggauugagagucagaaaaacggaucuuggaaacucgaaaaggccucuuucaucgaaguaaaaacuuguacguggccgaagucgcauacacuguggucaaauggcgugcucgagucagauaugguuauuccuaaaaguuuagccggcccuauaagccaacauaaucaccggccuggauaucauacgcaaacagcaggaccuuggcauuuaggaaaacucgaauuagauuucaauuauugugagggaacaacaguaguuauaacugaaaauuguggaaccaggggaccaucauuacgaacgacaacuguaagcggaaaauuaauacaugaauggugcugucgaucguguacguuaccuccgcuacgauauaugggagaggauggcugcugguauggcauggagauucgcccaauuaaugaaaaagaggagaauaugguaaagucgcugguauccgcggguucuggaaaagucgacaauuucacaaugggcguguuguguuuagcgauauuauucgaagaaguaaugagaggaaaauuugggaagaagcauaugauagccgguguguuauuuacguucguacuucuguugucaggucagaucaccuggcgugauauggcacacacucugauaaugauuggaagcaaugcaucugauagaaugggaaugggaguuacauaccuugcacuaauagcaaccuuuaaaauucaaccguuccucgccuuaggauuuuuccuaaggaaacuaacaucgcgagaaaaccuccuccucggugucggccuagcuauggcuaccacucuacaguuacccgaagauauugaacaaauggcaaauggaauagcguugggguuaaugacauuaaaauugauaacacaauuugaaacauaucaacuauggacagcauuaguuucguugaccuguucaaauacaauuuuuacuuuaaccguagcguggaggaccgcaacacuaauucuagccggaguuucauugcuaccccuuugucaauccagcagcaugaggaaaacggauugguuaccaaugacgguugcugcaauggguguaccaccacuacccuuauuuaucuuuucauuaaaagacacuccuaagcgacguaguuggccccuuaaugagggcguuauggccguuggucuaguuagcauacuugccucaaguuuacuacgaaaugauguacccauggcagguccacugguugccgguggacuguuaauugcaugcuacgucauuacaggaacauccgcagauuuaacgguugagaaagcugccgauguaacaugggaagaagaagcagagcaaaccggaguuagucauaauuuaaugauuacuguagacgaugacggaacaaugcgcauuaaggaugacgaaacugaaaauauacucacaguacuuuuaaagacggcacuucugauugugagcggaauauuucccuauucaauucccgcuacauuauuaguauggcacacauggcagaaacagacacagagauccggggucuugugggauguccccagucccccggagacucagaaagcagaacucgaggaagguguuuacagaauaaaacaacaggguauauucgggaaaacgcaaguaggcguaggugugcaaaaagaggguguuuuccacacaauguggcacguaacucguggagcaguguuaacgcacaacggaaaaagacuugaaccuaacugggccucgguuaagaaagacuuaauaaguuacggcggcggguggagguuaagcgcacaauggcaaaaaggggaagaagugcaaguaauugcuguagaaccggguaaaaacccuaaaaauuuucagacaaugccgggaauauuccaaacaaccacgggagagauaggagcgauagcgcuagacuuuaagccgggaacuucuggcagcccuauuauaaaccgcgaagggaaaguaguaggucucuauggaaauggagugguaacuaaaaauggagguuaugucucugguaucgcgcaaacaaaugccgaaccggauggaccaaccccugaauuagaagaagaaguguucaagaagagaaaucucacaauaauggauuuacaccccggguccgguaaaacacgaaaauaucuaccugcaauaguccgugaagcuauaaaaaggagacuucgcaccuuaauacuagcgccaacaagaguaguugcugcggagauggaggaagcacugaaaggucuaccuauuagauaucaaacuacagcuaccaaaagugaacacacuggaagagaaauuguugaccuuaugugucacgcgaccuuuacuaugagauuacuaucuccaguuagaguacccaauuauaaucuaauaauaauggaugaggcacacuuuaccgacccggcauccauugcagcucggggcuacauuucuacgcgaguaggaaugggcgaggcggcugcuauauucaugacagcuacaccuccuggaacagcggaagcguuuccccaaaguaacgccccaauucaagaugaggagcgagauauaccagaaagaucauggaacucaggaaaugaguggauaacggauuuugucggcaagacagucugguucguuccaucaauaaaggcagggaacgacauugcaaauugcuuacguaaaaaugguaagaaaguuauccaacuaaguagaaagacguuugauaccgaauaucagaaaacacgcuugaacgacugggacuucgucguuacuacggauauaucagaaaugggggcaaauuuuaaagcggaccgaguuauugauccgcgaaggugccuuaaaccagucauauuaacagacggcccagaacgugugauacuugccggaccaaugccgguuacggcagcaagugcggcacagaggaggggcagaguuggacguaauccacaaaaagaaaacgaccaauauauuuucacuggacagccacuuaacaacgacgaagaccacgcacauuggacugaggcaaagaugcuucuagacaacauuaauacacccgaaggaaucauaccggcauuauuugagccagaaagagagaagucugccgcuaucgauggggaauacagauugaaaggggagagucgcaagacauucguagaauugaugcgucgcggagaccuuccuguauggcuggcccacaaaguagcuagcgaagguaucaaauauacugaucgcaaauggugcuuugauggugaaagaaacaaucaaauacucgaagagaauauggacguagaaauauggaccaaagaaggggagcggaaaaagcuaagaccaagaugguuagaugcgagaacauacucagauccauuggcuuuaaaagaguucaaagauuuugcagcuggucgaaagucaauagcguuagaccucguuacagaaaucggaagaguacccucucacuuagcuuaucggacgagaaacgccuuagacaauuugguuaugcuacacacgucggaacacggugguagggcauacaggcacgccguagaagaacucccagaaacuauggagacacuguuguuguuaggacuaaugauccuacuaacaggcggugccaugcuauuccuaaucucaggcaagggaauagguaagacaaguauaggauuaaucugcguaaucgucaguaguggaauguuauggauggccgauguacccuuacaguggauagccucggcgauuauauuagaguucuuuaugaugguacuauuaaucccagaacccgaaaagcagagaacaccacaagauaaucaacuugccuauguaguaauagguauauuaacauuggcugcaauaguagcugcaaaugaaaugggauugcuggagacaacuaagagggaucuugguaugagcaaagaaccgggaguagucagcccuacaagcuaccucgaugucgaucuacauccagccagcgcuuggacucuguacgcuguagcaacuacaguaaucacaccuaugcuacgucauacuauagaaaacaguaccgcaaacguaucacuggcugccauugcuaaccaagcuguaguauuaaugggucucgauaaagguuggccuauaucuaaaauggauuuaggcguaccauuauuggcacuaggauguuauagucaaguuaacccgcuuacuuuaacugccgccgucuuacuacucguaacacauuaugcgauaaucggcccgggucuucaagcuaaagccacaagagaagcgcagaaaagaacagcagcuggcauaaugaagaauccuacaguagauggcauaaugacuauagaccuagauccgguaauuuaugacucuaaauucgagaaacaauuaggucaaguaauguuauuaguacucugcgccguacagcuacuccuaaugcguacaaguugggcacugugugaagcgcugacccuugccacagguccgauuacuacguuaugggaggggucucccggaaaauucuggaacacaacgauugcuguuucaauggcgaauauauuuagaggaaguuacuuagccggugcaggauuagcguucucgauuaugaaaucaguuggaacaggaagacguggcacaggaagccagggagaaacacuuggggaaaaauggaagaagaaacuaaaccaauuaagucgcaaagaauuugaccuauacaagaaaaguggaauaaccgaaguugauagaacagaagcaaaagaggggcuaaaaagaggggagacuacacaccaugcugucagucgcggaucugcuaaacugcagugguuuguagagcgaaacaugguaauacccgaaggccgcguaaucgacuugggcugcgguaggggaggauggucuuauuauugcgcuggucugaagaaagucaccgaagucagagguuauacuaaagguggucccggacaugaggaaccugugccuaugucgacuuauggauggaaccuaguaaaauugaugagcggaaaagacgucuucuaucuacccccagaaaaaugugacacacugcugugugauauaggcgagucgagcccgucaccaaccguagaagaaucuaggacgauacgcguacugaaaauggucgaaccgugguuaaagaacaaucaauuuugcauuaaagucuugaauccauauaugcccacgguaauugaacaucuugaaaggcuacagcgaaaguauggagggaugcuaguacgaaauccccuaucccggaauaguacccaugagauguauuggauuagcaauggaacaggcaacaucguaucaucuguaaacaugguaaguagacuacuucucaauagauuuaccaugacacaccgacgacccacaauugagaaagauguugacuugggcgcaggcacccggcauguuaacgcagaaccagagacuccuaacauggaugugauaggugaaagaauuaaacgaaucaaggaagaacacagcucuaccuggcauuaugaugaugagaaucccuauaaaacaugggcauaccauggaucauaugaagucaaggcuaccgggagugcaucaagcaugauaaacggaguuguaaaguuacuuacaaaacccugggacguagucccaaugguaacgcaaauggcuaugacagacacaacaccauuuggacaacagcgaguauucaaagaaaaaguugauacaaggaccccacgaccuaugccaggcacgcgaaagguaauggagauaacagccgaauggcuguggagaacacucgggagaaauaagaaaccaagauuauguacgagagaagaauuuacuaagaaagugagaacuaacgcggcuaugggagccguauuuacggaagaaaaccaaugggauucugcaagggccgcgguggaagacgaggaguuuuggaagcuaguggacagagaaaggaaguugcacaaguuaggaaaauguggaucuugcguguauaauaugauggggaaacgcgaaaagaaacuaggggaauuuggcaaagcaaaaggaaguagagcaaucugguauaugugguuaggugcacgguaucuugaauuugaagcccuuggauuucucaaugaagaccauugguucaguagagaaaacucauauucaggaguugaaggagaaggacuucauaaguuaggauauauacuacgggacauuaguaaaauaccuggaggagcaauguacgcggaugacacagcagguugggauacucguauaacugaagaugauuuacauaaugaggagaaaauaacucagcagauggaccccgaacauagacaacuugcuaacgccaucuuuaaauugacauaucaaaauaaaguaguaaaaguacagaggcccaccccaaaagggacaguuauggacauuauuuccagaaaggaucaacggggaagcggacaaguggguacauauggucuuaacacauuuacgaacauggaagcacagcuaguaagacaaauggaaggagaaggggugcugucuaaagcggaucucgagaauccacaccuucuagagaagaaaauuacgcaguggcuagaaacaaaaggaguggaacgccucaaacggauggcuaucagcggugaugauugcgucguuaaacccauagaugacagauucgcuaaugcauuauuagcccugaaugauaugggaaagguaagaaaggauauaccacaguggcaacccuccaaaggauggcaugauuggcaacaaguaccauuuugcucgcaccauuuucaugaauuaauaaugaaagacgggcgaaaacucguagugccaugcagaccgcaggacgagcugauaggacgagcacguauaagccaaggggccggauggucuuugaaggaaacggcgugcuuaggaaaggcuuaugcucagauguggucauugauguacuuucacagaagagaccuuagacuugccucuaacgcgauauguagugcaguuccagugcacuggauaccaacgucgagaaccacuuggucuauacacgcacaucaucaguggaugacuacggaagacaugcugaccguuuggaauaggguauggauugaagauaauccuuggauggaagacaaaacucccguuacaacgugggaggacguaccauaucugggaaaacgugaagaucaaugguguggaagucuaauuggucuaacaucacgggcuacuugggcacaaaacauucugaccgcuauacagcaaguuagaucgcugaucggagaugaagaauuuuuggauuauaugccaagcaugaaacguuucaggaaggaagaagaaucugagggagcaauaugguaa

SEQ ID NO: 23483 - RNA, 9873 nt, Artificial Sequence
  derived and/or modified CDS sequence (opt6) from DENV-3__FJ562099__SS-prME
acuagccugugucuaaugaugaugcuuccugcaacauuagcguuccauuugacgucacgagauggagaaccuagaaugaucguagggaaaaaugaacgcgggaaaucuuuacuuuuuaaaacagcgucaggaauaaauaugugcacacugauagcaauggaccuaggagaaaugugugaugauacaguuacauacaaaugcccacucauagcagaaguugaacccgaagacauagauuguugguguaaucucacaagcacuugggugacguaugguacuuguaaucaagcuggggagcaucgacgagauaaacgaaguguagcauuagcuccacauguuggaaugggacuggauacuagaacucaaacauggaugucagcugaaggugcauggcgacaaguagaaaaaguagaaacaugggcucugagacaucccggauuuacuauccuggcguuauuuuuggcgcacuacauaggaaccucucucacacaaaaagugguaauauucauucuauuaauguuaguuacccccucaaugacgaugcguuguguagggguagguaaccgugacuuugucgaaggccuuagcggugcgacuuggguugaugucguauuagaacauggagggugugucacuacgauggccaaaaacaaaccaacgcuugauauugagcugcagaaaacagaggcgacacaauuagcuaccuugcguaaauuaugcauagaaggaaaaauuacgaauaucaccacggauaguagauguccuacacaaggggaagccauucuaccagaggagcaagaccaaaauuauguaugcaaacauaccuaugucgaccgaggauggggcaacgguuguggccucuuugguaaaggaucauuagucacuugugcgaaauuucaaugucuggaaccgauagaagguaaaguaguacaauacgagaaucuaaaauauacaguuauaauuacaguacacacaggagaccaacaccaaguagggaacgacacacaaggaguaaccguugaaauuacaccacaggcuucgaccguugaagcaguuuugccagaauacggaacuuuggguuuagaaugcaguccccggaccgguuuagauuucaaugaaaugauucuauuaaccaugaaaaauaaggcuuggaugguacaucgacaaugguucuuugauuugccacuuccauggaccaguggggcaaccacagaaaccccuaccuggaaucgaaaagaauuauuaguaaccuuuaaaaaugcucaugccaagaaacaagaggucguuguucucggaagucaagaaggagcaaugcacaccgcucugacaggagcuaccgaaauucaaaacagcggcgguacaucaaucuucgcugggcaucugaaaugcagacuuaaaauggauaaacuagaauuaaaagguaugucauaugcaaugugucuaaacacauucguccuuaagaaagaagugagugagacgcaacacgguacaauacuaauaaaaguggaauauaaaggugaagacgcgcccugcaaaauuccauuuaguaccgaagacggacaaggaaaagcgcacaacgggcgacuuauaacggccaauccuguagucacgaagaaagaagaaccgguaaacaucgaggcagaaccacccuuuggagaaaguaauauugucauagguauuggcgacaaagcguuaaaaaucaacugguacaagaaagguuccaguauuggcaaaauguuugaagcuacagccagaggagcuagaagaauggcuauauugggugauacggcuugggauuucggaucaguugguggaguauugaacagucuaggaaaaaugguacaucaaauuuuuggauccgcauacacagcucuguucucggggguuagcuggaucaugaaaauugggaucggagugcuauuaacauggauugggcuaaauucgaaaaauacaucaaugaguuuuaguuguauaguuaucggaauaauaacgcuuuaucugggugcaguaguacaagccgauaugggaugcgugauuaacuggaaaggaaaagaguugaagugcgguucagguauuuuugugaccaacgaaguacacaccuggacggaacaauauaaauuccaagcagacaguccaaaacgucuggcaaccgcaauagccggggcaugggaaaauggcgucugcggaauaagauccaccacuagaauggaaaauuuauuauggaaacaaauagccaaugaacuaaauuacauacucugggagaauaauauuaaacuaacgguuguaguaggggauauaauaggaguccucgagcaaggaaaaagaacgcuaaccccacaaccaauggaacugaaauauagcuggaaaacguggggaaaggcuaaaauaguuacugcagaaacucaaaacuccaguuuuauuauagauggucccaacacaccugaauguccaagugcuucuagagcauggaaugugugggaagucgaagacuacggauuuggagucuuuaccaccaauauaugguuaaaacuacgagaaguauacacacaaaguugugaucaccgccugaugucagcagcaauuaaagacgagcgagccguacacgccgauauggguuauuggauagaaucacagaaaaauggaucguggaaauuggagaaggccagcuuuauugaaguuaaaacauguacguggccaaaaucacauacguuguggucaaacggaguacucgaauccgacaugauuauuccaaaaagucuagcuggcccgauaucucaacauaaucauagaccaggauaucauacacagaccgcuggacccuggcaccuugggaaauuagaauuggacuucaauuauugcgagggaaccacuguaguuauuacugaaaauugugggacucgagguccaagucucagaacaacgacuguuaguggcaaacuaauccaugaauggugcuguaggucaugcacacuuccaccauuacgauacaugggugaagaugguugcugguauggaauggagaucaggccuaucaacgagaaagaggagaauaugguuaaaucuuuggugucagcaggcucaggcaagguagauaauuucacuauggguguccuaugucuugccauccuauuugaagagguaaugcguggcaaauucgggaagaaacacaugaucgccgguguacuauuuacauucguucuucugcuaaguggacagauuacuuggagggauauggcacacacucuaauaaugauuggcucuaacgccagugaucguaugggaaugggaguaacguaucuugcgcuaauugccaccuuuaaaauacagccguuccuagcguuaggguucuuucuuagaaagcuaaccucucgggaaaauuuguuauugggcguaggacucgcaauggcaacaacucuacagcuuccggaagauaucgaacaaauggcaaacgguauagcgcuaggauuaaugacucucaaacuaauuacacaauuugagacauaucaauuguggacagcauuggugucgcuuacauguaguaauacaauuuuuacuuuaacgguugcauggcgaacagcuacacuuauccuugcaggggugucacuacuaccacucugccagucaagcucgaugcgaaaaacagauuggcuaccgaugacaguagcugccaugggaguaccaccucuaccuuuguuuaucuucucguuaaaagauaccccgaaaaggaggagcuggccucucaacgagggaguaauggcgguaggccuaguuagcauacuugcaucuucccuccugagaaacgauguccccauggcaggcccgcuugucgcugguggauuacugauugccugcuacguaauaacuggcacgagugcggaucugaccguggagaaagcugcugacgucacaugggaggaggaagcggaacaaacaggugucagccauaaucugaugauaacaguggaugaugacgguacaaugaggauaaaagaugaugaaacugaaaacauucuuacgguauuacuaaaaacagccuuacugauagucagugggguauucccauauucaauacccgcaacucuacucguauggcauacguggcaaaaacaaacccaaagaucaggaguucuaugggaugugccgaguccgccugaaacgcaaaaagcagaacuggaggaaggaguauauagaauaaaacaacagggcauauucggaaaaacacaagucggcguuggcguacagaaagaggguguauuccauacgauguggcauguaacacguggagcuguuuuaacucauaauggcaaacgcuuagaaccuaauugggcgagugucaagaaagaucucauauccuacggugguggauggcgacucucugcgcaauggcaaaaaggcgaggaaguacaaguuauagcuguagaacccgggaaaaaccccaaaaacuuucagacaaugccuggaauauuucagacgaccaccggcgaaauaggagcaauagcccuagauuuuaagccagguacuuccggcucgccgaucauaaaucgugaggggaaaguaguuggcuuauacggaaacggagucguaacgaaaaauggaggcuauguuucagguaucgcacaaacgaaugcggagccugacggaccgacuccagaacuagaagaagaaauguucaaaaagagaaaccucacgaucauggaccuucauccagggagcggaaagacaagaaaguacuugccugcaauagucagggaagcaauaaaaagaagacuaaggacuuuaauuuuagcaccuaccaggguaguagcugcagagauggaagaagccuuaaaaggguugccgaucagauaccaaacgacugcaacgaaaucugaacauaccggaagagaaaucguagaucuuaugugucacgccaccuucacuaugcgcuuauuaaguccaguaagggugccaaauuacaaccuaauuauaauggaugaggcacacuuuacagacccagcaucgauugcagcaagaggauauauuucaacccgcguugguaugggugaggcagcagcaauauuuaugacggcaacuccuccuggcaccgcagaggcuuuuccucaaucaaacgcgccaauacaggaugaagaaagggauauaccggaacgaucguggaacucuggcaaugaauggauaacugacuuuguuggaaaaacgguuugguuuguaccaucgauaaaagcaggcaacgacauugcaaacuguuuaaggaaaaauggaaagaaaguuauacaguuaagucgaaaaacauuugauacagaauaucagaaaacaaaacuaaaugacugggacuucguaguuacaacugauauuucagaaaugggggcaaauuuuaaagcagaucggguuauugauccccgcagaugucuaaaaccagugauccugacagaugguccugaacggguuauauuggcugggcccaugccaguaacugccgccucugccgcacagcgcaggggaagggucggaaggaauccucaaaaagaaaaugaucaguauauauuuacuggccaaccauugaacaaugaugaagaucaugcucauuggacugaagccaaaaugcuacuugauaauauuaacacaccagaaggaauaauucccgcucuguuugaacccgaaagagaaaaauccgcugccaucgacggagaguacagauuaaaaggggaauccagaaaaacguucguagaacuuaugaggcgcggcgaucuaccaguaugguuggcacacaagguugccagcgaagguauuaaguauaccgaucgaaagugguguuucgauggugagcgcaacaaccaaauacuagaggaaaauauggauguagagauauggacaaaagaaggugaaagaaagaaacuacgaccgaggugguuagacgcccgaacauauuccgacccauuagcgcugaaggaauuuaaggauuuugcagcagggaggaaaagcauagcacuggaccuaguaacggagauuggcagaguacccucucaucuagcuuacagaacuagaaacgcgcuagauaaccuuguuauguuacacacgucagaacauggaggccgugcuuauagacaugcuguugaagaacuaccggagaccauggaaacacuucuucugcugggucuaaugaucuuauugacaggaggugccauguuguucuugaucucaggaaaaggcaucggaaaaacuucaauugguuuaauaugugucauuguaaguucagggauguuauggauggcagaugugccuuuacaguggauagcaagcgcuauuguauuagaguucuuuaugaugguucuucugaucccagaaccugaaaagcaacgaacaccucaagacaaccaacuggcguacguuguuauuggaauuuuaacacuagcugcaauaguggcugcaaacgaaaugggauuguuagaaacaacaaaacgcgaucuaggaaugucgaaagagccaggggugguaucccccacguccuacuuagacguagacuuacauccagcuucagcuuggacauuguaugccguagcaacuacuguaauaacgccgaugcuaagacauacuauagaaaauucgacugcaaaugucucguuagcagcaauagcaaaccaggcagucguuuuaaugggucuugacaagggauggcccauuaguaaaauggaucuugggguaccauuguuggcucugggauguuacagucaggucaauccacucacguuaacugcugcggucuuacuacuggucacucacuaugcaauaauugguccuggacuacaagcgaaagcgacccgagaagcucaaaagcggacggcggcaggaauaaugaaaaauccgacaguagauggaauuaugacgauugaucucgacccuguaauuuacgauuccaaguuugaaaagcaauugggucaaguaauguuacuuguauugugugccguacaguuauugcucaugagaacguccugggcacugugugaggcucuuacacuagcuacggggcccauaacaacuuugugggaaggaucuccaggcaaauuuuggaauacaaccauagcagucucuauggccaacauauuuaggggcucuuauuuagcuggugcaggauuagcauuuucaauaaugaaaucaguagguacaggucggagaggaacaggaucccaaggagaaacauuaggagaaaaguggaagaagaaauuaaaccaacugucacguaaggaauuugaccuauacaagaagaguggcauaacugaaguagauagaacggaagcuaaagaaggacuuaaaaggggagagacuacacaucaugcagucucaaggggaucugcaaaauuacaaugguuuguugaacggaauaugguuauaccugaggguagaguuauagaccuuggauguggaagagguggauggucauauuacugugcuggacuuaaaaagguaacggaaguaagaggauacaccaaagguggaccaggucacgaagaacccguaccaaugucaacuuacgguuggaauaucguaaaguuaaugagugggaaagauguuuucuaucuaccacccgaaaaaugugauacucuucuuugugacauaggagaguccaguccgucccccacgguggaagaaucucggacgauacgaguacuaaaaaugguagaaccuuggcuuaagaacaaccaauuuuguauuaaaguuuugaacccuuacaugccaaccguaauagaacaucuggaaaggcuacagcguaaauacgguggaauguuggugagaaacccuuugucucgaaacagcacgcaugaaauguacuggauuaguaaugguacggggaacauuguuaguagcguaaauauggugucaagauuauuguugaauagguuuacaaugacucacaggcgacccacaauagaaaaagauguugauuuaggggcggguacaagacacgucaacgcggaaccugagacgccaaauauggacguaauuggcgaaagaauaaaacgaauaaaagaagaacacaguucaacauggcauuacgacgacgaaaauccauauaagacaugggcuuaucauggaaguuacgaaguaaaagcgacugguagugccucaaguaugauuaacggaguaguaaaacuauugacaaagcccugggauguaguaccaauggugacgcaaauggcaaugacagacaccacuccuuuuggucaacaacgagucuucaaggaaaaaguagacacccgcacaccaagaccaaugcccgguacaagaaaaguaauggaaauuacagccgaguggcuuuggaggacguuaggucgaaacaagaaaccuaggcuaugcacuagagaagaauuuacgaagaaaguccgaacuaaugcugcuaugggugccguauucacagaagagaaccagugggauucugcucgagcggcgguagaagaugaagaauuuuggaagcugguggacagagaacgagaguuacacaaauuaggcaaauguggaaguugcguauauaacaugaugggcaaaagagagaagaaacugggagaguucgguaaagcuaaaggaagccgggcaauuugguauaugugguugggugcuagauaucuagaauuugaagcucucggguuuuugaacgaagaucauugguuuagucgggaaaauucauauaguggaguagaaggagaaggauuacacaaauuaggguacauuuugagagacauaagcaaaauaccagguggagcaauguacgcugaugacacagcugggugggacacuaggauaacagaagacgauuuacacaacgaagagaagaucacucaacaaauggauccggagcauagacaauuagcaaaugcuauauuuaaauuaacauaccaaaauaaagucguaaaaguacaaagaccuacuccaaaagguacuguaauggacauuauaagcagaaaagaucaaaggggaucaggucaaguaggaacauacggucuaaacaccuuuaccaauauggaagcacagcuaguacgucaaauggagggagaaggaguccuuagcaaggcagauuuagaaaauccgcaccuucuugagaagaaaauaacucaguggcuugaaaccaagggggucgagagauugaaacgaauggcuauaucaggugaugacuguguaguaaaaccuaucgacgaccgauuugcgaaugcguuacuggcacuaaaugauaugggaaagguaagaaaagacauaccacaauggcaaccaagcaaaggauggcaugacuggcaacaaguaccauuuuguucgcaccauuuucaugaauugauuaugaaagauggacgaaaauuaguagucccuugucgaccucaggaugaguugaucgguagagcuaggaucagccagggagcggguuggucauuaaaagaaaccgcaugcuuggggaaggcauacgcccaaauguggagccuuauguauuuucaucgucgggauuugcgucuagcgucaaacgccauaugcucugcaguccccguucacuggauuccuacaagucgaaccacauggaguauacacgcacaccaucaauggaugaccacugaagauaugcuaacagucuggaacagaguguggauagaagacaacccuuggauggaagauaaaacaccagugacaacuugggaagauguucccuauuuagguaaacgcgaggaucaauggugcggaagucucauuggccucacuucacgugcaacaugggcgcaaaauauauuaacggcgauacagcagguaaggaguuuaauuggugaugaagaauuucuagauuacaugccgucuaugaaacguuuuagaaaagaagaagaaagugaaggugcuaucugguaa

SEQ ID NO: 23484 - RNA, 9873 nt, Artificial Sequence
  derived and/or modified CDS sequence (opt6) from DENV-3__KF955457__SS-prME
accucacuaugccuuaugaugaugcuacccgcaacguuggccuuccauuuaacgucccgagauggagaaccuagaaugauuguaggcaaaaaugaacgcggaaaaucauuauuauucaaaacugcaaguggaauuaauauguguacccuaaucgcuauggaccuaggagaaaugugcgacgacacuguaaccuacaaaugcccauuaauagcugaaguagaacccgaagauauugauuguugguguaaucuaacgaguacuuggguuacauacgggacgugcaaccaagccggagaacauagaagggacaaaagauccguagcguuagcaccacauguaggaaugggucuggacacucguacacagacuuggauguccgcggaaggagcauggaggcaaguagaaaaaguagaaacaugggcguuaaggcauccugguuucacuauauuagcucuauuucuagcgcacuauauuggcaccaguuuaacucagaaagucguuauuuucauuuuacuaaugcucguuacuccuagcaugacuaugaggugcgucggaguagguaaucgcgacuuugucgaaggacuaucaggcgccacguggguggaugucguccuugaacauggggguugugucacgacgauggccaaaaacaaaccaacuuuggauauagaauuacagaaaacugaagcaacacaacuagcaacacuaagaaaacuauguauagaggggaaaauaacaaauauaacuacugauucgaggugcccaacucaaggcgaagcaauucuacccgaagaacaagaccaaaacuauguauguaaacauacuuacguugacagagguugggguaauggauguggacuguucgggaaagggucuuuaguaacaugcgcgaaauuccagugucuagaaccaauagagggaaaaguaguucaauaugagaauuuaaaauacacugucaucauaaccguacauacgggagaccaacaccaaguagguaaugacacucaaggugcuacgguagaaaucacuccacaggcuucaacugucgaagcaguacuuccagaauauggaacauugggcuuagaaugcagcccuaggaccggucucgacuuuaaugaaaugauauuauuaacuaugaaaaauaaagccuggaugguacaucgccaaugguuuuucgacuuaccguugccauggacuucuggagcaacaacagagacaccaacauggaaucguaaagaacuauuggucacguuuaaaaacgcacaugccaagaaacaggagguagugguauuaggaucacaagaaggugcaaugcauacggcgcuuacaggagcuacagaaauucaaaauagcgguggaacgagcauuuuugcagggcaucuaaaaugucgauuaaaaauggacaaacuagagcuaaaagguaugucauaugcaaugugucuuaauacauuuguacucaagaaagagguaucagaaacccaacauggaaccauccuaauaaaaguggaauauaaaggugaagacgcaccguguaaaauacccuuuucuacugaagauggacaaggaaaagcacauaauggucgauuaaucacugcaaacccggucguuacgaagaaagaagaacccguaaauaucgaagccgaaccuccauuuggggaauccaauauugucaucgguauuggggauaaggcuuuaaaaauuaacugguacaagaaaggaucaagcauugguaaaauguuugaagcuacagcgcguggggccaggcgaauggcaauccuuggugacacugcaugggauuuugggucaguaggaggaguccuaaacuccuuagguaaaaugguucaccagauuuucgguuccgccuauacggcuuuauucagcggaguuucauggauuaugaaaaucgggaucggggugcuauuaacguggauaggacugaacagcaaaaauacaaguaugagcuuuaguuguauagucauugguaucauaacucuauauuuaggcgcgguuguacaagccgacaugggcugugcaauaaauuggaaaggaaaagaauuaaaauguggaagcgguauauuuguaacaaacgaaguccauacuuggacagaacaauacaaauuucaagccgauucaccaaaacgacucgccacggcuaucgccggagccugggaaaauggaguaugcggaauaagaaguacaacacgaauggaaaacuuguuauggaaacaaauagcgaaugaacucaauuacauacuaugggaaaacaauauuaaacugacaguuguuguuggcgacauuauagggguuuuagaacaaggaaaacgaacauuaacgccacaaccgauggaacuaaaauacagcuggaaaacuuggggaaaagcaaaaauuguuacagcugagacgcaaaacuucaguuuuauaauagauggaccaaauaccccugaauguccaagugcaucgagagcguggaaugugugggaaguggaagauuauggcuucggaguuuuuacaacgaauauauggcugaaguuacgugaagucuauacccaaaguugcgaccaccgucuuaugagugcagcaauaaaggaugaaagagcaguacaugcagauauggguuacuggauagaaagucaaaagaaugguucauggaaguuggaaaaagcgaguuucaucgaagugaaaacuugcacguggcccaagucucauacuuuauggaguaaugguguacuggaaagcgacaugaucauuccaaaaucacuugccgguccuaucucucaacauaaccauaggcccggauaucacacccaaaccgcagguccauggcauuuagguaaauuagaacuagacuucaacuacugcgaaggaacaacaguagucauuacggaagauugugggacacgaggaccaaguuuaagaacuacuaccguaaguggcaaacuaauucaugaauggugcugccgcucaugcacauuaccuccacuuagauauaugggugaagacgguugcugguacggaauggaaauuagaccaaucaaugaaaaagaagaaaacaugguaaagagcuuagugucagcggguucggggaaaguugauaacuucacaaugggcguacuaugcuuggcaauuuuauuugaggaaguuaugagaggcaaauucggcaagaaacauaugaucgcaggaguacuauuuacuuucguacuccuacuuuccggacaaaucacauggcgagauauggcucacacccuuauaaugauuggaagcaacgcaucagaucgaauggguauggguguaacauaucuggcuuuaauagcgacguuuaaaauacagccguuccuagcuuuagguuucuuuuuacgaaaacugacaagccgugaaaauuuacuauuaggaguuggauuggccauggcgacgacauuacaacuaccugaagauauugaacaaauggcgaacggaauagcccuaggucuuaugacuuugaaauugauuacacaauuugaaacuuaucagcuuuggacggcccuaguaucuuuaacauguucaaacacaauauucacucugacaguagcauggcguaccgcuacucuaauacuggcaggaguaucacuucuaccacuuugccaaagcaguucaaugcgaaagacugauuggcuuccaaugaccguagccgcaauggguguucccccacucccuuuauuuauuuucucccuaaaagacacccccaaacgaagaagcuggccauuaaacgaagguguaauggcaguuggauuaguuaguauacuggcaaguucacuucucagaaaugaugucccgauggcggguccuuuaguagccggaggauuacuaaucgccuguuaugucauaacaggaacuucugcagacuugacuguggaaaaagcugccgaugucacgugggaggaagaagcagagcaaacuggugucagccauaaucuaaugauaacaguugaugacgacggcacgaugcgaauuaaggacgaugaaacagaaaauauacucacuguucuucuaaaaaccgcuuuauugauagugagcggaauauucccauauucuauuccagcaacauuauuagucuggcauacguggcaaaagcagacccaaagaagugggguauugugggacguaccuucaccaccggaaacucagaaagcggaauuagaggaagggguauacaggaucaaacaacaaggcauauuuggaaaaacucaggucggcguugguguacaaaaagaagggguauuucacacaauguggcauguaacuagaggcgcgguauuaacucacaacggaaaaagacuugaaccgaacugggcuagugucaagaaagaucuaauaaguuacggcgguggauggaggcugagcgcacaauggcaaaaaggcgaagagguacaagucauugcgguagagccaggcaaaaauccgaaaaauuuccaaaccaugccagggauuuuccaaacaacaacuggagaaauuggagcuauugcucuggauuucaaaccagguacauccgggagccccauuaucaauagagaaggaaaagugguaggucuauauggcaauggcgugguaacaaagaauggcggauacguaucgggaauagcucagaccaaugcagaacccgauggaccaacaccagaacuagaagaagagauguucaaaaagagaaaccuuaccauaauggaccugcaccccggcaguggcaaaacucgaaaauauuuacccgcuauuguucgagaggcaauaaagcgaagacuccgaacacuuauauuagccccuacaaggguaguagccgccgaaauggaggaagcccuaaagggcuuacccauacgauaucaaaccacugcgaccaagucggaacauacagguagggaaauaguagaucuuaugugccacgccacauuuacuaugcggcuucuaagcccuguuagaguaccuaacuacaauuugauuauaauggaugaagcucacuuuacugacccagcuaguauagccgcgagagguuacauaucgacgcgaguagguaugggcgaagcugccgcuaucuuuaugacagcaacuccacccgggacugcagaggcuuuuccccagucaaacgcacccauccaggaugaggaacgagacaucccggaaagaagcuggaacucagggaaugaauggauuacugauuucguugguaaaaccgucugguucguaccgucgauuaaggcuggaaacgauauagcuaauuguuuacgcaagaacggcaagaaaguuauacaguuaagccgcaaaacuuucgauacggaguaucaaaagaccagacuaaaugacugggauuuuguaguaacaacagauauaucugaaaugggagccaauuucaaagcggacagaguaauagaccccagaagaugccugaagccugugaucuuaacagauggacccgagcgaguuauacuugcugguccaaugccaguuacggcagcaucugcagcccagagaagaggcagaguggguaggaauccccaaaaagagaaugaucaauacauauucacaggacagccccuaaauaacgacgaagaucaugcacauuggacugaagcaaaaaugcuucuagacaauaucaauacuccagaggggaucauuccugcccucuuugagccagaaagagagaaaagugcggccauagacggugaguauagguugaaaggcgaaagcaggaaaacuuuuguugaguuaaugcgacgaggagauuuaccuguauggcuugcacauaaaguagcuucggaagguaucaaauauacagaucguaaaugguguuuugacggagagcgcaauaaccaaauauuagaggagaauauggauguggagaucuggacgaaggaaggugaaaggaagaaacugagaccaagaugguuggaugcucgaacauauucugacccuuuagcgcuaaaggaauuuaaggacuuugcggcggguagaaaaucaaucgcauuagaucugguaaccgaaauuggaagggugccuagucaucuggcauacagaacccggaaugcguuggacaaccuaguuaugcuccauacaagugaacacggcggccgagcuuacagacaugcaguagaagaacucccagaaacuauggagacuuuacuguugcucggacuuaugauauuauugacuggcggugccauguuauuucuaauuaguggaaaaggcaucggaaagacgucgauaggauuaauaugcguaauaguaaguucagguaugcuuuggauggcagacguaccauuacaauggauagcaagugcaauuguccuggaguucuuuaugaugguguuacucauacccgagccugaaaagcaaagaacaccacaggauaaucaacuagcauauguaguaauagguauuuuaacuuuagcagccauuguagcagccaaugaaaugggucuacuagaaacgacaaaaagggaucuaggcaugaguaaagaaccugggguaguuucuccaacaagcuauuuggauguagaccuacauccggcaagugcguggacacuauacgcugucgcgacuacaguaauaaccccaaugcuacggcauaccauugagaacaguaccgcaaacguaucacuagcagcuauagcaaaucaggcuguagugcuaaugggacuagacaaaggauggccaauaagcaaaauggaucuaggugucccauuacucgcucuaggguguuacucacaaguaaauccucuaacacuaaccgcagcuguacuccuucugguuacccauuacgcuauuauaggaccagggcuucaggcgaaagcuacccgcgaagcccaaaaacgaacagcugcugggaucaugaaaaaucccacaguagacggaauuaugacaauagaucucgaccccguuauauacgacucgaaauuugaaaaacaauuaggucaaguuaugcuccuaguuuuaugugcugugcaacuuuuauuaaugaggacuucuugggcgcucugugaggcacuuaccuuagcaacgggaccaaucacgacauugugggaaggcaguccagguaaauuuuggaauacaacaauagcuguuucaauggcaaacauauuuagaggcucuuaccuugcgggcgcagggcuagcuuucuccaucaugaaauccgugggcacaggccgaagaggaaccggaucucaaggugaaacuuuaggggagaaguggaagaagaaauuaaaccaauuaagcagaaaggaguuugauuuauauaagaaaaguggcauaacggaaguagaucgaacggaagcuaaagagggacuaaagcggggagaaacgacacaucacgcugugagcagaggaagugcaaaacuucaaugguucguggacagaaauaugguaauuccagaaggaagaguaauagaccuagguuguggacgagguggcuggagcuauuauugugcgggacuaaagaaaguaacagagguacgggguuauacuaaagggggacccgggcacgaagaaccggugccuaugaguaccuauggauggaaucuagugaaacucaugagcgguaaagaugucuuuuaucuuccgccugagaaaugugacacucuccugugugacaucggagaauccucuccgucuccaacaguugaagaaaguagaacgauacggguauuaaaaaugguagagccaugguuaaagaacaaucaauucugcauuaaaguacuuaacccauauaugccuacaguaauagaacaucucgaacgguugcagcgcaaguacggcggcaugcuagugcgaaacccacuuucuagaaauucuacccacgaaauguacuggaucucuaauggaacaggaaauauaguuaguucaguuaauaugguaucuagauuguuauuaaacagauucacaaugacucacagaaggccaaccauagaaaaagacguggaccucggagccggaacacgacacgucaacgcagaacccgaaaccccgaacauggaugugauaggagaacgaauuaaaaggaucaaagaggaacacuccucgacuuggcauuaugacgacgagaauccguauaaaaccugggcguaucacgguaguuaugaaguaaaagcuacuggaucugcaaguucaaugauuaacgguguuguaaaacuccuuaccaaacccugggauguuguucccaugguaacgcaaauggcgaugacugauacuacaccauucgggcaacaaagagucuuuaaagagaaaguagacaccaggacuccuagaccaaugccaggaacacgaaagguaauggaaauuacagcagaguggcuuuggagaacguuagguagaaauaagaagccccgacucuguacccgagaggaguucaccaagaaaguaagaaccaacgcugcuaugggugcagucuucacugaagaaaaccagugggacagcgccagagcagcuguagaggaugaagaauuuuggaagcuaguagauagagaacgagagcuacauaaacucgggaaaugcggcucauguguuuauaacaugauggguaaaagggaaaagaaacuuggugaauuugggaaagcaaaaggcaguagggccaucugguauauguggcucggcgcaagauacuuagaauuugaagcucugggguucuuaaacgaagaucauugguuuaguagagaaaauucauauucaggaguggaaggggagggccuacauaaacuaggcuauauacuacgagacauaucgaagauuccuggaggagcaauguacgcugacgacacugcaggcugggauacucguauaacagaagaugacuuacauaacgaggagaagauuacccaacaaauggauccagagcauagacaacuagccaaugcuauuuuuaagcucacuuaucaaaauaaagugguaaaaguucaacgaccaacuccuaaaggaacagucauggauauuauaaguagaaaagaucagcgcgggagugggcagguagguacuuacggauuaaauacauuuacaaauauggaagcucaauuagugagacagauggaaggugaaggaguuuuaucgaaagcggaccucgaaaauccccaucuacuagagaagaaaauuacucaaugguuggaaacaaaaggggucgaacgucucaagaggauggcuauuucuggggacgacuguguuguaaaaccaauugaugaccgguuugcgaaugcccuauuagcucucaacgauaugggaaaaguaagaaaggauauaccccaauggcaacccuccaaaggcuggcacgauuggcagcaagugcccuucuguucacaucacuuccaugaacucauaaugaaagacgggagaaaauuaguuguacccuguaggccgcaagaugagcuuauuggucgcgcacgaauaagccaaggagcaggauggagucuuaaggaaacugccuguuuagguaaagcguacgcgcaaauguggucauuaauguauuuccauaggcgcgaucuucgacuagcaaguaaugccauuuguagcgcaguaccagugcacuggauaccaacaaguagaacaacuuggucaauccaugcgcaucaucaguggaugacgacagaagacauguuaacgguuuggaauagaguauggauagaagauaacccauggauggaggacaaaacaccugugacaaccugggaagaugucccauauuuagggaaacgugaagaucaaugguguggcucacuaauaggauuaacauccagagcaacaugggcucaaaacaucuugacagcaauacaacagguaagaagucucauaggggaugaagaauuucuugacuacaugcccucuaugaagagauuuaggaaagaagaagagagcgagggcgcuauuugguaa

SEQ ID NO: 23485 - RNA, 9873 nt, Artificial Sequence
  derived and/or modified CDS sequence (opt6) from DENV-3__FJ562100__SS-prME
accagucucugccuuaugaugaugcucccugcaacuuuagcauuucacuuaaccagucgggauggagaaccucgaaugauuguagguaaaaacgaaaggggaaaauccuuauuauucaaaacugccucaggaauaaauauguguacucugauagcgauggaucuuggcgaaaugugugaugauacggucacguauaaauguccuuuaauagcugaaguugaaccagaagacauugauuguuggugcaauuuaacaucaacuugggucacuuauggcacguguaaucaagcaggagaacaucguagggauaaacguucgguagcucuagccccacauguaggaaugggcuuggauacucggacgcaaacuuggaugucugcggaaggggcguggcgacaaguagaaaaaguugaaacaugggcuuuaaggcauccuggguuuacaauauuagcucuuuuccuggcgcauuacauugguaccagucuaacccaaaaagugguaauauucauucuguugauguuaguaacaccuaguaugacaaugagguguguaggaguaggcaaccgcgauuuuguugaaggacucucgggagcaacuuggguugacguggugcuugaacacggaggaugcguuacuacgauggccaaaaauaaaccaacguuggauaucgaauugcagaaaaccgaagccacccaacuagcuacacuuagaaaauuaugcauagaagguaaaauaacuaauauaacaacagacucacgcugccccacucaaggcgaagccauucuuccagaagaacaagaucaaaauuaugucuguaaacauacuuauguagauagagggugggguaacggcuguggacuguucggaaaaggaagucugguuaccugcgcaaaauuucaaugccuugaaccgauagaagggaaaguaguccaauaugaaaaucugaaauacaccguuaucauuacgguucauacuggagaccaacaccaaguaggcaacgacacacaaggcguuacaguggaaauuacaccacaagcgaguacuguggaagcaauauuaccagaauaugguacauuaggguuggaauguucgcccaggacaggacuggacuucaaugaaaugauauuacuaacaaugaaaaauaaagcauggaugguucauagacaaugguucuuugauuuaccacugcccuggacuagcggcgcuacaaccgagacuccaacuuggaaucguaaagaauuauuagugaccuucaaaaacgcccacgccaagaaacaagagguaguugugcuaggaucgcaagaaggcgcgaugcacacagcacuuacuggcgcgacggaaauacaaaauaguggcgguacuuccauauucgcaggacauuuaaaaugcagauuaaaaauggacaaauuagagcucaaagguauguccuaugcuauguguuugaauacauuuguacuaaagaaagaaguuucugaaacccagcaugguacgauauuaauuaaaguggaauauaaaggagaagaugcaccuuguaaaauuccauuuaguacggaagauggacagggaaaagcccauaacggacgcuuaauuacggcaaacccaguuguaacgaagaaagaagaaccaguaaauaucgaagcugaaccuccauucggggaaaguaauaucguuaucgguauaggcgacaaggcuuuaaaaauaaauugguauaagaaagguaguucuaucgguaaaauguuugaagcgacagcaagaggggcucgcaggauggcaauccucggggacaccgcaugggacuuuggaucugugggaggcguauuaaauucuuuaggaaaaaugguacaccaaauauucgguucagcguauacugcucuauuuaguggagugagcuggauaaugaagaucggaauaggaguauuauugacguggauaggcuuaaacucuaaaaacacaagcaugucguuuaguuguaucguaaucgggauuauuacuuuauauuuaggagcuguugugcaggcagauaugggcugcgcuauaaacuggaaggggaaagaacuaaaauguggaagcgguauauuuguuacuaaugagguacauacauggacugaacaauauaaauuccaagcugacuccccuaaacgacucgccacugcuauagccggugcgugggaaaacgggguuugugguauaagaucuacuacucgaauggaaaauuuguuauggaagcaaaucgccaaugaguuaaauuauauauuaugggaaaacaauauaaaacugacuguaguugucggagauauuauugguguguuggaacaagggaaacguaccuugacaccucagccgauggaauuaaaauauucuuggaaaacuugggguaaagccaaaauugugaccgccgaaacacaaaauucauccuuuauaauagacgguccaaacaccccagaaugcccuuccgcuuccagagccuggaauguaugggaaguagaagacuauggauuuggaguguuuacaacaaauauuugguuaaaacuuagggaagucuacacucaaagcugcgaucaucgccuuaugucugcagcuauuaaggaugaacgugcgguccaugcugacauggguuauuggauagaaucgcagaaaaauggaucauggaaacuagaaaaggcaucguuuaucgaaguaaaaacaugcacauggccaaaaucucauacccuguggucuaacggaguuuuagaguccgauaugaucauaccaaaaucccuagcagggccuauuagucaacauaaccacagaccaggauaucauacacaaaccgcugguccguggcaucuuggcaaauuagaacuggauuuuaacuauugugaagguacaaccguggucaucacagaaaauuguggaacaagaggcccaagccuacgcacaacuacagugucagggaaguugauccaugagugguguugucgaucauguacauugccaccccucagauacaugggagaagaugggugcugguauggaauggagauccgaccaaucaaugaaaaagaagaaaacaugguaaagagcuuaguauccgcgggaucagggaagguggauaauuuuacaaugggaguuuugugcuuagcuauauuauuugaagaaguuaugagaggaaaauuuggaaagaagcauaugaucgccggaguauuguuuaccuucguauuguuauuaucaggucaaaucacguggcgugauauggcccauaccuuaauuaugauagggaguaacgcuucagaucgaauggggaugggaguuacauaccuagcacugauagcaacuuucaaaauucaacccuuccuagcacuuggcuuuuucuuaagaaaauugacaagucgagagaacuuauuauugggugugggacuagcuauggcgacaacacuacagcuucccgaagacauagaacaaauggccaacggaaucgcauuagggcugaugacguugaaacuuauuacucaauuugaaacauaucaauuauggacagcuuuagucucccuaacgugcucaaacacuauauuuacucuaacuguugcuuggcguacggcaacucuuauccuugcaggaguaucucuauuaccucucugccaauccuccuccaugcggaagacugacuggcuaccgaugacuguugcagcuaugggaguuccuccgcuaccacuauuuauauuuucucucaaagauacaccaaaacgcagauccuggccacucaacgaagguguaauggcaguaggccuuguuucaauacuagccucaagccuucucagaaaugauguuccgauggcaggaccuuuagucgccggcgggcuacuaauagcaugcuauguuauaacuggcacuagcgccgaucuaacugucgaaaaagccgcagaugugacgugggaagaagaagcggaacaaacuggugugucucacaaccuaaugaucaccguggaugaugacggcaccaugcguaucaaagaugacgaaacagagaacauauugacaguacuuuuaaagaccgcguuacugauagucucagguaucuuuccauacucaaucccggcuacguuacucguauggcacacauggcaaaaacaaacacagagaucagguguucuaugggacguaccaucuccgcccgaaacacaaaaggcugaacucgaggaggggguauaucgaauaaaacagcagggcauuuucggcaaaacacaagucgggguagggguccaaaaagaggguguauuucacacgauguggcaugugacacguggugcuguguuaacacacaacgguaaaagacucgaacccaacugggcgucgguaaagaaagauuuaauaucauaugggggaggauggcggcucucggcacaauggcaaaaaggugaagaaguucagguaauagcaguagaaccgggcaagaaucccaaaaauuuucaaaccaugccgggaaucuuucaaacuaccacaggcgaaaucggugcaauugcucuugauuuuaaaccagguacaagugggucacccauaaucaauagagaaggaaaagucguaggauuauauggaaaugggguuguuacuaagaauggaggauacguuucuggaauugcacaaacaaaugcagaaccggaugggcccaccccggaguuagaggaagaaauguucaaaaagagaaacuuaacaauuauggacuugcacccugguagugggaaaacacggaaauaucugccggcaauaguaagagaagccauaaagagaagguugagaacuuuaauacuugccccgacuagggucgucgcugcugagauggaggaggcuuugaaaggucugccaaucagauaucaaacaacugcuacaaaauccgagcauacaggacgugaaauuguagaucuuaugugucaugcaacauuuacuaugcgacuuuuaucaccgguuagaguaccaaacuacaaucugauuaucauggacgaagcccacuucacggacccggcaaguauagcagcacguggauacauuaguaccaggguagggaugggagaggcugcugccaucuucaugacugcaacaccaccaggcaccgccgaagcauuuccccagagcaaugcgcccauacaggacgaggaaagggauauaccugaaaggaguuggaauaguggaaaugaauggauuaccgauuuuguaggaaaaacugugugguuuguuccaucuauaaaagcaggaaaugacaucgcuaacugccuaaggaaaaaugguaaaaaggugauacagcucaguagaaagacauucgauacagaauaucagaaaacuagguuaaaugacugggauuuugugguaacuacggauauuucggaaaugggagcgaauuuuaaggcugaccgugugauagacccgcgaaggugucuaaaaccaguuaucuugacagacgggccagaaagaguuauucuagcuggcccgaugccaguaacugcagccucagcugcacagagaagagguagaguaggccgaaauccacaaaaggaaaaugaccaauacauauuuaccggucaaccucugaauaaugaugaagaccacgcccacuggacagaggcuaaaaugcuucuugauaauauaaauacaccagaagggauuaucccagcuuuguuugaaccugaaagggagaagucagcagccauagacggggaauauagguuaaagggagagucucguaagacuuuuguagaguuaaugagaagaggagaccuaccugucuggcuggcucauaaaguggcaucggaaggaauaaaauacaccgauagaaaaugguguuuugacggcgaacgaaacaaucagauuuuagaagaaaacauggauguagaaaucuggacuaaagaaggggagcguaaaaaguuaaggccaagauggcuugaugcuagaaccuauucugacccuuuagcucuuaaagaguucaaagauuucgcugcuggucgaaaaucaauagcauuagaccuuguaaccgaaauuggccggguacccucucaucuagcuuauaggacaagaaaugcgcuagauaauuuaguaaugcuacauacgagugaacauggaggaagggcauauagacaugcaguagaggaacuaccggaaacuauggaaacucuccuacuauuggggcuuaugauacuacuaaccgguggagcaauguuauuuuugaucucugggaaagggauaggaaaaacaaguaucggauuaauaugcguaacugucucaucgggaauguuauggauggcggacgucccucuccaauggaucgcaucugcaaucguucuagaguucuuuaugaugguacuucuuauuccugagccugagaagcaaagaacaccccaagacaaccaguuagcguacguaguuaucggcauucucacacuugcagcuauaguagcagcgaaugaaauggguuuauuagagacaacgaaaagggaucuaggaaugaguaaggaaccuggcguagucucuccaaccaguuaucuggaugucgauuuacauccugcauccgccuggacauuguaugcaguagccacaaccguaauaacgcccaugcuaaggcacacuauugaaaauaguacagccaauguaucauuagcugcuauagcaaaucaagcaguaguucuaaugggauuagacaaaggcuggccuauaaguaaaauggauuuaggagucccccuacuagcauuagguuguuacucacaaguuaacccacuuacacuaacggcagccguauuacucuuaguuacccauuacgccauaauuggaccugguuuacaagcaaaagcuacacgugaggcccagaaaaggacugccgcuggaauuaugaaaaauccuacgguagaugguauuaugacuauagauuuagauccagucaucuaugacucgaaauucgagaaacaacuuggacaaguaaugcucuuaguacuaugugcaguccaauuguuauuaaugcgcacgucaugggcacuuugugaggcacuuacccuagcgacggggccuauaacaacucugugggaagguucgccagggaaguuuuggaacacaacgauagcgguaagcauggcuaauauauuucggggaucauacuuggcaggcgcaggacuagccuuuucuauuaugaaaucagugggcacggggcggagaggcacagguucucagggagaaacgcuuggugaaaaguggaagaagaaauugaaucaguuaucuagaaaagaguucgauuuguacaagaaaucaggcauuaccgaaguggauaggacagaagcuaaagaggguuuaaagcgcggugagaccacacaucaugcggugucuagagguagcgcaaaacuccaaugguucguugaacggaacaugguaauuccggaaggaagaguaauagauuuaggcuguggacguggugguuggucuuacuacugugcaggauuaaagaaagugaccgagguacgagguuauacuaaaggagguccaggacacgaagaaccaguacccaugaguacauacggauggaaucuaguaaaacuaaugucugggaaagacguuuucuaucugccaccggaaaaaugugauacccuacuuugcgauauaggugaaaguucuccaagcccuacaguagaagaaucucggaccauaagagucuuaaaaaugguagagcccugguugaaaaauaaccaauucugcaucaaaguguugaacccguacaugcccacuguuauugaacauuuagaacgucuccaaagaaaauaugggggaaugcuaguacgaaauccacuuucaaggaauaguacccacgagauguauuggauaucgaacgggacagguaauauagugaguagcguaaauaugguaaguagacuccuucuaaaccgcuuuacuaugacacacaggcggccaacaauugaaaaagaugucgaccucggcgccggaacacgccauguuaacgccgaaccagagacacccaacauggaugugauaggcgaaagaauaaaacgcauaaaggaagaacacagcucgaccuggcauuaugaugacgaaaauccguacaaaacaugggcguaccauggaucguaugaagucaaggcuacagguagugcuucuucaaugauuaacggggucguaaaauuacuuacaaaaccaugggauguagugccuaugguuacacaaauggcaaugacagauacaacaccauucggacaacagcgcguauuuaaagagaaagucgacacccgcacaccgcgaccgaugccaggaacaaggaaaguaauggaaauaacagcagaauggcucuggcgaacauugggcagaaauaagaaaccaagacugugcacaagagaagaauuuacuaagaaaguaagaacuaaugccgcaaugggugcuguuuuuacggaagaaaaccagugggacagugcucgagcugcaguagaagaugaagaguucuggaagcuaguggauagagagcgugagcuccacaaauuagguaaauguggaucgugcguauacaauaugauggguaaacgugagaagaaacucggugaguucggaaaggcuaaagggucaagggcuauaugguauaugugguugggggcaagguaccuugaauuugaggcgcuaggguucuuaaacgaagaccauugguucagcagggaaaauuccuauucgggcguugagggggagggguuacacaaauuaggauauauauugagggauauaaguaaaauaccagguggugccauguaugccgacgacacagcaggaugggauaccagaauaacugaggaugaccuacauaacgaggaaaagauaacacaacaaauggaucccgaacaucgucaauuagcuaaugcgauauuuaaguuaaccuaccaaaacaaaguuguaaaaguacagagaccaacuccaaaaggaacgguuauggacauaauuucuaggaaggaucaaaggggcagcggucaggucggaacuuauggcuuaaauacuuuuacuaauauggaggcgcaguuaguaagacagauggagggugaaggaguacuuucaaaagccgaccucgaaaacccucaccuacuugagaagaaaauuacacaaugguuagaaacuaaaggaguggaaagguuaaaaagaauggcaauauccggggaugauugcgucgucaaaccaauugaugauagauucgcaaaugccuuacuagcccucaaugacauggggaaagucagaaaggauauaccucaauggcaaccaucaaaaggcuggcaugacuggcaacaagucccauucuguucccaccauuuccaugaacucauaaugaaagaugguagaaaguuaguugugccaugcagaccucaagaugaguuaauagguagggcacgcauaagucagggcgcuggcuggagucuaaaagaaacugcuugcuuggguaaagcauaugcucaaaugugguccuugauguacuuucaccguagagaccuucgguuagcuaguaacgcgauaugcagugcaguuccaguacacuggauaccaacgucaaggacaacauggagcauacacgcacaucaucaauggaugacaacagaggacauguugacugucuggaacaggguguggauagaggauaaccccuggauggaagacaagacaccagugacaacaugggaagaugucccauaucuuggaaaaagagaagaucaauggugcggaaguuuaauuggguuaacaaguagagccacaugggcgcaaaacauccucacagcuauacaacagguaaggagucugauaggggaugaagaguuccuagauuacaugccaucuaugaaacgcuucagaaaagaggaagagucagagggcgcaauaugguaa

SEQ ID NO: 23486 - RNA, 9873 nt, Artificial Sequence
  derived and/or modified CDS sequence (opt6) from DENV-3__FJ547062__SS-prME
acaucauugugucuaaugaugauguuaccagcuacuuuggcauuucacuuaacuagccgagauggagaaccgagaaugauuguagggaaaaacgaacguggaaaaucccuuuuauucaaaaccgcuagcggaauuaauauguguacuuuaauagcaauggaucuuggcgaaaugugcgaugauacagugacauacaaauguccgcuuauagcagaagucgaaccagaagauaucgauugcuggugcaaccuaacaucaaccugggucacguacgguaccuguaaccaagcaggggaacacagacgagauaaaagaucuguagcguuggccccacauguaggaaugggacuagauacuagaacucaaaccuggaugagugcagaaggcgcauggagacaaguagaaaaaguagaaacaugggcacucagacacccagguuuuacaauacuugcauuauucuuagcgcauuacaucucaacuucacuuacgcaaaaagugguuaucuucauucuacucauguuaguaacgccaucaaugacuaugaggugcguaggaguaggaaaccgggauuuugucgaaggguuaucaggcgcaaccuggguagauguaguauuagagcauggaggcugcguaacaacuauggccaaaaauaaaccgacacuggauauagaacuccagaaaacggaagcaacgcaauuagccacacuacguaaauuaugcauugaggggaaaauaacgaauauaacaacagauucucgauguccaacacaaggugaggcaauuuuaccugaagaacaagaucaaaauuaugucuguaaacauaccuauguagauagaggguggggcaaugguugcggauuguuuggaaaaggaagccuaguuacuugugcuaaauuccaguguuuagaaccgauugaaggcaaaguaguacaauaugaaaauuuaaaauacacaguaaucaucacuguccauaccggagaucaacaucaagugggaaaugauacccagggcguuacgguagagauaacaccacaagcuagcacuguugaagcuaucuugccagaauacgguacgcuaggauuagaauguucaccucgcacaggucuagacuucaaugaaaugauucuuuugacgaugaaaaauaaagcauggaugguccauagacaaugguuuuucgaucuuccgcugccauggacaucaggagcuacaacugaaaccccuaccuggaauagaaaagaacugcuaguaaccuucaaaaaugcucaugcaaagaaacaagaaguggugguacuagguucucaagaaggugccaugcauacggcguuaaccggagccacugagauacaaaauucgggugguacaucuauuuucgcgggacauuuaaaaugccgauuaaaaauggacaaauuagaguuaaaagguaugaguuacgcuaugugucuuaauaccuucguacucaagaaagaagucucggaaacacaacauggaacaauauuaauuaaaguagaauauaagggagaagaugcccccuguaaaauaccguuuucgacggaggacggacaagguaaagcccacaauggacguuuaauaacagcaaacccaguugugaccaaaaaggaagaacccgugaauauugaagcagagccaccguuuggagaaucuaacauugugauaggaauaggcgauaaagccuuaaagauaaacugguacaagaagggaaguucaauaggcaagauguuugaagcaacagcuaggggagcacgacggauggcaaucuuaggcgauacagcaugggauuuugggucaguaggggguguacuaaauucauugggcaaaaugguucaucaaauauucgguagugcauauacugcauuauuuaguggcguuucuuggauaaugaaaauagguauagguguguuauuaaccuggauuggguuaaauagcaaaaacacaucaaugagcuuuaguugcauaguaauagguaucauaacauuauaccuuggagcuguaguucaggcagacauggggugcgcaauaaacuggaaagggaaagaguugaaaugugguuccgggauauucguaacgaaugagguacauaccuggacggaacaauacaaguuucaagcugacucaccaaaaagauuagcgacagcaauagcaggggcaugggagaauggagucuguggaauuaggagcacaacaagaauggaaaacuuacuuuggaaacaaauagcaaaugaauuaaacuauauacucugggagaauaacauaaaacuaacagugguaguuggggauauuauaggaguacucgaacaagguaaacgaacgcucaccccgcagccuauggaacugaaguauuccuggaaaacuugggggaaagccaaaauaguaacagcggaaacacaaaauucgucuuucauaauagauggaccuaauaccccugaaugcccaucugcaucccgugcauggaacguaugggagguugaggauuauggauuugguguauuuacuacgaacauuuggcucaaauugcgcgagguguauacccaauccugugaccacagauuaaugucugcagcuauaaaagacgaaagagcuguacacgcagacauggguuacuggauagaaagucaaaagaaugguaguuggaaacuggaaaaagcaucuuucauagaagucaaaaccuguacguggccgaaaucucacacacuauggaguaauggcguauuggagucugauaugauuaucccgaaaagucuagcaggaccaauaucacagcacaaccaccgccccgguuaccauacacaaacagcagguccuuggcaucuggguaaacuugaguuagacuuuaacuauugcgaagggacaacgguaguaauuacagaaaauuguggaacaagaggaccaucacugaggacaacaacuguaucugguaaacuuauacaugaauggugcugccgaucgugcacauuaccuccucuccguuacaugggggaagacggauguugguaugggauggaaaucagaccuaucaaugaaaaagaggagaauaugguaaaauccuuagucagcgcagguagugguaagguugauaauuuuacaaugggugugcuaugcuuagcaauucuguuugaagaaguaaugcgcggcaaauucggcaagaagcauaugauagccggaguacucuuuacauuugucuuacugcucucaggucagaucacuuggcgggacauggcgcacaccuuaauaaugaucggcagcaaugcuucugauagaauggggaugggcguuacauauuuagcucuaauagcuaccuuuaaaauacagccguuucuagcuuuaggcuucuucuuaagaaaguuaacuucgagagagaauuuacuacuugguguagguuuagcaauggcaacaacauugcaguuaccugaagauauugaacaaauggccaacggaauugcauugggucuuaugacccuaaagcugauuacacaauuugagacauaucaguuauggacagcguugguuucauugacaugcaguaauaccauauucacauugacagucgcguggcgaacggcaacauugauacuugccggagugucauuacuaccucuaugccaaaguuccucaaugcggaaaaccgauugguuaccgaugacaguagccgcaaugggaguaccgccacuaccucuauuuauuuucaguuuaaaggauacaccuaaaaggcgcaguuggccauuaaaugaaggaguuauggcuguuggccucguaaguauauuagcuucuagucuauuacgaaaugauguaccuauggccggaccuuugguagcgggaggucuucuaauagcaugcuauguaauaacugguacgagcgcagaucuaacgguagaaaaggcagccgaugucacaugggaagaagaagcugaacaaaccggaguuagccauaaucuaaugauaacaguugacgaugauggaacuaugcgcauuaaagacgaugaaaccgaaaauauacucacaguauuguugaagaccgcauuauuaauuguaagugggaucuucccuuauucuauuccugcaacgcuauuaguauggcauacguggcagaaacaaacacaaagguccggaguguugugggaugucccuucacccccagaaacgcagaaagcugaauuagaagaagguguauauagaauaaaacaacaaggaauauucggaaaaacucaaguuggggucggaguacaaaaagaaggaguauuccacacuauguggcacgucacgagaggagcagucuuaacgcacaauggcaaaagauuagagccaaacugggcuaguguuaaaaaggaucugauaucguauggcggaggauggagacuaucugcucaauggcaaaaaggagaagaaguccaagugauagcagucgaaccaggcaaaaauccgaaaaauuuucaaacgaugccaggcauuuuucaaaccacaacgggugaaaucggagcuauagcuuuagauuuuaaaccgggaacaucgggaagucccauaauaaaccgagaggggaaaguugugggucuuuacgguaaugggguuguaacuaaaaauggaggguauguaucuggcauagcacaaacaaaugccgaaccugaugguccuacucccgaacuugaagaagaaauguuuaagaaaagaaacuuaacaauaauggaucuacacccugggagcggaaaaacaaggaaauaccuuccugcuauuguuagagaagccauaaaaagacggcuacgaacccuaauacuagcgccuacuagaguugucgcggcagaaauggaagaggcucuaaaaggacuaccaauacguuaucaaacaacagcaacaaagucagaacacacagguagagaaauuguggaccuaaugugucaugcaacuuuuacaaugcgcuuacuaaguccuguucgaguuccgaauuauaaccuuauaauuauggaugaggcucauuuuaccgauccugcaagcauagccgcacgggguuauauaaguacacgcguaggcaugggggaagcggcugcaauauucaugacggcaacaccacccggaaccgcggaggcguuuccacaaucuaaugcgcccauacaggacgaagaaagagacaucccagagcgaaguuggaacucggggaaugaauggaucacagauuucguagggaaaacagucugguuuguaccuucaauuaaagccggaaaugacauugcuaacuguuuaaggaaaaauggcaagaaaguuauccaguuauccagaaagacuuuugacacagaauaucagaaaacuagacugaacgauugggauuucguaguaacaacggauauaucagagaugggcgcaaacuuuaaagccgauaggguaaucgauccucgaagaugcuugaaaccaguuaucuuaacugaugguccagaaagaguuauacuagcuggaccaaugccgguaacagcggcgucggcagcucaaagaaggggucgaguagggagaaauccacaaaaagagaacgaucaauacauauucacagggcaaccuuuaaacaaugacgaagaccaugcccauuggacagaggcaaagaugcuucuugauaauauaaauacaccagaagggaucauucccgcccuauuugagccggagagagaaaaaucagccgccauagacggagaauaucggcuuaaaggugaaucgagaaaaacauuuguagaacucaugcgacgaggcgaucugcccguauggcuggcacauaaaguggcaucagagggaauaaaauauacugacaggaaguggugcuucgauggugaaagaaacaaucaaauacucgaagaaaauauggauguggaaaucuggacuaaggaaggagaaaggaagaaauuacggccucguuggcucgaugcaagaacuuacucagauccccuagcauugaaggaauuuaaagauuuugcagccggaagaaaaaguaucgcacuagaccugguaacggaaauaggucgaguuccuucacaucuugcauauagaacaagaaaugcacucgauaacuuaguaaugcuacacacgucagagcacgggggccgagcauauagacacgcaguugaagaacuacccgaaacgauggagacauuauuacugcuuggacugaugauacuuuuaacuggcggugcaaugcuauuucuaauaucgggaaaaggaaucggaaaaacuuccauaggucuuauuugcguaauuguaaguagcggaauguuguggauggcagacguaccacuacaauggauagcgucagcaaucguuuuagaauuuuucaugaugguuuuacugauacccgaaccugaaaaacaacggacaccucaagauaaucaauuagcauacguagucauuggaauuuugacucuagcggcuauaguugcugcuaacgaaaugggacuacuagaaacgaccaagcgagaucuggguaugaguaaggaacccgggguugucucaccaacaagcuaucuugauguugaucuucacccugcaucugccuggacauuguacgcaguugcaacuacaguaauaacaccgaugcuacggcauacaauugaaaauucgacagcaaaugucuccuuagcugcaaucgcgaaucaggcuguuguacugaugggguuagauaaagguuggccgauuuccaagauggaucuaggagugccauuguuagcgcucgguuguuauagucagguuaauccucucaccuuaacagcagcaguacuacuauugguaacacauuaugcgauaauugggccugguuuacaggccaaagccacucgagaagcacaaaagcgaaccgcagcgggaauuaugaaaaauccuacgguggauggaauaaugacaauugauuuagauccuguaaucuacgacucgaaauuugaaaaacaauugggccaaguaauguuacuugucuuaugcgcuguacaauuguuauuaaugcggacaagcugggcuuuaugugaagcgcuaacgcuagcaaccggucccauaacgacgcucugggaaggcaguccaggaaaauucuggaauacaacaauagcgguaaguauggcaaacauuuuucgagguucauaucuagccggugcaggucucgcuuuuucgaucaugaaaucgguugguacgggaagacggggaaccggcagucagggcgagacucuaggugaaaaauggaagaagaaacuaaaccaauuaucacgcaaagaguucgacuuauauaaaaagagugguaucacugaaguagacagaacagaggcaaaagaggggcuaaagagaggcgagacuacccaucaugcaguauccaggggaagcgcuaaacuccaaugguuuguugagcguaauaugguaauacccgaaggaagaguuauagauuuagguugcgguagaggaggauggucuuacuacugcgcgggacucaagaaaguuacagagguaagagguuauaccaaggguggaccugggcacgaggaacccguaccgaugagcacauauggguggaaccuaguaaaauugaugucaggaaaagacguauucuauuuaccuccggagaaaugugauacucuucucugcgauauaggugaaaguuccccauccccaaccgucgaagagaguagaacaauccgcguccugaagaugguagaaccauggcuuaaaaauaaucaguucugcaucaaaguacuaaauccauacaugcccacaguaauugaacacuuggagcggcuacagcgaaaauaugggggaaugcuuguucggaauccacuuucuagaaacaguacccacgaaauguacuggauuaguaacggaacaggcaacauaguaaguagcguaaauaugguuucacgucuauuacugaacagauuuacaaugacccacagacgacccacaauagaaaaagauguagaucuaggagcugguacucgccauguaaacgccgagccagaaacaccuaauauggacguaauuggggaaagaaucaagagaaucaaagaagaacauagcaguacuuggcacuacgaugaugaaaaccccuauaaaaccugggcguaucaugguuccuaugaaguaaaagcgacagggagugcuucuaguaugauaaacggaguaguaaaacuucuuacuaaaccgugggauguaguaccaauggucacgcaaauggcaaugacggauacaacaccguucggacagcaaaggguguucaaagagaagguagauacacguaccccucggcccaugccuggcacuagaaagguuauggagauaacagccgagugguuauggaggacuuugggacggaauaagaaaccacgcuugugcacaagagaagaauuuacgaagaaggucagaaccaacgccgcaaugggagcuguauucacagaagaaaaucaaugggauucagcgagagcugccguugaagacgaggaauuuuggaaacuuguugauagggaaagagaguuacacaaauuagguaaaugugggucaugcguuuauaauaugaugggaaaaagagagaagaaauugggugaguuuggaaaggcuaaaggaucaagggcuauaugguauaugugguuaggcgcccguuacuuagaguucgaggcccugggcuuucucaaugaagaccacugguucucaagagaaaacaguuacucgggugucgagggugaaggcuuacacaaguuaggcuauauauuacgagacaucucuaaaauuccugguggcgcaauguaugcugaugauacugcugguugggauacacgcaucacagaagaugauuuacauaaugaagagaaaauaacccagcaaauggacccugaacauagacaauuagcaaaugccaucuucaaacucaccuaccaaaauaaaguaguaaaaguacaaaggccaacccccaagggcacgguaauggauauaauaucuagaaaggaccagagagguucaggacagguuggcacauacggccucaauacauucacaaacauggaggcacagcuaguuaggcagauggaaggggaggguguacuuaguaaagcugaccuagaaaacccacaucuauuagagaagaaaauaacucaauggcuagaaacuaaagggguggaaagauuaaaaaggauggcgauuucuggggacgacugcguagucaaaccgauagacgauagguuugcaaaugcccuauuggccuuaaaugacauggguaaaguucgaaaagauauaccucaauggcaaccuucuaagggauggcacgacuggcaacaggucccuuucuguagccaucacuuucacgaacuaauuaugaaggaugguagaaagcuagucguaccguguagaccucaagaugagcugauaggucgggcaagaauaucacaaggggcuggguggucuuuaaaagaaacugcuugucuggggaaagcauaugcgcagauguggaguuugauguacuuucacagacgagauuuaaggcuugcaaguaaugcaaucugcagcgcaguucccguccacuggauuccuacaucgcgaacaacaugguccauacacgcccaucaccaauggaugaccaccgaagauaugcuaacuguauggaaucggguguggaucgaggacaauccauggauggaagauaaaacaccugugacgaccugggaagacguccccuauuugggaaaaagagaagaucaauggugcgggucccucauugggcuaacgucucgugcaacuugggcacaaaacauccugacagccauacaacagguuagaucauuaauuggugaugaagaauuuuuggacuacaugccgucuaugaaacgguuccgcaaagaagaagaaucugagggagcaauuugguga

SEQ ID NO: 23487 - RNA, 9873 nt, Artificial Sequence
  derived and/or modified CDS sequence (opt6) from DENV-3__FJ461322__SS-prME
acuucccuaugucuaaugaugaugcuacccgcaacguuagcauuccauuuaacuucucgcgauggugagccccgaaugauuguugggaaaaaugaacgggguaaaucucuuuuauucaaaacggccagcgguauuaacauguguacucuuauagcaauggacuuaggggagaugugugaugauacugucacguacaaaugcccucucaucgccgaagucgaacccgaagacauugauuguuggugcaaucuaacuucaacuuggguuacauaugggacaugcaaucaagcgggagaacaucgccgagacaaaaggaguguugcuuuagcuccucacguaggaaugggcuuagauacccgaacccaaaccuggaugagcgcugaaggagccuggcgacaagucgagaaaguugaaacuugggcacuccgccauccgggguucacaauauuagcacuauuuuuagcucacuacaucgggacgucauugacucaaaaaguugugauauucauucuucugauguuggugacaccaucaaugacaaugcguugcguaggaguagguaaucgagauuuuguugaaggacuaagcggcgcaaccuggguugacguaguacuugaacauggcgguuguguaacgacuauggcuaaaaacaaaccaacauuagauauugaacuacagaaaaccgaagcgacacaauuagcaacuuugagaaaauuauguauagaaggaaaaauuacuaacauaacuacugauucacguugccccacgcagggggaagccauucuaccagaagaacaagaucagaauuaugugugcaaacacacauauguggacaggggguggggcaauggcuguggauuauuugguaaaggcagcuuagucaccugugcgaaauuucaaugucuagagcccauagaagguaaaguuguucaauaugaaaaccuaaaauauacuguaauaauaaccguccauacaggcgaucagcaucagguaggcaaugacacacaggguguaacaguugaaauaacgccucaggcaucuacaguggaggcgguucucccagaguacggaacacuaggucuagaguguucgccucgcaccggacuagacuuuaaugagaugauauuguuaacuaugaaaaacaaggcuuggaugguccauagacagugguucuuugaccugccacucccauggacaagcggcgcuaccacagaaaccccaacguggaauagaaaagaacuauuaguuaccuuuaaaaacgcccaugccaagaaacaagagguaguaguacuaggaucacaagagggggcaaugcauaccgcauuaacaggcgcuacagaaauacaaaauucugguggaacaagcauuuuugcuggccauuugaaauguagguuaaaaauggacaaauuggaauuaaaaggaaugagcuaugccaugugucuaaacaccuucguacuuaaaaaggaaguuuccgaaacacaacauggcacaauuuuaauaaaagucgaauacaaaggagaagaugcaccgugcaaaaucccauucucaacugaagacggccaagguaaagcacauaauggaagguuaaucaccgcaaauccuguaguuacuaagaaggaggaaccaguuaacaucgaggcagagccaccguucggagagucuaauauaguaauaggaaucggcgacaaagcacuuaagauaaauugguacaagaaaggaagcagcauaggaaagauguucgaagcaacagcaaggggagcuagacguauggcaauccugggggacacagcgugggacuuuggaucaguagguggaguguuaaauucauuagguaaaaugguccaccaaauauucggaucggcguauacagcacucuucagcggcgucucguggaucaugaaaauuggaauuggaguauuauugacguggauagguuuaaacucuaaaaauacaaguaugucauucuccuguaucguaauagguauuauaacccuuuaccuaggugccguggugcaagcagauauggguugcgcaauaaacuggaaagggaaagagcuaaaaugugggagcggaauauucgucaccaaugaaguccauaccuggacggaacaauauaaguuucaggcugacucaccaaagcgauuagcaacagcaauugcuggagccugggaaaauggggucugcggaauaagaucgacuacacgcauggaaaauuuacuauggaaacaaauugcaaaugagcuaaauuacauuuuaugggaaaauaacaucaaacuuaccgucguuguuggugacauaauuggaguuuuagaacagggaaagagaacucuaacaccacaaccaauggaauugaaauacucuuggaaaacguggggaaaagcuaaaauaguaaccgcagagacacaaaauucuucguuuauuauagauggaccaaacacaccggaauguccgucagcauccagagcauggaacgucugggaagucgaagacuaugguuuuggagucuuuaccacaaauauuuggcuaaaacuucgagagguauauacucagucaugcgaccacagguuaaugagcgccgcaauaaaggaugaacgugcaguucaugccgacaugggauauuggauagaaagucagaagaauggaagcuggaaauuagaaaaagcgagcuuuauagaggucaagacguguacauggcccaagucccauacucuauggaguaauggaguucuagaaagugauaugauaauaccaaaaagccucgcggggccaauaagucaacacaaucacagaccgggauaucauacgcaaacagcuggaccauggcaucuaggaaaacuagaguuagacuucaauuacugugaggguaccacuguugucauaacagaaaauuguggaacaaggggaccuucuuuaagaacuacaaccguaucaggaaaguuaauccacgaaugguguugcaggucgugcacuuuaccaccacuacgcuauaugggggaagacgggugcugguacgguauggagauaagaccuaucaacgaaaaagaagagaacaugguaaagagcuuagugucagcuggaagugggaagguugacaauuuuacuauggguguucuuugccuagccauacuuuuugaagaagugaugaggggaaaguuugggaagaaacacaugauagcaggcgugcuuuuuacuuuugucuugcuauuaucaggccaaauuacauggagagauauggcgcauacucucauaaugauaggcaguaaugcgagcgaucgaaugggaaugggaguaacuuauuuagcauuaaucgcaacuuuuaaaauacagccauuuuuagcauuaggauucuuucuaaggaaguugacaagcagagaaaaucuucuucuuggaguagguuuagcuauggcaaccacguuacaguugccagaagauauagaacagauggcaaauggcaucgcauuaggucuaaugacccuaaaauuaauuacucaguucgaaacuuaccaauuauggacggcauuaguuucccuaacuuguagcaauacuaucuuuaccuuaaccgucgcauggagaacagcaacgcuaauauuagcgggagugagucuuuuaccuuuaugucaguccaguaguaugagaaaaacagauuggcuaccgaugacuguggcagcaaugggcgucccuccauuaccacuuuuuauauucucauugaaagauacaccaaaacggagaaguuggccauuaaacgaaggcguaauggcuguaggguuagucucaauacuagcuagcucccuauuacggaacgauguucccauggcaggaccucuuguagccggaggucuauuaauugccuguuaugucauaacagggaccucugcagaucuuacgguugaaaaagcagcggauguaacaugggaagaagaagcagagcagacgggaguaucacauaaucucaugauaacuguggaugaugaugggacaaugcgaauuaaggacgaugagacggagaacauuuuaaccgucuuacuaaaaacggccuugcuuauaguaagugggaucuuccccuauagcauaccugcaacucucuuaguauggcacacauggcaaaaacaaacacaaaggaguggaguccuuugggacgucccuagcccuccugaaacccaaaaagcugagcuagaagaaggcgucuauagaauaaaacagcaaggaaucuuuggaaaaacgcaagugggagucgggguccaaaaagaaggagucuuucacaccauguggcauguaacucgcggugcuguucugacucacaacgguaaaaggcuagaaccgaauugggccucggugaaaaaggaucuaauuucguacggaggaggguggagauugucagcgcaguggcaaaaaggagaagagguacaggugauugcaguagaacccgggaaaaauccgaagaauuuucaaacgaugcccgguauuuuccaaaccacaacaggagaaauaggagccauagcacuagauuuuaaaccagggacaucaggaagcccaaucauaaacagggaaggaaagguaguaggccuauauggcaacggggucguaacuaaaaauggaggauauguauccggaauagcucagacaaacgcugaaccggacggaccaacuccagaguuagaagaggagauguuuaagaaaagaaaccucacuaucauggauuuacacccagguucuggcaaaacacgaaaguauuugccagcaauuguccgugaggcgauuaagagacgauugagaacgcucauauuagcuccuacaagaguuguggcugcagaaauggaagaagcacucaagggacuuccaaucagauaccagacuaccgcaacaaaaagugagcauacgggaagagaaauuguugaucugaugugccacgcaacauucacuaugcggcuacuaucaccaguuagaguaccuaacuauaaucuaauaauuauggaugaggcacauuucacggacccagcuagcauugcagcacgaggguacauuagcacacguguuggcaugggggaagcagccgcaauauuuaugacagcuacuccaccaggcaccgcugaggcuuuuccccaauccaaugcaccgauacaagaugaagaacgugacaucccagaacgaagcuggaacucaggcaaugaauggauuacggauuuugugggaaaaacuguaugguuuguacccaguauuaaggcuggaaaugacauagcaaacuguuuacguaaaaaugggaagaagguuauacaacuaucaagaaaaacuuucgauaccgaauaucagaaaacacgcuuaaaugauugggauuucguaguaacaacugauauaagcgaaaugggagcaaauuucaaagcggaccggguuauagacccccgaagauguuuaaagccuguaauacuaacggauggaccagaaagaguuauuuuagcaggcccaaugccaguaacugcagcaagugcagcccagcgaagagggaggguaggucgaaauccucaaaaagaaaaugaucaauauaucuucacaggccaaccacucaauaaugaugaagaucaugcucauuggacagaggcuaaaauguuacuugauaauauuaauaccccggaagggauaauuccagcccuguucgaacccgaacgugagaaaucagcugcaauugauggcgaauauaggcuaaaaggggaaucccgcaaaacguucguugaauugaugagaagaggagauuuacccguuuggcuggcgcacaaaguagcaucugaggggaucaaauauacugaccgaaaauggugcuuugauggugaaagaaacaaucagauacuggaagagaauauggacguugaaauauggacgaaagaaggcgagcguaaaaagcuaaggccaagauggcuagaugcaaggacauauagcgacccuuuagcacuuaaggaguuuaaggacuucgcagccggacguaaauccauugcacuggacuuagugaccgaaauaggaagagucccuagccaucuggcauauagaacucguaacgcauuagacaaucugguaaugcuacauacaagugagcauggagguagggcuuaucgucacgcaguagaagaacuuccagaaaccauggagacgcuacuucuuuuaggucucaugaucuuauuaacuggaggcgccaugcuuuuucuaauuaguggcaaagguauaggaaaaacaucuauagggcucaucugcguaauaguauccucuggaaugcucuggauggcggaagugccgcuccaauggauagcaagugcgauagucuuggaauuuuucaugaugguauuauuaauaccggaacccgaaaaacaaagaaccccgcaggauaaucaacucgcauacguaguuaucgguauuuuaacgcuugcugcuaucguugcugcgaacgaaauggggcuacuagagaccacuaaaagagauuugggaaugagcaaagagccgggugucguguccccaacgucguauuuagacguagaccuucauccagcauccgcauggacacuauacgccguggcuacaaccguaaucaccccaaugcuuagacauacuauagaaaacuccaccgccaacguaucacuagcagcuauugccaaccaagccguaguacuuaugggguuagacaagggauggccgauaagcaaaauggaucuagguguaccacuucuggcacuaggauguuauucucaaguuaaucccuugacuuuaacugcagccguguuguugcucgucacucauuacgcaauaauugggccuggcuuacaagcuaaagcaacuagagaggcacagaaaagaaccgccgccgguauaaugaaaaauccaaccguagauggaauaaugaccauagaccuugacccgguuaucuaugauucuaaauucgagaagcagcuaggacaaguaaugcucuugguccuuugugcuguucaauuguugcuuaugcguacaucgugggcacuaugcgaagcacucacauuagcuacuggacccauaaccacauugugggaagguucacccggcaaguucuggaacaccacgauagcuguauccauggcuaauauuuucaggggcagcuacuuagcuggagccgguuuagcauucucuauaaugaaaucuguaggcaccggcagacgaggaaccggcucacaaggagaaacguuaggggaaaaauggaaaaagaaacuaaaccagcucagucgaaaagaauuugaucucuacaagaaaucggguauaacggaaguugaucgaacagaagcgaaggaaggccuaaaaaggggagaaacgacacaucacgcgguuucucgaggaagcgcaaaacuacaaugguucguugaacguaauauggucauuccugaaggacggguuauagaccuaggaugcggacgcggagguuggagcuacuacugcgcaggccuuaagaaagucaccgaagucagagguuacacaaagggaggacccggucacgaagaacccgucccaauguccaccuaugguuggaauauaguuaaacucaugucgggcaaagacguauuuuaucuaccacccgaaaaaugugauacguuacugugcgacauaggagaaaguaguccaagcccaacaguagaagaaucacgcacaauuagggugcuaaaaaugguagaaccaugguuaaagaacaaucaauucuguauaaaaguacuuaauccuuacaugccuacagugauagaacacuuggagagacuacaacggaaauaugguggaaugcuagugagaaauccguuaucccgaaacucuacccacgaaauguacuggaucagcaauggaacggguaacauuguuaguagugugaauaugguuucacgucuacuauugaaucgauuuaccaugacacauagaagacccacaauagaaaaagaugucgaccuaggagcgggaacacgccauguuaacgccgaaccugaaacuccuaacauggaugucaucggggaaaggauuaaacguauaaaggaggaacacaguucaacguggcauuacgaugaugaaaacccuuacaaaacgugggcauaucacggaucuuacgagguuaaagcuacugguagcgccucgagcaugauaaauggagucguaaaacuacucacaaaaccaugggaugucguaccaauggucacccaaauggcaaugacagauacaacgcccuucggacagcaaagaguauucaaggagaaagucgacacccggacaccacgccccaugccuggaacgaggaaaguaauggaaauaacggcagaaugguuauggagaacucugggacguaacaagaaaccuagguuauguacuagggaagaauuuacuaagaaagugcgaacgaacgcagcaaugggugcaguguucacugaagaaaaucaaugggauagugcgcgagcggccguagaagaugaggaguucuggaaacuuguugaccgcgaacgggaauuacauaaacucggaaaaugugggagcuguguauacaauaugaugggcaaaagagaaaagaaauuaggagaauuuggaaaagcuaaagguucgagagcgauuugguauaugugguuaggugcaagguacuuagaauuugaggcacucggcuuccugaaugaagaccauugguuuucuagagaaaauuccuauucuggaguugaaggggaaggguuacacaaauuaggcuauauacugagagauauaucuaaaauuccugguggggccauguaugcagaugauacagcaggaugggauacacgaauaacugaagacgaucugcauaaugaagagaaaauaacccaacagauggacccagagcauagacaacucgcuaaugcaauauucaaacuaacguaucagaacaaaguuguaaagguacaaagacccacacccaaaggaacuguaauggauauuauuagccgaaaagaccaacgaggaagugggcaaguggggacauacggucuaaacacguucacaaauauggaggcccaacugguuagacaaauggaaggggaagggguauugucgaaagcagaucuagaaaacccacaucuccuagagaagaaaauaacacaauggcuagaaaccaaagguguugagcgacuaaaacggauggccauaucaggagacgauugugugguaaaaccaauagaugaucgauucgcaaaugcacuauuagcauugaacgauaugggaaaaguacgcaaagauauaccccaauggcaaccuucaaagggauggcacgacuggcagcaagucccuuucuguucucaccacuuccaugaauugauaaugaaggacggaagaaagcuaguugugccuuguagaccacaagacgaacucauaggucgagcacgcaucucccaaggagcaggauggagucucaaggagacagccugucugggaaaagccuaugcacagauguggucucuaauguacuuucaucgaagagaucucagacuugccucuaaugcgauuugcucggcuguaccuguacauuggauuccaacgucacgaacaacuuggucaauccaugcucaccaccaauggaugacaacugaggauaugcuaacgguuuggaaccgaguauggauagaagacaauccuuggauggaagauaaaaccccugucaccacgugggaagacauuccauacuuagguaagcgagaggaucagugguguggaucacuaauagguuuaacgucuagagccacuugggcacaaaacauauuaaccgccauccaacaaguuagaucacuuauaggagacgaggaauuucuagauuauaugccaagcaugaaacgauuuagaaaagaggaagaaucugagggggcgauuugguaa

SEQ ID NO: 23488 - RNA, 9873 nt, Artificial Sequence
  derived and/or modified CDS sequence (opt6) from DENV-3__KF955458__SS-prME
acgucgcuaugcuuaaugaugaugcuuccugcaacauuagcauuccaucuuacuagcagagauggggaaccacgaaugauuguaggcaaaaaugaacgcggaaaaagccuacuauuuaaaacugcgucaggaaucaacauguguacccuaauagcuauggaucucggagaaaugugugaugauacaguaaccuauaaaugcccacuaauagcugaaguagaacccgaagauaucgauuguuggugcaacuugacgucuacauggguuacguaugggacuugcaaucaagcuggcgaacauagaagggacaaacgaagcguagcucuugcuccccauguugggaugggauuagauacacgaacacaaacauggauguccgcggaaggggcguggcgacaaguugaaaaaguugaaacaugggcacucaggcaccccgguuuuacuauacuugcgcuauuucucgcucacuauauaggcacaagccuaacacagaaagugguaauauucauacuacuuauguuagucaccccgucgaugacgaugaggugcguuggaguagggaaucgagacuuuguggaaggguugucuggagccacauggguugauguuguacuagaacacggcggaugcguaaccacuauggcuaaaaauaaaccuacucuggauauugaacuccagaaaacggaagccacacagcuagcaacgcugcgaaaacucuguauagaaggaaaaauaacaaauauaacuacagacucgagauguccaacucaaggugaggcgauauugccugaggaacaagaccaaaauuauguauguaaacauacauauguggaucguggcuggggcaacggcuguggucucuuugguaaaggaucuuugguuacgugcgcaaaauuccaguguuuagaaccaaucgagggcaaaguaguacaauaugagaaccugaaauacaccguaaucauaacgguucacacgggugaucagcaucaggugggcaaugacacgcaagggguaacuguagaaauuacuccucaagcaaguaccguagaagcaguauuaccagaauacggaacguuaggauuagaauguucuccucgcaccggccuugauuuuaacgagaugaucuuauuaacaaugaaaaauaaagcauggauggugcacaggcagugguuuuucgaucuaccauuaccauggacaucaggggcuacaacggaaacuccuacauggaauagaaaagaauuacuuguaacguucaaaaacgcacacgccaagaaacaagaaguugucguuuuagggagccaggaaggugcaaugcauacugcccuaacuggugcaacggaaauacagaacucuggugguacuucgaucuucgcgggucauuuaaaaugccgucuuaaaauggauaaacucgagcugaaaggaaugagcuacgccaugugcuuaaauacauuuguucuaaagaaagaaguuuccgaaacacaacacggaaccauauuaauaaaagucgaauauaaaggagaagaugcaccuuguaaaauaccuuuuuccaccgaagacggacagggaaaagcacacaacgguagauugauaacggcuaacccuguagugacgaagaaagaagaacccgugaauaucgaagcagagccuccauuuggugaaagcaacauagugauugguauaggugacaaggcuuuaaaaauaaauugguacaaaaagggcaguucaauaggaaaaauguucgaagccacugcuagaggugcucgaagaauggcaaucuuaggagauacagcaugggauuuuggcucggucggagggguucuuaauagucuaggaaaaaugguacaccagauauuuggaagcgccuacacugcuuuguucaguggaguaucauggaucaugaaaauaggaauuggaguacuguugaccuggauaggauuaaauagcaaaaauacaaguaugucguuuaguugcauuguuauuggaauuauuacauuauauuuaggagcaguaguccaggccgacaugggaugcgcuauaaauuggaaaggcaaagaacuaaagugugggucaggcauuuuugugaccaacgaaguacacacauggacugaacaguacaaauuucaagcugauagucccaaacgucuugccacagcaauagcaggagcuugggagaauggcguuugugggauccguaguacuacaagaauggaaaaucugcuauggaaacagaucgcaaaugagcuaaauuauauuuuaugggaaaacaauauaaaauuaaccgucguaguuggcgacauaauaggcguguuagagcaggggaagcguaccuuaacaccccaaccaauggagcucaaauacaguuggaaaaccuggggcaaagcgaaaauuguaaccgcugagacgcagaauagcagcuucauaauagacggcccaaauacaccugaauguccgagugcuuccagagcauggaacguaugggaagucgaagauuacggauucgguguauuuaccacuaauauauggcugaagcugagggaaguuaauacgcagucaugugaucaccgucuaaugagugcugcaauaaaagaugaacgcgccguacaugccgacaugggauacuggaucgaaucccagaaaaauggcucuuggaaauuagaaaaggccucauuuaucgaagucaaaacguguaccuggccaaaaagucacacccuguggucaaauggggucuuagaaucugauaugaucauaccuaagucauuagcgggacccauaucccaacacaaccauagaccuggauaucacacacaaacagcagggccguggcaccuaggcaaacuugaauuggauuucaacuauugcgaaggcaccacggucguuauaacggaaaacuguggaaccagagguccaucucuacgaacaaccaccguaucagguaaauuaauccaugaaugguguugccggucuugcacccuacccccacugcgauauaugggagaagauggguguugguacgggauggaaauacgccccauaaacgagaaagaagaaaauauggucaagucauuaguaucagcggguucgggaaagguagacaauuuuaccaugggaguacugugucuggcuauuuuauuugaagaaguaaugcgagguaaguucggcaagaaacacaugauugcugggguauuauuuacuuuuguucuccuucuaagugggcagaucacauggagagacauggcucauacguuaauaaugauuggcuccaacgcuagcgaucgcaugggaaugggcguuaccuaucuagcucuaauagcgacguuuaaaauucaaccuuuucuagcacucggauucuuucuaagaaaauugacaaguagagagaaucuauugcugggcguaggccuugcaauggcaacaacucuucaacucccugaggauauagaacaaauggcuaacgguauugcauuagggcucaugacacuaaaauugauaacccaauucgaaacauaucagcuauggacugcucucguuaguuuaaccuguucaaauacaauauuuacacuaacaguagcguggagaacugcuacauuaauacuugcuggaguuucgcuacuacccuuaugucaaaguucgaguaugaggaaaacggauuggcuuccaaugacaguagcagcaaugggaguaccuccauuaccauuauuuauauuuucauuaaaagauacaccgaaaagaagaagcuggccgcuaaaugaaggaguaauggcgguuggucuagucucaauacuugcguccucauuauuaaggaaugacguaccuauggcaggaccccucgucgcagggggauuauugauagcguguuaugugauaacggggacuucagcagaucuaaccguugaaaaagcagcggauguaacaugggaagaggaggcagaacaaacagggguuucacacaaccugaugauaacaguagacgaugauggaacaaugcgcaucaaagaugaugagacagagaacauucuaaccguauugcugaagacagcacuacucauaguuucugguauauucccguauagcauaccugcuacgcuucuuguauggcauaccuggcagaaacaaacacaaagaaguggaguucuuugggacgugccuucgccuccagaaacucaaaaagcagaguuggaagaagguguuuaccgaauuaagcaacaggggauauuuggaaaaacacaaguaggagucggcguucaaaaagaaggaguauuucacacaauguggcacgucacgagaggagccguccuuacacauaauggaaaacgucuagaacccaacugggccucgguaaagaaagauuugauaucguaugggggaggcuggaggcucagcgcucaguggcaaaagggagaggaagugcagguuauugcggucgaaccaggcaaaaauccuaaaaacuuucaaacaaugccaggcaucuuucaaacuacuacaggagagauuggagcgauagccuuagauuuuaaaccuggaacaagcggaaguccaauaauaaauagagagggaaaaguuguugguuuauacgguaauggaguaguaacuaaaaacggaggcuacguaucaggaaucgcgcagacaaaugcggaaccggaugggccaacgccagaacuagaggaggagauguucaagaaaagaaaucuaacuauaauggauuuacaccccggaucuggaaaaacucgaaaauaccucccagcuaucguacgugaggcaauaaagagaagauuacgaacauugauuuuagcaccgacacgcguaguugcagcagagauggaagaagccuuaaagggauuacccaucagauaccaaacuacagcuacgaaaucagagcauaccggaagagagaucguugaccuaaugugccaugcaacuuuuaccaugagacuucuaucgccaguacgaguuccaaacuacaacuuaaucaucauggaugaagcgcacuucacagauccggcaaguauugccgcucggggguacaucucaaccagaguaggaaugggagaagcggcggcaauauuuaugacugcgacaccgccuggcacagcagaggcauuuccacaaucgaacgcgccaauacaagaugaggaaagggauauaccggaaaggucauggaacuccgggaacgaguggauuacagauuucguaggaaaaacuguaugguuuguaccaaguauaaaggcugggaaugauaucgcgaauugucuuaggaaaaacggcaagaaaguaauucaguuaaguaggaagacuuuugauaccgaauaccagaaaacucgcuuaaacgauugggauuuuguaguaacgacagacauuagugaaaugggagcgaauuucaaggcagaccgggugauugauccaagaagaugccucaaaccagucauccuaaccgaugguccugaaagaguuauucuagcgggcccaaugcccguuacagcggccucagccgcucaaagacgaggacgcgucggccgaaauccgcagaaagaaaaugaucaauauauuuuuacuggucaaccauuaaauaaugacgaagaccaugcucacuggacggaagcgaaaaugcuuuuagacaauaucaacacuccggaagguaucauacccgcccuauucgaaccagagagagaaaaaucugcagcgauugacggugaauaucggcuuaagggugagagcaggaaaacuuuuguagaacucaugaggagaggugaucucccagugugguuggcacacaagguagcaagugaggggauaaaguauacggacagaaaaugguguuuugacggagaaaggaauaaucaaauacuugaagaaaacauggauguagaaaucuggacgaaggaaggugagcgaaagaaacuuagaccgagauggcuugaugcucggacauacucagauccgcucgcccucaaagaauuuaaagacuucgcggcaggccguaaaucaauagcauuagaucugguaacagagaucggccgaguaccuucucaucuagcguaucgcacaagaaacgcauuagauaaucuaaugauguuacauacgucugaacacggcggacgagcguauaggcaugcaguagaggaacuaccugaaacgauggaaacuuuacuacuguuaggucuaaugauuuuauuaacaggaggagcaauguuauuucuuaucucuggaaaaggaauagguaagacauccauugguuuaaucuguguuauaguaucaagugguauguuauggauggcugauguuccacuacaauggauagcaucugcaaucguacuugaguuuuucaugaugguauuacugauaccugagccggaaaaacaaagaacaccacaagacaaccaauuggccuacguuguaauugguauccuaacucuugcagccaucgucgcugccaaugagauggggcuuuuggaaacaacuaagcgcgaccuaggaaugucaaaagaaccgggcguggucaguccaacuuccuaccuagauguagauuugcacccugcgucagcauggacucuauacgcaguugcaacaacgguaauaacaccgaugcugagacacacgauagaaaacaguacagcaaauguuucgcuggcagcaauugcgaaccaagcuguuguuuuaauggggcuagacaaaggauggccuauuaguaaaauggauuuagguguaccauuacuugcccugggaugcuauagucaaguaaaucccuuaacacuaacagcagcuguucuucuguuaguuacgcauuacgcuauaauugggccuggacuccaagcgaaagcgacuagagaggcacaaaagcgaacggcagcuggaauaaugaaaaauccaacugucgaugguauaaugacuauagaucuugauccaguaauuuacgauagcaaguuugaaaagcaauuagggcagguaaugcuauuaguacuaugcgcagugcaacugcuucugaugcguaccuccugggcacucugcgaagcucuaacauuagcaacagggcccauaacgacacucugggaaggaucaccaggaaaauucuggaauacgacaaucgcaguaucuauggcaaauauuuucagaggguccuacuuagccggcgcagguuuggccuucagcauuaugaaaucaguugguacaggucgucgugguaccggaagucagggugaaacacuuggggaaaaauggaagaagaaacucaaucaauugucacgaaaggaguucgaccuuuauaagaaaucaggaauaacagagguggaccguacagaggcuaaagaaggucuuaagagaggugaaacaacacaucaugcagucagucgggguucagccaaauuacaaugguuuguagagagaaacaugguaauucccgaaggccgcguuauagaucuugggugcgguagagguggauggagcuauuauugugcuggauuaaagaaaguuacagaaguacgugguuacacaaaaggagggccaggacaugaggaaccaguaccaaugucaaccuaugguuggaaucuaguuaaacuaaugagcgggaaagauguauucuaccuaccaccagaaaagugugauacccuccuaugugauaucggcgagucuaguccaucaccaacaguagaagaaucacgaacaaucagaguguuaaaaaugguugaaccauggcucaaaaacaaucaauuuugcauaaaaguauugaacccauauaugccgacaguuauugagcaucuggaaagauuacagcgaaaguauggaggcauguugguaaggaacccauuaagcagaaauucgacccacgaaauguauuggauauccaacgguacagggaacauagugagcagugucaauaugguaagcagauuacuccugaauagauuuacuaugacucaucgacguccgacaaucgaaaaagauguugaucuuggagcagggacuagacacgugaacgcggagccagaaacuccaaauauggacguuaucggagaaaggauaaaacguauaaaagaagaacacucgucaacguggcauuacgacgaugaaaacccauacaaaacaugggcauaucaugguucauacgaaguaaaagcgacgggaagugcaucuucuaugauuaauggaguugucaaacuauuaaccaaaccaugggauguaguaccgauggucacacaaauggcgaugacagacacaacacccuuuggucaacaaagaguuuucaaagaaaaaguagacacccgaacuccaagaccaaugccaggcacacgaaaaguaauggaaauaacagcggaauggcucuggagaacucugggucguaauaagaagccucgacucuguacuagagaggaguucaccaagaagguacguacaaaugcugcaaugggugcaguauucaccgaggaaaaccaaugggauucagcccgagcagcaguugaagaugaagaauuuuggaaauuaguagauagggaaagagaguuacauaaauuagguaaaugugguagcugcguauauaauaugaugggaaaaagagagaagaaauuaggagaguucgggaaagcaaagggaucacgagccauuugguauaugugguuaggagcuagauacuuagaguucgaggcuuuaggauuccuuaaugaagaucauugguucucaagagaaaauucauauagugggguagaaggggaagguuuacacaaacuaggauauauuuuacgagacauaaguaaaauaccugguggugccauguaugcagacgacacagccgguugggacacaagaauuacagaagaugauuuacauaaugaggaaaagaucacccaacaaauggauccagaacauaggcaauuagcuaaugcaauuuuuaaauuaacuuaucaaaacaagguaguaaagguucaacgcccgacaccaaagggaaccguaauggauauuauaagucgcaaagaucagcgagguucuggacaggucgggacauauggacuuaauacauuuacuaacauggaagcucaauuaguucggcaaauggagggggagggugugcuuaguaaggcggaucucgaaaauccgcaucuucuggagaagaaaauuacacaauggcuugagacaaaggggguagagaggcuuaagaggauggcaauaucaggugaugauuguguuguaaaaccaauagaugaucgguuugcuaacgcguuauuagcauugaacgauaugggaaagguuaggaaagacauaccacaguggcagccaucaaagggauggcaugauuggcaacaaguuccguuuuguagccaccacuuccaugaauuaauuaugaaggauggucggaaauuggugguccccugccggccacaggacgagcuuauuggcagagcacguauaucacaaggugcagguuggucguuaaaagaaacagcauguuuaggcaaggcuuaugcucaaauguggucccucauguacuuucacaggcgggaccuucgacucgcgucaaaugcaauuuguuccgcggucccuguucacuggauaccaacgucacguacaacauggucaauacaugcacaucaccaauggaugacuaccgaagacauguugacaguauggaaucgaguauggauagaagacaauccauggauggaagacaaaacgcccguaacuacuugggaggauguuccauaucuagguaagcgcgaagaccaauggugcgggucauuaauaggccuuaccucgcgagcaacaugggcacagaacauccuaacggcaauccaacagguaagaucauugaucggggacgaggaauuucuugacuauaugcccucuaugaagcgauucagaaaagaagaagaaucggagggagccauaugguaa

SEQ ID NO: 23489 - RNA, 9873 nt, Artificial Sequence
  derived and/or modified CDS sequence (opt6) from DENV-3__FJ562102__SS-prME
acgucucuaugucuaaugaugaugcuucccgcgacccuagcguuccaucuaacauccagagauggugaaccgcguaugauaguagguaaaaacgaacgaggaaaaucgcuucuauuuaaaaccgcaucagguaucaacaugugcacacuaauagccauggauuuaggagagaugugugacgauaccguaaccuauaaauguccguuaauagcagaaguugaacccgaagacauagauugcugguguaacuuaacgaguacaugggucacuuaugguacaugcaaccaagcaggggaacauagaagagauaaacguucuguagcuuuagccccacauguugguaugggauuagacacaagaacucaaacuuggauguccgcagaaggagccuggcgacaggucgaaaaaguugaaacgugggcuuuaagacauccgggauucacuauacuugcucuuuuccuugcucacuauauaggaacaaguuuaacgcaaaaaguaguaauauucauacuacucauguuaguuacgccguccaugacuaugcguuguguuggaguuggaaauagagauuucgucgaaggucuaaguggagcgacuugggucgauguagugcuggagcauggagguugcgugacaacuauggcuaaaaacaaacccacucucgacauugaauuacagaaaacugaagcaacgcaacuugcaacacugcgaaaacugugcauugaaggaaaaaucacgaauauaacuacugauagucgaugcccaacacagggagaggcgauauuaccagaagaacaagaucaaaacuauguauguaaacauacauauguagaccgcggguggggcaauggaugcggauuauuuggaaaagguucucucguuacaugugcaaaauuucaaugccucgaaccuaucgaaggaaaagugguucaguaugaaaacuuaaaauacacaguaauaauaacugugcauaccggggaucaacaccaaguuggcaaugacacacaaggcgucacggucgaaauaacaccucaggcaucgacggucgaggcuguuuuaccagaauauggaacguuagguuuagaauguucacccagaacaggacuugacuucaacgaaaugauccuucugacaaugaaaaauaaggcuuggaugguucaucgccaaugguucuuugauuuaccacuuccguggacgaguggggcaaccaccgaaacaccaacuuggaacagaaaagaacuucuaguaacauuuaaaaacgcacacgccaagaaacaagaaguuguaguuuuaggcagccaagaaggagcuaugcacacagcauugaccggcgcuacugagauccaaaauucuggaggcacaucgauauuugcaggucacuuaaaaugucgccuuaaaauggacaaauuggaauuaaaagguaugaguuacgcaaugugucugaacacauucguacucaagaaagaaguuucagagacacaacacgggaccauacucauaaaaguggaauacaaaggggaggaugccccgugcaaaauuccauuuucuacagaggacggacagggaaaagcccauaacggacggcuuauaacagccaacccagugguaaccaagaaagaagaacccgugaauauagaagcugagccuccuuucggugaaagcaauauuguaauugguauaggugacaaggcacucaaaauaaacugguauaagaaaggcaguucuauagggaaaauguuugaggcuaccgcaagaggugcacgcaggauggcaauuuuaggcgauaccgcaugggauuuuggaucuguaggcgguguacuuaauucacuuggaaagaugguacaccagauuuuuggcucagccuacacagcccuauuuucgggaguaucauggauaaugaaaauagguauuggaguacuccugaccuggauaggacucaauuccaaaaauacaucaaugagcuuuaguuguauaguaauuggaauuauaacucuguaucuuggcgcgguaguucaagcagauaugggaugugccauuaauuggaagggcaaggaguuaaaaugcgguagcgguauuuucgugacuaaugaaguucauacauggacagagcaauauaaauuucaggcugacucaccuaaaaggcuugcgacugcuauagcuggugcaugggagaacggugucugugguauaagaucaacuacgagaauggagaaucuacuguggaagcagauugccaacgaauugaacuacauauuaugggaaaacaauauaaaauuaacugucguagugggggauauuauagguguacuagagcaaggaaaaagaacacuaacgccccaacccauggaauuaaaguauaguuggaaaaccugggguaaggcuaaaauaguuacggccgaaacucaaaauucaaguuuuauaauugauggcccgaauacaccugaguguccgucagcuagcagagcuuggaauguaugggaagucgaggauuauggauuuggaguguuuacaacaaauauaugguuaaagcugcgggagguuuauacucaauccugugaucaucgacucaugucugcugcaauuaaagaugaaagagcuguccacgcugacaugggauauuggauugaaucgcagaaaaacggcucauggaaguuggaaaaagcgaguuuuauugaaguuaaaacuuguacguggccgaagagucacacacucuggaguaauggaguuuuagaguccgacaugauaauuccaaaaucgcucgcgggaccuaucucacaacauaaucauagaccuggauaccacacacaaacugcugggccauggcacuuagguaaauuagaguuagacuucaauuacugugaaggcaccacgguuguuauaacggagaacugcggaacacggggucccucguuaagaaccacuacuguaucuggcaaacuuauucacgaauggugcuguaggaguuguacguuaccgcccuugcgguauaugggugaagauggauguugguauggaauggaaauucgaccaauuaaugaaaaagaagaaaauauggugaagagucuaguaagugcuggcucagguaaaguagauaauuucacaaugggcguucuaugucuagcaauauuauucgaagagguuaugagaggaaaauucgggaaaaagcauaugauugccgguguacucuuuaccuucguccuauuacuaagugggcaaauaacauggagggauauggcgcacacuuuuauuaugauaggcuccaacgcaagcgauaggaugggcaugggaguaaccuaucuagcguuaaucgcaacuuuuaaaauacaacccuuuuuagcccuaggauucuuuuuaaggaaacuuacaaguagggaaaaccuacuuuuagguguuggauuagcaauggccacaacgcuucaauugccugaggauauagagcaaauggcuaaugggaucgcgcucggucugaugacuuugaaacuuauaacacaguuugaaacguaucaauuauggacagcauuagucucacuuaccugcaguaauacuauuuuuacuuuaaccguugcguggcgcaccgcgacuuuaauacuagccgggguauccuuauuaccgcuaugucaaucaaguagcaugagaaaaacggauuggcucccaaugacaguagcugccaugggagucccgccuuugccccuuuuuaucuuuucuuuaaaagauacuccuaaaaggaggaguuggcccuuaaaugaagguguaauggcagucggucuaguuucaauacuugcgagcucauuacuuagaaacgacgugcccauggcaggaccucuaguggcugguggauuauuaauugcaugcuacguaaucacuggaacguccgcagaucucacgguagaaaaggcagcagaugucacuugggaagaagaagcagaacaaacagggguaagccacaaucuaaugauaaccguagacgaugauggcacaaugcgcauaaaggacgaugaaacagaaaacauuuugacuguacuacuuaaaaccgcucuacuuauaguaucaggaaucuucccauauaguauacccgcaacccuccuagucuggcauacauggcagaaacaaacacaaagauccggcgugcuaugggauguuccuucaccaccagagacccaaaaagcugaguuagaggagggaguauaccgaauuaaacagcagggaaucuuuggaaagacucaaguuggagucggaguacagaaagagggaguuuuccacacaauguggcacguaacaagaggggcuguucuaacacauaaugggaagcguuuagaacccaacugggcuagugucaagaaagaucugauuucauauggaggugguuggaggcucucugcucaauggcaaaagggagaagagguacaagucauagccguugaaccgggcaaaaacccuaaaaauuuccaaacuaugccgggcauuuuucaaacaaccaccggugaaauaggagcaaucgcucuagauuuuaaaccuggcacaagcgggucaccaaucauaaacagggaaggcaaaguaguaggacuauaugguaauggcgucguaaccaaaaauggaggauauguuuccgguauagcccagacgaacgcugaaccggaugguccuacgccugaauuagaagaagaaauguuuaaaaagagaaaucuaacgauaauggaucugcacccggggucagguaaaacucggaaauacuuaccagcaaucgucagagaggcgaucaaaagaaggcucaggacgcuuauccuagcaccaacucgcgucgucgcagcagaaauggaggaagcauuaaaaggacuuccuauccgcuaucaaaccacugcuacaaaaagcgaacacacuggaagggaaauaguagacuuaaugugccaugcaacuuucacgaugagacuauuaucuccaguuagaguuccaaauuauaacuuaauuauaauggaugaagcucauuucacagacccggcuagcauagcugcuagaggauauaucucaacuagggugggaaugggggaggccgcggcuauuuuuaugacagccaccccaccugguaccgcagaagcguuuccacagucgaaugcaccaauccaagaugaagaacgagauauccccgaacguaguuggaacucaggaaacgaauggauaacagacuucguaggaaaaacagucugguuuguuccgaguauaaaagcuggaaaugauauagcaaauugcuuacguaaaaauggcaagaaaguaauccaauuaagucguaaaaccuuugauaccgaauaccagaaaacaagacuaaaugauugggacuucguuguaacaacagacauuagcgagaugggagcuaauuucaaagcugaccgaguaauagacccacgcagaugucuaaaaccgguaauucuuacagauggacccgaaaggguaauauuagccgguccaaugccgguuacugccgccucagcagcucaaagaaggggaagaguaggacggaauccucaaaaagaaaaugaucaguacaucuuuacaggccaaccccuaaacaaugacgaagaucaugcgcauuggacagaagcuaaaauguuauuagauaacauaaacacuccagaaggcauaauaccugcauuauuugaaccugagagagagaaaucggcagcaauagacggagaauauagauuaaaaggugaaaguagaaaaacuuucguggaacuuaugcgacguggcgaucucccaguauggcuagcccacaaaguagccucagaagggauuaaauacacggacaggaagugguguuuugauggagaacggaacaaucagauuuuagaagagaauauggacguugagaucuggacgaaggaaggagaaagaaagaaacuuagaccaagaugguuagaugcacgaaccuauagugaccccuuagccuuaaaagaguuuaaagauuuugcagcgggaagaaaaagcauugcucucgaucuagugacggaaauaggaagaguaccuucgcauuuagcauauaggacuagaaacgcuuuggauaauuuaguaauguuacauacgucggaacacggcggacgagcauacagacaugcaguagaagaacucccggaaacaauggaaaccuugcuccugcucgguuuaaugauccuauuaaccggcggagcgaugcuauuucuuauaucugguaaagggauagguaaaacaaguauaggacugaucugugucauuguaaguaguggaauguuauggauggcugacguaccucuacaauggauugcaagcgcuauaauacuggaauuuuucaugauggucuuguugauaccagagccagagaaacagcggacuccucaagacaaucaacuggccuaugugguuaucggcauccugacacucgcagcaauagucgcagcaaacgagauggguuuauuagaaacgacaaaaagagaucuagguauguccaaggagccaggcguagucucaccaaccaguuacuuagaugucgauuugcaucccgccucagcauggacauuauacgcugucgcaaccacagugauuacuccgaugcuacgccauacuauagagaauagcacagcuaacgugucacuagccgcaauagcgaaucaagcuguaguguuaaugggucuagacaaaggguggcccauaucgaaaauggaucuaggaguaccacucuuagccuuaggaugcuauagucaggugaacccauugacacucaccgcugccguauugcugcuuguaacacacuaugcuaucauaggaccaggccugcaagcuaaggcaaccagagaagcacaaaagagaaccgcagcggggauaaugaaaaaccccacaguugauggaauaaugaccauagaccuagacccaguaauauacgauucgaaauuugaaaaacaguuaggucaagugauguuguuaguguugugugcaguucaacuauuacucaugcgaacuucuugggcgcuuugcgaggccuugacauuagcaaccggucccauuacaacguuaugggaaggaagcccagguaaauucuggaacaccacgauagcaguuaguauggcuaacauuuuucgagggagcuauuuagcaggagcaggacucgcguucuccauuaugaaaucuguaggaacagggcggcguggaacggggucacagggagaaacacugggagaaaaguggaaaaagaaacuuaaucaacuaucucgaaaagaauuugaucucuacaagaaaucaggaaucaccgaaguagauagaacggaagcuaaagaaggccuaaaacgaggagaaacgacucaccaugcaguuagcagaggcucugcaaaauugcaaugguucguggaacgcaauaugguuauaccagaagggcgcgucauagauuuaggauguggaagaggcggauggucauacuauugugcuggacuaaagaaagucacggaagugagaggcuauacaaaagguggaccgggacaugaggagccaguaccaaugucaaccuaugguuggaaucuagugaaacucaugagcgguaaagauguauuuuaucuaccgccggaaaaaugcgauacauuacuaugcgacauaggagaaagcaguccguccccaacaguggaggaaucaagaaccauuagaguccuaaaaauggucgaacccuggcucaaaaauaaucaauucugcauuaaaguccucaacccauauaugccaacaguaauugaacacuuggaaagauuacaacggaaauaugguggaaugcucguuaggaacccauuaagucgaaacucaacgcacgagauguacuggaucucuaauggcacagguaauauuguauccagugugaacaugguaaguaggcugcuucuuaaucgguuuacaaugacucaccgucgaccgaccauagaaaaagauguagauuuaggagcuggaacacgacacguaaaugcugaaccagaaacuccgaauauggacguuauaggagaaagaauaaagagaauaaaagaggagcauuccucgacguggcacuacgacgaugaaaacccauacaagacaugggcguaucacggaaguuaugagguuaaagccacggguucagcaaguuccaugauaaauggugucgugaaauuacucacgaaaccaugggacguuguuccaauggugacacaaauggccaugacggacacaacuccauuuggacagcaaagagucuucaaagaaaaagucgacacccguacuccaagaccgaugccagguacaagaaaaguaauggagauaacagcagaguggcucuggcgcacucuagguagaaauaagaaacccagauuguguacucgagaagaguucacuaagaaaguacgcaccaaugccgcuaugggagccguauucacagaagagaaccagugggacagugcaagggcagcaguggaggacgaggaguucuggaaacuugucgaucgugagcgagaauuacauaaauuagguaagugcggaagcugcguguacaacaugaugggaaaacgugagaagaaacuuggagaguucggcaaagcuaaaggcagcagagcaaucugguacaugugguugggagcuagguauuuagaauuugaggcacuaggcuuuuuaaacgaggaucacugguuuagucgagaaaauagcuacucgggaguugagggggaaggauuacacaagcuaggauauauauugcgggauauuucgaagauaccagggggugcaauguacgcggacgacacugcagguugggacacgagaauaacagaagacgaccuucauaaugaggagaaaauaacacagcagauggauccugaacauaggcaauuggcgaacgcgauauucaaauuaaccuaucaaaacaaaguuguuaaaguacagcgaccuacaccaaaagguacaguaauggacauuauaaguaggaaggaucaaagggggucugggcaagugggaacguauggccuaaacacauucaccaauauggaagcacaguuaguaagacaaauggaaggcgaaggagucuuaucuaaagcugauuuagaaaacccacaucuacuugaaaagaaaauuacgcaguggcuagaaacuaaaggaguagaacgcuugaaacgaauggcaauauccggagacgauugugucgugaagccuaucgaugauagauucgcaaacgcauuacuagcacucaaugacaugggaaaaguuagaaaggauauuccgcaauggcaaccguccaaaggguggcaugauuggcaacaaguuccguuuuguagucaucacuuucaugaauugaucaugaaagauggaagaaaguuggugguaccgugcagaccccaagaugagcuuaucgguagagcucgaauuagccagggggccggguggucucucaaagaaaccgccuguuugggaaaggcuuacgcacaaauguggagccuuauguacuuucaucggcgagaucuacgucuagcgaguaaugcaauaugcagcgcaguccccgugcauuggauucccacuucucgaacuaccuggagcauucaugcacaccaucaguggaugacuacagaagauauguuaacgguuuggaauagggucuggauagaggacaauccguggauggaggacaaaaccccugucacuaccugggaagauguuccauaccuaggaaagagagaagaucaguggugcggcagcuuaauaggucugacaucucgcgcaacuugggcucagaauaucuugacugcuauacaacaaguccggucacuaaucggagacgaggaguuccucgacuauaugccgagcaugaaaagguucagaaaagaagaggaguccgagggagcuauaugguaa

SEQ ID NO: 23490 - RNA, 9873 nt, Artificial Sequence
  derived and/or modified CDS sequence (opt6) from DENV-3__FJ410229__SS-prME
acgagcuuguguuuaaugaugaugcuacccgccacacucgcuuuucauuuaacaucgagggacggggaaccgaggaugauagugggcaaaaaugaaagagggaaaagccuccuguuuaaaacggcuaguggaauaaauaugugcacacuuauagccauggauuuaggcgaaaugugugacgauacgguuacguauaaaugcccgcugauagcugaaguagaaccagaagauauugauuguuggugcaaccuaacaucaacguggguaacauaugguacaugcaaucaagcuggcgaacaucgacgagauaagagaagcguagcccuagcuccacauguaggaaugggacuagauacaaggacucaaaccuggauguccgcagaaggggcguggagacaagucgaaaagguggaaacgugggcacuuagacacccuggauucacuauauuagcguuauuuuuagcucacuauauuggaacuagcuugacacaaaaaguaguaauuuuuauacuucucaugcuagucacuccaagcaugaccaugagauguguaggaguuggcaauagagacuuuguagaaggcuuaagcggagcaacauggguagaugugguauuggaacacggcgggugugugacgacaauggcgaaaaacaagccaaccuuagauaucgaguugcagaaaacagaagcaacucaacuggccacucuacguaaacuauguauagaagggaaaauaacaaacauuacaacagacucucguugucccacacagggugaggcaauucuccccgaagaacaagaccaaaauuacgucugcaagcauaccuauguagaucgcgguugggguaaugguuguggguuauuuggaaaggguagcuugguaacgugugcaaaauuucaaugucuagaaccuaucgagggaaagguaguacaauacgagaauuuaaaauauacgguaaucauuacugugcauacaggugaccaacaccaagucggaaaugauacacagggcgugacagucgagauaacaccacaggccucgaccguugaagcaguauugccagaauauggaacuuuaggguuggaaugcaguccacgaacagggcuggacuucaacgaaaugaucuuauugacgaugaaaaauaaagccuggaugguucacagacaaugguucuuugaucuccccuuaccguggacgucaggcgcaaccacugagacaccgacguggaacaggaaggaacucuuaguaacuuucaaaaaugcacaugcgaagaaacaagaaguuguuguacuugggagucaagaaggagcaaugcauaccgcuuugacuggagcaacagaaauccaaaauaguggaggaaccaguaucuuugccggacaucuaaagugcagguuaaagauggacaaauuagaauugaaaggcaugucuuaugccauguguuuaaacacuuucgugcuuaagaaagaggugagcgaaacucaacauggaacgauucuaauuaaagucgaauacaaaggggaggaugcgccuuguaagauaccguuuucaacagaagacggacaagguaaagcgcacaaugguagacuuauaacugcaaauccgguuguuacaaagaaagaagaacccguaaacauagaagcagaaccgcccuuuggugaguccaauauuguuaucggaauaggugauaaagcucuaaaaauuaauugguacaaaaaggggagcucaauaggaaaaauguucgaagcaacagcuaggggagcccguagaauggcaauauuaggggauacggcuugggacuuugggaguguaggagguguauuaaacagucuaggaaaaaugguccaccagaucuuugguagugcauacacugcauuauucucagguguguccuggaucaugaaaauuggaauaggagugcuuuugacguggauuggccuaaacagcaaaaacaccaguaugucuuucuccuguauagucauaggcaucauaacacucuaucuuggagcagucguacaagcagacauggggugugcuauaaauuggaagggaaaagaauuaaaaugugggucuggaauauucguaaccaacgaaguacacacauggacagaacaguauaaguuucaggcggauucgccaaaacgacuagcaacagcaauagcuggagcaugggaaaauggcguuugugguaucagaaguacaacuagaauggagaaccucuuauggaaacaaauagcuaaugaacuaaauuacauauugugggaaaauaauauaaaauuaacgguuguaguaggagauaucaucggugucuuagaacaaggaaaacggacacuaacuccccagccaauggaacuaaaauauucuuggaaaacauggggaaaagcgaagauugucacugcggagacacaaaauucaucauucauuauugaugggccaaauacuccagaaugccccucagcaucacgagccuggaacguaugggaagucgaagacuacggauuuggcguuuuuacgacuaauaucugguugaaauuaagagagguuuauacacaaaguugugaucacagacuaaugucagcagcaaucaaagaugaacgggcuguucaugcagauaugggauacuggauagaaagucagaaaaauggaucauggaaauuggaaaaagcgucauuuauagaaguaaagacuuguacuuggccuaagagucauacgcuauggucuaaugguguuuuagaaucagauaugaucauuccgaaaagccuagccggaccaauaagucaacacaaccacaggcccggauaucacacucagacugcugggccauggcauuuagguaaacuagagcuagauuuuaacuauugugaagguacaacaguaguuauaacugaaaacugugguacucgaggaccaucguugagaacgacgacaguaucagggaaacuuauucaugaguggugcugcagaucuuguacuuuaccaccuuugcgauauaugggcgaggaugggugcugguacgguauggagauaaggcccauuaaugaaaaagaggagaacaugguaaaaagucuaguaagugcaggcagcgguaagguggauaacuuuacgaugggcguauuaugcuuagcaaucuuauuugaagaaguaaugagaggcaaauuugguaaaaagcauaugauagcugguguguuauuuaccuucgugcuguuguuaaguggccaaauuacauggagagauauggcacacacuuuaauaaugauugggagcaaugcuuccgacagaaugggaaugggagugacuuacuuggcauugaucgccacuuucaaaauacaaccauuccuugcucuaggauucuuuuuacggaaacuuaccagccgugagaaccuacuacugggagugggacuugcuauggccacaacucuucaacuuccugaagacauagaacaaauggcuaauggaauugcauuaggccuaaugacauuaaaacuuauaacacaguuugaaacauaucaauuauggacugcgcuaguuucauuaacauguucaaacacgauuuuuacacugacaguugcauggcgcaccgccacuuuaauacucgccggcgucucacuacuuccauuaugucaaaguaguucuaugcgaaaaaccgauugguuaccuaugacgguagcugcaaugggaguaccuccacuaccacuauucauauuuuccuuaaaagauacaccgaagcgaaggagcuggccacuaaaugaaggugugauggccguaggguugguguccauauuagcuuccucacuacuaagaaaugacgugcccauggcaggaccguugguagcagggggauugcucauugcauguuauguaaucacaggaaccucagcagacuuaacagucgaaaaggcagcugacguaacaugggaggaagaagcagagcaaacggguguaucgcauaaccuuaugaucacaguugacgaugacggcacaaugagaauaaaagacgacgagacagagaacaucuugacgguccuccucaaaacagcauuauuaauaguauccggaauauuucccuauagcauaccagcaacacugcugguuuggcauacuuggcagaagcaaacucaaagauccgggguauuaugggauguuccuaguccuccagaaacccagaaagccgaauuagaagaaggcguauacaggauaaagcaacaagguaucuucgguaaaacacaagucggugugggaguccaaaaagaaggaguguuccauacuauguggcauguaacaagaggggccguuuuaacacauaacgguaaacgguuggaaccgaacugggcuucugucaagaaagaucuaauaagcuacggaggaggguggagacuuucugcacaauggcaaaaaggugaagaggugcaaguaauagcaguugaaccuggcaaaaacccuaaaaauuuccaaaccaugccaggaaucuuccagaccacaaccggagaaaucggagcaauugcacuagauuucaaaccaggaacaucaggaucaccgaucauuaaucgugaagguaaagucguaggauuauauggaaacggcguugucacgaaaaacggcggcuauguuuccggaauugcgcagacuaaugcugaaccugacgguccaacuccggaguuagaggaagaaauguucaagaaaagaaaucuaacaauuauggacuuacacccuggcucaggcaagacaaggaaguauuuacccgcaauuguacgagaagcgauaaaaaggagauuacgaacguuaauacuugccccaacucggguagucgcagcagagauggaagaagcacuaaaaggauuaccaaucagauaccaaacuacagcuacuaaaucugaacacacaggaagagagauaguagauuugaugugucaugccaccuucacaaugcgacuuuugucaccaguccgaguaccaaauuacaauuuaauaaucauggaugaggcgcauuuuacagaucccgcuucaaucgcagcuagaggcuacaucucuacccggguuggaaugggagaggcagcagcaauuuuuaugacagcuacaccacccggaacggccgaggcuuucccacaaagcaacgcaccuauccaagaugaagaacgugacauucccgaacguucuuggaacucggguaaugaauggauaacggauuuuguuggcaaaacuguaugguuuguaccaagcauaaaggccggcaaugauaucgcaaauugcuuaaggaaaaaugggaagaaggucauacaacuaucuagaaaaacuuuugauacagaguaccagaaaacaagacucaacgauugggauuucguugugacaacggauauaagugagaugggagcaaacuuuaaagcagacagagucauugauccaagacgaugucuaaaacccguuauucuaacagacgguccugagcgaguuauucucgcaggaccgaugccagucacagcagcgucggccgcucagagaagggguagaguugguagaaauccacagaaggaaaacgaucaauacaucuucacaggacagccucuuaacaaugaugaagaucaugcacacuggacggaagccaaaauguugcuagauaauaucaacacuccugaaggaauaauacccgcgcuauucgaacccgagagagagaaaagugcagcuauagauggcgaauauagauugaaaggugagucacggaagacauucguugaauuaaugcgucgcggggaucucccaguauggcuagcacauaaagucgcaucugaggguauaaaauauacagauagaaaauggugcuucgauggugaaagaaacaaucaaauacucgaggaaaauauggaugucgaaauauggacuaaagaaggugaacggaaaaaguuacgaccaagauggcuggaugcuagaacauauucagaccccuuggcguugaaagaauuuaaagacuuugcggcagguagaaaaucaaucgcucucgacuuagugacugagauagggagaguuccuucacaucuugcauaccggacaaggaacgcccuugauaacuuaguaaugcuacacacgucagaacauggcgggcgagcuuaucgacaugccguagaagaacucccagaaacaauggaaacuuugcuucuauuaggauuaaugauccugcuuaccggaggggcgaugcuuuucuuaauuucaggaaaagguauaggcaagacaagcauagggcuaauauguguaauaguaucauccggaauguuauggauggcugauguacccuuacaguggauagccagugcaauaauacucgaauuuuucaugaugguuuugcuuauccccgaaccagaaaagcaaagaacaccacaagauaaccagcuagccuauguagugauagggauauuaacuuuagcagcaauaguugcagccaaugagaugggccuauuggaaacaacaaaaagagaucuaggaaugucuaaagaacccggaguagugaguccuacgucguaucuagauguggaucugcauccagcauccgccuggacacuuuaugcggucgcaaccacugucauuaccccaaugcuuagacacacaauagaaaauucaaccgccaauguaucguuggcagccauugccaaucaagcaguaguccucaugggguuagauaaaggguggccgaucucgaaaauggaucuaggaguuccguuauuggcccugggauguuacagucaggucaauccacucacucucacagccgccgugcuucuccuagucacacacuaugcaauaauagguccaggauuacaggcaaaggcgacaagagaagcgcaaaaacggaccgcagcaggaaucaugaaaaauccgacgguugacggaauaaugacuaucgaucuugacccaguaauauacgacucaaaauuugaaaagcaauuaggucaaguuaugcuauuggugcuaugcgcagugcaacuauugcugaugcguacuucuugggcauuaugugaagcgcugacacuugccacgggaccaauaacuacccucugggaaggcucuccgggcaaguuuuggaacacaaccauugcgguuaguauggcaaauauuuuuagagggucauacuuggcuggagcuggacuugccuuuuccauaaugaaaagcguaggcacgggacgaagaggcacagguucacaaggagagaccuuaggugaaaaauggaaaaagaaauuaaaccagcugagccgaaaagaguucgauuuauacaagaaaagcggcauaaccgaagucgacagaacagaagcaaaagaaggauugaaaagaggggaaacuacccaucaugcaguaucucgaggcagcgcuaaacuucagugguuugucgaacgaaauaugguaaucccagaagguaggguuauagauuugggcuguggacgaggcggcuggucauauuauugcgcgggucucaagaaaguuacggaaguacgcgguuauaccaaaggcggcccgggucacgaggaacccgugccaaugucgacuuaugguuggaaucuagucaaacuuaugucaggaaaagacguauuuuaccugccaccugaaaaaugcgauacguugcuaugugacauuggugaaaguagucccucuccuacaguagaagaaagucggaccauacgaguccugaaaaugguagaaccauggcuuaaaaauaaucaguucugcauaaaaguacuuaacccauauaugccaacaguuauagagcaucuagaacgacugcaaagaaaguacggugguauguuaguuagaaacccacuaucuagaaauucgacacaugaaauguauuggauuucaaacggaacgggaaauauaguauccucagugaacauggucucaagauuauuacugaauagauucacaaugacacacagacgcccaacgauagaaaaggauguggacuuaggagcggguacgagacacgucaaugcugaacccgaaacuccgaauauggacguaauuggugaaagaauaaaacgaauaaaggaagaacauagcucuacuuggcauuaugaugacgaaaacccauacaaaacaugggcauaccacggcaguuaugagguuaaagcaacuggaucagcuaguaguaugauaaacgggguaguuaaacugcucacgaagccuugggauguaguuccuaugguuacucagauggcgaugacggacacuacucccuuuggucagcaacgggucuucaaagaaaaaguagauacacguacuccccguccuaugccuggcaccagaaagguuauggaaauaacugcagaauggcuuuggcguacucuuggaaggaacaagaaaccaagauuaugcacgcgagaggaguucacaaagaagguuaggaccaacgcggcaaugggcgccguguucaccgaggaaaaucaaugggauucagcaagggcagcuguagaagacgaggaguuuuggaaauuaguugacagagagagagagcuucacaaauuggggaaaugugguucaugcguauacaauaugauggggaagcgagagaagaaacugggagaauuuggaaaggccaaagggaguagagcuauuugguauauguggcuaggagcaagguaucuugaguucgaggcacugggguuccuuaaugaagaucauugguucucgcgugaaaacuccuauucaggcguagaaggcgaagguuuacacaaguugggauauauacuaagagacauaucaaaaaucccaggaggagcgauguacgcagaugacaccgcaggaugggauacgagaauaacagaagaugaccuacauaaugaagagaaaaucacgcaacagauggauccagaacaucgccaacuagcaaaugcgauauuuaagcuaacauaucaaaauaaaguuguuaagguccaacgaccuacgccgaaggguacuguaauggauauuaucuccagaaaggaccaacgggggagugggcaaguuggcacauauggguuaaacacuuuuacaaacauggaggcgcaauuagucagacagauggaaggcgagggcguacugaguaaagcugaccuugaaaauccucauuuauuagagaagaaaauaacccaguggcuagaaacaaaaggaguagaaaggcucaagagaauggcaauuagcggcgaugacugcguagugaagccgauagacgacagauuugcaaacgcccuccuugcacugaaugacaugggaaagguacgaaaggacauuccacaguggcaaccuaguaaaggauggcacgauuggcaacaaguaccuuuuugcucacaucacuuccacgaauugaucaugaaagacggaagaaagcuaguagugcccugcagaccacaagaugaguugauaggucgggcgagaaucucacaaggggcaggcuggucauuaaaggaaacagccugcuuggguaaggccuacgcccaaauguggucacuuauguauuuccacagaagagauuugagguuagcaaguaaugcaauaugcucagcugucccaguacacuggauaccuacgagccguacgaccuggagcauacaugcacaucaucaauggaugacaacggaggauaugcuuacgguuuggaacagaguguggauagaagauaauccauggauggaagacaaaacaccggucacaacaugggaagacguacccuauuuagggaaaagagaagaucaauggugcggaucauuaauaggcuugacaaguagagcuaccugggcacaaaauauccuaacagcaauacaacaaguaaggaguuuaaucggugaugaagaguucuuagacuacaugcccaguaugaaacgguuuaggaaagaagaggaaucagagggugcuauaugguaa

SEQ ID NO: 23491 - RNA, 9873 nt, Artificial Sequence
  derived and/or modified CDS sequence (opt6) from DENV-3__FJ461326__SS-prME
acuucuuuaugccuuaugaugaugcuuccagcaacgcucgcauuucauuuaacuucccgagauggggaaccuaggaugauagucgguaaaaaugaaagaggaaaaaguuuacuauucaaaacugcaagugguauaaauauguguacacugauugcaauggauuuaggagaaaugugcgaugauaccguaacuuacaaauguccauuaauugcagaaguggaaccggaagauauagauuguugguguaaucuuacaagcacauggguuaccuacgggacauguaaucaagcuggagaacauaggcgcgauaaaagauccguagcucuagcaccucacgugggaaugggauuggauaccagaacacaaaccuggauguccgcagaaggagcauggcggcaaguggaaaaagucgaaacaugggcauugcgacaucccggauuuacaauacucgcucuauucuuagcgcauuauauaucgaccucacugacacaaaaaguaguaaucuucauacuucuuaugcuugucacuccaucaaugacgaugcguugcguaggcguaggcaaucgugauuuuguugaagguuuaaguggagcaacaugggucgacgucguguuagaacauggaggguguguuacuacaauggcaaggaacaaaccaacauuagauauugaauuacagaaaacggaagccacgcaauuggcuacacucagaaaacuguguauugaaggaaaaauuaccaacauuacaacagauagucguuguccaacucaaggagaggcaauccuuccagaagaacaagaucaaaacuaugucuguaaacauacauacguggauagaggguggggaaauggcugcgguuuauucgggaaagguucuuugguuacaugcgcgaaauuccaaugucuagaaccgauugaaggaaaaguaguacaauacgaaaaucuaaaauauacaguuauaauuacaguccauaccggagaccaacaucaaguagggaacgauacacaaggagucacaguggaaauuacaccacaagcgucuacgguggaagcaguauuaccggaauacggaacgcuuggucuagaaugcagucccagaacuggcuuagauuuuaaugaaaugauacuauugacuaugaaaaauaaagcauggaugguucauagacaaugguuuuucgaucugccacugccuuggacaaguggggcuacgacugaaaccccgaccuggaaucgaaaagaacuauuaguuacguuuaaaaaugcucaugcuaagaaacaagaagucguaguauuaggaucucaagaaggugccaugcacacagcguuaacuggugcgacagaaauucaaaauagcggaggcacgagcauuuucgcaggacaccuaaaaugucgcuuaaaaauggauaaauuggaguuaaaaggaaugaguuacgcaaugugucuaaauacauuuguauugaagaaagaagucucagaaacucaacauggaacgaucuugauuaaaguggaauauaaaggcgaagacgcuccguguaaaaucccauuuucuacagaagacggucaaggaaaagcccauaauggcagauuaauuacagcuaacccaguagugaccaagaaagaggaaccagucaauauagaggcugaaccacccuuuggagaaucaaauauuguaauugggauaggggacaaagcucuaaaaauaaacugguacaagaaaggaucaucuaucggaaaaauguuugaagcgacagcaagaggagcaagaagaauggcaaucuuaggcgacacugcgugggauuuuggaucggucgguggcgucuuaaauucauuaggcaaaauggugcaucaaauauuugggucugcauacacagcucuguuuuccgguguauccuggauaaugaagauaggaauaggaguacuacugacauggauuggucuuaauucgaagaacacaaguaugucauuuucauguauugucauugguaucauuacguuguauuuaggagcgguaguucaggcagauauggguugugcuauuaacuggaaggggaaagaacuaaaauguggaucuggaauuuuuguaacuaaugagguacacacuuggacugagcaauacaaauuucaagcagauucgccgaaaagacuugccacggcuauagccggugcuugggagaaugggguuugcggcaucagguccacgaccagaauggaaaaccuacuuuggaaacagauagcaaaugaauuaaauuauauacugugggaaaauaauauuaaauuaacuguuguagugggagauaucauuggcgucuuagaacaaggcaaaagaacguuaacaccacaaccaauggagcuaaaauauucauggaagacauggggcaaagcaaaaauaguuacugcagaaacucaaaacuccagcuucauaaucgacggaccuaauaccccagaauguccaagcgcuagccgggcauggaauguaugggaagucgaagauuauggcuucggaguauuuacaacaaauauauggcuaaaauugagagaaguauauacacagaguugcgaucauagauuaaugucagcugcaaucaaagaugaacgggcuguacaugcggacaugggauauuggaucgaaucgcagaaaaaugggucuuggaaacucgagaaggcauccuucauagaagugaaaacauguacguggccaaaaagucauacucuguggucaaauggagugcuugaaagcgacaugauaauuccuaaaucucuagcaggaccuauuucgcaacacaaccaccgcccaggauaccauacacaaacagcaggaccguggcauuuaggaaaauuggaauuagauuuuaauuauugugaaggcaccacuguugucauuacggagaauugcggcacgcgaggacccagcuuaaggacgacgacaguaagcgguaagcuaauacacgagugguguuguagaaguuguacauuacccccgcuucgauauaugggagaagacggauguugguaugguauggaaauccgaccgauuaaugagaaagaagaaaacaugguaaagagcuuggugucagcuggcuccggcaaaguagacaauuuuacaaugggcguauugugucuugcuauauuguucgaagaagucaugagaggaaaauuuggcaagaaacauaugaucgcaggaguauuauucacuuuuguacuguuauuaucaggacaaaucacauggcgugauauggcgcauacuuuaauuaugauuggcaguaacgcuagugaccggauggguaugggaguaacuuaccuagcauuaaucgccacauucaaaauucaaccauuucucgcguuaggguucuuuuugagaaaacucacaucuagagaaaaucuacugcuuggaguuggccucgccauggcaacgacauuacaguugccagaagacaucgagcaaauggcuaacggaauugcucugggucuuaugaccuugaaauuaauaacucaauucgaaacauaccaauuguggaccgcauuaguuucauuaacgugcucaaauacaaucuucacacuuacaguagcauggaggacagcaaccuuaauauuagcgggagugucuuuacuacccuuaugucaaaguucaagcaugagaaaaacagacugguuaccuaugacaguagcagccaugggagugcccccacuaccgcuuuuuauauuuaguuuaaaagauacucccaaacgacggaguuggccccuuaacgaaggagucauggcggucggauuagugucaauacuagcgucaagccuacuucggaaugauguccccauggcgggaccacuugucgcuggcggauuacuaauagcauguuaugugauuaccggaacuucagcugaccuuaccgucgaaaaagcagccgacgucacgugggaagaagaggccgaacaaacugggguuucacacaaccuaaugauaacaguugaugacgaugguacaaugcguauuaaggacgaugaaaccgaaaauauucugacaguauuacuuaagacugcauuauugauaguuucgggcauauucccuuacucaauuccugccacacuucuaguauggcacacguggcaaaaacagacccaacgaucagggguauuaugggacgugccgucgccacccgaaacgcagaaagcagaguuagaagaaggaguauacagaaucaaacaacaaggaauauucggcaaaacacaaguggggguggggguacaaaaagaaggaguuuuccauacuauguggcacgucacacgaggugcaguucuaacucauaauggaaagagauuagaaccgaauugggcaucaguuaagaaagacuuaauuagcuauggaggcggguggaggcuuucagcacaauggcaaaaaggggaagaaguacaagugauagccguugagccaggcaaaaauccuaagaacuuucaaaccaugccagguaucuuucaaacuacaacuggagaaauaggcgcaauugcacuagauuuuaagccagguacgagcggaaguccaauuauaaaccgcgaggggaaaguaguagggcuauauggaaacgguguagucacaaagaauggcgguuacgugucuggcauagcucaaacuaacgcagagccagauggaccaacaccggaguuagaggaagaaauguuuaagaaaaggaacuuaacaauaauggauuuacauccggguucggguaaaacuagaaaauauuugcccgccauuguuagggaagcaauuaaaagacgucuaagaacauuaauccucgcacccacuagggugguagcagcugaaauggaggaagcccuaaaaggauuaccaauacgauaucaaacgacggcuacuaaaucagaacacacuggucgagaaauaguagaucuaaugugccaugcaaccuuuaccaugagacuacucucacccguaaggguaccuaacuauaauuugauuauaauggaugaagcccauuuuacagauccagcaagcaucgcagcacgcggguauaucaguacacguguuggcaugggagaggcugcugcaaucuuuaugacugcgacgccuccugguacggccgaggcauucccacaaaguaaugcaccgauccaagaugaagaaagagacauaccagaaagaucuuggaacucaggcaaugaauggauuacagacuucguaggaaagacaguuugguucguuccgucuauaaaggcagguaaugacaucgcgaacuguuuaaggaaaaaugguaagaaggucauacagcucucacggaagacauuugauacagaauaucagaaaacgcgauuaaacgacugggauuuuguugucacaacagauaucuccgaaaugggggcaaauuucaaagcugaucgugugaucgauccaagaagaugucuaaagccuguuauauuaacggacggacccgaaagaguuauacuagccggucccaugccuguaacagccgccagcgcggcucaaagaaggggucgaguuggacguaacccucaaaaagagaaugaccaauauauuuuuacaggucagccacucaacaacgaugaagaucaugcucacuggacagaggcaaaaaugcugcuagacaacauaaacacaccagaaggaauuauaccagcucuuuuugaaccggaaagagagaaaagcgcugccauagacggugaauaucgcuugaaaggagaauccaggaaaaccuucguagaauugaugcgaagaggggauuuaccggucuggcuagcgcacaaaguagcuagugagggaauuaaauauacugacagaaaaugguguuucgauggugaaaggaauaaccaaauucucgaagaaaacauggacgucgaaauuuggacaaaagagggagagcgcaagaaauuaaggccaagauggcuagacgcaaggacauauagcgauccucuggcauuaaaggaguucaaggacuuugcugcuggucguaagagcauagcucuggaccuagucacugaaauugguagaguaccgucucaucuagcguaucgaacacguaacgcauuggacaauuuagucauguuacacacaagugaacauggaggcagagcauauagacaugcgguggaggaacuaccugaaacuauggaaacacuacuacuacuuggucuaaugauacuccugaccgguggagcaauguuauucuuaauuaguggaaaagguaucggaaagacaagcauaggauuaaucugcguuauugcgucgucaggaaugcuauggauggcagauguuccacuacaauggauagccucggcgaucauacuggaguucuucaugaugguucuacuaauacccgaaccugaaaaacagagaacuccacaggauaaucaauuagcuuauguggugauagguauccugacgcuugcggccauaguggcugcuaaugaaaugggucuucuugaaacgacgaaaagggauuuagguaugagcaaagaaccgggugucgucuccccaacauccuaccuagacguagaccugcacccugcgagugcauggacacuuuaugccguugcaacaacuguaauaacgccuaugcuuaggcauacuauugaaaauagcacagcuaacguaucacuagccgcuaucgccaaccaagcaguaguccuaaugggcuuagauaaaggcuggcccauaucuaaaauggaccuugggguaccacuacucgcucuaggaugcuacucucaaguaaauccacuaacucuaacggcggcggucuuacuauuaguuacgcauuacgcaaucauugggcccggauuacaagcaaaagcgacacgugaggcacagaaaaggaccgcagcgggaauaaugaaaaauccaaccguagauggaaucaugacgauagacuuagaucccgugaucuaugauucgaaguucgagaaacaauuaggucagguuauguugcuugucuuaugugcuguucaacuacuccuaaugcguacaucgugggcauugugugaagcauuaacauuggcgaccggcccuauuacgacacuaugggaagguagccccgguaaguuuuggaauacgacgauugccguuaguauggcuaauauauuuagaggaucauacuuagcuggagcaggacuagcauucaguauaaugaaaucuguaggaacugguagacgcggaacggguagccagggggaaacucuaggagagaaguggaagaagaaauuaaaucaguuaucucguaaagaauuugaucuuuauaagaaaucuggaauaacggaaguugaccgcacagaggccaaagaaggacuaaaacgcggugagacaacucaucacgcuguaagucgugguucagccaaauugcagugguucguugaaagaaauauggugauucccgagggcagagugauagacuuagguuguggccgaggggguuggucguacuauugugcuggacuaaagaaaguaacagaaguucguggauacacaaaagguggaccgggacaugaggaaccuguaccuaugaguacauauggauggaaucuugucaaauugaugagcggaaaagaugucuucuaccuuccaccagaaaaaugcgacacuuuacugugcgacauuggcgaaucgagcccaucgccaacagucgaagaaagccgaacuauuagaguacuaaaaaugguagaacccuggcuuaaaaauaaucaguucugcauuaaaguccuaaauccuuauaugcccacuguaauugaacauuuagaaagacuacaacgaaaauacggcggaaugcuaguuagaaauccucugagucguaauucaacucaugaaauguauuggauuucaaacggaaccgguaauauuguaucuaguguaaauaugguuucgcgauugcuccuuaaucgauucaccaugacgcaucgucgaccaacaaucgaaaaagaugucgacuuaggagcgggaacaagacacguaaacgcggaaccagagacaccaaacauggacgucauuggagaaaggauuaaacgcauaaaagaggaacacucaucaacuuggcacuacgaugacgagaauccauauaaaacaugggcauaucacgguaguuaugaaguaaaagcuacagggagcgcuucaucaaugauaaacggaguuguaaaauuauuaacaaagccuugggacgucguaccgaugguaacccagauggcuaugacugauaccacgccuuuugggcaacaaagagucuuuaaagagaaaguugauacucguacgccuaggccuaugccgggaacgagaaaaguuauggagauuacugcagaguggcuuuggaggacuuuagguaggaacaagaaaccgagguuauguacuagagaagaauuuacgaagaaagugcgaacgaaugcugccaugggggcuguuuucacugaagagaaccaaugggauucagccagagcugccguugaagacgaagaauuuuggaaguuagucgaucgugaacgagaauuacauaagcuggguaaauguggaucauguguuuauaauaugaugggaaaaagggagaagaaauuaggggaauuugggaaagccaaagggaguagagcaauaugguauauguggcugggggcacgcuauuuggaguucgaagcacucggauuccuaaaugaagaucauugguucagucgagaaaauucguauuccgguguagaaggugaaggacuacauaaacuuggauauauauuacgagauauuucaaaaaucccaggcggggcaauguacgcagacgacacagcagguugggacacacgaauuacagaagaugaucuccacaacgaagagaaaauuacucagcaaauggauccagaacauagaaaacuagcuaacgcaauuuucaaauuaacauaccaaaauaaagucguaaaaguucaacgaccuacgcccaaggguacuguaauggauauaauaucucguaaagaucagagaggaagcgggcagguuggcacauauggacuuaauacauucacaaauauggaagcucagcuaguucggcaaauggaaggggaaggcguacuuucaaaagcugaucuagaaaauccucaucuucuggagaaaaagauuacacaauggcuagaaacaaaagggguagagaggcuaaagagaauggcgauuucuggcgacgauugugugguuaaaccaauugaugauagauucgcgaaugcguuacuagcauuaaaugacauggguaaaguaagaaaagauauuccucaauggcaaccauccaaaggguggcacgauuggcaacaaguuccguucuguagucaucauuuucaugaauuaaucaugaaagaugggcguaaguuggucguaccgugcagaccgcaggaugaacuuauuggacgagcacguaucagccagggcgcaggauggucguuaaaggaaacagcuuguuuagggaaggcuuaugcacaaauguggucccuaauguauuuucaccgccgggaucuuaggcuugccucgaacgccaucuguuccgccguaccuguacauuggaucccaacuucacgaacgacgugguccauacacgcucaucaucaauggaugacuacugaagacauguuaacaguuuggaauagggucuggauagaggauaacccauggauggaggauaaaacgccagugacgacaugggaagaugucccguacuuaggaaaaagagaagaucaauggugcggaagucugauugguuugacuagccgugcaacaugggcacaaaacauauuaacagcuauucaacaaguacguucuuuaaucggagacgaagaguuccuagacuacaugccaucaaugaagcgauucagaaaggaagaggaaucggagggggcaauaugguaa

SEQ ID NO: 23492 - RNA, 9873 nt, Artificial Sequence
  derived and/or modified CDS sequence (opt6) from DENV-3__FJ461329__SS-prME
accaguuuauguuugaugaugauguuaccugcaacccuagcauuccaucugaccucaagagacggcgaaccaagaaugauaguagguaaaaacgaaagagguaaaaguuuacuguuuaaaacagcgagcggaauaaauauguguacauuaauagcuauggaucuaggagaaaugugcgaugauaccgucacguauaaaugcccacuaauugcagaaguugaaccagaagauauagauuguuggugcaauuuaacuucaacauggguaacauacgguacauguaaccaagcgggugaacaucgacgggacaaacgaucaguugcauuagcaccucaugucgggauggguuuagacacaagaacucaaacguggaugucagcggaaggugcguggcggcaaguggagaaaguggaaacaugggcuuuacgccacccaggauucacaauacuagcauuauucuuagcucacuauauugggacuucguugacucaaaaaguuguuaucuuuauucuauugaugcuaguuacgccaaguaugacaaugcgauguguuggcguaggcaauagagauuuuguugaaggccuauccggugcaacuuggguagacgucguucuugaacauggagguugcguaacgacaauggcuaaaaauaaaccaacauuagauauagaauugcagaaaacagaagcaacucaauuggccacgcugcguaaacuuuguauagaaggaaaaaucacuaauauuacaacagacucaagauguccuacccagggagaagcaaucuuaccugaggaacaagaccaaaacuauguauguaaacauacguacguugauagaggaugggguaauggauguggccuauuuggcaaagggucccuggucacgugcgccaaauuucaauguuuagaaccaauugagggcaaaguuguacaauacgaaaauuuaaaauauacugugauaauaacaguccacaccggugaccagcaucaaguuggaaacgacacgcaaggaguaacugucgagauaacgccacaggcuucaaccguagaagcaguauugccagaguacggcacauuagguuuagagugcaguccaagaacuggucuagacuucaacgaaaugauacuuuugacaaugaaaaacaaggcuuggaugguacauagacagugguucuuugauuugccauuaccauggacgucaggagcgacaacagagacaccuacauggaacagaaaagaacuuuuaguuacguuuaaaaacgcucaugccaagaaacaggaaguaguuguuuuaggaagucaagagggugccaugcauacagcauuaacgggugcgaccgagauccaaaauaguggagggaccucaauuuuugcaggucaccugaaaugccgauuaaaaauggauaaacuagaauuaaaagggaugaguuaugcaaugugucucaauacuuuuguucugaagaaagagguuagcgagacacagcauggaacuauauuaauaaaaguugaguacaaaggagaagaugcaccuuguaaaauaccauucuccacagaggacggucaaggaaaagcgcauaauggccgcuuaauaacagcaaacccaguaguuacuaagaaagaagaacccgucaacauagaagcugaaccaccguuuggagaaaguaauaucguaauaggaaucggagacaaagcacuuaaaauuaacugguacaagaaaggcucaaguaucggaaaaauguuugaagcuaccgcucguggagcucgaagaauggcuauauugggagauacugcaugggauuuuggaaguguuggaggaguacuuaacagccuagguaaaaugguacaucaaauuuucgguucagcauacacagcgcuuuucucagguguaucauggaucaugaaaauagguaucggcguacuauuaacuuggaucggauuaaauagcaaaaacacuucaaugaguuucucgugcauaguuauagguauaauaacucucuauuugggugcggucguacaggcggacaugggaugugcaauuaacuggaaagggaaagaacuuaaauguggaucuggaauauuugugacaaaugaaguucauacauggaccgaacaauauaaauuucaagcagauucaccaaagaggcuugcaacggcaauagcgggagcaugggaaaaugguguaugcggaauaaggucaacgacccgcauggagaauuugcuuuggaaacagauagcaaacgaacucaauuauaucuuaugggagaacaauauuaaguugacagucguugucggcgauauuauuggagugcuugaacaagggaaaaggaccuuaacaccccaaccuauggaauuaaaauauucuuggaaaaccugggggaaagcuaaaauaguaacagcagaaacccaaaauucuuccuuuauuauugaugggccgaauacaccagaauguccaagugcaucucgggcauggaauguuugggaaguagaggauuauggguucggaguauuuaccacaaacauuugguuaaaacuacgagaagucuacacacaaaguugcgaucacaggcuuauguccgcagcuauaaaagaugaacgugccguacacgcggauaugggcuacuggauagaaucacagaaaaauggaaguuggaaauuagaaaaagcaucauuuauugaaguaaaaacauguacauggccaaaaagccauaccuuguggucuaauggcguauuagaaucagacaugauaauaccuaagaguuuggcugggccgauaucccaacacaaucauagaccaggauaccauacacaaacugcaggacccuggcacuugggcaaguuagaacuagauuucaacuauugugaagguacaacuguuguuaucacagaagauuguggcaccagaggaccaucauuaagaacaacgacaguaucggguaaauuaauacacgaaugguguugucggucgugcacacugccaccauugcgauacaugggagaagaugguugcugguauggaauggaaauaagaccaauaaaugaaaaagaggaaaacauggucaaaucgcuugugagugcaggcagcgguaaaguggauaauuuuacaauggguguacucuguuuggccauacuauuugaggagguaaugagagguaaauuuggaaagaaacacaugauagcugguguuuuauuuacauuuguccuuuuauuaagugggcaaauaacauggcgcgauauggcucauacucugaucaugauuggaaguaacgcauccgauagaauggggauggguguaacuuacuuagcguuaauugcgacauucaaaauucaaccuuuucuagcauuaggauuuuuccugagaaaacucacuucuagagagaacuuacucuuaggagucggauuggcuauggccaccacuuuacagcuccccgaagacauagaacagauggcuaauggaauagcauugggguuaaugacacugaaacugauaacacaauucgaaacauaucaacuauggacagcccuaguaucuuugaccuguucuaauaccauauucacacugaccguagcauggagaacagcgacucuaauauuggcugggguaagccuacugccuuugugccaaaguucaucaaugcguaaaaccgacuggcuaccuaugacggucgcagcgaugggcguaccgcccuuaccgcuuuucauuuucaguuuaaaagauacuccgaaacgaagaucuuggccuuuaaacgagggaguuauggcugucggcuuaguuucaauauuagcaucaucucugcuacgcaacgacguaccaauggcaggaccucuaguugcuggcggcuugcuaaucgccuguuacguaaucacggguaccagcgcagacuugacuguugaaaaggccgcagaugucacuugggaagaagaagcugaacaaacuggaguaucccacaaccugaugauuacuguugaugaugauggcacuaugcgaauuaaagaugaugagacagaaaacauccugacagucuuacugaaaacagcacuuuugauugucucagguaucuuuccauacagcaucccagcuacacuccuagucuggcacacauggcagaaacagacgcaacguucuggcguccuuugggaugucccaaguccaccagagacacaaaaagccgaacuggaagaagggguguacaggauuaaacaacaaggaauauuugguaagacacaggucgggguaggcguccaaaaagaaggcguauuucacacaauguggcauguaacacguggcgcaguguuaacucauaacggcaaacgauuagaaccgaacugggcuucagucaagaaagacuuaaucuccuauggcggaggauggcgccucagugcucaauggcaaaaaggggaggaaguacagguaauagccguagaaccugggaaaaaucccaagaauuuccagacuaugccggguauauuccaaacuaccacgggcgagauaggagcuauugcuuuagauuuuaaaccaggaacgagugguucgccgauuauaaaucgagagggaaaaguagugggcuuauacggcaauggcguugugaccaaaaauggaggcuaugugucaggaauugcgcaaacuaacgcggaaccagauggaccaacaccggaacuagaagaagaaauguuuaagaaaagaaauuugaccauaauggaucuccacccuggaucaggaaaaacaaggaaguaccuuccagcgauagugagggaagcaaucaaaagaagguuacgaacacuaauccuagcacccacacgagugguugcugcagaaauggaagaagcauuaaaaggccuaccuauuagguaccagacaacagccacaaaaagugaacacacgggacgagaaaucguugauuugaugugucaugcgacauucacaaugcgccuuuuaagcccagugaggguaccaaauuauaaucucaucauuauggacgaagcucauuucaccgauccugcauccauagcggcgaggggauauauuaguacacgaguaggcaugggggaggcugcugcuauuuuuaugacugcaacaccaccggggacugcugaagcauucccgcaaucaaacgcuccuauucaggaugaagaaagagauauuccugaaaggagcuggaacuccgguaacgaguggauaaccgauuuuguaggaaaaacagucugguuugucccaucaauuaaagccgguaacgauauugcaaacugccuuaggaaaaauggcaaaaagguaauacaacuaucaaggaagacauuugauacagaauaccagaaaaccagguugaacgauugggauuuuguuguaacgaccgauauaucagagaugggcgcaaauuuuaaagcugauaggguuaucgauccucgucgaugccucaaaccggugauucuaacagacgguccagaacgcguuauucuagcugguccuaugcccguuacggcagccagugcggcucaacguagaggaagaguuggaagaaauccccaaaaagaaaacgaccaauacauuuucacuggucaaccacucaauaaugaugaagaucaugcucauuggacggaagcuaagauguuauuagauaacauaaacaccccagagggcauaauucccgccuuguuugagccagagagagaaaaguccgcagcaaucgauggagaauauaggcuaaaaggggaaucacgaaaaacguuugucgaauugaugcgaagaggagaccucccaguauggcucgcccauaagguggcuucugaggggauaaaauauacagacagaaaaugguguuuugauggcgaaagaaacaaccaaauuuuagaagaaaacauggauguagagauauggacaaaagagggggaaaggaagaaauuacguccacgauggcuagacgcaagaacauauucagauccacuagcgcuuaaggaauuuaaagacuuugcagcgggucgaaagucgauagcccuugaccucgugacggagauaggccguguccccucacauuuagcauacaggacacgaaaugcauuagauaacuuaguaaugcuccauacgagugaacauggaggacgcgcauacaggcaugcaguugaagaauuacccgaaacaauggaaacguugcuuuuauuaggcuuaaugauauuacuuacuggaggagcgauguuauuuuuaauuucagggaaagguauaggaaaaacgucgaucggacugauauguguaauagucucaucgggaaugcuauggauggcggauauaccgcugcaauggaucgcaagugcgauaguccuugaguucuuuaugaugguacuauuaauaccugaacccgaaaaacaaagaacaccacaggacaaucaauuagccuauguagugaucggcauauugacuuuagcagcgauugucgcagcuaaugagaugggacuauuagaaacaacaaaaagagaucucggcaugucgaaagaaccagguguagugucuccaaccucguauuuggauguugacuuacacccagcauccgcauggaccuuauaugcuguagcaacgacaguaauaacaccaaugcuaagacacacuauagaaaauaguaccgcaaaugucucccucgcagcuauugcgaaccaagcuguaguauuaauggggcuugauaaaggauggccaauaucaaagauggacuuagguguuccccuuuuggcgcuaggcuguuauucccaagucaauccgcuaaccuugacagccgcaguuuuacuacucgugacgcauuaugcaauaaucgggcccggacuucaagcuaaagcuacgcgugaagcacagaaaagaacggcugcugggauaaugaaaaauccaacaguugaugguauaaugacaauugaucuagaccccguaauauaugauucuaaguuugaaaaacaacugggucaagugauguuauuagucuuaugugcaguucaauugcugcuuaugcguacaucuugggcccuaugcgaggcucuuacccucgcaaccggacccauaacuacacuuugggaaggcucacccgguaaguuuuggaauacaacgauugcugucagcauggcaaacaucuuuaggggaucguaccucgcgggugcuggauuggcauuuucgauuaugaaauccguuggcacugguagaagagguacaggaucgcagggcgagaccuugggcgagaaauggaaaaagaaacuaaaccaauuaucgagaaaagaauuugaccuauacaagaaaucaggaauuacagaaguagacagaaccgaagccaaagagggacugaaacggggagagacuacccaucacgcuguuucaagggguuccgcuaaacugcagugguuuguagaaagaaacaugguaauucccgaagggagagugauagaccugggcugcggacgcggcggauggagcuauuacugcgcgggccugaagaaggucacugaagugaggggauacacgaaagggggcccgggccacgaagaaccuguuccaaugagcaccuaugguuggaaccuaguuaaauugaugaguggaaaagauguauuuuacuuaccaccagagaaaugcgauacucuacuaugcgauauaggagaaucaucaccuagcccgaccguagaagaaucaaggacgauccgagugcuaaaaaugguggaaccguggcugaaaaauaaccaauucuguauaaaaguucuaaauccguacaugccgacgguuaucgaacaucuagaaagguugcaaaggaaauaugguggcaugcuugucagaaauccgcuaaguagaaauucuacucaugaaauguauuggaucuccaacgguacugguaauaucgugagcagugucaacauggucucgcgacuacuauuaaacagauucaccaugacucauaggcgccccaccauagaaaaagacguagacuuaggggcugggacuaggcauguuaaugcugaaccagaaacaccaaacauggauguuauaggagaacggauaaaacggauaaaagaagaacauucaucuacauggcacuacgaugaugaaaauccauacaagacaugggcauaucauggcagcuacgaggucaaagcgaccgguucagcaucgagcaugauaaacgggguagugaaauuacucacgaagccgugggaugucguucccauggucacacaaauggccaugaccgauaccacaccguuuggacaacaacgugucuucaaagagaaagucgacacgaggacaccgagaccaaugccagggacucguaagguaauggaaaucacugcagaauggcuauggagaacacuaggcagaaauaagaaaccacguuugugcacucgggaagaguucaccaagaaagucagaacgaaugcugcgaugggagcaguauucacggaagagaaucaaugggauucagcaagagcugcaguggaagacgaggaauuuuggaaauuagucgaccgggagcgcgaauugcauaaauuaggcaaaugcgguaguugugucuauaauaugaugggaaaacgagagaagaaacuuggggaauuuggaaaagcaaaagggucacgggcuaucugguacauguggcuaggagcgcgauauuuggaauuugaggcuuuaggauucuugaaugaagaucacugguucuccagagaaaauaguuauucgggugucgaaggcgagggauugcauaaauugggauauauacuuagagacauuucaaaaauuccaggcggagccauguaugcagaugauacagcaggaugggauacacggauuacagaagaugacuuacacaaugaagagaaaauaacacagcaaauggauccggaacauagacagcuugcaaaugcaauauucaaauugacuuaucaaaacaagguuguuaaaguacaaaggcccacaccaaaagguacaguuauggacauaaucucacgaaaagaccaaagaggaaguggacaaguaggaacauauggauugaacacauuuacuaauauggaagcucaguuagucaggcaaauggaaggagaaggagugcuuucuaaagcugaccuagaaaauccacaucucuuggagaagaaaaucacacaauggcuagaaacaaaagggguugaacgguuaaaacggauggcaaucucaggcgaugauuguguggucaaacccauagaugaucgauuugcuaaugcguuacuggcgcuaaacgauaugggaaaagugcgcaaagacauaccacaguggcaaccuucaaaaggcuggcaugauuggcaacaagucccuuuuuguucccaucauuuucaugagcuaauuaugaaagaugggagaaagcuaguaguaccauguagaccccaagacgaacugauugggagggcaagaaucucacagggagcugguuggaguuuaaaggaaacagccugccuugguaaggcauaugcucaaauguggucguugauguauuuucacaggagagaucuucgacuugcauccaacgcuauaugcuccgcugugccuguccauuggauccccacgucacggacaaccuggagcauacaugcgcaccaccaauggaugacaacagaggauaugcugaccguauggaaccguguuuggauagaagauaacccguggauggaagauaagaccccagucacaacuugggaagauguaccguauuuggggaaaagggaggaccaauggugcggauccuuaaucggucuaacaucuagggcaacuugggcucaaaauauccuaacugcuauucaacaaguuagaagccucauaggaaacgaagaauuucuggauuacaugccuaguaugaaacgauuuaggaaggaagaagaaucugagggagcaaucugguga

SEQ ID NO: 23493 - RNA, 9873 nt, Artificial Sequence
  derived and/or modified CDS sequence (opt6) from DENV-3__KF955459__SS-prME
acuagcuuauguuuaaugaugaugcuuccagcuacucuagcauuucacuugaccucaagagauggagaaccuagaaugauuguugggaaaaaugaacgaggaaaaucacuauuauucaaaaccgccagcggaauuaauauguguaccuugauagcaauggaucuuggagaaaugugugaugauaccgucacguauaaauguccccucaucgcugaaguagaaccagaagacaucgacuguugguguaaucuaaccucaaccugggucacauacggaacauguaaucaagccggagaacauagaagagauaaacgaaguguagcccucgcaccucauguagguauggguuuggauacacgaacgcaaacauggaugagugcagaaggggcguggaggcaagucgaaaaaguugaaaccugggccuuaagacaucccggguucacgauauuagcuuuauucuuagcucacuauauagggacuucacuaacacaaaaaguaguuauuuuuauacuauuaaugcuaguaacccccucuaugacaaugagguguguagguguugguaaucgggacuuugucgaaggacugucaggagcaacauggguugaugucguucucgaacaugggggaugcguuacgacaauggcuaaaaauaaacccacgcuagacauugaacuccagaaaacagaagcuacacaacuagcuacccuaaggaaauuauguauagaaggaaaaauaacaaauauaacgacggauucgcgauguccgacacaaggagaagcaauauugcccgaagaacaggaccaaaauuauguuuguaaacauacauauguugaccgcggcuggggcaaugguuguggacuguuuggaaaagguucucucguaaccugcgcaaaauuucagugcuuagaaccuauagaaggaaaaguaguacaauaugaaaaucugaaauacacgguaauaauuacaguucauaccggggaccaacaucagguuggaaaugacacacaaggaguaacgguagaaaucaccccucaagcgucaacugucgaagccguucuuccggaauaugguacgcuuggucuggaaugcucacccagaacaggacuggauuucaacgaaaugauauuauuaaccaugaaaaacaaagcauggauggugcauaggcaaugguucuucgaccucccacuuccguggacaucuggagcaaccacugaaacgcccaccuggaauagaaaagaacucuuaguaacguucaaaaaugcacaugcaaagaaacaagaagucgugguauuagguagucaagaaggggcaaugcauacagcgcucacaggugcaacggaaauacagaauagcggagguaccagcaucuuugcuggacacuuaaaaugcagauuaaaaauggacaaauuagagcuuaaagggaugagcuaugcaaugugcuuaaauacauuuguccuaaagaaagaaguaucugaaacacagcacggaacuaucuuaauaaaagucgaguauaaaggagaagaugcuccaugcaaaauaccuuuuagcacugaggauggacaggguaaagcacauaauggacguuugauaacggcgaauccaguugucaccaagaaagaagaacccgugaacaucgaagcugagccacccuuuggugaaaguaauauaguaauaggaauaggcgacaaagcccuuaaaauaaacugguacaagaaaggcucuaguauuggcaaaauguucgaagccaccgcuagaggugcuagacgaauggcaauuuuaggagacacugcaugggauuucggaucggucggugggguuuuaaacuccuuaggcaaaaugguccaucaaauauucgggagugcauauaccgcacuguucucggguguauccuggauaaugaaaauaggcaucgguguucuccuuacauggaucggguugaacuccaaaaacacuagcaugaguuuuucuugcauaguaauaggcauuauuacccuauaucucggcgcuguaguccaagcagauaugggaugugccauuaacuggaaagggaaagaauuaaaauguggaaguggcauauucguaacaaaugaaguccauacuuggacggagcaauacaaauuccaggcugacagcccaaaaagauuagccacagcgauagcuggagcgugggaaaauggagucugugggauuaggucugcgacacgaauggaaaauuuauuauggaaacaaaucgccaacgaauuaaacuauauauugugggagaauaauaucaaauuaaccgugguugugggugacauuauuggaguguuagaacaggggaaacgaacgcuuacaccccaacccauggaacuaaaauauuccuggaaaacaugggguaaagcuaaaaucgucacagccgaaacccaaaacucgagcuuuauaauagacgggccaaauaccccugaguguccgagugcuagucgcgcuuggaauguuugggaaguugaggacuacggcuuuggaguguucacaacaaacauaugguuaaaacuaagagaaguuuacacacaaucaugcgaccauagauuaaugucggcagcgauaaaagaugaaagagcaguccacgccgauaugggauauuggaucgaaagucagaaaaacgguucuuggaaacucgagaaagcauccuuuauagaaguaaaaacuugcacauggccaaaaucgcacaccuuguggagcaauggcgucuuagaaagugacaugauaaucccaaagagcuuggccggaccuauaucacaacacaaccaccgcccagguuaccacacacaaacggcaggcccuuggcaccuaggaaaacucgaacuagacuucaacuacugugaagggacgacagugguaauaacggaaaauuguggaacacgcggcccgucauuaagaacaacgacugugagcgggaaacuuauacaugaauggugcugccgaaguuguacucuaccgccacuucgauauaugggagaagacgguuguugguacgguauggaaaucaggcccauaaaugaaaaagaagagaacaugguuaaaucauuaguaucggcgggaucgggaaaagucgauaauuuuacaaugggugucuuauguuuggcaauccuauucgaggaaguuaugagaggaaaauuugguaagaaacacaugaucgcaggcguacuauucacuuuuguauuacuccugagcggacagauaacuuggcgagacauggcacauacucuaauuaugauaggcaguaaugccagugacaggauggggaugggaguaaccuauuuagcucuuaucgcuacuuucaaaauucagcccuuucuggcuuuaggguucuuccuaagaaaacuuacaucaagagaaaaucugcuacuaggcgugggcuuagcaauggcaacaaccuugcaauuaccugaggacauagagcagauggcaaaugguauugcauuaggccucaugacauuaaagcuaaucacacaauuugaaacauaucaauuguggaccgcacuuguaagucuuacuuguaguaacacaaucuuuaccuuaacaguagcuuggaggacagcuacccuaaucuuagcagggguuucauuacuuccacuuugccagaguaguagcaugaggaaaacggacugguuaccgaugacggucgcggcgaugggaguuccaccucuuccgcucuuuauuuucagucuaaaggacacaccaaaacggagaucauggccacuuaacgaaggcguaauggcuguaggccuaguuucuauauuagcgaguucacuacucagaaaugacguuccuauggcagggccuuuaguagcaggcggcuuauuaauugcuuguuaugugaucacaggaacuucagcugauuuaacagucgaaaaggcagcugacgucacaugggaagaagaagcagaacagacuggggugucgcacaaccuaaugaucacuguggaugaugauggaacuaugcgcauuaaggacgacgaaacagaaaacauauuaacaguauuacuaaaaacagcuuuacugauagugagugggauuuuuccguacucaaucccugcgacucuucugguauggcacacauggcaaaaacagacgcagagaagcggaguacuaugggacguacccucgccaccagagacucaaaaagcagaguuggaggagggaguauauagaauuaaacagcaagguauauucgguaaaacacaagucggugucgggguucaaaaagaaggcguuuuucacacaauguggcauguaacccguggggcuguacuuacucacaaugggaaaagacuugagccgaauugggcaucuguuaagaaagaucuaauuuccuauggaggaggcuggcgacuaucggcucaauggcaaaaaggugaggaagugcaaguaauugcggucgaaccgggcaagaacccuaaaaacuuucaaacuaugccuggaauauuccaaaccacuacaggcgaaauaggagcaauugcccuggacuuuaaaccagguacuucagguucaccaauaauaaacagggagggaaaaguagucgguuuguauggaaaugguguuguaacgaagaauggagguuauguaucggggauagcacaaacaaacgcagagccagaugggccgacaccggagcuagaggaagaaauguuuaagaaaagaaaccuuaccauaauggaucuacacccugguuccggaaagacgaggaaauaucuaccugcuaucguacgagaagcaaucaagagacguuuacguacuuuaauacuggcuccuaccagaguaguagccgcagagauggaagaagcucuaaaaggauugccuauccgauaucaaacaacugcaacgaagagugaacacacagguagagagauuguagacuuaaugugccaugccaccuucacgaugcgacuacucaguccuguaaggguuccgaacuauaauuuaauuauuauggacgaagcacauuucacggauccagcgagcauagcugcacgagguuauaucaguacgagggugggaaugggugaggcugccgcaauauuuaugacagcuacaccgccuggaacggcggaagcauucccucaaaguaaugcgccaauacaagacgaagaaagagacaucccagagcgaaguuggaacucagguaaugaguggauuacugauuucguagggaaaacagucugguuugucccgucaauaaaggcuggaaaugauaucgcaaauugcuugcgcaagaaugguaagaaagucauacaacuaucucgaaaaaccuuugauacggaauaccaaaagaccagguugaaugauugggacuuuguagucaccaccgauauaucagaaaugggugccaacuucaaggcugauagaguaauugauccaagaaggugucuuaagccagucauauuaacagaugguccugaaagggucauccuagcagguccgaugccaguaacggccgcaucugcugcgcaaagaagagguaggguugggagaaauccacaaaaagaaaacgaucaauauauauuuacaggccaaccucuaaauaaugaugaagaccacgcucacuggacagaagcaaaaauguuacuggauaacauuaauacucccgaggguauaaucccugcacuguucgagccagagcgugagaaaagugccgcgauugauggugaauauagacuuaagggcgaaaguagaaagacguucguugaacucaugagaagaggagacuuacccguauggcuugcacauaagguagcgagugagggcaucaaauauacagaccgcaaguggugcuuugacggagaaagaaauaaccaaauuuuggaagaaaauauggauguugaaauuuggacaaaggagggugagaggaagaaauugaggccccgauggcuugacgccagaacauauuccgauccguuagcucuaaaagaguucaaggacuucgcugcuggucggaagucaauugcguuggaucuaguaacagaaaucgggagggugccaucccauuuagcuuauagaacgaggaaugcacucgacaaucuaguuauguugcauacuuccgaacauggaggacgugcauacagacaugcugucgaagaacuaccggaaaccauggaaacauuacuauuacuaggucugaugaucuuacucacagguggggcaauguuguucuuaaucucagguaaaggcauuggaaaaacgucuauuggauuaaucugcguuaucguguccaguggaauguuauggauggcugacgucccguuacaguggaucgcaagugcgauuauccuagaguucuuuaugaugguauuacuaauccccgaaccugaaaaacaaagaacaccgcaagauaaucaguuggcauacguuguaaucggcauccuaacacuagcugcuauuguagcagcgaacgaaaugggacuacuugaaacuacaaaaagagaucuagggaugucaaaagaaccgggcguaguaucacccacuagcuauuuagauguugacuuacauccagcaucagcauggacacucuaugcaguggcgacaacugucauaaccccuaugcugaggcacacuauagaaaacaguacugcuaacguaucauuagccgcuauagcaaaccaagcagugguccuuaugggacuugacaaggguuggccaaucagcaaaauggauuuaggugugccuuugcucgcacugggaugcuacagccaagugaaucccuuaacacucacggcagccguauuauuacuggucacacacuacgcuauaauaggaccaggccuacaggcuaaagcgacuagagaggcacagaaaagaaccgcagcaggcauaaugaagaacccgacuguagacgguaucaugacuauugaccuggaucccguuauauacgauucaaaguuugaaaagcaguuaggacaaguaaugcuauugguacucugugcaguacaacuacuacuaaugagaacauccugggccuugugcgaagcguuaacuuuggcaacaggcccgauaaccacucuaugggaagguucaccagguaaauucuggaauacaaccauugcugucuccauggcgaauaucuucagaggaagcuacuuagccggagcaggacuugcguuuaguauaaugaaauccguugguaccggaaggcgugguacgggcagucaaggugaaacauuaggagaaaaauggaagaaaaagcucaaccaacuaagcagaaaggaguuugaucuuuauaagaaaaguggaauuacagaggucgauaggacagaagcgaaagaaggccuaaagagaggugaaacaacgcaucacgcugugucaaggggaucagccaaacuucaaugguuuguagagcgaaauauggucauaccagaaggccgggugauagaucuagggugcggacgaggugguuggaguuauuacugcgccggacuuaagaaaguaacugagguaaggggauacacaaaaggaggcccuggccaugaagaaccaguacccauguccacauauggguggaauuuaguuaaauuaaugagcggaaaagauguauuuuauuuaccgccagaaaaaugugauacacuucuaugugauauaggagaaucuaguccuucaccgacaguagaagaaaguagaacuauuaggguauuaaaaaugguagaaccauggcuuaaaaauaaccaguuuuguauaaaaguauuaaauccuuauaugccuaccguaaucgaacaccucgaaagauuacagcguaaauacggugguauguuagucagaaaucccuuaucuagaaauaguacacacgaaauguauuggauaucuaacggaacugguaauaucguaagcucuguuaacaugguuucuagauuauuacugaaucguuucacuaugacacaucgccguccgacaauagagaaagauguugauuuaggggcgggcacuagacaugucaaugcagaaccugaaaccccgaacauggauguuauaggugaaagaauuaaacgaauaaaggaagaacauaguaguacauggcauuaugacgaugaaaauccauauaaaacaugggcauaccaugguucguaugaagugaaagcgacaggaucggcaucaucaaugauuaacggcguuguuaaacuccuuacaaaacccugggauguaguacccauggugacacaaauggcuaugacugauacuacccccuuuggacaacaacgaguuuuuaaggaaaaaguugauacacgaacaccuagacccaugccagggacacgcaaagucauggagauaacagcggaaugguuauggaggacuuugggaagaaauaagaaaccccggcucuguacaagggaggaguuuaccaagaaggugcgaacaaacgcugcaaugggagcuguauuuacggaagagaaucaaugggacagugccagggcagcuguugaggaugaagaguucuggaaauuaguagauagagagagggaacuucauaaacuaggaaaaugcggaucuugugucuauaacaugaugggcaaaagagagaagaaacuaggugaguuuggaaaggcaaagggaagucgagcuauaugguauauguggcuuggagcaagauaucucgaguucgaagcacuuggcuuuuugaacgaagaccauugguuuucuagagaaaauucauacaguggugucgaaggcgaaggguuacacaaacuugguuacauucuaagagauaucucgaaaaucccugguggagcuauguaugcagaugauacggcaggaugggauacuagaauaacugaggaugaucuacauaaugaggaaaagauuacacaacaaauggacccagagcauaggcaacucgcuaaugcaaucuuuaagcuaaccuaccaaaacaaaguaguaaagguacaacguccaacaccaaaaggaacagugauggacaucaucucucgaaaagaccaaagagguagcggacaaguagggacauacggauugaacacauucacuaauauggaagcgcaacucguaagacagauggaaggugaaggugugcuaaguaaagccgacuuagagaauccacaccuucuagagaagaaaauuacacaaugguuagagacaaaaggaguagaaagacuaaaacgaauggcaauaaguggagaugauugcgucgugaaaccuauagaugaucguuucgcuaaugcacuucuugcucuuaacgauaugggaaaaguuaggaaagacaucccacaauggcaaccaucaaaaggcuggcacgauuggcaacaaguucccuucugcagucaucauuuccaugaacuuauaaugaaagacggaagaaaauuaguuguacccuguagaccucaagacgaauuaauaggucgggcaagaauuagucagggugcuggauggucauuaaaagagacagcaugccuggggaaagcguaugcccagauguggucccugauguauuuucaccggagggaucuuagacuagcgucaaacgcuauauguucagcgguucccguucacuggauaccaacaaguagaacaacuuggucaauacacgcacaucaccaauggaugacuacagaggauauguugacuguauggaacagaguuuggaucgaagacaacccguggauggaagauaagacuccaguaaccacgugggaggaugugccuuaucuaggcaaaagagaagaucaaugguguggauccuugaucggguugacgagcagggcuacaugggcacagaacauacugacugccauacaacaaguuagaaguuugauuggagaugaagaauuucuugauuacaugccauccaugaaacguuuccgcaaggaagaggaaucagagggagcaaucugguaa

SEQ ID NO: 23494 - RNA, 9873 nt, Artificial Sequence
  derived and/or modified CDS sequence (opt6) from DENV-3__FJ547066__SS-prME
acaagccucugccuuaugaugauguuaccugcgaccuuagcauuccacuuaacuagcagagacggcgaaccgagaaugauaguuggcaaaaaugaaagaggcaaaucgcuuuuauucaaaacagcaucagggauuaauauguguacacuuauugcaauggacuuaggagaaaugugcgaugacaccguuacauacaaauguccgcuuauagcagaaauggaaccagaagauaucgacugcugguguaaucuaacgucuacaugggucacauauggaacguguaaccaagccggugaacaccgccgagacaaacgcucugucgcauuggcuccacauguugggaugggacucgacacaagaacacaaaccuggaugagcgcagaaggggccuggagacaaguugaaaaaguagaaacaugggcacuaaggcauccaggcuuuacaauacuagcauuguucuuggcacacuauaucggaacuucuuuaacccaaaaaguuguaauauucauauuacuaaugcugguuacaccaaguaugaccaugaggugugucggaguuggcaacagggacuuuguagaagguuugucaggagcaacauggguagacguuguccuagaacauggugguuguguaacuacaauggcgaaaaacaaaccaacucuagauauagaauugcaaaagacggaggcuacgcaauuagcuacacuccgcaaacuauguauagaagguaaaauaacaaauauuacuacagacagcagaugccccacucaaggagaggcaauucugcccgaagaacaagaucaaaauuauguuugcaaacauacauacguugaucgagguugggggaacggcuguggcuuguucgggaaaggcaguuugguaacgugugccaaauuucaaugucuggaaccaaucgagggaaaaguuguucaauaugaaaacuuaaaauacaccguaauaaucacuguccauacuggggaccaacaucaaguagguaaugauacccaaggcguaacugucgaaauaacaccacaggcuuccacgguugaggcaguacugccagaguacggcacacuaggucuugagugcaguccaaggacgggacuagauuuuaaugaaaugauuuuauuaaccaugaaaaacaaggcuuggaugguacacagacaaugguucuucgaucugccuuuaccauggacaaguggagcgaccacagaaaccccuacauggaauagaaaagaguugcuaguuacuuuuaaaaacgcacacgccaagaaacaagaagucguaguuuuagggucacaagaaggagcaaugcauacagccuuaacgggagcaacagaaauccaaaacucuggcggcacgagcauauucgcuggccaucuuaagugucgacugaagauggacaaauuagaauuaaagggcaugucuuaugccaugugucuaaacacuuuuguauuaaagaaagaagucagugaaacucaacauggaacgauacugauuaaaguagaauacaagggugaagacgcaccaugcaaaaucccauucucgaccgaagauggacaagguaaagcacauaaugguagauuaauuacugcgaacccaguuguaaccaagaaagaggaaccaguuaacauagaggcagaaccaccuuucggggagaguaauauuguaauagguauaggggacaaagcccuaaaaauuaauugguacaagaaagguaguucaauaggaaaaauguuugaggccacagcuaggggcgcaagaaggauggcaauacugggugauacagccugggauuuuggaagcguaggaggggugcuaaacucucuuggaaaaaugguccaccagauauuugguucagccuauaccgcacuguuuagcggaguauccuggauuaugaaaaucggcauuggaguucuuuugacauggaucggucuaaauagcaaaaacacaaguaugucguuuaguuguauaguuauaggaauaauaacucuuuaccucggugccguuguacaagccgauaugggaugugcgaucaauuggaaagggaaagaacuaaaaugcggcucagggauuuucgucacaaaugaaguccauaccuggacugaacaauacaaauuccaagcugacuccccuaaaagacuagcgacagccauagcaggggcaugggaaaauggaguuugugguauaagaaguacaacaaggauggagaauuugcucuggaaacaaauugcuaaugagcugaauuauauacuuugggaaaauaauauuaaacuaacggucguaguaggagacauaaucggaguauuagagcaggguaaacgaacucugacuccccaaccaauggaguugaaauauucauggaaaacuugggguaaagcgaaaaucgucaccgcggagacacagaacucuucuuuuauuaucgacggaccuaauacuccagaaugcccgagcgccucucgugcauggaaugugugggaaguugaagacuauggcuucgguguuuucacaacaaauauauggcuuaaacuaagagagguguacacgcaaagcugugaucaccgucucaugucugcagcuauaaaagaugaaagggcaguucaugcagacauggguuacuggauugaaucacagaaaaaugggaguuggaagcucgaaaaagcaucauuuauagaagucaaaacuugcacauggccuaaaagucacacucuauggucaaauggaguacuugagucugauaugauaaucccaaaaagucuagcaggaccaauuagccaacauaaccauaggccaggguaucacacccaaacugcuggaccauggcauuuggguaaacuugaacucgacuucaacuauugcgaaggaacaacuguaguaaucacagaaaacugcgguacacgaggaccaagccugagaacaacaacaguuucgggaaaauuaauucaugaaugguguugccgcaguugcacucuaccgccguuaagguauaugggagaagacggaugcugguauggaauggaaauaaggccgaucaacgaaaaagaagagaauaugguuaaaucuuuaguaucagcugguucgggcaaagucgacaacuucacuaugggggucuugugccuagccauccucuuugaagaaguaaugcggggaaaauucgguaagaaacauaugauagcuggcguccucuucacuuucguucuucuccuuagugggcaaauuacauggcgugauauggcacauacucucauuaugauaggaagcaacgcaucugaucggauggguaugggcguuacauaucuagcguugauugcgacuuuuaaaauucagcccuuuuuagcccugggauucuuuuuaagaaagcuaacuagccgagaaaacuuauuacuaggggucgggcuagcaauggcuacaacguugcagcuacccgaagauauagaacagauggcaaacggaaucgccuugggauuaaugaccuuaaaauuaauaacacaauucgaaacauaucaauuauggaccgcuuuagugagcuugacauguucaaauacaauauucacacuaaccguggcauggaggacagcaacauuaauauuagcuggagucucacuguuaccauuaugccaaucaucguccaugagaaaaacugauuggcuacccaugaccguagccgcaauggguguaccuccucuuccacucuuuaucuucagcuuaaaagacacuccuaaaagaagaaguuggccccuaaacgaaggcgugauggcgguaggucuuguuaguaucuuagcaaguagucuauuacgaaaugauguccccauggcaggaccucucgucgccgggggcuuauuaaucgccuguuauguaauuacggguacaucagcagaucucacugucgaaaaggcggcggauguuacaugggaagaagaagcugaacaaacuggagucucucacaacuuaaugaucacaguugaugacgaugguacgaugagaauuaaagacgaugagacugagaauauacuuacgguucuuuuaaaaacagcacuacuaauagucaguggaauauuucccuauaguauuccagcgaccuugcuaguuuggcauacauggcaaaaacagacgcaaagaaguggaguguugugggaugugcccucgccaccugaaacgcaaaaagcagaacuagaggaggguguuuaucggauuaaacagcaaggaaucuuugguaagacacaagugggaguuggaguucaaaaagaagguguauuucauaccauguggcaugugacuagaggagcuguucuaacccauaacggaaagagguuagaaccaaauugggccucaguaaagaaggacuugauaucauacggaggaggauggagauuguccgcucaauggcaaaaaggcgaagaaguucaaguuauagcaguagaaccagguaaaaaccccaaaaacuuccaaacaaugccaggaauauuucaaacaacgacaggugagauaggugcaauugcacuugauuuuaagcccgggacgucugguagcccuauuauaaaucgcgaagguaaaguuguugguuuguaugguaacgggguaguaacuaaaaauggaggguacguauccggaauugcacaaacaaacgcagaaccagauggucccacucccgaacuagaggaggaaauguuuaagaagcggaacuuaacaauaauggacuugcauccaggauccggaaaaacccgaaaguauuuaccggcgauuguuagagaagcaauuaaacgacguuugagaacacuaauccuagccccuacacgaguaguagcagcagaaauggaagaagcccuaaaaggauugcccauucgauaccagacuaccgcuacuaaaagcgaacacacgggccgcgaaaucgucgauuuaaugugccacgccacauuuacaaugcgccucuuaagucccguccgaguuccaaauuauaacuugaucauaauggaugaagcgcauuuuaccgacccugcgagcauugcugcaagaggcuacauuucaacgcguguaggcaugggagaggcggccgcuauauuuaugaccgcaacaccaccuggaaccgcugaggcuuuuccacaaucaaacgcacccauacaggaugaagaaagagauauuccagaacguucauggaacagcgggaaugaauggauaacugauuuugucggcaaaacaguaugguucgugccaucaauuaaagcuggaaaugauauugccaauuguuugaggaaaaacggaaagaaagugauucaauuaagucguaaaacauucgauacugaauaccagaaaacuagguugaaugacugggacuuugucgucacaacggauauuucagaaaugggagcuaacuuuaaagcagauagagugauagauccgcgaagaugucuaaaaccaguaauuuuaacagacggcccagagcgggucaucuuagcaggaccuaugcccgucacagccgcaucugccgcgcagagaagaggucgaguaggaaggaacccgcagaaagaaaacgaucaauacauauucacaggucagcccuuaaauaaugaugaggaccaugcucauuggacagaagcaaaaaugcuauuagauaacauaaauacaccagaagggauaauuccagcauuguuugaaccagaacgugaaaaaucggcugcaaucgacggagaauaucgacuaaaaggugaaagcaggaaaacguucguagaacuaaugagacgcggagaccuucccgugugguuggcucauaaaguagccucugaaggaauaaaauauaccgaucguaaauggugcuucgauggggaaagaaauaaccaaauauuggaggaaaauauggacguggaaauuuggacaaaagaaggagaacguaagaaacuacgaccaagauggcuagaugcgagaacuuauagugacccccuagcacuaaaagaguuuaaggauuuugcagcaggucguaaaucaaucgcguuggaccuaguaacagaaauuggacgcguuccuagucaucuagcauacagaacaagaaaugcacuugauaacuuaguuaugcuacauacgucagaacauggagggagagcauacagacaugcagucgaggaauuaccagaaacgauggagacuuuguuauugcuuggauuaaugaucuuacuuacagguggagccaugcuguuuuuaauaucugguaaaggaauuggaaaaaccagcauaggauuaauaugugucauaguaucuagcgguauguuauggauggcugauguaccguugcaauggauugcaucugcaauuauacuugaauuuuucaugaugguucuguuaauuccugaaccagagaaacaacguacgccucaggauaaccaguuagccuauguaguaauuggcauauugacacuagcggcuauuguugcugccaaugaaaugggucuuuuagaaacaacuaaaagggaccuagggaugaguaaagagccugggguaguaucgccaacaucguaccuggauguugacuuacacccagccucugcauggacauuguacgcaguggcaacaacaguaauaacuccuauguugagacauacuauagaaaacuccacagcgaacgucagucuugcagccaucgcuaaccaggcaguaguucuuaugggucuggacaaggguuggcccauuucuaagauggaucuuggcguaccacuucuugcuuugggauguuauagccaaguaaauccauugacauugaccgcggcgguccuacuacucgugacacacuaugcaauaaucggaccgggauuacaagcaaaagccacuagagaagcccaaaagagaaccgcugcggguauaaugaagaacccgaccguagacggaauuaugaccauugaccuugauccaguuauuuacgacaguaaauuugagaaacaacuuggucagguuaugcuacucguauuaugcgcagugcaacuucuacugaugaggacaucuugggcguuaugcgaagcauuaacccuggcuacaggacccauuacuacacucugggaggggucuccuggaaaauucuggaauacaacgauugccguaucaauggcaaauaucuuccgcgguucauaccuggcaggggcgggacuagcauuuagcauuaugaaaagcguuggaacaggucggcggggcaccgguagucagggggaaacauuaggcgaaaaauggaagaagaaauugaaucaacuuaguagaaaagaguucgaucuauacaagaaaucugggauuacggaaguggaucgaaccgaggcaaaagaaggcuugaaacgaggagagacgacccaccaugcuguuucucgagggucagcuaaacuacaaugguuuguugaacguaauauggucaucccagaaggacguguaauugaucuaggaugcggucgcgguggauggucauauuacugugcaggauugaagaaagugacagaaguacgaggauacacgaaaggugguccaggucaugaagaaccagugccaaugaguacuuauggauggaaucuuguaaaacugaugucuggaaaagacguauuuuacuuaccgccagaaaagugcgacacauuguuaugcgacauuggagaaucaucaccaaguccuacgguugaggaaucaagaacaauuagaguacuaaaaaugguagaacccuggcugaaaaauaaucaauuuugcauaaaaguucuaaacccauacaugccuacugucauugaacauuuagaacgccuccagcgaaaauaugggggaaugcucguaagaaauccacucucaagaaauagcacccaugagauguauuggauaaguaaugggacgggcaacauaguaaguucugucaauaugguaucucgacucuuauuaaaccgauucaccaugacccaccgucguccaacgaucgaaaaagauguggaucuaggugcagguacaaggcauguaaacgcagagccagaaacccccaacauggaugucaucggcgaaagaauuaaaagaauaaaagaagaacacucaucgacguggcauuacgacgaugaaaaucccuauaaaacaugggcauaucacgguucuuaugagguaaaggcgacuggaagugcguccucgaugauaaauggaguagucaaguuacuaacuaaaccaugggacguaguucccauggugacgcagauggcuaugacugauaccacgccuuucggucaacaaagaguauucaaagaaaaaguugauacuagaacaccuagaccgaugccagguacaagaaaaguaauggaaauaacagcggaaugguuauggagaacauugggacggaauaagaaaccgcgacucugcacaagagaggaauuuacgaagaaagugcgaacaaaugcugccaugggggcaguauucaccgaagagaaucaaugggauagugcacgagcugcgguagaggaugaaggauuuuggaaacugguggaccgugagagagaauugcauaaauuagggaagugcggaucuuguguauauaacaugauggggaaacgggagaagaaacugggugaauuuggaaaagcaaaagggagccgagcuauaugguacauguggcuaggggcaagguaccuugaguucgaagcucuuggguucuugaaugaagaccauugguuuucacgggaaaacucauacucagggguagaaggagagggacuacauaagcucgguuacauauuaagggauauaucuaagauaccaggaggagcuauguaugcugacgauacugcagguugggauacacgaaucacggaggaugacuugcauaaugaagagaaaaucacacaacaaauggacccugaacaucgacagcuagcaaacgcaauauuuaaacuuacuuaucaaaacaagguugugaaagugcagcgaccaacaccuaaaggaacuguaauggauaucauauccagaaaagaccaaagagguuccgggcaaguagguacuuauggacuuaauacauuuacuaauauggaagcacaauuagucaggcaaauggagggagaagggguucugucuaaggcagauuuagaaaauccucaucuacuggaaaagaaaauuacacaaugguuagaaaccaaagguguagaacgucugaaaagaauggcaauuagcggagaugauugcgugguaaaaccaaucgaugauagauuugcgaacgcguuauuagcucuuaacgauaugggcaaaguaagaaaagacauuccucaguggcagccaucuaaaggcuggcaugacuggcagcaaguaccuuucuguucgcaucacuuucacgaauugauuaugaaagacggaagaaaacuuguugugcccugccguccccaagacgaauuaauuggcagagcccggaucagucaaggagccgguuggagucuaaaagaaaccgccugccuagguaaagcauaugcccaaauguggagccuuauguacuuucaucgccgagauuuacgcuuagcauccaacgcaauauguucggcaguccccguacauuggauaccaacaagcagaaccacaugguccauacacgcgcaucaucaauggaugacaacagaagauaugcuuacuguuuggaaccguguguggauagaagauaauccguggauggaagauaaaacuccggugacaacaugggaagaugugccguaucuagguaagagggaagaccaaugguguggaucgcugauugguuugacgucgcgggcaacaugggcacagaacauucuuaccgcaauucaacagguuagaucucuuaucggugaugaagaauuuuuagauuauaugccaaguaugaaacgcuuuagaaaggaggaggaaagugaaggugcuauaugguaa

SEQ ID NO: 23495 - RNA, 9873 nt, Artificial Sequence
  derived and/or modified CDS sequence (opt6) from DENV-3__KF955460__SS-prME
acaucacuuugccuaaugaugauguugccagcgacacuagcauuucaccuaacgucaagagacggagaacccaggaugauaguagggaaaaacgaacggggaaaaucacuacuguucaaaacggcaagcggaaucaauauguguacacucauugcaauggauuugggagaaaugugcgaugacacuguaaccuacaaauguccucuuauagcggaaguagaaccugaagacauagauuguuggugcaaccucacuagcacauggguuacauauggaacuugcaaucaagcaggagaacauagacgggacaaaagguccguagcacuugcaccucaugugggaaugggacucgacaccaggacccaaacauggauguccgcagaaggugcauggaggcaagucgaaaaaguagaaacaugggcacuaaggcauccaggauucacuauauuagcauuguuucuggcucauuacaucgggacuuccuugacucaaaaaguuguuauauuuacccuacucauguuaguuacaccgucgaugacuaugagauguguuggaguaggaaaucgggacuuuguggaaggauuaucaggagcaaccuggguagauguuguauuggaacacggagguuguguuacuacaauggccaaaaacaaaccuacauuggauauugaauugcagaaaacagaagcaacacaacucgcuacucuccggaaacucuguauugaagguaaaauuacaaacauuaccacagauucuagaugccccacgcaaggugaagcuauuuuacccgaagaacaagaccagaacuacgucuguaaacauacauauguagaccgaggauggggcaacgguuguggacuauuuggcaaaggaagccuagugacgugugcuaaauuucagugcuuagaaccaaucgaagguaaaguaguacaauaugaaaauuuaaaauauaccguuauaauuacaguccacacuggugaucaacaucaaguugguaaugacacacagggaguaacgguagaaauaacaccgcaagcuagcacuguugaagcgguacuuccagaauaugguacauuaggacuggaauguucuccucgcacaggucuagauuuuaacgaaaugauuuuacuaacuaugaagaauaaggcuuggaugguucacaggcaaugguucuuugacuuaccauuaccauggacaagcggggccacaacagaaaccccuaccuggaaucguaaagagcucuuagugacauucaagaaugcgcacgcuaagaaacaagaggucgucguauugggcucacaagagggagcuaugcauaccgcguugacuggcgccacggaaauacaaaacucaggaggaacaucuaucuuugcaggacacuugaaaugccguuuaaaaauggauaagcuagaauugaaggguaugaguuaugcaaugugcuuaaauacauucguacugaagaaagagguaagugagacacaacacggaacaauuuugauuaaaguugaauauaaaggggaagaugcgcccuguaagauuccauucaguacggaagauggucaaggcaaggcucacaauggaagguuaaucacagccaacccaguaguuaccaagaaagaagaacccgucaauauagaagcggaaccaccuuuuggugaaagcaauaucgugauagguauuggcaacaaagcauuaaaaauuaauugguacaagaaggguucaucaauuggaaaaauguuugaagcuacagccagaggugcgaggagaauggccauucuaggagauacagccugggauuuuggcagugugggaggaguucucaauaguuuaggaaagaugguucaccaaauauuuggaagugcauauacugcauuguuuuccgguguguccuggauuaugaaaauaggcauugguguguuacuaacauggauuggucuaaacagcaaaaauacauccauguccuucaguuguauaguuauuggaaucauuacguuauaucuuggagcagugguacaggcugacaugggaugugcaauuaacuggaaagguaaggagcuaaaaugcggaagcgguauauucgucacgaaugagguucauacuuggacugaacaauauaaauuucaagcagauagcccgaagcggcuugcaacagcgaucgcuggagcaugggaaaaugggguaugcggcauucguucaacgacacgaauggagaaccuguuguggaagcaaauugccaaugaauuaaacuacauacuuugggaaaacaacauaaagcugacagucguaguaggcgacauaauagggguucuggaacaagguaaacguacauuaacaccccaaccaauggaacugaaguauucguggaaaacguggggcaaagcuaaaaucguuacugcugaaacccagaacucaaguuucauuauugacggaccuaauacgccggaaugcccauccgcuucacgagcauggaauguaugggaaguagaagauuacgguuuuggaguuuucacuaccaacauauggcuuaaauuaagagaaguguacacucaaucuugcgaucacagauuaaugagugcagccauuaaagacgaaagagcgguacaugcagauaugggauacuggauagagucacagaaaaacggaucuuggaaacuagagaaggcuuccuucauugaaguaaaaacaugcacauggccuaaaucacacacuuuauggaguaauggaguauuagaaagcgauaugauaauucccaaaagucuugcggguccuaucagccaacacaaucacagaccugguuaucacacucaaacagcggggcccuggcaccuagguaaauuagaauuggauuucaauuauugcgaaggcacaacugucguuauaacugagaauugcggaacacgaggcccaucacuaaggaccacaacuguaaguggaaaauuaauucacgaaugguguuguagaucauguacguugccuccgcuuagauauaugggagaggaugguuguugguaugguauggaaauaagaccuaucaaugagaaagaagaaaauaugguaaagucgcuuguaucggcaggaucaggcaaaguugacaacuucacgaugggagucuuauguuuggcuauuuuguuugaagaaguaaugcgagguaaauucgguaaaaagcauaugauugcaggaguguuguucacuuucguuuuauuacugucaggccagauaacauggagagauauggcgcacacauuaauaaugauaggaaguaacgcaucagacagaaugggaauggggguaacauaucuagcauuaauagcuaccuucaaaauacagccuuucuuggcacuaggcuuuuuccuaagaaaguuaaccucacgcgaaaauuugcuacuagggguaggacuggcaauggccacuacucuucaguugcccgaagauauagaacaaauggcaaaugguauagcgcuuggucuaaugacacuuaaauugaucacgcaauucgaaacuuaucaacuuuggacagcauuaguuagccucacguguaguaauacaauuuuuacauuaacaguagcauggcgaacagcuacacuaaucuuagccgguguaaguuuacugccacugugccagucgucuagcaugcgaaaaaccgacuggcuuccuaugacgguagcagcaauggggguuccgccucucccuuuauucaucuucagccuaaaggauacuccuaaacgcaggucauggccacuaaaugaaggagucauggccguaggacugguaaguauacuagccagcucucuacuaagaaacgauguaccgauggccggaccacuggucgcuggaggauuguuaauugcaugcuaugugaucaccgggacaagugccgaucuaacaguagaaaaagccgccgacguaaccugggaggaagaagcagaacagacaggcguaagccauaaccuaaugauaacaguugaugaugaugggacgaugaggauaaaggaugaugagacugaaaauauacucacuguacuacuaaaaacugccuuacugauagucagugguauauuuccauacucaaucccggcgacgcuacugguguggcauacauggcagaaacaaacacagagaaguggaguuuuaugggacguaccgagucccccugaaacacaaaaagcggaguuggaagagggaguauaccgcaucaaacaacaaggaauauucgguaaaacacaagucgggguuggaguacagaaggaagguguauuccacacaauguggcacguaacaagaggagcaguucuuacgcauaaugggaaacgauuagaaccgaacugggcuaguguaaagaaggacuugauuucauacggcgguggauggcgacuaagugcccaauggcaaaaaggcgaggaagugcaagucauugccguagaaccagggaagaaucccaaaaacuuccagacaaugccaggaaucuuucaaacaaccacaggugaaauuggggcaaucgcccuggacuucaaaccagggacguccggauccccaauaauaaacagagaagguaagguagugggccuuuauggaaauggaguagugacgaaaaaugguggguacguaucgggaauugcccaaacaaacgcugaaccugauggcccaacucccgagcucgaggaggaaauguucaagaagcgaaacuuaacaauaauggaccuccauccgggaucggggaaaacaagaaaguauuugccugcuauuguacgagaagccauuaaacgccgacugaggacucuaauauuagcaccaaccagaguuguagcugcggaaauggaagaagcgcucaaagguuuaccuauucgauaccaaacaacugcaacaaaaagugaacauacggguagagaaauuguagaucucaugugucaugcuacauucacgaugcggcuacuaucaccgguaagaguaccgaacuauaaucuaauaaucauggaugaagcgcacuuuacugauccggccucaauagccgcaagaggguauauaucuaccaggguagguaugggggaagcugcagcgauauuuaugacagcuacuccgcccggaacugcagaggcauucccucagaguaacgcaccaauucaagacgaggaaaaggacauacccgaaagaagcuggaacaguggaaaugaauggaucacagauuuuguuggaaaaaccgucugguuuguaccaucuauuaaagcuggaaacgacaucgccaauugucugcgaaagaaugguaagaaaguaauucaguuaagucgaaaaaccuuugauacugaauaccagaaaacucgauuaaacgacugggacuuugucguaacgaccgauaucuccgaaaugggagcgaacuucaaggccgaucgcguaauagauccaaggcgaugcuuaaagccgguuaucuuaacugacggaccagagcggguuaucuuggcaggaccaaugccgguaacugcagcaucggcugcacaaagaagaggccgaguggggaggaacccacagaaagaaaacgaucaauauauauuuacaggucaaccacucaauaacgaugaagaucacgcucacuggacagaagccaaaauguuauuagauaauauaaauacacccgaggggauaaucccggcuuuauuugaaccugaacgcgagaaauccgcugcuauagauggagaguauagauuaaaaggagaaucacguaaaacuuuuguggagcuaaugcgucgcggagaucuuccugugugguuagcucauaaaguugccucugaaggaauaaaauauacagacagaaaauggugcuuugauggggaaaggaauaaucaaauauuagaagaaaauauggacguugagauauggacuaaagaaggggaacguaaaaagcuacggccaagauggcuagacgcccgaacuuauucagauccauuagcacuaaaagaguuuaaagauuuugcagcagguagaaaaaguauugcccuggaccuaguaacugaaauuggaaggguuccgucacauuuggcuuaucgaacucguaaugcuuuggacaauuuaguaaugcugcauaccuccgaacauggugguagggcguaucgacacgcaguugaagaauuaccggagacaauggagacucuucugcugcucgguuugaugauauuauugacaggcggcgcuaugcuauuucuaauaucugguaaagggaucggcaaaacgaguauuggguuaaucugugugaucgugucaucggguauguuauggauggcagauguuccucuucaguggauugcgucugcaauaguucuagaguucuuuaugaugguuuuacuuauaccggaaccugaaaagcaacguacuccgcaagacaaucaguuagcauacguugugauaggaauauuaacucucgcugcuauagucgcggcaaaugagauggguuuacuugagaccacaaaacgcgaucuagguaugaguaaagagccaggugucguuagcccaacaucguauuuagacguugaccuacauccagccagcgccuggacucucuaugccguugcaacaacuguaauuacacccaugcuaaggcacacaauagaaaacuccaccgcaaaugugucgcuagccgcgauugcaaaccaggccguaguauuaaugggacuagauaaaggcuggcccaucaguaaaauggaucuagggguaccucuauuagcucuagguuguuauagccaagucaauccauugacauuaacugcagccguacuacuccuaguaacucauuaugcaauaauuggaccaggccuacaagcaaaagcaacuagagaagcgcagaaaaggacggcagcugggauuaugaaaaaucccacaguagauggcauaaugacaauagaccuugauccugucaucuaugacucaaaauuugaaaaacaauuaggacaaguaaugcuacuuguacuaugugcuguucaguugcuccuaaugaggacuucaugggcacuaugcgaagcauugacauuagcuacuggcccaauuaccacccucugggagggaucucccggaaaguucuggaacacaacuauagcggucagcauggcaaacaucuuucguggcagcuaccuggcuggagcuggucuagcauuuaguaucaugaaaagugucgguacaggaagaagagguacaggaagucagggcgaaacacuaggugagaaguggaagaagaaacuaaaucaguugucccguaaagaguucgaucuauacaaaaagucuggaauaacagagguggauagaacugaagccaaggagggacucaaacggggugagacuacgcaccacgcaguaucucguggaagugcgaaacuccaaugguucguagaaaggaacauggugauaccggaaggaagaguaauagaccuagguugcggaagaggaggcuggucauacuauugugcagguuuaaagaaggucacagagguaagaggcuacacgaaaggagguccuggucaugaggaaccuguuccgaugucaacauauggcuggaacauaguaaaacuuauguccgguaaagaugucuucuaccuucccccagaaaaaugcgacacacuauuaugcgauaucggagagucgucaccuucucccacaguugaagaaucuaggacuauucgagucuugaaaauggucgaaccauggcuaaagaacaaucaguuuuguauaaaaguauuaaacccuuauaugccaacgguaauugaacacuuggaaagacuccagagaaaauacggcggaaugcuuguucgcaauccacuaaguagaaauucgacacaugaaauguacuggauuucgaaugguacaggaaauaucguaagcuccguuaauauggucucaagauuauuauuaaaccgguuuacaaugacgcacagaagaccaacaauagagaaagacguugaucugggcgcaggaacaagacacguuaaugcagaaccagagacuccaaacauggauguaauaggugaacgaauaaaacgaauaaaagaagaacacucaucuacguggcacuacgacgacgaaaauccuuacaaaacaugggcauaucacgggaguuaugaagugaaagcuacugguucagcaucauccaugauaaaugggguaguuaaguuacuuacuaaaccaugggacguaguacccauggucacccaaauggcuaugaccgacacgacuccguucggucagcaaaggguauucaaagaaaaaguagacacacgaacaccccgaccaaugcccgguacgagaaaagucauggagauuacugcagaauggcucuggaggacacuagggcgcaauaaaaagccgagauuaugcacacgugaagaguucaccaagaaagucagaacaaaugcagcgaugggcgcaguauucacagaggaaaaucagugggauuccgcacgugcagccguagaagacgaagaguuuuggaaauuaguugaucgggagcgugaacuacacaaguuagggaagugcgggucuuguguauacaacaugaugggcaaacgggagaagaaacugggugaauuuggaaaggcgaaagguucccgcgccauuugguacauguggcuaggcgcacgcuauuuggaauuugaagcauuagguuuucucaaugaggaucauugguuuucacgagaaaauucuuacagcggaguagagggagaaggacuacauaaacuugguuacauacugagagauauaucgaaaauuccugguggugcaauguacgcagaugacacugcaggaugggauaccaggauuacagaagaugaucuucauaaugaagagaagauaacucaacaaauggauccggaacauagacagcucgccaacgccauauucaaacugacuuaucagaauaaaguuguaaaagugcaaagaccuacaccaaagggaacuguuauggacauaauaagcagaaaagaucaacggggaucaggucagguagggacauacggucuaaacacauuuacuaauauggaagcacaacuugugcgucaaauggaaggagaggguguuuugucaaaagcagaucuugaaaacccgcacuugcuagagaagaaaauaacucaauggcuagaaacaaaagggguagagagacuuaaaagaauggcuauuucgggggacgacugcgugguuaagccuauugacgaucgauuugccaaugcacuacuagcacucaacgacaugggcaagguaagaaaggacauuccacaauggcagccuucaaaaggauggcacgauuggcaacaaguuccuuuuugcagccaucauuuucacgaacuuaucaugaaagaugguaggaagcuagugguuccauguagaccacaggacgaauuaauaggcagagcacggauuagccaaggagcugguuggagcuugaaagaaacagcauguuugggaaaggcuuacgcacaaauguggucacucauguauuuucaccggagagauuuaagauuagcaucaaacgcaaucugcuccgcgguaccggugcauuggauacccaccucgagaacgacauggucaauccacgcccaucaucaauggaugaccacggaagacauguugacggucuggaaucggguauggauagaagacaauccguggauggaggacaaaacaccugucacaaccugggaagauauaccuuauuuaggaaaaagagaagaucaguggugcggcagcuugauagguuuaacaaguagagccacaugggcccaaaacauacuaacugcuauucaacaaguacgaucguuaaucggugaugaagaguucuuagauuauaugccguccaugaaacgcuucagaaaagaggaggaaucggaaggggcaauaugguaa

SEQ ID NO: 23496 - RNA, 9873 nt, Artificial Sequence
  derived and/or modified CDS sequence (opt6) from DENV-3__FJ461334__SS-prME
acaagucuaugucugaugaugaugcuaccagcuacguuagcauuucacuuaacaucgcgggacggggagccgcgaaugauugucggcaaaaaugaacgggguaaaucccuuuuauuuaaaacagcaucagggauaaauaugugcacauuaauagcgauggauuuaggagagaugugcgacgacacuguuacauacaaauguccucucaucgcugaaguagaaccggaagacauugauugcugguguaaucuaacaaguacuuggguaacauaugggacuuguaaccaagcuggagagcacagaagagacaaaagaucgguggcuuuggccccacacgucggaaugggcuuagacacucgaacacaaacuuggaugagugcugagggggcguggcgacaaguggaaaaaguagagacaugggcauuacgacacccaggcuuuaccauccuagcauuauucuuggcucacuacaucggcaccucgcuaacucaaaaaguuguaauauucauauuacuaaugcuagugacuccaucaaugacaaugagauguguaggugucggcaaucgggauuuuguugaaggacucucaggagcaacguggguggacgugguuuuagaacauggaggaugcguaacgaccauggccaaaaacaaaccaacccucgauauugaguuacagaaaacugaggcaacccaauuagccacucuccguaaacuguguauugaaggaaaaauaaccaacauuacuaccgacucacgauguccaacacaaggcgaagccauacuaccagaagaacaagaccaaaauuauguguguaaacauacuuacguagauagaggaugggguaacggaugugguuuguuuggaaaagggagcuuaguaaccugugcaaaauuccaaugccuugaaccaauagaaggaaaaguaguacaguacgaaaaucuuaaauacacuguaaucauuacaguacacacaggugaccaacaucagguagggaaugacacucaaggcguaacaguagagaucaccccgcaggcuucaacuguagaagcaguauuaccagaauaugguacacuagguuuagagugcucuccgaggacuggauuggauuuuaaugagaugauccuacuaacgaugaaaaacaaagcauggauggugcaucggcaaugguucuuugaucugccucuuccuuggacuagcggugcuacaaccgagacgccgaccuggaaucguaaagaauuacuggugacguuuaaaaaugcucacgcuaagaaacaagaaguagugguccucgguucacaagagggugcaaugcauaccgcuuuaacaggugcgacagagauacagaacagcgggggaaccagcauuuucgcuggucacuuaaaaugccggcugaaaauggacaaacucgaacuaaaaggaauguccuaugccaugugccuaaauacuuuuguucucaagaaagaagugucggagacacaacauggaacuauucuaauuaaaguggaauauaaaggcgaagaugcaccauguaaaauaccguuuagcacagaagacgggcaaggaaaagcucauaauggaagguuaauaacugccaacccaguugugaccaagaaagaagaaccuguuaauauagaggcggagcccccauuuggggaaucaaauauagugaucgguauuggugauaaggcacucaaaauuaauugguacaagaaagggagcucaauagguaaaauguucgaggcgacagcccgaggggcaagaagaauggccauucuaggagauacagcaugggacuucgguaguguaggugggguauuaaauaguuuaggaaaaaugguacaucaaauauuuggaagugcuuauacugcucuguucagcggcguuuccuggaucaugaaaauuggaauaggcguacuucucacuuggaucggccuuaacagcaagaauacaucaaugagcuucuccuguauuguaaucgguauaauuacccuauaucuuggggcugucguucaagcagauaugggcugugcuauuaacuggaaaggaaaggaauuaaaguguggaucgggaauauuuguaacaaaugaaguccauacauggacagaacaguauaaauuucaagccgacucaccaaaaagacuagccaccgcaauagcgggggcaugggagaauggggucugcggaauacgaucuacgacacgaauggaaaacuuacuuuggaaacaaauugcaaacgaacucaacuauauccuuugggaaaauaauauuaaacuaacaguggugguaggagacauuaucggcguacuugaacagggaaagagaacacuuacuccgcaaccuauggaacugaaguacucguggaagacuuggggaaaagccaaaauugugacagcagaaacucaaaauucaaguuuuauaauagauggaccaaauacuccggaguguccaagcgcaagucgagccuggaacguuugggagguugaggauuauggguucgguguguuuacaacuaacauuuggcucaaauuacgagaaguguacacucaaucuugugaccacagacuuaugucugcagcuauuaaagaugaaagggcgguucaugcagauaugggcuacuggauagagucacagaaaaacggaaguuggaaauuagaaaaggcaucuuuuauugagguuaaaacaugcacauggccuaagagucacacauuauggagcaacggaguuuuggagagcgacaugauuaucccuaagucccuagcuggaccaauaucacaacacaaucaucguccgggcuaucacacccaaacggcaggucccuggcacuuagggaaguuagaacuagauuuuaauuauugcgaaggcacgacgguaguuauuaccgagaauugcgguacacgaggccccaguuugcgaacaacaacugugucgggaaagcuaauacaugaaugguguugcaggucauguacucuaccuccucuaagauacaugggcgaggacggauguugguauggaauggaaauacguccgauaaaugaaaaagaagaaaauaugguuaagagcuuaguguccgcagguucgggcaaaguagacaauuucacuauggguguacuauguuuagcuauacuuuuugaagaaguuaugaggggaaaauuugggaagaaacacaugauugcaggcguauuauucacauuuguccuacuuuuaucagggcaaauuacauggcgugauauggcgcauacacuaauuaugauugguucaaacgcgagcgacagaaugggaauggggguaacauauuuagcguuaauagccacguuuaaaauucaaccauuuuuagcauuaggauucuuuuuaaggaaacuuacuucccgugagaaucugcucuuaggcguuggauuagcaauggcuacaacucuacaauuacccgaagauauagaacagauggcaaauggaaucgcccuugggcuaaugaccuuaaaauuaauaacccaguuugaaacguaccaacuuuggacagcgcuuguaagccuaacguguucaaauaccauauucacuuuaacuguugcuuggagaacagcaacgcuaauuuuagcugguguuucgcuacuucccuuaugccagucaaguaguaugagaaaaaccgacuggcuaccgaugacggucgcggcaauggguguuccaccacuaccucuguucauauucagccuuaaagacacacccaaacgccgguccuggccccucaaugaaggagugauggcugugggacuuguaucgauacuggcaaguagcuuguugagaaacgacguuccuauggcagguccucuaguagccggugguuuacuaauugcaugcuauguaauuacaggaacaagugcagauuuaacggucgaaaaagcagccgauguuacaugggaagaggaagcagagcaaacuggagugagccauaaucucaugauaacaguagaugacgacggaaccaugcgaauuaaagaugaugagaccgaaaacauacucacaguacuucuaaaaacagcuuuauuaauuguaucagggauuuuucccuauagcauuccugcuacccuauugguuuggcauacguggcaaaaacaaacacaaagaaguggcguuuuaugggauguuccuaguccacccgaaacgcagaaagcggaguuggaagaagggguuuacagaaucaagcaacaagguaucuuuggaaagacgcaaguggggguaggaguccagaaagaggguguauuccauacaauguggcauguuacucgaggagcaguauuaacucauaauggaaaacgcuuagaacccaauugggcaucugugaagaaagauuuaaucucauauggaggaggauggagacuaucuacucaauggcaaaaaggcgaagagguucaaguuauugcaguagaacccgggaaaaaucccaaaaauuuucaaaccaugccggguauauuccaaaccacaacaggcgagauaggagcuauagccuuagacuuuaaacccgggacuuccggcucuccaaucauaaaucgcgaagguaagguaguuggauuguacggaaauggaguaguuacuaaaaacggaggcuacgugagugggauagcucaaacaaaugcugaaccugauggacccacuccugaacuugaggaggaaauguuuaagaaaaggaaucuuacuauuauggacuugcauccggguucaggaaagacaagaaaauaucuuccggcaauaguuagagaggcaauaaaaagaaggcuacguacuuuaauacuugcaccaacacguguuguagcagcugaaauggaagaggcuuuaaagggauugccgauacgauaucaaacgacugcaacuaagagugaacauacuggaagagagaucguugaucuuaugugucacgccacuuuuacaaugcgacuucugagucccguaagagucccaaacuauaaccuuauaauaauggaugaagcacauuucacagauccagcaaguauagcugcaagggguuauauaucuacaaggguagguaugggcgaagcggcugcaauauuuaugacugcaacaccuccgggcaccgccgaggcguucccacaaucaaaugcuccaauccaagacgaagaaagagauauuccagaaagauccuggaacucaggcaaugaauggaucacagauuucgucgguaaaacgguaugguuugucccgucgauuaaggccggcaacgacaucgcuaauugcuuaaggaaaaacgguaagaaaguuauacaacuaucaagaaaaacuuucgauacagaauaccagaaaacacgguuaaacgauugggauuuuguaguaacaacagauauaagugaaaugggugcaaauuuuaaggccgauagagugauugaccccagaaggugccuaaagccugugauucuaaccgacgggccagagcgaguaauucucgccgggccgaugccuguuacggcggcgucggccgcacagaggcgaggaagggugggucgaaacccacagaaggagaaugaucaauauaucuucacgggacaaccucuuaacaaugacgaagaucacgcucacuggaccgaagcaaaaauguuacuggauaacauaaacacuccagaaggaaucauucccgcuuuauuugaaccagaaagggaaaaauccgcagcuaucgacggagaauaccgauuaaaaggagaaucacgaaagacuuuuguagaacuuaugagaagaggugaucuaccuguuuggcuggcacauaaaguggcauccgaagggaucaaauauacagaucgcaaguggugcuuugauggcgaaaggaacaaccaaauccuugaagaaaauauggauguugaaauuuggacaaaagaaggagaacgcaagaaacuucggccacguugguuggaugcaagaaccuauucggauccacuagcucugaaagaguucaaggacuucgcugcgggaaggaaaaguauugcacucgaccuugugacugagauuggacgcgugccuucacaccuggccuaccguacacgaaaugccuuagauaaccuuguuauguugcacacaagugaacacggaggaagggcauaccgucacgccguggaagaauugccugaaacgauggaaacgcuacuuuuauuaggauuaaugauauuguugacuggaggcgcaaugcuauuccuaaucucaggcaaaggaauaggaaaaacuuccauaggauuaauaugcguaaucguuuccucaggaaugcuguggauggccgacguuccauugcaauggaucgcgucugcaauaauauuagaauuuuucaugaugguacuguuaauaccagagccagaaaaacaaagaacaccgcaagauaaccaauuagcauacgucguuauagguauacucacuuuagcggcuauugucgcggccaaugaaaugggccugcuagaaacaacaaaacgcgaccuaggcaugaguaaagaaccuggaguaguaucgccuaccucauaccuugauguagacuuacauccagcaucggcguggacucuauaugcaguagcuacaacugugauuacaccuauguugcggcauacuauagaaaauaguaccgcaaaugugucacuagcggccaucgcaaaccaagcggugguccuuaugggauuggacaaaggauggccaaucaguaaaauggacuuagguguucccuuacuugcucuagguuguuacagccaggugaauccauuaacacucaccgcugcaguucucuuauuagugacccacuaugcaaucauugguccuggucuacaagcuaaagcaaccagagaagcgcaaaaacguacugcagcaggaauaaugaagaacccaacugucgaugggauuaugacuauugaccucgacccagucauauacgauucaaaauuugagaagcaauuaggucaaguaaugcuacuuguucuaugugccguucaacuucuucucaugaggacaucgugggcguuaugcgaagcauuaacguuagcuacagggcccaucacgaccuuaugggaggguucaccgggcaaauuuuggaauacuaccauagcgguguccauggcuaacauuuuucgagggucauacuuggccggugcaggauuagcauucucaauaaugaaguccguagguacaggaagacggggcacaggaagucagggagagaccuuaggcgaaaaauggaagaagaaacugaaucaacuaucacguaaagaauuugaucuuuauaagaaaucaggaauaaccgagguggacagaacagaagcaaaagaggggcuuaaacguggagagacgacucaucaugcaguaucaaggggcagugcuaaacuacagugguucguagaaagaaauaugguaauaccagaaggaagagugauagauuuggggugcggucguggaggauggucauacuauugcgcugggcuaaagaaagucacagaggugaggggauauacgaaaggagguccgggacacgaagaaccaguaccgaugucuacauauggguggaauuuagucaaacuuaugucagggaaggauguguuuuaccucccgccagaaaaaugugacacucuuuuaugcgauauuggggaaucaucucccucaccuacaguagaagagagcagaacaauuaggguauuaaaaaugguagagccgugguuaaagaauaaucaauuuuguauaaagguauuaaacccguauaugcccacaguuauagaacaccuggaaagacuacaaagaaaauauggaggcaugcuugugaggaacccacuaucucgcaauucaacacaugaaauguauuggauaaguaacggaacugguaauauaguaucaucagugaauaugguuagucgucucuuauuaaaccgcuucacaaugacucacagaagaccuacaauagaaaaagauguggaucucggggcaggaacgcgucaugugaacgccgaaccagaaaccccaaauauggacguaaucggugagcgaaucaaaagaaucaaagaagaacauucaaguacauggcauuacgacgacgaaaauccauacaagacaugggccuaucaugguaguuaugaggucaaagcaacagguucugcuucaucaaugauuaauggaguugucaaacuauuaacgaagccaugggauguagugccuauggugacacaaauggcaaugacugauacaacuccuuucggacaacagaggguuuuuaaagaaaaaguugauacccgaacaccucgccccaugccggguacacgaaaaguuauggagauaacggccgagugguuauggaggacuuuaggccgaaacaagaaaccuagauuauguacuagagaagaguucaccaagaaaguccguacuaacgcagccaugggagccguauuuacagaagaaaaccaaugggauucagcucgcgcagccguagaggaugaagaauuuuggaagcugguugaucgggagagagaguuacacaaauugggcaagugcgguucauguguauacaauaugaugggcaaaagggagaagaaacuaggagaauuuggaaaagcgaaaggaucacgagcuauaugguauaugugguugggggcaagauaucuagaguucgaggcacugggauuuuuaaaugaagaucacugguucucacgcgaaaauuccuauagcgggguggaaggagagggauugcacaaacucgguuacauucuacgugacauuagcaaaauacccggaggagcaauguaugcugaugauaccgcagguugggacacacggauuacugaagaugauuuacauaacgaggagaaaauaacgcaacaaauggacccagaacaccgccaauuagccaaugcuauauuuaaacucacauaccagaacaaagugguaaaaguacaaagaccgacgccgaaagggacagucauggauaucauuagcagaaaagaucagagaggaucggggcaaguagguacguacggccucaacacuuuuacaaauauggaagcucaguugguacgacaaauggaaggugaagguguauugucaaaagcugaccuggaaaacccucaucuacuggagaagaaaauaacgcaaugguuagaaacaaaagguguagaacgacuaaagaggauggcgauaaguggugaugauugugucgugaagccuauagaugaucgauucgcuaaugcccuuuuggcacucaacgacauggguaaaguucgcaaagauauaccacaauggcaacccuccaaaggauggcaugauuggcagcaaguaccguucuguucucaucauuuccaugaacugauaaugaaggaugguagaaaguuaguuguaccgugccgaccacaagaugaauuaaucgguagagcaaggauuucacaaggggccggauggagucucaaagaaacagcuugccugggaaaagcauacgcacaaauguggucuuuaauguacuuccauagaagggaucuaagauuagcaagcaacgcgauaugcuccgcagugcccguacacuggauaccaacaucuagaacuacauggucaauucacgcucaccaucaguggaugaccacugaagacaugcuaacggucuggaaucgaguuuggauagaagacaaucccuggauggaagacaaaacuccgguaacaacaugggaggauguaccauaucuaggaaagagagaagaccaaugguguggaagccuaauagguuugacuucgagagcaacaugggcacaaaacauucugacggcuauacagcagguccguucuuugauuggugacgaagaguuccucgacuacaugcccuccaugaagcgguucaggaaagaagaggaaagcgaaggugccauaugguga

SEQ ID NO: 23497 - RNA, 9873 nt, Artificial Sequence
  derived and/or modified CDS sequence (opt6) from DENV-3__FJ461337__SS-prME
acaucauuguguuuaaugaugaugcucccagcuacauuggcguuucaucucacuucgcgugacggggaaccaagaaugauaguagggaaaaaugaaagagguaaaaguuuacuauuuaaaacugcuucggguaucaacaugugcacacucauugccauggauuugggugaaaugugcgaugacacaguaacguacaaauguccccuaauagcggaaguggaaccggaagauauugauuguugguguaacuuaacaaguacuugggucacuuauggcacuugcaaucaagcgggagaacaucguagggacaaaagaagugucgccuuagcgccgcauguaggcauggggcucgauacgcguacccaaacauggaugagugcagaaggggcguggaggcaaguugaaaaaguugaaaccugggcccuaaggcacccaggauucacuauauuagcauuauuucuggcacacuacauaggcaccucacuaacgcaaaaaguugugauauuuauauuacuaauguuaguuacuccuucaaugacaaugagauguguuggagugggaaacagggauuuuguagaaggccuaucaggagcgacauggguagauguaguuuuagaacaugguggguguguaacaacuauggcgaaaaacaaaccuacuuuagauauagaacugcagaaaacugaagcaacacaacuugcaaccuuaaggaaacuuuguaucgaagguaaaauaaccaauaucacgacagauucacgaugcccaacgcaaggugaagcuauacuaccagaggaacaagaucagaauuacgucuguaaacauacauauguugaccgcggaugggguaaugguuguggucuauuuggaaaaggaaguuuaguuacaugugcaaaauuucaaugcuuagagccgaucgaaggcaaaguaguccaguaugaaaauuuaaaauacacaguaaucauaaccguacacacuggggaucaacaucaagugggaaacgauacgcaaggcgugacugucgaaauuacgccucaagcgagcacuguugaagcuguauuaccagaauauggaacacuugggcucgaaugcaguccuagaacgggucuagauuuuaaugaaaugauuuuauuaacuaugaaaaacaaagcauggauggugcacagacaaugguucuucgaccuuccccuaccauggacgucaggcgccacgaccgaaacgccuacuuggaaucgaaaagaguuacucguaacauuuaaaaacgcucaugcaaagaaacaagaaguuguuguacuaggaucccaggaaggcgccaugcacacggcacuuacaggcgcaacagaaauccaaaauucaggugggacaaguauauucgcaggccaccuuaaaugucgccugaaaauggacaaauuagaauuaaaaggaaugucauaugcaaugugucuaaauacguuuguacucaaaaaggaagugagugaaacacagcaugguacaauacuaauaaaaguggaauauaagggagaggacgccccguguaaaaucccauuuaguacagaagauggacaaggcaaggcacacaacgguaggcucauaacagcaaacccaguuguaacuaaaaaggaagaaccaguuaacauagaagcugaaccuccauuuggagaaucgaauauaguaaucggaauuggagacaaagccuuaaagauuaauugguacaagaaaggaucuucaauagggaaaauguuugaggccacggcaaggggugcaaggcgaauggcaauauuaggagacacugcaugggauuucggcuccaugggaggcgugcuuaauucguuggguaaaauggugcaucagauuuucggaucugcuuauacagcacuauuuaguggaguaaguuggauaaugaagauagguaucgguguuuuacuaacuuggauuggccuaaauagcaaaaacacauccaugucuuuuucuugcauugugauaggaauaaucaccuuguaucucggagccguuguacaggcggauauggguugugcgauuaauuggaaggggaaagaauugaaaugcggcagugggauauucguuacaaacgagguccauacuuggacugaacaguacaaauuucaagcagauaguccuaagcggcuagccacagcgauagccggggcaugggaaaaugguguaugcggaauaagaucaaccacccgaauggaaaauuuacuguggaaacaaaucgcaaaugaacugaacuauauacuuugggaaaauaacauaaagcucacaguaguaguaggugauauaauagguguauuggaacaagggaagagaacucugacuccgcaaccaauggaacuuaaauauagcuggaaaacauggggaaaagcgaaaauaguaacggcggaaacccaaaauuccagcuucauaauugauggaccaaauacucccgaaugucccagugcuucccgagcauggaauguuugggaaguugaagacuacggauuuggcguguucacgacuaacaucugguuaaagcuaagggaaguuuacacacagucaugugaucauaggcuaaugucggcugcuauaaaagaugaacgagcuguccacgccgauaugggcuauuggauugaaucucagaaaaacggaucuuggaaacuagaaaaagcgagcuuuauugaaguaaaaacuuguacauggccuaaaucacauacauuauggaguaacgggguguuagagagugauaugauaaucccaaagucccuagcaggaccaaucucucaacacaaccauagaccuggauaucacacacaaaccgccgggcccuggcacuuagguaaacuagaauuagacuuuaauuacugcgaagguacuaccguaguaaucacagaggauugcggaacaagagguccaucgcugagaacuacgacagugucaggcaagcuaauacacgaauggugcuguagaagcugcaccuuaccuccacugagguacaugggagaagaugguugcugguaugguauggaaauuagaccuaucaaugaaaaagaggaaaauaugguaaaaucucucguaucagcuggaucaggaaagguagauaacuuuacgaugggaguccucugcuuagccauuuuauuugaggaagucaugagggggaaguuugguaagaaacacaugauugcaggaguucuuuucacuuuuguauuacuucuaucgggccaaauaacauggagagauauggcgcauacucugauuaugauuggaaguaacgcaucugacagaaugggaaugggagugaccuauuuagcucuaauugcuacauuuaaaauacagccauucuuagcacucggcuuuuucuuacgaaaacuaacgucuagagagaaucuuuuauugggagucgguuuggcuauggcaaccacucuccaguuaccggaggacauagagcaaauggcaaauggcauugccuugggucuaaugacuuuaaaacuaauaacacaauucgaaacuuaccaacuuuggaccgcgcucguuucuuuaacauguaguaacacaauuuuuacucucacgguagcauggaggacugcaacccuaauacuagccggggucucuuuacugccuuuaugucagucuucaucgaugaggaaaacagauugguuaccgaugacaguggcagcgauggguguuccaccacuacccuuauuuauauuuagcuugaaagauacaccaaaaaggagaaguuggccucuaaaugagggugucauggcuguaggacucgugucaauacuagcaucuucacucuugaggaacgaugucccgauggcugguccauugguagcgggaggucuacuaaucgcuuguuacguaauuacaggaacauccgccgaucuaacuguagagaaagccgcggacguaacaugggaagaagaagcugaacaaacaggcguuucccauaaucugaugauaacuguggacgacgauggaacuaugcguauuaaagaugaugaaacagagaauauacuuacgguacuauuaaaaacggcucuacugauuguuucaggaauuuuucccuacagcauaccggcuacguuacucgucuggcauacuuggcaaaaacaaacacagcgaucaggggucuuaugggaugugcccucaccuccagaaacgcaaaaagcggaauuggaagaaggcguuuauaggauaaagcaacaaggcauauucgggaaaacccagguuggagucgguguacaaaaagaagggguauuucauacuauguggcacgugacucgcggcgcuguacuaacacacaacggcaaaagauuggaacccaauugggcaaguguuaagaaagaucuuauaagcuaugggggaggguggcgacucucugcucaauggcagaaaggagaagaaguacagguaaucgcugucgaaccuggaaagaaccccaaaaauuuccaaacaaugcccggaauauuucaaacgacugcaggcgaaauuggugcuaucgcccuagauuucaagccaggcacaucagguuccccgauaauaaauagagagggaaaaguagugggacucuaugguaacggaguuguaacuaaaaacggagguuacguuuccggaauagcacaaacaaacgcagaaccggauggcccgaccccggagcuagaagaagaaauguuuaagaaacgaaaucucacuaucauggaccuucacccagguucuggaaagacacgaaaauaccucccagcaauaguacgcgaagcaauaaaaaggagauuacgaacacuaauucucgcccccacaagaguaguagcugcugagauggaggaggcuuuaaaggggcuuccaauaagguaccaaacaacggcaacaaagucugagcauacagggcgggagauagucgauuuaaugugucacgcaacuuuuacuaugcgcuuauugaguccgguuagaguaccaaacuacaauuuaauaauaauggaugaagcgcauuuuacagauccggcaucaaucgcugcuagaggauacauaucaacacguguagguaugggggaagcagcagccauuuucaugacggccaccccuccgggaacggccgaagcguuuccgcaaucgaacgcaccuauccaagaugaagaaagagacauaccggagagaucauggaacuccggaaaugaauggauaaccgauuuugugggaaaaacugugugguuuguccccucuauaaaggcgggaaaugacauagcaaacugucuucguaaaaacgguaaaaagguaauacaguugaguagaaagaccuuugauacugaauaccagaaaaccagacucaaugauugggauuucgucguuacgacugacauaucugagaugggagcgaauuuuaaagccgaccgagugaucgauccaagaagguguuuaaaaccggucauucuaacugaugggccugaaagaguaauacuugccggccccaugccaguuacggcagcaagugcagcucagcgucgaggucgaguuggacguaacccacaaaaagaaaacgaucaauacaucuucaccggacagccacucaauaacgaugaagaccaugcacauuggaccgaagccaaaauguuauuggauaauaucaauacuccugaagguauaauaccugcgcuuuucgagcccgagagagagaagagugccgcuauugacggagaauaucgccuaaagggagaauccagaaagacauuuguagagcuaaugaggcggggagaucuuccaguaugguuggcucauaagguugcuucggaagggauaaaauauacagauaggaaaugguguuuugauggagaacgaaauaaucaaauauuggaagaaaacauggauguagagauauggaccaaagaaggagaaagaaagaaacuuagaccacgguggcuagacgcucggacguacucugacccgcuugcuuugaaagaauuuaaagauuuugcagccgguaggaaaaguauagcgcuagauuuaguaacggaaauugggagaguaccaucccacuuagcauaucgcaccaggaaugcucuagauaacuuagucaugcuucauacaucagaacacggcggacgugcauacagacaugcaguugaagaauugccugaaacaauggagacauuauuauuguuaggacuaaugauauuguuaacggguggggccauguuguuucuaaucagcgguaaagguaucgguaaaacaucaauuggacuaauauguguuaucgugucaaguggaauguuguggauggcagauguuccucugcaauggaucgcuucugcaauugugcuugaguucuuuaugaugguauugcugaucccggaaccagaaaagcaaagaaccccacaagacaaucaauuagcuuacgugguaauugggauccucacacuagcagcaauaguugcagccaaugaaauggggcuacucgaaacaaccaaaagagauuuagggaugucaaaagagccaggaguagugaguccuacaucuuaucucgauguugacuuacauccugccucugccuggacacuauaugcaguagccacuacuguaaucacuccaaugcuucgacauacaaucgaaaacagcacagcaaacgucucccuggcugcuaucgccaaccaagcugucguuuuaaugggauuagacaaaggauggccaauauccaagauggauuuagguguuccucugcucgcacuagguuguuauagucagguaaauccucuuacucuaaccgccgccguauuacuauuaguaacucacuaugcaauuauaggaccgggcuuacaagcaaaggcuaccagagaggcucaaaaacgaacagcagcaggcaucaugaagaacccgacaguugacgggaucaugacgauugaucuagauccaguaauuuaugacucgaaguuugaaaaacaauuaggucaagugaugcuccuaguuuuaugugcuguacaauuguuguuaaugcgaaccaguugggcauuaugcgaggcuuuaacacuagccacugguccuaucacaacgcuaugggaaggaucgccaggaaaguuuuggaacacuacuauagccguuuccauggcgaacauauuuagggggucauaccuagcaggagcgggauuagcuuucaguauaaugaagucagucgggacaggacgaagggguacggguagccaaggagaaacccuuggagaaaaguggaaaaagaaacuaaaucaguuaucaagaaaagaauuugaccuauacaagaaaucaggaauaacggagguagauaggaccgaggcaaaggaaggacuuaagaggggugagaccacucaucacgcagugagucgaggaucggcaaaacugcagugguuuguggaaagaaauaugguuauaccugaaggaaggguaauagaucuugggugugggcgagguggauggagcuauuauugugcaggucuuaagaaaguaacugaagugagagguuauaccaaagggggaccaggucaugaggaaccuguacccaugucaacuuacggguggaaucuagucaaacugaugaguggaaaagaugucuuuuauuuaccacccgaaaaaugcgacaccuugcuaugugacauaggcgaauccucaccuucaccaaccguagaagaaagucgcacaauaagaguuuuaaaaaugguugaaccauggcugaaaaauaaucaauuuuguauaaaaguuuuaaacccuuauaugccgacuguaauugagcauuuggaaagacuacagcggaaauaugggggaauguuggucagaaauccgcuauccagaaacucuacgcaugaaauguauuggaucagcaacggaacgggaaauauaguuucguccguuaauaugguaucucgauuacuauuaaacagauucacuaugacccaccgacgaccgacgauagagaaggauguugauuuaggcgcagguacacgacacguuaaugcagaacccgaaacaccuaauauggauguaauuggggaaagaauuaagagaaucaaagaggaacacaguucuacauggcacuaugaugacgagaauccguacaaaaccugggcuuaucauggauccuaugaaguuaaagcaacaggaagugcaaguucuaugauaaauggggugguuaaauuacuaacaaaaccaugggacguaguaccuaugguaacucaaauggcaaugacagacacgacgccuuuugggcaacaacguguauuuaaagagaaagucgauacacgcacaccccgaccuaugccaggaacucgcaaagucauggagauaacagcggagugguuauggcguacccuaggacgaaauaagaagccuagauuaugcacuagagaagaguucacuaagaaaguuagaacgaaugcugcuaugggagcgguauuuacagaagaaaaccagugggauucagcgcgagcugcaguagaagaugaagaguucuggaaguuaguugauagggaacgugaauuacacaaauugggcaaaugcgguucauguguguauaauaugaugggaaaacgagagaagaaacuuggcgaauuugggaaggcaaaagguucuagagcaauaugguacaugugguuaggagcaagauacuuggaguuugaagccuuaggauuucugaaugaagaccauugguuuucucgcgaaaauagcuacucaggcguggaaggagaaggucuccauaagcugggauacauacuacgagacauaucaaagauuccggguggugcaauguaugcagaugauacggcaggaugggacacuagaauaaccgaagaugaccuacauaaugaagagaaaaucacacaacaaauggauccggaacauaggcaacuagcgaaugcaauauucaaauugacuuaucaaaauaaggucguaaaaguacaacgaccuacaccaaaaggaacggugauggacauaaucucaaggaaagaucagcgugggaguggacaaguuggaacauauggucuaaauacauuuaccaauauggaagcgcaacuuguuagacaaauggaaggagaagguguccuuucgaaagcagacuuagaaaauccccauuuacuugaaaagaaaauuacccaaugguuagaaaccaagggaguugaacgccuaaaacgaauggcgauaagcggugacgacugugugguaaagccuauugaugauagauucgcaaaugcgcugcuagcccuuaacgauaugggaaaaguuaggaaagauauaccacaauggcaaccgucaaaaggauggcaugauuggcaacagguaccguuuuguagucaucacuuccaugaacugaucaugaaggaugggcgcaaauugguaguaccguguagaccgcaagaugaauugauaggcagagcgagaauaucacaaggagcaggguggucgcugaaagaaacugcuuguuugggaaaagccuacgcgcagauguggagcuugauguacuuccacaggcgugaccuaagacuagcuaguaaugccauaugcagcgccguuccuguacauuggauaccaacaucacggaccacauggucgauacaugcacaccaccaguggaugacaacugaagauaugcuaacggucuggaauaggguauggauagaagacaauccauggauggaagacaaaacgccugucacgacuugggaagauguuccauaccucggcaagcgagaggaucaaugguguggaucauugauuggacugacuagccgggcaaccugggcucagaacauuuuaacggcaauacaacaaguuaggagcuugauuggcgaugaagaauuuuuagacuacaugccaucaaugaaaagauucagaaaagaggaagaaagugaaggcgcaauuugguga

SEQ ID NO: 23498 - RNA, 9873 nt, Artificial Sequence
  derived and/or modified CDS sequence (opt6) from DENV-3__FJ461338__SS-prME
acguccuuaugucuaaugaugaugcuuccugcaacacuagcuuuucaucuuacuagccgugacggagaaccaagaaugauugucgggaaaaacgaaagagguaaaucauuacuauucaaaacagcaagugguauaaacauguguacccuuauugcaauggacuuaggagaaaugugugacgacacaguaaccuauaaaugcccccuaguagcagaaguggaaccagaagacauugauugcugguguaaucuaacuucaaccuggguuacuuaugguacgugcaaucaagcuggugaacauagaagagacaaacguucaguagcuuuggcaccacaugucggaauggggcuagauacucgaacacaaacauggaugucugcagaaggugcauggcgacaaguugaaaaaguagaaacuugggcucuaagacauccgggauuuacuauccuggcccuauuucuagcucauuauaucggaacuucauuaacccaaaaaguuguaauauuuaucuuacucauguuaguuacuccaucaaugacaaugagauguguagggguaggaaaucgugauuuuguagaagggcuuucgggugcaacuuggguagaugugguauuggaacauggaggauguguuacaacaauggccaaaaauaaaccgacccucgauaucgaacuucagaaaacagaagcgacacaacuagcuacacuaagaaaacuuuguauagaaggaaaaauuacaaacauaacaaccgauagucguuguccgacccaaggagaagcuauucuaccugaagaacaggaccagaauuauguauguaaacauacauacguugauagaggcuggggcaacggaugcggacuauuuggaaaaggaaguuugguaacaugugccaaauuucagugcuuagaaccaaucgaaggaaaaguaguucaguaugaaaauuuaaaauauacaguaauaauuacaguucauacgggggaucagcaccaaguagggaacgauacacaaggagugacgguggaaaucacuccacaagcgucaacuguagaagcaguacuaccagaauacggaacauuaggucuugagugcucaccgcgcacuggccuagauuuuaacgaaaugauccugcuuacgaugaaaaauaaagcauggaugguucacagacaaugguuuuucgauuugccguugccauggacaucaggagcaacaaccgaaacuccgaccuggaauaagaaagaauuacucguuacauucaaaaaugcucaugcgaagaaacaggaaguuguaguguuaggaucgcaagagggcgcuaugcauacggcguuaacgggugcaacagaaauucaaaacaguggcgguacauccaucuuugcggggcaucuaaaaugccguuugaaaauggacaaacucgaauuaaaaggaaugucauaugcaauguguuuaaauacauucguacucaagaaagaaguuucagagacccaacacggaacaauuuugauuaaaguagaauacaaaggagaggaugccccauguaaaauuccguucucaacagaagauggacaaggaaaagcccauaauggacgauuaauuacugcuaacccaguagucacuaagaaagaagaaccaguuaauauagaagcugaaccgccguuuggagaguccaauaucgugauuggaauaggggacaaagcccugaaaauaaacugguacaagaaaggcucaaguauaggcaaaauguuugaagcgacagcuaggggagcaaggcggauggcgauuuugggggacacagcgugggacuuuggaagugugggaggaguauuaaacucuuuagggaaaaugguacaccaaauuuucgguagugcuuauaccgcacuguucuccggugugucguggauaaugaaaaucggcauaggcguacucuugacuuggauuggucuuaauuccaaaaacacgagcaugucauuuucauguaucguaauagguauuaucacccuauaccuuggugcaguaguccaagcagauauggggugugccauuaauuggaaaggaaaagaauuaaaguguggaagcggcaucuucguuaccaacgaaguucacacauggacagagcaauacaaauuccaagcagacucacccaaaagacuagccacugccauugcgggugcgugggagaacggaguauguggcauucguaguacgaccagaauggagaaucuguuguggaaacaaauugcaaaugaauugaauuacauacuaugggagaauaauaucaaacuaacgguagugguaggagauaucauaggaguucuagagcaaggaaagcgcaccuuaacgccccaaccaauggaauuaaaguauaguuggaaaacauggggaaaagcaaaaaucguaacugcugaaacacagaacuccucauuuaucauagaugggccaaauacgcccgaauguccaucagcgucgagggcuuggaauguuugggaaguugaagauuauggauuuggcgucuuuacuacaaacauaugguuaaagcuaagagaggucuacacucaaaguugugaucaucguuuaaugucagcugccauaaaagacgagcgggcugugcaugccgauaugggauauuggauagaaucacagaaaaauggaagcuggaaacuggaaaaagcaucauuuauagaaguuaaaacuuguacuuggccaaaaagccauacacucuggagcaauggcguguuggaaucugacaugauuauaccgaaaucgcuggcagguccaaucucacagcacaaucacagaccuggauaccacacccaaaccgcaggaccauggcauuugggaaaacuugaauuagacuucaacuauugcgaaggaacuacaguaguaauuacagaaaacugcggaacaagggguccgagcuugcguacuaccaccguaagugggaaacugauccaugaauggugcuguagaagcugcacucucccaccucugcgauacaugggcgaggauggaugcugguacggcauggaaauuagaccgauaaacgaaaaggaagaaaauaugguuaaaagucuaguuucagcggguucggggaaaguagauaauuuuacgauggguguccuaugcuuagcaauauuauuugaagagguaaugcgaggaaaguuuggcaagaaacauaugauugcggguguucuuuuuacuuuuguuuuauuauuaucaggucaaauaaccuggagagauauggcgcauacuuugauaaugauugggucuaaugcaucugaucgaauggguaugggagugacauauuuggcauuaauagcaaccuucaaaauccaacccuuuuuagcacuaggauuuuuccuaaggaaauuaacuucacgggaaaaccuacuacucggaguagggcuagccauggcaacaacacuacaacucccagaagacauugaacaaauggcuaauggaauagcucucggccuaaugacgcugaaacuuauaacacaauucgaaacuuaucaacuguggacagcucuugucagcuuaacuugcucuaauacaauauuuacacuaacggucgcauggaggaccgcuacacuuauuuuggcagggguaucuuuacucccccuaugucaaagcaguaguaugaggaagacagauugguuaccaaugacaguugcagcaaugggaguaccuccacuaccacuauucauauucucauuaaaagauacuccaaagagaagaaguuggccgcuuaaugaaggaguuauggccgugggauugguuaguauacuagcgucaucauuacugcggaacgacguaccgauggcaggaccguuaguagccggaggucuuuuaauagcgugcuacguuaucacagguaccucagcagaucuaacggucgaaaaagcugcugacguuacgugggaagaagaggcggaacaaaccggagugagccauaaucuaaugauaacaguugaugaugaugggacaaugcggauuaaagaugaugaaacagaaaauaucuugacgguguugcugaagacggcgcugcugauaguaagugguauauuuccauauucaaucccugccacccucuuaguauggcacacguggcaaaaacagacacaacgaucgggaguguuaugggauguuccuagcccuccagaaacacagaaagcugaacuagaagagggagucuacagaauaaagcaacaagguauauucggaaaaacucaaguagggguuggaguacaaaaagaaggaguauuccacacaauguggcaugugacaagaggagcaguacuaacacauaauggaaaacgguuggaacccaacugggccucaguaaagaaagacuuaauauccuacgguggugguuggagacuuucagcacaauggcagaaaggugaagaaguccaaguaaucgcuguagagccaggcaaaaaucccaaaaauuuucaaacaaugcccggaauuuuucaaacaacuacaggcgaaaucggugcaauagcucuugacuucaaaccuggcacgaguggaaguccaauuauaaauagagagggcaaaguagucggucuauacggcaauggaguaguuaccaaaaacgguggcuauguaagcggaaucgcccagacgaaugcugagcccgaugguccaacucccgaauuggaagaggaaauguuuaagaaaagaaauuuaaccaucauggacuuacacccuggcucaggaaagacuagaaaauacuuaccugccauagugagagaagcuauuaagagacguuugagaacacuuauacuugcgccgacacguguaguagccgcugaaauggaagaagccuuaaaaggauuacccauaagauaucaaaccacagccaccaagucagagcauacuggacgugagaucgucgaucuuaugugccacgcaacauuuacuaugcgauuacuuagcccggugcgaguaccuaacuacaaccuaauuauuauggacgaggcgcacuucacugauccugcuucaauagcagcacgaggauauauaagcaccagagucggcaugggugaggcagccgcaaucuuuaugaccgcuacgccgcccggaacugcugaagcguuuccgcaaucgaaugccccaauacaagacgaagaacgggauauaccugaaaggucguggaacucugguaaugaauggauuacugacuuuguuggaaagacaguaugguucguaccaucuauaaaagcuggaaaugacaucgcuaauuguuuaaggaaaaacggcaagaaaguuauacagcuguccagaaaaacuuucgacacugaguaucaaaagacccgauuaaaugacugggauuuuguagucacgacagacaucucugaaaugggagccaauuucaaagcugaucggguuauugaucccagaagauguuuaaaaccagucauuuugacagacggaccugaaagagugauauuggcaggacccaugcccguuacagccgcaagcgcagcacaaagaagggggcguguuggaagaaauccucaaaaagagaaugaccaauacauuuucaccggccagccgcucaauaaugacgaagaucacgcacauuggacugaagcaaaaauguuauuggacaauauuaacacuccagagggaauuauaccugcacuguucgagccggagcgagagaaaagugccgcuauugauggagaauaucgacuuaaaggcgagucgcguaaaacauuuguggagcuaaugcggagaggagaucuaccugugugguuggcccauaaaguggcaagugaagggauaaaauauacagaccguaaauggugcuuugauggugaacguaauaaccaaauauuggaagaaaauauggacgucgagauauggacgaaagagggcgagcgaaagaaacuucguccgcguugguuagaugcuagaaccuauucagauccgcucgcuuuaaaggaauuuaaggacuucgcugcaggaaggaaaucuauugcccucgauuuaguuacggagaucggacguguaccuagucaccuagcauacaggacuaggaacgccuuagacaaucuaguaaugcuucacacaucagaacauggcggcagagcauacaggcaugcaguagaagaacucccggagacaauggaaacuuuauuacucuuagguuuaaugauuuuauuaacaggaggggcgaugcuauuccugauaucagguaaagggauugguaaaacaucuauaggguugauauguguaauaguaucgaguggaaugcuauggauggcagauguaccacuucaauggauagcuucggcuauaguucuugaguucuuuaugaugguuuuauuaauacccgaaccagaaaaacaacgcacuccccaagacaaucaauuagcuuaugucgucaucggaaucuugaccuuagcugcaauaguugcagcaaaugaaaugggucuguuggaaacaacgaaaagggacuuaggaauguccaaagagcccggcgucguaagcccaacguccuacuuagauguagaccuacauccugcuagugcguggacauuauaugcaguggcaaccacagugauuacaccuaugcucaggcauaccaucgaaaauuccacugcuaaugugucgcucgccgcgauugcaaaccaggcaguaguccucauggguuuggacaaaggauggccuauaagcaagauggaucuaggcguuccccugcuggcacuaggauguuauucucaagugaauccacuaacauugacugccgcaguauugcuuuugguaacgcacuacgcuauaauagggccgggauugcaagccaaagcaacuagggaagcgcagaaaaggacugcggcagggauaaugaaaaauccaacagucgacgggauaaugacuauugauuuagaucccguaauuuacgauagcaaauuugagaaacaauugggacaaguuauguuacuggugcuuugugccguacaauuacuauuaaugagaacaaguugggcacugugugaagcucuaacacuagcuacaggaccaauaacaacguuaugggagggaaguccgggaaaauuuuggaacacaacaauugcaguuucaauggcgaauauauuuagagguuccuaucuugcgggggccggauuggcauuuaguauaaugaagucuguagguacugguagaagaggaacugguucucaaggcgaaacucucggcgaaaaauggaagaagaaacucaaccagcuuagucgaaaagaguucgauuuauauaaaaagucgggaauaacugaagucgauagaacggaagcaaaggaaggauuaaaacgaggugaaacuacucaccacgcaguuuccaggggaucugcaaaguuacagugguucguugaaaggaauauggugauaccagagggaagagugauugaucugggcuguggucgcgguggauggagcuauuacugugccggccucaaaaaggucacagaaguaagaggauacacgaaaggaggcccagggcacgaggagccagugccaaugucaacuuaugguuggaacauaguaaaauugauguccggcaaagaugucuucuaccuaccaccagaaaaaugugauacuuugcuaugugacauaggagagucaucaccuaguccaacuguggaagagucaagaacaauaaggguuuuaaaaaugguagaaccaugguugaaaaauaaccaauuuuguauuaaaguauuaaacccauacaugccuacugugauagaacaccuagaacgacuucaaagaaaguauggugguaugcuaguuagaaauccccuaucuaggaacagcacacaugaaauguauuggauaagcaaugguacagguaauauaguaagcucagucaauauggugucuagacucuuacuaaacagauucacuaugacucauagaagaccaacaauagaaaaagacgucgauuugggagcgggcacuaggcauguuaacgcagagccugaaacaccaaauauggauguaauaggagaacgcauuaaacggauaaaggaggaacauucgucuaccuggcacuaugaugaugagaauccuuacaaaacaugggcuuaucacggaagcuaugaagugaaagcuacggguagugcaucguccaugaucaaugguguagucaaauuacuaaccaaacccugggacguaguuccuauggucacccaaauggcuaugacagauacuacgccauuugggcagcaacgcguuuuuaaagagaaaguagauacaagaacuccgcgaccaaugccugggacacggaaaguaauggaaauuacagcugaaugguuauggagaacacuugggcggaauaagaaaccaagacuuugcacuagggaagaauuuacgaaaaagguaagaacuaaugcagcuaugggugcuguuuucacggaggagaaucaaugggauucagcucgggcugcaguugaggacgaggaauuuuggaaacucgucgacagagagagagagcuucauaaacucggaaagugugguagcuguguguacaauaugaugggcaaacgugagaagaaacucggagaguuuggaaaagcaaaagguagucgcgcaauaugguacaugugguugggggcaagguaucuugaauuugaagcacuuggauuuuugaacgaggaucauugguuuuccagagaaaacuccuacucuggagucgaaggagaagguuuacauaaguuagguuauauccuacgagauaucucuaaaauaccuggaggugcuauguaugcggaugacacagccggcugggauacacgaauuacugaagacgaucuccacaaugaagagaaaauuacgcaacaaauggauccugagcauagacaauuggcuaaugcgauauuuaaacuuacauaccaaaauaagguagucaaaguucagcgaccaacuccgaaaggaacuguuauggauaucauaucacgaaaagaccaaagaggaucagggcaagucggaaccuauggauuaaacacuuuuacaaacauggaggcgcaauugguaaggcaaauggaaggugaaggaguucuaucaaaagcugacuuagaaaauccacaccuccucgagaagaaaaucacgcaaugguuagaaacaaaagguguugaacgacucaaacgaauggcgauauccggagaugauugugugguuaaacccauagaugaucgauuugccaaugcauugcuagcucuuaaugacauggguaagguaagaaaggacauaccacaguggcagccaaguaaaggguggcacgacuggcaacaaguaccguucuguagccaccacuuucacgaguuaauaaugaaggauggccgaaagcuaguagucccaugucgcccccaagacgaacucaucggcagagcaaggaucagccagggagcgggauggucucucaaagagacagcaugccuagguaaggcuuacgcacaaauguggagccuaauguauuuccaccgacgcgaccuucgauuggcaucuaacgcuauuugcagugccgucccaguucauuggauuccgacaagucgaacaacuuggaguauacaugcacaccaucaauggaugacuacagaagacaugcuuacagucuggaaccguguauggauagaggacaacccauggauggaagacaaaacuccaguaaccacuugggaagauguuccuuaucuagggaagcgcgaggaucaauggugcggaucacugauaggcuugacuagccgagcaaccugggcgcaaaauauuuuaacagcaauccaacaaguccgcucuuuaauaggugaugaagaauuucuugacuacaugccuagcaugaagcguuuccgaaaggaagaggaauccgagggagcuauaugguaa

SEQ ID NO: 23499 - RNA, 9873 nt, Artificial Sequence
  derived and/or modified CDS sequence (opt6) from DENV-3__FJ562103__SS-prME
acuucucuaugcuuaaugaugaugcuaccggcaacgcuagccuuucauuugaccagucgagauggagaaccgaggaugauugucgguaaaaacgaaagaggaaaauccuuacuguucaaaacugccaguggcauaaauauguguacucuuaucgcaauggaccuaggggaaaugugugacgacacuguaacguauagguguccauuaauagcagaagucgagccagaggauauugauugcuggugcaacuugaccuccacauggguuacauaugguaccuguaaccaagcgggcgaacauaggcgagauaaaagaucaguagcacuagcaccucauguuggaaugggcuuggauacgagaacucaaacguggaugucggcugaaggugccuggcgacaaguugagaaagucgaaacuugggcacuacgucacccagguuucacaauccuugcacuuuuccuggcacauuauauagguaccucacuaacacaaaaagucgucauuuuuacauuauugaugcuagucacgccaaguaugacaaugagaugugucggagucgguaaucgagauuuuguagaaggacucucuggagcaacuuggguagaugucguacuugagcacggaggaugcgucacuaccauggcuaaaaauaagccaacucuagauauagagcuucaaaagacugaagcaacgcaacuugccacauuacgaaaguuguguauagaggggaagauuacaaacauaacaacagauaguagaugcccgacgcagggcgaagcaauccuaccagaagaacaagaucaaaacuaugucuguaaacauaccuauguggacagaggcugggguaauggcuguggacucuuuggaaagggaaguuuaguaaccugcgcuaaauuccaaugccuagaacccaucgaagguaaagucguacaauacgaaaauuuaaaauacacugucauaaucacuguucauacgggagaccaacaccaagugggaaacgacacacaaggaguaacuguagaaauaacgccucaggccucuacuguggaagcaguacugccggaauaugggacucuaggacuggaguguaguccuaggacugguuuagauuucaaugaaaugauuuuacuaacuaugaaaaacaaggcuuggaugguccaccgacaaugguucuucgauuuaccuuugccuuggacaaguggagcgacuacagaaacaccgacguggaacagaaaagaacucuuaguaacauucaaaaacgcucacgccaagaaacaagaaguaguugugcuugggagucaagagggagccaugcauaccgcuuuaacgggggcaacggaaauucaaaauagcggcggcacaaguauauucgcgggccauuugaaaugucgacuaaaaauggauaaauuagaguugaaagguaugagcuaugccaugugucuaaauacguucguacucaagaaagaagucucagaaacacaacaugggacgauacugauuaaaguugaauacaaaggagaagaugcaccauguaaaauaccauuuaguacagaagacgggcaaggcaaagcacauaaugggagauugauaacagcuaauccuguagugacaaagaaagaagaaccaguaaauauagaagcugaaccaccuuuuggggaauccaauauugucauagguauagguaacaaagcguuaaaaaucaauugguauaagaagggaagcagcauaggaaaaauguuugaagcaacugcaagaggggcaagaaggauggccauccugggagauacggccugggauuuuggaucaguggguggggucuuaaauaguuuagguaagaugguacaucaaauuuuuggaucugcauauacugcauuguuuagcggcguaucauggauaaugaagaucggaauuggcguauuauugacuuggauaggauuaaauuccaagaacaccucgaugaguuuuuccuguauaguaauuggaauuauuacauuguauuuaggcgcaguuguacaggccgauauggguugugcaauaaacuggaaagguaaagagcuaaaaugcggcucgggaauauucgucacaaacgaaguccacacauggacagagcaauauaaauuucaagccgacucuccgaagagacuugcaaccgcuauagcuggagcaugggaaaaugggguuugcggcauaagaucaacaacaagaauggaaaacuuacuauggaagcaaauagcaaaugaauugaauuacauauuaugggagaauaacauaaaauuaacaguagugguaggggauauaaucggaguguuagagcaaggaaaaagaacguuaacuccgcagccuauggagcugaaguauaguuggaaaacaugggggaaagcaaaaauaguuacagcggaaacacaaaauuccucauuuauaaucgaugguccaaauacaccagaaugccccucggccucacgggcuuggaacguaugggaaguagaagacuacggauuugggguauuuaccacgaauaucugguugaaacucagagaggucuauacccaauccugugaucauagauuaaugucugccgccauuaaagaugagagggccguacacgcagauauggguuacuggauagaaagccagaaaaaugggucauggaagcuagagaaggccagcuuuauugaagucaaaaccuguacauggcccaaaucgcauacucuaugguccaauggaguucuagagagugauaugauaauaccuaaaucccuagcaggcccuauuagucagcacaaccaucguccugguuaucacacccaaacggcaggaccauggcaucuaggaaaauuagaauuggauuuuaacuacugugagggaacaacuguaguaauaacagaaaauuguggaacacgagggcccucgcugcguacuacuacuguaagcggaaaacuuauacaugaaugguguugccgaucaugcacccugccacccuuaagguauaugggagaagauggauguugguauggaauggaaauccgcccaaucaaugaaaaagaagaaaauaugguaaaaagucuaguaucagccgguucaggaaaaguugauaacuucaccaugggagucuuaugcuuagcaauucucuucgaagaaguuaugagaggaaaauuuggcaagaaacauaugauagcaggagugcuuuuuacauuuguauuauuauuaagcggccaaauuaccuggcgagacauggcucacacauuaauaaugauugguaguaaugcaagugaccgaauggggaugggaguuacguacuuagcauuaauugcgaccuuuaaaauucaaccauuccuugcacuaggauucuuucuacgaaaacuuaccagcagagaaaaucucuuauuaggagucggacuagccauggcaacaacauuacagcuaccagaagacauugagcaaauggcaaaugggaucgcguuaggauuaaugacacucaaauuaauaacucaguuugaaacuuaccaauuguggacagcauugguaucccuaacauguaguaauacuaucuucacuuuaacgguagcauggcguacugcaacauuaauccucgcuggugugucacuguuaccuuuaugucaguccagcaguaugagaaaaacggauuggcuaccuaugaccguggcugcgauggggguaccgcccuugcccuuguuuauauuuagcuuaaaagauacaccgaaaaggagaucuuggccuuuaaaugaaggaguuauggcaguugguuugguaucuauucuagcgaguaguuuacuuagaaacgaugucccuauggcaggcccguugguagccgggggacuucuaauagcuugcuauguuauaacaggcacauccgcagaucuaacaguggaaaaagccgccgacguuacuugggaagaggaagcagaacagacaggggugucucauaacuugaugauaacugucgaugaugacgguacuaugcgcauaaaggaugaugagacagaaaacauauugacaguucuccugaaaacagcuuuacuaauagucaguggaauauuucccuacaguauaccugccacucuguugguuuggcacacauggcaaaaacaaacacaacgaucuggaguacuuugggauguaccuucuccaccugagacacaaaaagccgaauuagaagaagggguauacaggauaaagcaacaaggaauauucggcaaaacacagguaggggugggaguacaaaaagaagggguauuucacacaauguggcauguaacgagaggcgcuguuuugacacauaauggaaaacgacuugaacccaauugggcgucugucaagaaagauuuaauuaguuaugguggggguuggagacuaucagcacaauggcaaaaaggagaggaagugcaagugauugcugucgaaccagggaaaaacccgaaaaacuuccagacuaugccugggauuuuccaaaccacuacaggugaaauuggggcuauugcauuagauuucaaaccgggaacgucaggcaguccaauaaucaacagggagggaaaaguuguaggauuguacggcaaugggguuguuacuaagaacggagguuacgucuccggaauagcacaaacaaacgcagagccagauggaccuacaccagaauuagaagaagaaauguuuaagaaaagaaaccugacuauuauggaucuucacccagguucugguaaaacgagaaaguaucuuccggccauaguucgugaagcgaucaaaagacgucuaagaacauuaauacuggcaccaacacgagucguagcagcagaaauggaagaagcacuaaaaggauugccgaucagauaccaaaccacagcgaccaaaucagaacauacaggaagagaaaucguagaucuaaugugccaugccaccuuuacaaugcgacuucuaaguccaguaagaguaccuaauuacaaccuaauaaucauggaugaagcacacuuuacugacccggcuucgauugcugcacgaggauacaucucuacucgcgugggaaugggagaagcagcggcuauauucaugacugccacgccucccggcacagcugaggcuuuuccacaaucgaaugcgccuauccaagacgaagaaaaagacauaccagaaagaaguuggaacucaggcaacgaauggauaacggauuucguggggaagacaguaugguucguuccaagcauuaaagcaggcaacgacauugcuaacugccuuagaaagaaugggaagaaagucauccaauuauccaggaaaaccuucgauacagaauaccagaaaacucgauugaacgauugggacuuuguaguaacaacugacauuucggagaugggagcaaauuucaaagcagauaggguaauugaccccagacguuguuugaaaccagucauucugaccgauggcccagaaagaguaauccuagcugggccaaugcccgucacugccgcaucagccgcacaaaggcgggguagaguaggacgcaauccgcaaaaagaaaaugaccaauauaucuuuacaggacaaccuuuaaauaacgaugaggaccaugcacacuggacagaagcaaaaaugcuauuagauaacauuaacacgccagaaggcauaauaccugcucuguuugaacccgagcgugaaaaauccgcugcaauagauggagaguacagguugaaaggagaaucgaggaagaccuuuguagaauuaaugagaagaggagauuugcccguauggcuagcacacaaaguagcaucagaagguauaaaauacaccgaccgcaaauggugcuucgauggcgagcgaaauaaccaaauucuggaggagaacauggacguagaaaucuggacaaaagagggagaacggaagaaauuaaggccucgaugguuagaugcgcguacuuauucggauccacuagcuuuaaaagaauuuaaagacuuugccgcaggcaggaagucaauugcgcucgaucucgugacagaaauaggccgcguaccaagccaccucgcuuacagaacacgaaacgcuuuggacaacuuagugauguuacauacuucagaacauggaggcagggcguauaggcaugcaguggaggaacuuccagaaacaauggaaacgcuccuucuccuaggcuuaaugauuuuauuaacuggaggcgcuauguuauuccucauaucagggaaagguauaggcaaaacaaguauaggacuuauauguguaauugucucaucaggaaugcuuuggauggcggauguuccccugcaauggauagcgucagcaauagucuuagaguuuuucaugauggugcuacucauacccgagccggagaaacaaaggacaccgcaagauaaucagcuugcauaugucgugauuggaauccuuacacucgcagccauuguugcugccaacgaaaugggccuccuagaaacaacaaaaagagauuugggaauguccaaagagccaggcguagugucaccaacaaguuaucuggauguagaucuucauccagcauccgcauggacucuauaugcaguggcaacaacaguuauaacaccuaugcuaagacacacaaucgaaaauaguacagcaaaugugucacuagccgcuaucgcuaaucaagcaguuguacuaauggguuuagauaaaggcuggccaauaucuaaaauggauuuagguguucccuuauuagcccuuggauguuacucucaaguaaacccauuaacgcucacugccgcaguccuauugcuaguaacccacuaugccaucauaggacccggcuuacaggccaaagcaacaagggaagcgcagaaaaggaccgcagcggguauaaugaaaaauccuacaguagauggaauuaugacuaucgaccucgacccgguuauauacgauucaaaauuugaaaaacaauuggggcaaguaauguuacugguauuaugugccguacaacuguuacuaaugagaacaucaugggcguugugugaagcccugacauuagcuaccggaccaauaacaacauuaugggaagguaguccagggaaauuuuggaauaccacaauagcugugaguauggcuaacauuuuucgcgggagcuacuuggcuggugcaggauuggcuuucaguauuaugaaaucgguggguaccggucguagggguacaggaucacaaggcgagacuuuaggagaaaaguggaagaagaaauuaaaucaacuuucgcgcaaagaauuugauuuauacaaaaagaguggcaucaccgaaguggauaggacggaagcaaaggagggucuuaaaaggggagaaacaacgcaccaugcugugaguagagggagcgcaaaacuccaaugguuuguggaaagaaauaugguaaucccagaaggucgaguaauagaccuaggcuguggucgaggaggcuggucuuauuacugugccggccuaaagaaaguuacagaaguacgaggauauaccaagggcgguccaggccaugaggaaccaguacccaugagcacuuauggauggaauauagucaaacuaaugaguggaaaagacguauuuuaucugccaccagaaaaaugugauacguuauuaugugauauaggcgaaaguaguccuucuccaacaguugaggaaucacgaacaauucgaguccuuaaaaugguagaaccuugguugaaaaauaaccaauuuuguauuaaaguguuaaauccguacaugccuacaguaauagaacaucucgagcggcuucagcguaaauaugguggaaugcuuguuaggaaucccuugucccguaauagcacgcaugagauguauuggauaaguaauggaacuggcaauauaguuagcagcgugaauaugguaucaagauugcucuuaaaccgauuuacgaugacacacagacguccuacuauugaaaaggaugucgauuugggagcuggaacuagacauguuaaugcagaaccagagacgccuaauauggauguaauaggugagcgaauaaaacggauuaaagaagaacauagcucuacguggcacuaugaugacgaaaacccguacaaaacuugggcauaucauggauccuacgaaguaaaggcaaccggaagcgccaguucaaugauuaacgggguaguuaagcuacugaccaagccaugggacguggugccaauggugacccagauggcuaugaccgauacgacuccguuuggucaacagagaguuuucaaggaaaagguugauacaagaacaccaagaccaaugccuggaacaaggaaaguaauggaaauuaccgcugaaugguuauggcgaacccuaggacgaaauaagaaaccaaggcuaugcacgagggaagaauuuaccaagaaaguaaggacaaacgcggcuaugggugcuguauucacagaggagaaucaaugggacucagcucgagccgcaguggaagaugaagaauuuuggaaguuaguugaucgagaaagggagcuccauaagcuagggaaguguggcagcugugucuauaauaugauggggaagcgggaaaagaaauuaggugaguucgguaaagcgaagggaucaagagcgaucugguacaugugguugggagcgagguaucucgaauuugaggcauuggguuuucuaaacgaagaccauugguucucucgcgaaaacucauacagcggggucgaaggagagggacuucacaaacuuggauauaucuuaagggacauaucaaaaauuccaggaggagcaauguacgcugaugacaccgcuggaugggauacacguauuacagaggacgaucuacacaaugaagagaaaaucacucaacaaauggacccagaacacaggcagcuggcuaacgcaauuuuuaagcuaacguaccagaauaaagucgugaaaguacagagaccgacuccaaaggguacgguaauggauauuaucuccaggaaagaccagcgugggagcgggcagguugguacguaugggcucaauacauuuaccaacauggaagcacaguuagugagacaaauggaaggggaaggcguccuaaguaaagccgaucuagaaaauccccacuuauuagagaagaaaauaacgcaaugguuagaaaccaaggguguggaacgcuuaaaaagaauggcaauauccggagacgacuguguggugaaaccuaucgaugauagauuugcaaaugcauugcuagcauuaaacgacaugggaaagguacgaaaagauauaccacaauggcaaccuagcaaaggauggcaugauuggcagcaagucccuuucugcucccaucauuuucaugaauuaauaaugaaggacgggagaaaacuuguagugccaugucggccacaagaugaacuuauagguagggcaagaauaagccaaggggcagggugguccuuaaaggaaaccgcuugucuaggcaaggcauacgcccaaauguggaguuuaauguauuuccauaggcgcgaucuaagauuagcgucgaacgcaaucuguagugcuguuccagugcacuggauaccuacaagcaggacgacauggucaauacacgcgcaccaucaguggaugacuacagaagauaugcucacuguauggaaccguguauggauagaggacaacccguggauggaagacaaaacaccugugacaacuugggaagacauaccguauuuaggaaagcgugaagaccaauggugcgggaguuuaauaggacuuacaaguagagcuacuugggcacaaaauauauuaacagcaauacaacaaguuagaucauuaauaggugaugaggaguucuuagauuauaugccuagcaugaaacgauuuagaaaggaagaagaaagugaaggugcaauuugguaa

SEQ ID NO: 23500 - RNA, 9873 nt, Artificial Sequence
  derived and/or modified CDS sequence (opt6) from DENV-3__FJ898456__SS-prME
acuucucuauguuuaaugaugaugcuuccugcuacuuuagcuuuucacuuaacaagucgcgauggugaaccacggaugaucguaggcaaaaaugaacgaggaaaaucacugcuauuuaaaacggcaucaggcauaaauauguguacccugauagcuauggauuugggagaaaugugugaugauacuguaacuuauaaaugcccacucauaaccgaaguagaaccagaagacauagauuguuggugcaaccucaccucaaccugggucacauaugggacuuguaaucaagcaggagaacacagaagagauaaaagaucaguugcacuugcaccacacgucgguaugggauuggacacucguacacaaacauggaugucggcagaaggagccuggagacaaguagaaaaaguugaaaccugggcuuuccgucauccaggcuuuacaauucucgcauuauuucuugcccauuauauuggcacgucauugacucaaaaaguugugauauuuauccugcuuauguuggugacuccaucgaugacaaugcgcugcguggggguagggaauagagauuucguugaaggauuauccggggcaacuuggguggacguaguuuuagaacacggcgguugcguaacgacgauggccaaaaauaaaccaacauuggauaucgaacuucagaaaacugaagccacacaacuggcaacccuaagaaaacucugcauagaagguaaaauuacgaacguaacgacggauaguagaugcccuacacaaggggaagcuaucuuacccgaagaacaagaccaaaauuaugucuguaaacauacauauguggacagaggcuggggaaacgggugcggauuauucggaaaaggcucuuuaguaaccugugccaaauuucaaugucuugaaucaauugagggcaaagcaguacaacacgaaaaccuuaaauacacagucauaauuaccguacacacuggagaccaacaucaaguuggaaaugagacgcaaggaguaaccgcggaaauaacuccccaagcaagcacaguagaggcuauacuccccgaauauggaacgcuaggacuugaauguucaccaagaacuggcuuagauuuuaaugaaaugauccucuuaacgaugaaaaacaaggcuuggaugguacacaggcaaugguucuucgauuugcccuuaccuuggacaagcggugcuacuacggaaacacccacauggaacaagaaagaauuauugguaacauuuaaaaacgcacaugccaagaaacaagaggucguuguuuuggggagucaagagggugcaaugcauacggcguugacaggcgcaaccgagauucagacgucuggaggaacgagcauauuugcaggacaucucaaauguagauuaaaaauggauaaauuagaacuuaaaggcaugaguuaugcaaugugcuugaaugcuuuuguauuaaagaaagaaguuagugaaacccaacauggaaccaucuugauuaaagucgaguauaaaggagaggacgcuccauguaaaauaccauuuagcacagaagacggacaaggaaaagcucauaaugggagguuaauuacagccaacccuauagugacuaagaaagaggaaccagugaacauagaagcugaacccccauuuggagaaucaaacauagugauaggaauaggcgauaaagcacugaaaauuaacugguauaagaaaggaucauccauaggcaaaauguucgaagcaacggcaagaggagcuaggagaauggcaauccuuggagacacugcaugggauuucgggagugucggagggguacugaacucgcuuggaaaaaugguucaccaaauuuucgguagugcauauaccgcucuauucucuggggugagcuggauaaugaaaauugguauaggcguguuacuaacauggauugguuuaaacuccaaaaauaccucgaugucguucuccuguauaguaauaggaauuauaacauuauaccuuggagcgguggugcaagcggacaugggaugcguuaucaauuggaaaggcaaagaauuaaaaugugggucaggaauuuucgugaccaacgaaguacauaccuggacggaacaauauaaauuucaagcugacaguccuaaaagauuagcaacagcuauagcaggagcaugggaaaacggcgucuguggcaucagaaguacgacacguauggagaauuuacuuuggaaacaaauagcuaacgaacucaauuauauuuuaugggagaacaauauaaaacuaaccauaguagugggggaugugauuggaauacucgaacaaggaaaacgaacguuaacaccacaaccuauggaacuuaaauacaguuggaaaaccuggggaaaggcuaaaauaguaacugccgaaacucagaauaguaguuuuauuaucgaugguccaaacacgcccgagugcccgucagcaucgagagcguggaacguuugggaaguagaggacuacggcuucggcguauuuacaacuaauauauggcuaaaacuuagggagauguacacacaacuaugcgaucacagauuaaugagcgcagcagucaaggaugagcgagcuguccacgcagauauggguuacuggauagaaucacagaaaaauggcucauggaaacucgaaaaagccagucuaauagaggucaaaacuuguacauggccuaaaagccauacauuauggaguaauggugugcucgaauccgacaugauuauaccaaaaagccuagcgggaccaauaucacaacacaauuauagaccuggguaucauacgcaaacagccggaccguggcaucuagguaaauuagaauuagauuucaauuauugcgaaggaacuacgguaguaaucaccgagaauugugguacaaggggccccagcuuaagaacaacaacaguaucaggcaaacuaauucaugaauggugcugccgaucaugcacauuaccaccacugagauauaugggggaagacgguuguugguauggcauggaaauacgaccaaucaacgagaaggaggaaaauaugguaaaaucucugguuagugcgggcagcggcaaagcagauaacuucacaaugggcgugcuaugucuggcaauauucuuugaagaggucaugaggggcaaauuugggaagaaacauaugauagcuggcgcgcuauuuacauuuguauuacugcuaucuggacaaauaaccuggagagauauggcucacacacuuauaaugaucggaucgaaugcuagugaucgaaugggaaugggaguaacauauuuagcucuaauugcaacguucaagauucaaccguuucuagcauugggcuucuuucucagaaaauuaacgagcagagaaaacuuauuacucgguguaggccuggcgauggccacgacccugcagcuaccugaggauauagaacagauggccaauggcaucgcauuaggacucauggcccuaaaacuuauaacacaauuugaaacuuaucaacuauggacagcguuaguuagccuuauguguuccaacacuauuuuuacauuaaccguugccuggaggacugcgacccuuauacuugcggugauuucacugcuaccaguuugucaaucgaguaguaugcguaaaacugacuggcuacccaugacggucgccgcgaugggaguuccuaguuugccguuauucauuuucucccuaaaggauacacuuaaaagaagaaguuggccucuuaaugaaggcguuauggcagucggguuaguuucuauauuagccuccucauuuuugcguaaugauguacccauggcugggccccucguagcgggaggauuacuuauugcuuguuaugugauuacaggaacaagugccgauuugacuguagaaaaagcagcugacguaacgugggaagaagaagcagaacaaacuggaguaucacacaacuuaaugauuacugucgacgacgacgggacaaugaggauuaaagaugaugagacugaaaacauccucaccgucuugcucaaaacugcauuacuuauagugucaggcaucuuuccuuauaguaucccugcgacccuacucguguggcauacuuggcagaaacaaacgcaaaggagcggcgucuuaugggaugugcccuccccgccagagacucagaaagcagaauuagaagaagggguauaucgcaucaaacaacaagggauauuugggaagacacaaguuggaguuggaguccaaaaggaggguguauuccauacaauguggcaugugacuagaggagccguacuaacccauaauggaaaaaggcuagaaccuaauugggcuaauguaaagaaagacuuaauaucauauggcggcggguggaaacuuagcgcacaguggcaaaaaggugaagaagugcaaguaauagcuguagaaccugggaaaaacccaaagucauuccaaacuaugccagggauuuuccaaacaacgaccggagaaaucggugccaucgcucuggauuuuaagccagguacaucuggcucacccauuauaaaucgugaaggaaagguaguaggguuauacgguaacggaguaguuacuaaaaaugguggcuauguaaguggaauugcacaaacaaaugcagaaccugaugggccaaccccagaguuagaggaagaaauguuuaagaaacguaacuugacaauuauggaccugcauccgggcucaggcaaaacacgaaaauaucucccggcaauaguuagagaggcaauuaaacggagacuccgcacgcucauacuagcaccaacuagaguaguugcugcagaaauggaagaagcacugaaaggauuacccauacguuaccaaacaacugcuacaaaaucugagcauacagguagggaaauagucgaccuaaugugccaugcuacauucacaaugagauuacuaagcccggugcgagugccaaacuauaaccuaauuguuauggaugaagcucauuucaccgauccugcaucgaucgcugcaagaggauauauaaguacucgaguggguaugggugaagcagcagcgauauuuaugacggccaccccaccggguacagcagaugcauucccacaaucuaacgccccgauacaagacgaggaacgagauauccccgaacgcucauggaacagcgggaacgaguggauuacagacuucgcgggaaaaacaguaugguuuguacccucgauaaaggcagguaaugauaucgcaaauuguuugaggaaaaauggcaagaaaguaauucaacuuucgagaaagacuuuuaacaccgaguaucagaagacuaaguugaaugacugggacuuuguugucacgacagacauuucagaaaugggagccaauuuuaaagcugaucggguaaucgacccgagaagaugucuaaaaccuguaauacuaacagacggaccugagcgaguuauauuagcggggccuaugccugugacaguugccuccgcugcacaacgcagagguagaguuggccgaaauccgcaaaaagaaaaugaucaguacauuuuuacuggucaaccucucaauaacgaugaagaccacgcacacuggaccgaggcuaagaugcuccuagauaacaucaauacaccugaagguauuauucccgcccuuuucgaaccugaaagagaaaagucagcugcaauugacggcgaauaucgucugaaaggugaaucaagaaagacauuuguggaauuaaugagaaggggagaucucccggucugguuagcacacaaaguugcaagugaggguauuaaguacacugaucguaaaugguguuuugauggagaaagaaacaaucaaauucuggaagaaaauauggacguggaaauauggaccaaagaaggugaaaagaagaaacuaagaccuagaugguuggacgcaagaacauacucugacccacuagcgcuaaaggaauuuaaggacuuugccgcugggcgaaaaaguauagcucuagaccuagugacagaaauuggaagagucccaucacaucuagcucauagaacgagaaaugcguuagauaaccuuguaauguuacauacaucagaacacggaggucgagccuauagacacgcaguagaagaacuccccgagacaauggagacauuacucuuauuaggacuaaugauccuauuaacaggaggggccaugcuguuccuaaucucgggaaaaggaauaggcaaaacuagcauaggacuaauauguguaguugcgucuucggguaugcucuggauggcugaugucccacugcaauggauugccucagccauaguccuagaguucuuuaugaugguuuuguuaaucccugaaccagaaaagcagcguacuccgcaagauaaccaacuugcguaugucgugaucggaauacuaacacuagcagcgauuguggcagcaaaugaaaugggcuuauuagaaacgacaaaaagggaucuuggaaugucaaaagaaccgggaguuguaucuccaacaaguuaucuugauguagaccuccauccugcuucagcuuggaccuuauaugcuguagcaacaaccguuauaacgccaauguuacggcauacaauugaaaacagcacggcaaacgucagcuuggcugcgauugcaaaucaagcuguuguacucaugggccucgauaaaggauggccuauuaguaaaauggaucuggguguacccuuauuagcucuaggauguuacucacagguaaacccauuaacacuaacagcagcuguucugcuguuaguaacucacuaugccauuauaggaccuggacuccaggcgaaggcuacaagagaagcgcaaaaacggacugcggcgggaauuaugaaaaaucccacaguugauggcauuaugacaauugauuuagauccaguuaucuacgacucaaaauuugaaaaacaauuaggacaagucaugcugcuagugcuaugugcaguacaacuucuucucaugcguacuucaugggccuuuugcgaagcacuuacauuagcaaccgggcccauuacaacuuugugggaaggaucgccagguaaguuuuggaauaccacuauagcaguuuccauggcaaauaucuuuagagguuccuaucuugccggagcaggucuugcguuuucaaucaugaaaaguguagggacaggaaaaagagguacugguagccaaggagagacauugggggagaaauggaagaagaaauuaaaccaacugucuaggaaagaguucgauuuauauaagaaaagcggaauaacugagguagagcgaacggaagcgaaagaaggacuaaaaagaggugagauaacucaucaugcgguuucaagagguucagccaaacuacagugguuuguagaacgaaauauggugauacccgaagggagaguaaucgacuugggcuguggucggggaggcuggagcuacuauugugcaggucucaagaaaguaacugaaguaagagguuauacaaaaggggguccuggccaugaggaaccgguuccgaugagcacauauggauggaacauugugaaacucaugagcggaaaagacguauuuuaucuuccuccagagaaaugugacacgcuuuugugugacauuggggaaagcucuccaagcccgacaguugaggagaguagaacaauaagaguccuaaaaaugguugaaccauggcucaaaaacaaccaauucuguauaaaaguacuaaauccguauaugcccacagugauagagcaucuagaaagguuacagagaaagcacgguggcauguuaguacguaacccucuaagucggaacucuacucaugaaauguacuggauuucaaauggaacgggaaauauaguaaguaguguuaauaugguaucccgacuucugcuaaauagauucacaaugacgcauagacgcccuacaaucgaaaaagauguagaccuaggcgcagguacaagacauguuaaugcggagccagagacaccaaauauggauguuaucggugaacggauaagacgcauaaaagaagaacauagcucuacguggcauuaugaugacgaaaacccuuauaagacgugggcuuaccauggaagcuaugaagugaaagcaacagguagugcaucaagcaugauaaauggcguaguaaagcuguuaacgaaaccgugggaugucguuccuaugguaacucagauggcuaugacagauacaacaccauucggacaacaaagagucuucaaagaaaaaguugauacaagaacgccacggccaaugccgggaacccgaaaaguaauggagauuacagccgaguggcucuggcgaacccuaggaaggaauaaacgaccaagacucugcacgcgagaagaauuuauaaagaaagucagaacuaaugccgcuaugggagcuguauuuacagaagaaaaucaaugggacagugcacgcgcugccguugaagacgaagaguuuuggaagcucguggaccgcgaaagagaauuacauaaguuagguaaaugcggcaguugcgucuauaauaugauggguaaaagagagaagaaguugggagaguucgggaaagcaaaaggaucacgggcaauuugguauauguggcuaggagcccgauauuuagaauuugaagcucucggauucuugaacgaagaucauugguucucgcgagaaaauucguacuccggaguggaaggugaaggacuacacaaauugggguacauacuacgugacaucaguaaaauaccgggcggagcaauguaugcugaugauacagcuggaugggacacacguaucacggaagaugaucuucacaacgaagagaaaauuacacaacaaauggaccccgaacacagaaggcuagcgaacgcuauuuuuaaguugacauaucaaaacaaagugguaaagguacaaaggccuacaccuaaaggaacagucauggauauuauuucgcggaaagaucaaaggggaagcggacaaguuggcacauacggucuuaauacuuuuacaaauauggaagcccaacuaauuagacagauggagggcgaaggugugcugagcaaggcugaucuagagaacccacaccucuuagagaagaaaguaacacaauggcuagaaacaaaaggaguagagaggcucaaaaggauggcuaucucaggagaugacugcguuguuaaaccaauugacgacagauuugcaaaugcauuauuagcauuaaaugauauggguaaaguaaggaaagauauaccucaauggcagccaucgaaaggauggcaugauuggcagcagguaccauuuuguucacaucauuuucaugaguugauaaugaaagauggacgaaagcuaguuguuccaugccguccacaagaugaacuuauuggaagggcuagaauuucccaaggagcaggguggucgcuacgcgaaacagcaugucuaggaaaggcauacgcucaaaugugggcuuuaauguacuuccaccgacgagacuugaggcuagcauccaacgccauuuguucagcaguuccaguacacuggguacccacaagccguacuacaugguccauucacgcucaucaccaauggaugacaaccgaagauaugcuuacaguauggaauagaguauggauagaagauaaucccuggauggaggauaaaacuccugugacuacgugggaagauguaccuuaucuagguaagcgcgaggaucaauggugcgggucgcucaucggacuggcaucacgggccacgugggcucaaaauauacuaacagcgauucaacaggucagaagccucauagguaacgaagaguuccuagacuauaugccaucuaugaagagauuccgcaaagaagaagaaucagagggugcaauaugguaa

SEQ ID NO: 23501 - RNA, 9873 nt, Artificial Sequence
  derived and/or modified CDS sequence (opt6) from DENV-3__JN697379__SS-prME
acgucacuaugucuuaugaugauguuaccagcaacacuagcauuccauuuaacaagccgagacggugaaccucgaaugauaguagggaaaaaugaacgaggaaaaucacuuuuguuuaaaacugccucuggcauuaauauguguacauuaauagccauggacuuaggugagaugugcgacgacacuguuacuuacaaauguccgcacaucacagaaguagaaccagaagauauagauugcugguguaaccucacauccacuugggugacauauggaacgugcaaccaggcuggugagcauagacgggauaaaaggucuguagcacucgcaccccauguuggcaugggacucgacaccagaacucagacguggaugucagcggagggcgcuuggagacaaguggaaaaaguagagacuugggcacugagacauccaggauuuacaauacuugcucuguuucuagcacauuacauuggaacuagccucacucagaaagucguaauauuuaucuuguuaauguuaguuaccccuucuaugacgaugagauguguuggggucggaaaucgggauuucguagaggguuuaaguggagccacguggguggauguaguauuggaacacggggggugugugacaacaauggccaaaaacaaaccaacacuagauauugaacuacagaaaacagaagcgacucaauuagccacacucagaaaacuaugcauugaggggaagauaacgaacauaaccacagauucucggugcccgacgcaaggagaggcaauauugccugaagagcaagaucaaaacuauguaugcaagcauacuuauguggaucgaggguggggaaacggaugcggccucuucggcaaagggaguuugguaacgugugccaaauuucagugucuggagaguauugaaggaaaaguuguucagcacgagaauuuaaaauauaccguaauuauaaccguacacaccggggaucagcaucaaguagguaaugaaacacagggcguaacugcagagauaaccucucaagcuucaaccgcugaagucauucugccagaauauggaacuuuaggucuugaaugcucaccucgaaccgggcucgauuuuaaugaaaugauuuuacuuacaaugaaaaacaaggcguggaugguacacagacaaugguucuucgaccucccucugccuuggacaucaggagccaccacagagacacccacauggaauagaaaagaauugcugguaaccuuuaagaaugcucacgcuaaaaagcaggaaguaguaguauuaggaucacaggaaggugcgaugcauacggcccuaaccggagcuacugagauucaaacgagcggcggcacaaguaucuuugcaggacaccugaagugucgucugaaaauggacaaacuuaaguuaaaagguaugucguacgcaaugugcuugaauaccuucguuuuaaaaaaggaagucagugaaacacaacaugguacuauacuaauuaagguugaauauaaaggggaagacgcucccuguaaaauuccguuuaguacagaggauggacagggaaaggcacauaauggaaggcuuauaacugcuaaucccguuguaacaaaaaaagaagaaccaguaaauauagaagcagaaccgccauuuggagaauccaacauaguaauuggcaucggagauaaagccuuaaaaaucaauugguaucguaagggaaguuccauagggaagauguucgaagcaacagcgcgaggagcucgaagaauggcuaucuuaggugauacugcuugggacuucggcucuguuggaggaguccucaauucacugggaaagaugguacaccagauauuugguagugcauacacagcauuauucucugguguaagcuggauuaugaaaauagguauaggcguucuccucacauggauugguuuaaauucuaaaaauacuaguaugucauucagcugcauagcaauagguauaauaacacuuuauuuaggcguugugguucaggcggauauggguugcguaauaaacuggaagggcaaagagcuaaaguguggcaguggaaucuuugucacaaacgaaguucacacauggacagagcaauacaaauuucaagcggacaguccaaaaagacuugcgacugcgauugcaggugcuugggaaaacgggguauguggcauuagaucuacaacacggauggagaaucuuuuauggaaacagauagcaaaugaauugaacuauauauuaugggagaauaauauuaaacuuacagucguagugggcgauauaacaggaguuuuagaacaaggaaaaagaaccuuaacaccucaaccuauggaacuaaaguacucauggaaaacauggggaaaagcaaagauaguaaccgccgaaacgcaaaauagcucauuuauaauagacggcccaucaaccccagaguguccuagcgccagccgagcauggaacgugugggagguggaagauuacgguuuuggagucuuuacuacaaacauuuggcuaaaguuacgagaaguuuauacgcaauuaugcgaucauagacuaaugucggcugcagugaaagacgaaagagcuguacacgcggacaugggauauuggauagaaucacaaaagaacggaucuuggaaguuggaaaaggcaagucucauugaagugaaaacuuguacuuggcccaaaucacacacacuuuggucaaacggaguccuugagucagacaugauaaucccaaagucucuugcuggcccaaucucacaacauaaucaucggccaggcuaccauacucagacugccggucccuggcauuuaggaaaacuugagcuagauuuuaacuauugugaaggaacaacugucguaauuucagagaauugugguacaagaggaccaagcuugagaacuaccaccgucuccggaaagcucauucacgagugguguugucguaguugcacguuaccaccuuuacgauauaugggggaggauggauguugguauggaauggagaucagaccaauaaaugagaaagaggaaaacauggucaaaucgcuagcgagugccgggucgggcaagguagauaacuuuacaauggggguucuaugucuggcaauauuauucgaagagguuaugagaggaaaguucgguaaaaagcacaugauagcugguguccuguucacuuucguucugcuauuaucaggacaaauuacauggcgugacauggcgcacacgcugaucaugaucgguucaaacgucagcgacagaauggguaugggagucacuuaucuggcucuuauugcgacuuuuaaaauacagccauuucuagcuuuaggcuuuuuuuugaggaaacugaccucuagagaaaaucuauuauuaggggucggcuuggcgauggccgcgacguuaagacuaccagaagacaucgaacaaauggccaacggaauagcacuuggucuaauggcccugaaacugaucacccaguucgaaacuuaucaacuauggacugcauuaguuagccuuacuuguagcaacacaauuuuuacauuaacagucgcuuggaggacugcuacccuaauauuagcaggcauaagucuauugcccguuugucaaucuucaucaaugaggaaaacggacuggcuacccaugacuguagcagcgauggguguaccaccgcuaccauuauuuauauucagucuaaaagauaccuugaaaaggcgcuccuggccacuaaacgaaggugugauggcggucggucuagugaguauacuagccucaucacucuugcgcaacgauguccccauggcuggaccucuagucgcaggcggauuauuaauugcuugcuacgucauaaccgggaccucggcagaccucacgguagaaaaggccgcugacguaaccugggaagaagaggcggagcaaacaggugugucacacaacuuaaugauaacagucgaugacgacggaacuaugcguauuaaagaugacgagacggaaaauauauuaacagugcuacucaaaaccgccuugcugaucguuucggguauauuccccuacaguauuccagcuacacuucuuguauggcacacauggcaaaaacagacucaaagaucagguguuuuaugggacguaccaucccccccagaaacccagaaagccgaacuagaggaaggaguauauagaauaaaacaacaaggcauauuugguaaaacccaggugggaguaggaguacaaaaagaaggagucuuucauacaauguggcacguaacacgaggggcuguucuaacacauaauggaaagcgguuagaaccuaacugggcaaguguaaagaaggaucuuaucagcuaugguggcggguggcgacuaucagcacaauggcaaaagggcgaggagguacaaguaauagcuguagaacccggcaagaauccaaaaaauuuccaaacgaugccagguaucuuucaaacaacuacaggagagauaggagccauugcacuugauuuuaaaccuggcacaucaggauccccaauuauaaauagagaaggaaaagugguaggucuauacgguaaugggguagucacgaaaaauggggguuacguaaguggaauagcucaaaccaaugcagagccagauggaccaacaccggaauuagaggaagagauguucaagaaacguaauuugacgauaauggauuuacauccaggcucaggcaagacacgcaaauaucuaccagcaauuguuagagaagcuauaaaaagacgauuacgaacgcugauacuagcaccaacacgaguuguagcugcugagauggaggaagcauuaaaaggucugccaauaagauaucaaacaacagcgaccaaaucagaacauacgggcagagaaauaguugaucuaaugugucaugcaacauuuacaaugagauugcuaagcccugucagaguaccaaauuauaaucugauaauaauggaugaagcacauuucacggacccggcaaguaucgcagcacguggcuacaucucaacaagaguuggaaugggcgaggcagcagcaaucuuuaugacugcgacaccucccggcacugcugaugcuuucccucaaagcaaugcuccuauacaggaugaggaaagagauaucccggaaaggagcuggaacucaggaaacgaauggauaacugauuuuguggggaagacaguaugguuuguaccguccauaaaggcaggaaaugauauagccaacugcuuacgaaaaaacggaaaaaaaguaauccaauugucgagaaaaacauuugauaccgaauaucaaaaaacgaaacucaacgacugggauuuugucguuaccacagauaucucugaaaugggagcuaacuuuaaagcggauagaguaauagauccgagacgaugccuaaaaccgguaauauuaacagauggacccgaacgaguaauauuggcagguccuaugcccguuacuguggcaucugccgcacaacgccgcggaaggguaggacgaaacccccaaaaagaaaacgaccaguauauauuuaugggacaaccucuuaacaacgaugaagaccacgcacauuggacagaggcaaaaauguuauuagauaacaucaauacgccugaggggauuauaccugcacuuuucgaaccugaacgagaaaaguccgccgcuauagacggagaauauagacugaagggagaaucuagaaaaaccuucguggaacuaaugaggagaggagaccuuccgguuugguuggcacauaaaguagcaucggagggcauaaaauacacagaucgcaaauggugcuucgacggggaacggaacaaccaaauacuagaggaaaauauggacgucgaaaucuggacaaaagagggagaaaaaaaaaaacuaagaccacgauggcuugaugcaagaacauauucagauccauuggcuuugaaggaauucaaggacuucgcugcagggagaaaaucaauugcuuuggacuuggugaccgaaauagguagagucccaagccacuuagcacauagaacaagaaaugcgcuugauaaccuuguaaugcuucauacaucagaacauggagggcgagcguaucggcacgcgguagaagaguuaccggaaacaauggagacccuguuacuuuugggacugaugaucuuauuaaccgggggagccaugcucuuuuuaaucucagggaaagguauaggaaaaacaaguauaggacucauaugcgucauugcauccucaggaaugcucuggauggcagacguaccacuacaauggauagcaucggcuauaguuuuagaauuuuucaugaugguacuccuaauuccugaaccggaaaaacagagaacaccacaagacaaucaguuagcauacguuguaauuggaauucuuacguuggcagcaauaguugcagcgaacgaaauggguuugcuugaaacaacgaagcgagauuugggaaugagcaaggagccuggaguaguuucuccgacaaguuaucuagauguagaccuccacccagcaagugcguggacuuuauaugcaguagcuacgacaguaauaacaccaaugcuaagacauaccaucgaaaauaguacugcaaauguauccuuggcagcgauagcaaaucaagcaguuguauuaaugggucucgacaaaggcuggcccauauccaaaauggauuuggggguaccuuuacucgcccuaggauguuauagucagguuaauccgcuaacauuggccgccgcuguccuacucuugguaacgcacuaugcgaucauaggcccaggguugcaagccaaagcuacaagggaagcacaaaaaagaacagcagccgguaucaugaaaaauccuacuguagacgggauaaugacaauagauuuagauccgguuauauaugauucaaaguuugaaaagcaacuuggccaaguaauguuauugguacuuugugcaguacaauuguuauuaaugaggacaucuugggcguugugcgaggugcuaacacuggcgacggguccaauuacaacacuuugggaggguagcccaggaaaguuuuggaacacuaccauugccguuagcauggcaaauaucuucagaggcucauauuuggcuggagccggccuugcguuuaguauuaugaaaaguguaggaacaggaaagagaggaacggggagucagggagaaaccuugggggaaaaauggaaaaaaaaguuaaaccagcuuaguagaaaagaauuugacuuauacaaaaaaagcggaauuacagaaguggaccguacggaagcuaaagagggucuaaaacguggagaaauuacacaucaugcuguaucuaggggaucagcgaaauugcagugguucguagaaaggaacaugguaauaccugaaggacguguaauagaucucggaugugguagaggaggguggagcuacuacugcgcaggucucaagaaaguuacugaaguuaggggauauacuaaaggagggccuggucaugaagagccuguucccaugucuacauacggauggaauauagugaaauugaugucuggaaaagacgucuucuaucuaccaccagaaaaaugugauacacuguuaugugauaucggcgaaucaucaccaucaccuacgguugaagagucgcguacgauaagaguacuuaaaaugguagaaccuugguugaaaaauaaccaauuuuguauuaaaguauuaaacccuuauaugccgaccgugaucgagcacuuagaacgacuacaaagaaaacacggagguaugcuggugagaaauccgcucucgagaaauaguacccacgagauguacuggaucuccaacggaacagguaauauagucaguucggucaacaugguaucaagacucuuacuaaaucgcuucacaaugacacauagacgacccaccauugaaaaagauguagauuuaggagcuggcacaagacauguaaacgccgaaccagaaacaccgaauauggacgucauaggcgagcguauuaagagaauaaaggaagagcacucaaguacuuggcauuacgacgaugaaaaccccuacaaaacuugggcuuaucauggcaguuaugaagucaaggcgacuggcagcgccucaucaaugaucaaugguguagucaaauugcucacaaaacccugggaugucgucccaaugguuacucaaauggcaaugacagacacgacuccauucggucaacagcguguauuuaaggaaaaaguagauacgcguacgcccagacccaugccaggaacaaggaaggucauggaaauuaccgccgaauggcucuggcguacucugggccguaauaaaagaccccgacuauguacaagggaggaauucacaaaaaaagucagaacgaaugcugcaaugggagccguauucacagaagagaaucaaugggauucugcacgggccgcaguagaagacgaagaauucuggaaacucguagauagagaaagagaauuacauaaguuagguaagugcggaucaugcguguauaauaugauggggaaacgcgagaaaaaacuaggagaauucgggaaagcaaaagguucaagagccauuugguauaugugguuaggagcucgguaccuagaauucgaagcccuuggauuccucaaugaagaccauugguuuucucgggaaaauagcuacagcgggguagaaggugaggguuugcauaaacuagguuauaucuuaagagauauaucaaaaauacccggaggugccauguacgcagacgacaccgcuggaugggacacgcguauaacugaagacgacuuacauaaugaagaaaaaaucacucaacaaauggacccagaacauagacaguuagcuaaugccaucuuuaaauuaacauaucaaaauaaagucguaaaggugcaaagaccgacaccuaagggaacaguaauggauauaauuucccguaaagaucaaagagggaguggccaagucgggacauauggauuaaauacguuuaccaauauggaggcccaacuaauuagacaaauggagggagaagguguacuuucuaaagcagaccuagaaaauccucacccacuugaaaaaaaaauuacacaauggcuagaaacuaaaggaguggaacgcuuaaaacgcauggcuauuaguggggaugacugcguggugaaaccuaucgaugauagguucgcaaaugcccuacuagcuuuaaaugauaugggaaaaguaagaaaggauauaccgcaauggcaaccgaguaagggauggcacgacuggcagcagguaccuuucugcagccaucauuuucacgagcuuauaaugaaagacggacggaaauuaguaguuccaugcagaccucaagaugaauuaauugguagagcgcgaauuucacaaggggcuggcugguccuuaagggaaacugcgugccuagggaaggcguaugcgcagauguggacacuaauguauuuccacaggagagaucugagacucgcaucuaaugcgauaugcucagccgucccuguccauuggguaccaaccucuagaacaacguggucgauucaugcacaccaucaauggaugacgacugaagauauguuaacaguauggaaucgggucuggauagaagauaauccuuggauggaagauaaaacaccaguuacgaccugggaagaugucccguacuuaggaaaacgagaggaccaaugguguggaucccuaauaggauuaacgucccgugcaaccugggcucagaacauccuuacugcuauacagcaaguucgaaguuuaauugggaaugaagaauuucuugacuacaugccuucuaugaaacguuuccggaaagaggaagaaucagaaggagcuauuugguaa

SEQ ID NO: 23502 - RNA, 9873 nt, Artificial Sequence
  derived and/or modified CDS sequence (opt6) from DENV-3__JQ045687__SS-prME
acaagccugugcuuaaugaugauguuaccagcaacauuagcguuccaucuaacaucacgagauggagaaccuaggaugauagucgggaaaaaugaacguggaaaaagucuuuuauucaaaacagcuucuggcauuaauauguguacacuuauagcgauggaccugggggaaaugugcgaugacacaguaacauacaaaugucccuuaguugcggaaguagaaccugaagacauagacugcugguguaaucuuacaucaacuugggugacuuacgguacguguaaucaagccggugaacaccgacgagauaaaagaaguguugcacuugccccucacgugggaaugggauuggacacccgaacccaaacuuggaugagugcugaaggugccuggcgacaaguugaaaaaguugaaacaugggcauuacgacauccaggauuuaccauacuagcuuuauuuuuagcucacuauaucgguacuucccugacccaaaaagucgugauuuuuauacuccugaugcuugugacaccaucuaugacuaugcguugugucggaguugggaacagagacuuuguagaaggacuaucgggugcaacuuggguugaugugguucuagaacacggugguugcguaacuacuauggccaaaaacaaaccgacacuugauauugaauugcagaaaacggaagcaacgcaacuagcaacgcuacguaaacucugcauugaagguaaaauaacuaacauuacaacagauucaagaugucccacucaaggagaagcaauauuaccagaagaacaagaucaaaacuacgucuguaaacauacauacgucgaucgcggaugggguaaugguuguggcuuguuuggcaaaggcucguuaguaaccugugcgaaauuucaaugccucgagccaauugaaggaaaaguuguucaauaugaaaaccuuaaauauacaguaauaauaacaguacacacaggggaucaacaucagguagggaaugauacacaaggugugaccgucgaaauuacgccacaggcuagcaccguagaagccguacuaccggaguacggaacacuaggauuagaaugcucuccgcgaacuggauuagauuucaacgaaaugauacucuuaacgaugaaaaacaaagcauggaugguacaucggcagugguucuuugaucuuccguuaccuuggacuagcggcgcaacaacggagacacccaccuggaauaagaaagagcugcugguuacuuuuaaaaacgcccaugcuaagaaacaagagguagucguauugggcucucaggaaggagcaaugcacaccgcguugacgggagcuacugagauucaaaauucggguggcacaucgauauucgcuggacaucuuaaaugucgauuaaaaauggauaaacuagaacucaaaggaaugucguacgccauguguuuaaacacauuugucuuaaagaaagaagucucggaaacucaacaugguacuauauuaauuaaaguagaauauaaaggagaagacgcaccuugcaaaauuccauucaguacggaagauggacaagggaaagcacauaacggaagauuaauaacagcaaauccagucguaaccaagaaagaggagccuguaaauauagaagcugagccgccguuuggagaaucaaauaucguaauuggaauaggugauaaagcguugaaaauuaacugguacaagaaaggcaguucaauaggcaaaauguuugaagcuacagcucgcggugcuagaagaauggcgauccuaggagauacagccugggacuuuggcagcguagggggaguauugaauagccuuggaaaaaugguacaccaaauauucggcucugcauauacugcgcuauucucuggaguaaguuggauaaugaaaauuggaauugguguucuauugacauggaucggacugaauaguaagaauacgagcaugucuuucuccugcauaguuauuggaauaauuacauuauauuuaggugcuguaguacaagcagauaugggcugcgcaauaaauuggaagggaaaagaacucaaauguggcucagguauauuuguaacgaaugagguucauaccuggacugaacaauauaaguuucaagcggacaguccuaaaagacuggcaacagcaauagcaggagcuugggaaaacgguguuugcgggauccggaguacuacaagaauggaaaauuuguuguggaaacaaauagcaaacgaacuuaacuacaucuuaugggaaaauaauauuaaauugaccgucguggugggugauaucaucggcguauuggagcaggguaaacgaaccuugacuccacagcccauggaguuaaaguauuccuggaaaaccuggggaaaagccaaaauaguaacagcggaaacccaaaacagcagcuuuauuauagaugggccgaauacaccugaauguccuucugcgagccgggcauggaacgucugggagguagaagauuauggguuuggggucuucacgacaaacauuuggcuaaaacuuagagagguauacacgcaauccugugaucaccgucuaaugucugcugcaaucaaagaugaaagggccgugcaugccgauaugggcuauuggauagaaucacagaaaaauggcucguggaaacuugagaaggcuucauuuauugaagucaaaacaugcacuuggccaaaaucacacacacuguggucaaaugguguauuagagucugauaugauuauaccuaagucacuagcuggaccaauaucccaacauaaccauagaccaggauaccacacacaaaccgcgggacccuggcacuuaggaaaguuagaauuagauuuuaacuacugcgaaggcacaacagugguuauaaccgagaauuguggaacuaggggcccauccuugagaaccacuacuguauccgggaaacuuauacacgaauggugcugcagaagcugcacuuugccgcccuuacguuauaugggggaggacggguguugguauggcauggaaauacggcccauaaacgagaaagaagagaauauggucaaauccuuaguuucugcugguucuggcaagguggacaauuucacaaugggaguauuaugccucgcaauucuauucgaagagguaaugagaggaaaauuuggcaagaaacauaugauugcuggagucuuauuuacguuuguuuuguuauugucaggacaaauuacauggcgagauauggcgcauacccuaaucaugauuggaucaaaugccucagacagaauggggaugggugucacauaucuugcccuuauugcaacuuuuaaaauacaacccuucuuagcauuaggcuuuuuccuacgaaaacuaaccucgcgugagaaucuucuauuaggagucggcuuagcuauggcaacuacucuacagcuacccgaagauauagaacaaauggcgaauggcauagcguugggacuaaugacucuaaaauuaaucacccaguucgagacauaucaacuauggacggcacuuguuucauuaaccuguucaaauacaauuuuuacauugacggucgcauggaggacagccacacuuauauuagcuggcguuucacuauugccgcugugucagucuucgucaaugcgaaaaacagauugguuaccaaugacuguugcggcgaugggagucccuccacuaccguuauuuauauuuucacugaaagauacaccuaaaagacgaaguuggccauuaaaugaaggaguaauggcugucggguuaguuucaauauuagcaucaucacugcugcguaacgauguaccaauggcgggaccccuaguagcugggggacuuuuaauagcuuguuacguaaucaccggaacgagugcugacuuaacuguugaaaaggcagcagauguaacuugggaagaagaggcagaacaaacuggagucucacauaaucuuaugauaacaguagaugaugacggaacaaugcgaauuaaagaugaugaaacagagaacaucuuaacaguauuauuaaaaacagcccuacuuauagugucaggaaucuuuccuuacuccauacccgcaacgcuuuuaguguggcauaccuggcagaagcaaacacagcguucaggaguccugugggauguaccaucaccaccagaaacacaaaaagcugaguuagaagaagguguauauagaauuaagcagcaaggaauauucgggaagacacaaguugguguuggcguccaaaaagaagguguauuucauacaauguggcaugucacacggggugcuguacucacacauaacggcaaacguuuggaaccuaauugggcgucgguuaagaaagaucuuaucagcuaugguggaggauggagguuaagcgcacaauggcaaaaaggagaggaagugcaaguuaucgccguugaaccaggcaaaaauccaaagaauuuucaaaccaugcccggaauauuccagacuacaacaggagaaaucggugccauagcuuuggauuuuaaaccagguacaaguggcaguccuauaauaaaccgagaggguaagguagucgguuuguacggaaaugguguugugacuaaaaaugggggauacguaucgggcauagcccaaacgaaugcugagcccgacggaccuaccccugaguuagaagaagaaauguuuaagaaaagaaaccucacgacaauggaucuucauccagguucagguaagacaagaaaauaccuaccagccaucguaagagaagccauaaagagaagacuuagaacauuaaucuuagcgccaaccagggugguugcagcggaaauggaggaagcgcuuaaaggccuuccuauccguuaccagacuacugcgacaaaaagcgaacauacaggaagagagauaguugaccuuaugugccaugcgacauuuacaaugcgguugcuaucaccaguaagaguaccaaacuauaaucuuauaauaauggacgaggcacacuuuacagauccggccucuauugcagcaaggggauauauuaguacacgagucgguaugggugaagcugcugcuauauucaugacugcuacuccaccuggaacagcagaggcuuucccacaaaguaacgccccuauacaagaugaagaacgagauauacccgagagaucguggaacuccggaaacgaguggauaacggauuuugugggaaagacagucugguuugugccaucaauaaaggcugguaacgacaucgccaacuguuuaagaaagaaugguaagaaaguuauacaacucagccguaagaccuuugauaccgaguaucagaaaacaagauuaaaugacugggacuuuguuguuacaacagauauaucggaaaugggagcgaauuuuaaagcagacagaguaauugauccccgaagaugcuugaaacccgucauucuaacugacgguccagagcggguaauucuagcaggaccuaugccaguaacagcagccucagccgcacaacgccgagggcggguaggacgaaauccacaaaaagagaacgaucaguauauauuuacaggucaaccuuugaacaaugacgaagaccaugcacacuggacagaggcaaaaaugcugcuugacaauauaaauacuccugaaggaauuauuccugcacuguuugagccugagagggagaaaagugcagcuaucgacggugaauaccggcugaaaggcgaaucgaggaaaacauucguugaauuaaugagacggggagacuuaccaguuugguuggcacacaagguggcuagcgaagguauaaaauacacugaucguaaguggugcuuugauggggaacguaacaaccagauacucgaagagaacauggauguggaaauauggacaaaagagggugagcguaagaaauuaagacccagaugguuggaugcccgaacauauagcgauccuuuagcucucaaggaauuuaaggauuucgcagcggggcguaagucaauagcacuagaccuaguaacagagauaggaagagugccaagccacuuagcauacaggacacgaaaugcauuggauaacuuaguaauguuacacacuucagaacauggagguagagccuaucggcaugccgucgaggaauugccagaaacuauggaaacacuucuuuuguuaggucuaaugauucugcugacagguggagccauguuauucuuaauuagugggaaagguauaggaaaaaccucaaucgguuuaaucuguguaauagugagcaguggaauguuauggauggcugaugugccgcuacaauggauagcaagcgcuauaguuuuagaguuuuucaugaugguacucuugaucccagaaccagaaaagcagaggacuccacaggauaaccaacuugcguacgugguuaucggaauacucacacuugcagcaauaguagccgcuaaugagaugggacuucuagaaacgacaaaacgcgauuugggaaugucaaaggagccggggguagucagccccaccuccuaucuugacguggauuuacauccagccagcgcuuggacguuauacgcuguagccaccacuguuauaaccccgaugcuaagacauacgauagagaacuccacugccaauguaucauuagccgccaucgccaaucaagccguuguacucaugggauuagauaaggguuggccaauaucuaaaauggacuuaggaguacccuuauuagcccucgggugcuauucacaagugaauccuuuaacuuugacggcagcgguguugcucuuaguaacucauuaugcuauuauaggucccgguuuacaagccaaagcaacccgagaagcccagaaaaggacagcggcuggaaucaugaaaaaucccacaguugacgguauuaugaccauugaucuugaccccgucauauaugacagcaaauucgaaaaacagcucggacaaguaaugcuucuaguucuaugcgcuguacaauuauuauuaaugagaacaucaugggcacuuugugaggcuuugacuuuagcaaccgguccgauuaccacucugugggaggguaguccaggaaaauuuuggaacacaacuauagccguaaguauggcaaacaucuucaggggaaguuauuuggcaggggcaggauuggcauuuucaaucaugaaaucaguugggacgggaaggagagguacaggaucacagggugaaacucuaggagagaaauggaagaagaaauuaaaucaacuaaguagaaaagaguucgaccuuuacaagaagucagguauaacggaagucgauagaacggaagccaaagaaggacuuaaacguggggagacaacacaucaugcagucagcagagguuccgcaaaauuacaaugguucgucgaaagaaauaugguaauuccugaaggucguguaauugaucuaggcugcgggcguggaggguggucauauuacugugcgggguugaagaaagugacggaagugagaggauauaccaagggcggaccgggucaugaagaaccugucccuaugagcacauacgguuggaauauuguuaagcuaaugucaggaaaagauguuuucuacuugccaccugaaaaaugugacacauuacugugugauauaggcgaguccucaccaucuccaaccgucgaggaaucaagaacuauucggguauugaaaaugguagaacccuggcuaaagaacaaucaguucuguauaaagguucuaaacccuuauaugccaacaguaaucgaacacuuggaaagacugcagcguaaauauggugguauguuagucagaaauccauuaucacgaaauaguacacacgaaauguacuggauaaguaauggcaccggaaacauagucucuuccguuaacaugguuuccagguuacuacucaacagauuuacuaugacucaucgaagaccgacuaucgaaaaagauguagaucuuggugcaggaacaaggcacgugaaugcggaaccagaaacaccaaacauggacgucauaggugaacgaauuaaacgaauaaaagaagaacacucaucuacguggcauuaugaugaugaaaauccguauaaaacuugggcauaucacggaagcuacgaaguaaaagcuacaggcagugcuucgagcaugaucaacggaguaguuaagcuacucacuaaaccuugggacgugguaccaauggucacacaaauggcuaugacugauacgaccccauuuggacaacaacgcguuuuuaaggagaaggucgauacuagaacuccuagacccaugcccggaaccaggaaagucauggaaaucaccgcagaauggcuauggaggacuuugggucgcaauaagaaaccacgauuauguacucgugaagaguucaccaaaaagguuaggacuaaugccgcuaugggagcaguguuuacagaagaaaaccagugggacagugcgagagcugcagucgaagaugaagaauuuuggaaacuugucgaucgagaaagagaacuacacaaguuaggaaaaugcgguucauguguauauaauaugaugggcaaaagggagaagaaacuaggagaauuuggcaaagcaaaaggaagcagggcaauaugguauaugugguuaggagcgagauauuuggaguucgaggccuuggguuucuuaaacgaggaccacugguuuagucgagagaacucuuauaguggaguagaaggagaaggccuucacaaauugggguauauucucagagacauuaguaagauuccagggggagcgauguacgcagaugacacggcggguugggauacuagaauaacggaagaugaucuacacaaugaagagaaaauuacacaacaaauggauccugaacauaggcaacucgcgaaugcaauuuuuaaauuaacauaccaaaacaagguggugaaaguacaacggccaacaccgaaagggacaguaauggauauaauaaguaggaaagaucaaagaggcaguggccagguaggaaccuacggucugaauacauucacuaauauggaagcucaauuaguaagacaaauggaaggagaaggaguacucaguaaagcggaucuagaaaacccucauuuguuggaaaagaagauuacccaaugguuagaaaccaagggcguugagcgcuuaaaacgaauggcaauaucaggggaugauugugucguuaaaccuauugacgacagguuugcaaaugcauuacuugcauuaaaugauaugggcaaaguaaggaaggauauaccucaauggcaaccuucgaaagguuggcaugacuggcaacaagucccuuucuguucccaucauuuccaugagcucaucaugaaagauggcagaaaauuagucgugccaugcaggccacaggaugaacuaauugggagagcacggauaucgcaaggugcugguuggaguuuaaaggaaacugcaugucuagguaaagcauaugcucaaauguggucacuaauguauuuccaucgcagagauuuacgucuggcaaguaaugcuauauguagcgcggugcccguucacuggauucccacgucaagaacaacauggagcauacacgcacaucaucaauggaugacuaccgaggacauguuaacagucuggaaccguguauggauugaagacaauccauggauggaagauaaaacucccgugacaacaugggaagauguacccuauuuaggaaagcgcgaagaccaguggugugguucucugauaggcuuaaccuccagagcaacaugggcgcaaaauauuuuaacugcaauccaacaaguuagaagccuaaucggggacgaggaauuucuagauuauaugccgucuaugaagcgguuccgaaaagaggaagagagugaaggagccauuugguaa

SEQ ID NO: 23503 - RNA, 9873 nt, Artificial Sequence
  derived and/or modified CDS sequence (opt6) from DENV-3__JQ045689__SS-prME
accuccuuaugcuuaaugaugauguuaccugcaacucuagccuuccauuugacuucgagagacggagaaccuagaaugaucguugguaaaaaugaacggggaaaaagucuacuuuuuaaaacugcaucaggaauaaauaugugcaccuuaaucgcaauggaucuaggcgaaaugugugaugauaccgugacuuacaaaugucccuuaauugcagaaguagaaccggaagauauugacugcuggugcaaucuuacaucaaccugggucacuuauggaacauguaaccaagccggugaacacagacgagacaaaagaucuguggcguuagcgccgcauguuggaaugggacucgacacaaggacacaaacuuggaugucugcagaaggggcguggcgccaauuugaaaaaguagaaacgugggccuuacgacacccaggguucacaauuuuggcacuguuucuagcccauuauauaggaacaucucuaacacaaaaaguagucaucuuuauucuccuaaugcuugucacccccucaaugacaaugagaugugucggaguuggcaaucgugacuuugucgaagguuuaucaggagcaaccuggguagacguaguauuggaacacggcggaugcguuaccacaauggcgaaaaauaaaccaacauuagauauagaacuacagaaaacggaagcaacgcaauuagcaacuuuacggaaacuauguauugaagguaaaauaacuaauaucacuacugacagccgaugcccuacacaaggagaagcgauccuuccagaagaacaagaucaaaauuauguauguaaacauacuuacguugaccguggauggggaaaugggugcggacuauucgguaaaggaagccuaguaacaugugcaaaauuccaaugccuagaaccuauugaaggaaaagugguacaauacgaaaacuugaaauauacuguaauuauaacuguucacacuggggaucaacaucagguuggaaacgacacccaaggaguaacaguagaaaucacaccgcaggcuucuacgguggaagcagugcuuccagaauacggaacacuaggguuagaauguagcccgcgcacugguuuagauuuuaacgaaaugauuuugcuuacaaugaaaaauaaagcauggaugguccaucgucaaugguucuuugaucucccucuuccguggacaagcggagcaacuacagaaacgccuacuuggaauagaaaagaacuccuaguuacauuuaaaaaugcccaugcuaagaaacaagaaguugugguucuagguucgcaagaaggggcgaugcauacggcucuuacgggagcaacugaaauccaaaacagcggaggaaccucgaucuuugcgggucauuuaaaaugccgauuaaaaauggacaaacuagaauuaaaaggaaugucguaugcuauguguuugaacacauucgucuuaaagaaagaagugagugaaacucaacaugguacaaucuuaauuaaaguagaauacaaaggagaagacgccccauguaaaauaccauucagcacggaagacggccagggcaaagcgcacaaugguaggcuuauuacagcuaaccccgucguaacgaagaaagaggaaccaguuaauauagaagccgagccgccauuuggcgaaucaaauauugugauagguauaggugauaaagcucugaaaauuaauugguauaagaaagguucuucuauaggcaaaauguuugaggccacugcuagaggggcuagacggauggccauauuaggagauaccgcaugggauuucggaaguguagguggaguauuaaauagucuagguaaaauggugcaccaaauauuuggaagugcuuauacagcacuuuucucugguguaaguuggauaaugaaaauugguauaggcguauuacuaaccuggauaggcuugaauaguaaaaacacaucuaugucuuuuagcuguauuguuauagguauuauuacuuuauaccuuggggcaguaguccaggcagacauggguugugcaauuaauuggaaaggaaaagaacuuaaauguggcagcggaauauuuguuacgaaugaaguucauaccuggacugaacaauauaaauuccaagcggauucuccaaaacgauuggcuacagccauagcuggagcaugggaaaauggaguuuguggcauccgcaguaccaccaggauggaaaauuugcuauggaaacaaaucgccaacgaacuuaauuauauccuaugggagaauaacauaaaacucacaguagugguuggggauaucaucgggguacuggaacaagguaaacgaacgcucacuccacagccgauggaguugaaauauaguuggaaaacguggggaaaagcgaaaauuguaacugcagaaacucaaaauucaaguuuuauaauagacggcccgaacacaccggaaugcccuagcgcaagucgagcauggaacguaugggaagucgaagacuauggauucggaguuuucacaacaaauauuugguuaaaacugagagaaguuuacacccaaagcugugaucaccgauuaaugagugcagcgauuaaagaugaacgagcaguucaugccgacauggguuacuggaucgaaagucagaagaauggcagcuggaagcuagaaaaggcuuccuucaucgaaguaaaaaccugcacuuggccaaaaucacauaccuuaugguccaaugggguauuagagucagauaugauuauaccgaaaucacuugcuggaccaauaagucagcacaaccaucgcccaggguaucacacucaaaccgcuggaccuuggcaccuagggaaacuagaacuggauuucaauuacugcgaagggacgacuguuguuauaacagaaaacugugggacacgugggccaucccucagaacaaccacuguaucaggaaaauugauccacgaguggugcugccgaucuuguaccuuaccuccacuacgguauaugggagaagacgggugcugguaugguauggaaauacgaccaauuaacgagaaagaagaaaauaugguaaaaucauuagucucagcaggaucagggaaagucgacaacuucacaaugggaguacuuuguuuagcaauccucuuugaagaaguuaugcgcggcaaauucggcaagaaacauaugaucgcugguguacucuuuaccuuuguuuuauuacuauccggacagaucacauggagagauauggcgcauacacucauuaugauugguucaaaugcuucggaccguauggguauggggguaacuuaccuagccuugauagcuacuuucaaaauccaacccuucuuggcguuaggcuuuuucuuacguaaacuaacgucccgagagaacuuacuguuagguguaggacuugcaauggcaaccaccuuacaauuaccagaagauauagagcagauggcaaacgggauagcauuagggcuuaugacguugaaguuaauuacacaauuugaaacguaccaacuguggaccgcgcucguaucucuaacaugcucuaauaccauauuuacauuaacuguagcuuggcgaacagcgacccuaauucucgcgggaguaucauugcuaccauugugccagucaaguagcaugaggaaaacagauugguuaccaaugacaguugcggcgauggguguaccgccauuaccauuauucauauuuucucuaaaagauacucccaaaagacgaaguuggccccuaaacgaagggguaauggccguagggcugguauccauuuuggcuucuagccuacuacgaaaugauguaccaauggcagguccuuuaguagcugguggacuucucauagcaugcuauguaaucacugggacaucagcagaccugacgguagagaaggcagccgaugucaccugggaagaagaggcagagcagacugguguaucccacaauuuaaugauaacuguagacgacgauggcacaaugagaauuaaagacgacgaaacagaaaauaucuuaacuguacuguuaaaaacugcguugcuaaucgugaguggcauauucccguacucgauaccugccacucuguuaguauggcauacauggcaaaaacaaacgcaaaggucaggugucuuaugggacgucccaagcccaccggaaacccagaaagcggaacuggaagaaggugucuauaggauaaaacaacagggaauuuuuggaaagacccaagucggaguaggugugcaaaaagaaggggucuuccauaccauguggcaugucaccagaggagcaguacuaacucacaacggaaaaagacuugaacccaacugggcuucuguuaagaaagaccucauaucauauggaggaggcuggagguuaucugcacaauggcaaaaaggagaagaaguccaaguaaucgcgguugaaccaggcaagaacccuaaaaacuuccaaacuaugcccgggauauuucagacgacgacaggugagauaggugcuauagcucuugacuuuaaacccgguacgucuggcucgcccauaauaaaccgcgagggaaaaguaguuggcuuauacgggaauggaguagugacuaaaaaugggggauacguaagugggauugcccaaacaaaugcagaaccagauggaccaacgcccgaauuagaagaagaaauguuuaagaaaagaaaucuuacaauaauggaccuacauccggguaguggaaagacacggaaguauuugccugcuauaguacgugaggcuauuaaacgucgucuaagaacauuaauauuagcgcccacaagaguagucgcggcagaaauggaagaagcucucaaagggcuuccgauucgauaucaaaccacagccaccaaaucagaacacacggggagggaaauagucgacuuaaugugucaugcuacauuuacaaugcgcuuacuuucaccuguucgagugccuaauuacaaccuuauuauuauggacgaagcccacuuuacagacccagccaguauagcagcgagaggauauauaagcacaaggguagggaugggagaagcggcugccauauuuaugacagcaaccccgccuggaacagcugaagcauucccacagucaaaugcaccuauucaagaugaagagagagauaucccagaacguucauggaacucagggaaugaauggaucacagacuucgucggaaaaacaguaugguucguaccaucuauaaaagcgggaaacgauauagccaauuguuugcguaaaaauggcaagaaagugauacaauuaucccgcaaaacuuuugauacagaauaucaaaagacgcgacuaaacgacugggauuuuguggugacaacugacauuucggaaaugggugcgaauuucaaagcagaucgcguaauugauccaagaagguguuuaaaaccugucauuuuaacagaugggcccgaaagaguuauccuugcaggaccgaugccuguaacggcugcuucagcagcucaacggagaggaagagugggucguaauccacaaaaggaaaacgaucaguauauauuuaccgggcaacccuuaaauaaugaugaagaccacgcacauuggacagaggccaaaauguuacuugacaacauaaauacgcccgaagguauuauaccugcguuauuugaaccugagagagaaaaaucagcggcgaucgauggcgaguaccgauuaaagggugagucacgcaagacauucguagaacuaaugcggagaggagaucuacccgugugguuggcgcauaaaguagcaucagaaggaauaaaguauacagaucggaaaugguguuuugacggagagagaaacaaucaaauccuagaagaaaacauggacguagagauuuggacgaaagaaggagaaaggaagaaacuucgaccccguugguuagaugcaagaacauacagcgauccuuuagcccuaaaagaauuuaaagacuucgcugcggggcggaaaucuaucgcucuagauuugguuaccgagauaggaaggguaccaucccauuuagcucaccguacaaggaaugcguuggacaaccuuguaauguugcauaccucagaacaugguggacgagcguacagacacgcaguagaggaauuaccagaaacaauggagacguuauuauuacucggguuaaugauauuauuaacaggaggugcaauguuauuuuugauuucggguaaggggauaggcaagacuagcauaggacugauauguguaauuguaucaucaggcauguuauggauggcagauguuccauuacaauggauagccucagcuauaguacuugaauuuuucaugaugguguuacuaauaccagaaccugagaaacaaaggacaccccaagacaaucagcuugcauaugucguaauugguauacuaacccuagcagcgauaguagcagccaaugaaaugggacuauuggaaacuaccaaaagggaccucggaauguccaaggaaccaggaguaguuucgccaacaucauaccuggauguggaucuucauccugccucugccuggacucuguaugccgucgcgacaacuguaaucacuccaaugcuacgacacacaauagaaaauucaacugcuaacguauccuuggcagcaauugcuaaccaggccgucgugcuaaugggauuagauaaaggauggccgaucucgaaaauggaucuaggagugccauuauuagcgcuuggcugcuacagucaagucaauccacuaacauuaacagcggcaguuuuauugcuugugacucauuaugcgauuauuggucccggauugcaagcaaaagcgacucgggaagcucagaaacguaccgcagccgggauaaugaagaauccaacaguugauggcauuaugacaaucgauuuggauccagugaucuacgacucgaaauuugaaaaacaauuaggacaagucauguuauugguauuaugcgcaguucaauugcuucuaaugcgaaccaguugggcucuuugugaggcuuuaacacuugcaacaggucccauuacaacacuaugggaaggaucaccggggaaauucuggaauacgacuauugcugucaguauggcaaacauauucagagguaguuaccuugccggagcaggauuagcuuuuucaauaaugaagucaguagggacugggcguagagguaccgguucacagggggaaacauugggagaaaaauggaagaagaaauuaaaccaauuaucgcgaaaagaguucgauuuauauaaaaagucagggaucacagaaguugacagaaccgaggcaaaggaagggcuaaagagaggcgagacuacacaccaugccguaaguagaggcuccgcgaaacugcagugguuuguagaaaggaauauggucacuccggaaggcagggucaucgaccuuggauguggaagggguggaugguccuauuacugugcaggucuaaagaaaguaacagaaguaagaggguauacaaaggguggcccaggacaugaggaaccagucccuaugagcaccuacggcuggaauaucguaaaacucaugaguggaaaagauguauucuauuuaccaccagaaaaaugcgauacccuauuaugugacauaggggaaaguucucccuccccuacuguagaagagagccguacgauaagaguauugaaaauggucgagccauggcucaaaaauaaccaguucugcauaaagguacuuaacccauauaugccaacugucauugagcaucuagagcgacugcaacggaaguaugggggcauguuaguacgaaacccacuuagcaggaauaguacacaugagauguauuggauuucuaaugguacuggaaacauuguaaguaguguaaacauggucucacgacuauugcuaaaucguuuuacgaugacccaucgccgaccgacgauugaaaaagacguugaccuaggcgcgggaacaagacaugugaacgcugaacccgagacgccgaauauggauguaauaggcgagagaauaaaaagaauuaaagaagaacacucgucuacuuggcacuacgacgaugaaaauccauauaaaacgugggcauaccauggaaguuacgaagucaaagcaaccgguucggccucuucuaugauuaaugggguugucaaacuacuaacuaaaccaugggaugucguaccaaugguaacacaaauggcaaugaccgacaccacaccauucggacagcagcguguauucaaagagaaaguugauaccaggacgccuaggccgaugccugguacacggaagguuauggagauuaccgcugaaugguuauggcgaacgcuaggacguaacaaaaagccucgucuuuguacaagagaagaguucaccaagaaaguccgaacaaaugcggcaaugggggcgguauucacugaagaaaaucaaugggauagugcccgggcagcaguggaggacgaagaguucuggaaauugguugaucgagaaagggaacuccacaagcuaggaaaauguggaagcuguguauacaauaugauggguaagagggagaagaaauugggagaguucggcaaagccaaggggucgcgggcaaucugguauauguggcucggagcuagauaccuugaguucgaggcgcuaggcuuuuuaaacgaagaucauugguuuaguagagagaacucuuauuccgguguugaaggugaagggcugcauaaguuagguuacauccuuagagauauaaguaagaucccggguggagccauguaugcggaugauaccgcagguugggauacaagaauuacagaggaugacuuacacaaugaagagaaaauuacccaacagauggacccagagcacagacaacuugcuaacgcgauauucaaauuaacuuaccaaaauaaaguggucaaaguucagagaccaacaccaaaaggaacaguaauggauauaauuagcagaaaagaucagcgaggaagcggacaagugggcacuuacgguuuaaacacuuuuacuaauauggaagcccagcuagugagacagauggagggagaagguguccuuaguaaggcagacuuggaaaauccacaucuauuagagaagaaaauuacacaauggcuggagacgaaaggagucgaacgucuuaaaagaauggcgauaucaggagaugauugcguaguuaagccuauagacgaucgauucgcaaaugcuuuacucgcacucaaugauauggggaagguacggaaagacauuccacaguggcaaccaucaaaaggguggcacgauuggcagcaaguaccuuucugcagccaucauuuucaugaacuaauaaugaaggauggacgaaaauuaguaguaccaugucgaccacaggacgagcugauugggagagcgcgaauuucccagggugccggauggucgcuuaaagaaacagccugccuaggcaaagcauacgcgcaaauguggucauuaauguauuuccauagaagagauuugcgccuagcuagcaaugcaaucuguucagcaguucccguacacuggauaccuacaucccgcacuacauggucgauacacgcgcaucaucaguggaugacaacggaggacaugcugacuguguggaaucggguauggauagaagauaacccauggauggaggacaaaacuccaguaaccacaugggaagacauacccuauuuagguaagagggaagaucaauggugcgguagucuaaucgggcucacaagcagagccacgugggcccaaaacauccuuacugcgauacaacaaguacgaagucuuaucggagaugaagaauuuuuagauuacaugccgucaaugaaaagauuuagaaaggaagaagaaagugaaggugcuaucugguaa

SEQ ID NO: 23504 - RNA, 9873 nt, Artificial Sequence
  derived and/or modified CDS sequence (opt6) from DENV-3__JQ045691__SS-prME
acgagucucuguuuaaugaugauguuacccgcaacauuagcuuuucaucucacaucacgagacggagaaccucgaaugauaguaggcaaaaaugaaagaggaaaaucccuguuauucaaaacagcauccgggauaaacaugugcacgcugauagcaauggacuugggagaaaugugugacgauacaguaacauacaaaugcccgcuuauugcagaaguugaaccggaggacaucgacugcugguguaauuugaccaguacuuggguaacuuauggaacauguaaccaagccggugaacaccggagggacaaacggucgguggcguuagcuccucauauaggaauggguuuggauacacguacacaaacauggaugucagcagaaggugcauggagacaaguggaaaaaguagaaaccugggcucuacgacauccugguuucacaauacuugcacuauuuuuagcacauuacauaggaacaucccuuacacaaaaaguaguuauauucauuuuacugaugcuuguaacucccaguaugacuaugcguugcguaggaguagguaaccgcgacuuuguagaggguuuaucaggugcaacauggguagacgucguccuggaacaugggggauguguaacaacaauggccaaaaauaaaccuacauuggauaucgaauuacagaaaaccgaagcuacacaacucgccaccuuacgaaaacugugcaucgaagguaaaaucacaaacaucacaacugacucgagguguccaacacaaggagaagcaauuuuaccggaggaacaagaucaaaauuauguuuguaaacacacauacguagaucguggauggggaaauggguguggguuauuugguaaggguucacuuguaacuugugcaaaauuucaaugucuagaaccgauugaagggaaaguugugcaauacgagaaccuuaaauauacagucauaaucacugugcacacaggagaucaacaccaaguaggcaaugauacgcagggugucacagucgaaauuaccccgcaggcaucuacaguagaagcuauuuugccagaguauggaacauuaggucuugaaugcagcccgcgaaccgguuuagacuuuaaugaaaugauccuguuaaccaugaaaaacaaggcuuggaugguacaccgucaaugguucuuugauuugccauuaccauggacaagcggagcaaccaccgaaacccccacauggaaucgaaaagaauuacuugugacauuuaaaaaugcucacgcgaagaaacaagaaguaguaguucuagguucacaagaaggagcaaugcauacagcucuuacuggggcaacagaaauacaaauaucaggcggaacaagcauauuugcuggacaccuuaaaugcagacuaaaaauggacaaauuagaacucaaagggauguccuaugccaugugucuuaauacauucguacuaaagaaagaaguuucagagacacaacaugguacaauacuuauaaaaguagaauacaaaggugaggaugcuccaugcaaaauaccuuucucuacagaagacggucaggguaaagcgcauaacgguagacuuauuacugcgaacccaguuguaacuaagaaagaagaacccgucaauaucgaagcugagccacccuuuggggaaaguaauauaguaauuggaauaggagauaaagcauuaaaaauaaacugguacaagaaaggaucuuccauaggaaaaauguucgaagcaaccgcacggggagccagacgcauggcaauccuaggagauaccgcaugggacuuugguaguguuggaggagucuuaaauucuuugggaaaaauggugcaucaaaucuuuggcuccgcuuauaccgcauuguucagugggguuucauggauuaugaaaauaggaauagguguauuacuuaccuggauuggacuuaauaguaaaaacacaucgaugaguuucuccuguauaguaaucgguauaauuacccucuaucuuggagcaguaguccaggcggauaugggaugugccauaaacuggaaagguaaagaguuaaaaugugguaguggaauuuuugucacaaacgaaguccauacauggacugaacaauauaaauuucaagcggacuccccaaagcgauuagcaacagcuaucgcgggagcuugggaaaauggaguaugcggaauaagaucaaccacaagaauggaaaauuuacucuggaaacaaauagcaaacgaauuaaauuauauucuuugggaaaauaauaucaaacucacaguaguagucggagauauuauaggcguuuuagaacaagguaaaaggacgcuaacgccacagccaauggaauuaaaauauaguuggaaaacguggggaaaggcgaaaauagucacugcugaaacgcaaaacucaucauucauaaucgaugguccgaacacacccgaaugucccagcgccucgagggcauggaacguaugggagguugaggauuauggauucgggguauuuacuacaaacauauggcuaaaacuacgagaaguauacacccaaagcugcgaucauaggcuaaugucagcagccaucaaagaugaacgagcaguucacgcagauaugggauauuggauagaaucacagaaaaacggcaguuggaaacuugagaaagccagcuuuauagaggucaaaaccuguacauggcccaaaucccacacuuuguggucaaacgguguuuuagagucggauaugaucauuccgaaaagccucgcaggaccgauuucccaacauaaccacagaccagguuaccacacacaaacagccggaccguggcauuuggggaaacuggaauuagauuucaauuauugcgaaggaacaacggucguaaucacggaaaauugcgguacgcgcggccccaguuugagaaccaccaccguauccgguaaguuaauacaugaauggugcuguagaagcuguacacuaccuccucuaagauauaugggggaagauggcuguugguaugguauggaaauccgaccgauuaaugaaaaagaagagaauaugguuaagucucuaguuucggccggcagcggaaagguugauaacuuuacgauggguguucuaugucuagccauauuguuugaggagguuaugcggggaaaguuuggcaagaaacauaugauugcaggaguauuauuuaccuucguacugcuucuaucuggucaaauaacguggagggacauggcacauaccuuaauuaugauaggaaguaaugccagugaccguauggguaugggagucacuuaucucgcccucauagcaacauuuaaaauacagccguuccuugcgcugggauucuucuuacguaaacuaacaaguagggaaaauuuacuucuuggcgucggacuagcaauggcaacgacauugcaauuacccgaagauaucgagcaaauggcaaaugguauugcuuugggcuuaaugacauuaaaacugauuacacaguuugaaacauaucaguuguggacugcacucguaagucuaacguguuccaauacaauuuuuaccuuaacaguagcauggagaacugcaacguugauacucgcaggcgucagccuucuaccacucugucaaucaucaucaaugagaaagacagauugguuaccgaugacaguggcggccauggguguaccaccuuuaccacuauucaucuucagccuuaaagacacuccuaagaaacgaucauggccauugaacgagggaguaauggcuguugguuuagucucuauacuagcgaguagccuucuccgcaaugauguccccauggcugguccauugguagcaggagggcuucuaauagcuugcuacgucauaacuggaacaucggcugaucuaacaguagaaaaagcggccgacgugacgugggaagaagaggcagaacaaacugguguaucacauaacuuaaugauaaccguagacgacgauggcacaaugagaauaaaagacgacgaaacagaaaacaucuuaacaguccuauuaaaaacggccuugcuaaucgucucagggaucuuuccauacuccauaccagcaacguuauuagucuggcacaccuggcaaaaacagacucaaaggucuggcguccuuugggauguaccgucgccuccagaaacgcaaaaagcugaauuggaggaaggaguuuacagaauaaagcaacaaggaauauucggcaaaacgcaagucgguguuggcguccaaaaagaaggcguauuccauaccauguggcauguuacuagaggggcgguccuaacacauaauggaaaacgacuggaaccgaacugggcaagugucaagaaagauuuaaucucuuauggagguggguggcggcuaucugcucaauggcaaaaaggugaggaaguccaaguaauagcgguugaaccggguaaaaaucccaagaacuuucaaacaaugccuggaauuuuccaaacaaccacaggugaaauaggagcgaucgcguuggauuucaagccgggcacaucagguucgccgauuauaaaccgagaaggcaaaguugugggauuauacggaaauggaguaguaacuaaaaacggaggauaugucagcgggauugcucagacuaaugcagaaccggauggccccacaccagaacuugaagaggaaauguucaagaaacgaaauuugacaauaauggauuugcacccuggaaguggaaagacaagaaaauaucuaccugcuauagucagagaagccauaaaaagaagguuaagaacacugauauuagcccccacacgcguaguagcugccgaaauggaagaagcacuaaaaggcuuaccgaucagauaccaaacuaccgcaacuaagucagaacacaccgguagggaaauaguagauuuaaugugucacgcaacauucacaaugagauuacuaucuccuguucgagugccgaacuacaauuugaucaucauggaugaagcgcauuuuacagaucccgcguccaucgcagcucgcggguauauaaguacacggguagggaugggagaagcagcugccauuuucaugacagccacuccaccaggaacagcugaagccuucccacaaucuaacgcgccaauacaggaugaggaacgcgacauaccggaacguaguuggaacucuggaaaugaauggauuacagacuucguaggcaaaacagucugguuuguaccuucuauaaaggcaggcaaugacauagcuaauuguuuaagaaagaacggcaagaaagugauccaacuuucuagaaaaacguuugacacagaguaucagaaaacuagguuaaaugacugggauuucguuguaacgacagauauaucggagaugggagcgaauuuuaaagcggauagaguaauagauccacgcagaugccuuaaacccgugauauuaacugacggucccgagcgggucauacuugcagguccuaugccuguaacagcggcuucagccgcucaaagacgggggaggguaggcagaaauccccaaaaggaaaaugaucaauauaucuuuacaggccagccuuuaaauaacgacgaagaucaugcccacuggacagaagcuaaaaugcuuuuagauaauauuaauaccccggaagguauaauuccagcucuauucgaaccagagagggagaaaagcgcagcaauagauggggaauaucguuugaaaggugagagccggaaaacauucgucgaacuuaugaggcguggugaucuuccugucuggcuagcacauaaaguagcuucugaagggauaaaauacaccgacagaaaauggugcuuugacggugagaggaacaaucagauuuuagaagaaaauauggacguugaaauuuggaccaaggaaggugaacggaagaaauuaagaccacguuggcuagacgcgcggacuuauagugacccauuagcacucaaggaauuuaaggauuuugcagcagggcgaaaaagcauagcuuuagaccuagucacugaaauugggcgugugccaucgcaucuagcacaccggaccagaaacgccuuagauaaccucgucauguuacauacauccgagcacggaggaagggcauaucgucaugcaguggaagaauuaccugaaacuauggagacacuccucuuacuuggguuaaugauauuacuuacagggggagcuaugcucuuucuacugucagggaaaggcaucggaaaaacauccauagggcucauaugcgugauaguaaguagcgguaugcuauggauggcagaugugcccuuacaauggauagccucagcaaucguauuagaguucuuuaugaugguacuacuaauuccagaaccagaaaagcaacgaacuccacaagauaaucaauuagccuauguagucauugguauucuuacauuagcagcgauaguagccgcuaaugaaaugggucucuuagaaacaaccaaaagagaccuagggaugaguaaagaaccaggaguaguaucacccacaaguuaccucgauguagauuugcacccugcaagugcauggaccuuguaugcgguugcaacuaccgugauaaccccuaugcuuagacacacuaucgagaacucgacagcaaaugucagcuuagccgcgauagcuaaucaagcaguuguauuaaugggauuagacaaagguuggcccauauccaagauggaucugggcguaccauugcuugcucuaggcugcuacagccaaguuaauccacucaccuuaaccgcagcuguacuacuuuugguaacacacuaugccauaauaggcccagggcuccaagcaaaagcaacucgcgaggcgcagaaaaggacagcugcaggcauaaugaaaaauccgaccguggaugggaucaugacuauugaccuagauccaguaauuuaugauaguaaauuugagaaacaacucggucagguaauguuauugguguugugugcgguacaacuucuacucaugagaacauccugggcguuaugcgaagcacuuaccuuagcaacagggcccauaacaacucuuugggaagguucacccgguaaguucuggaauacgacaaucgcgguaagcauggcgaacauauucaggggcaguuacuuggcgggagcagggcuagcauuuaguauaaugaaauccguagguacaggccgcagaggcacggguagucaaggagaaacccugggagaaaaauggaagaagaaacuuaaucaguuaagccgaaaagaguuugauuuauauaagaaaagugguauaacagaagucgauaggacggaagccaaagaaggccuaaaaagaggggagaccacucaucaugcaguaaguagaggauccgcaaaacuacaaugguuugucgaaagaaauauggucaucccggaaggaagaguuaucgauuuagggugcggaagagguggaugguccuauuacugcgcaggacuaaagaaagugacagaaguuagaggauauacuaaaggaggucccggacacgaggaaccaguuccaaugucaaccuauggguggaaccuuguaaaguuaaugucgggcaaagacguauuuuacuuaccuccagaaaagugcgauacacucuuaugugauauaggagaaucuucuccuucaagcacuguugaagaaucccgaacgauacggguucuaaaaaugguagagccauggcugaaaaauaaucaauucuguaucaaaguccuaaauccguauaugccaacagucauagaacauuuagagcgacuacaaagaaaauauggaggcaugcuggucagaaacccuuuaaguagaaacucaacgcaugaaauguauuggaucucaaauggcacgggcaauauugucucaucaguaaacauggucagcaggcuauuauugaaccguuuuacgaugacacaccgaagacccacuaucgagaaagacguagaucuuggcgcuggcacgcgucacguuaaugccgagcccgaaaccccuaacauggauguaauaggagagcguauaaagcggauaaaagaagaacacaguucuacauggcauuacgaugaugaaaaucccuauaaaacuugggcuuaucacgggucuuaugaggucaaagcgacagguagugcaucgaguaugauaaauggagucguuaaacuucuuaccaaaccaugggacguagugccaauggucacacagauggcgaugacugauacaacaccauuuggccagcaacgcgucuuuaaagaaaaggucgauacucgaacaccgagagcaaugccaggcacgcguaaaguaauggagauaacugccgaguggcuauggcgcacgcuuggaagaaacaagaagccccgcuuguguacccgugaagaauuuacuaagaaagucagaacaaaugccgccaugggcgcaguguuuacagaagaaaaucaaugggauuccgcccgagcugcaguagaagaugaggaguuuuggaaauugguggaucgcgaacgggaacugcauaaauugggaaagugugguaguuguguguauaauaugaugggcaaaagggaaaagaaacuaggugaauuugguaaggccaaagggucaagggccauaugguacaugugguuaggggcucgauaucuggaauuugaggcacuaggcuuucucaaugaagaucauugguuuucuagggaaaauagcuauucagggguagaaggugagggccuacauaaauugggauauauuuugagagacauuucuaagauaccugggggcgcaauguaugcagaugauacagcagggugggauacgcgaaucaccgaagaugauuuacauaacgaagagaaaauuacacagcaaauggauccagaacaccgccagcuagccaacgccauauuuaaacucacauaucagaauaaaguaguuaaagugcaaagaccaacuccgaaaggaacuguaauggacauaaucucgagaaaggaucaaaggggcucaggucagguaggcacauacggccucaacacguuuacgaauauggaagcgcaauuaguacggcaaauggagggagaggguguauugaguaaagccgauuuagaaaauagucaucuucuagagaagaagauaacucaaugguuagaaacaaaaggcguagaacgauuaaaaaggauggcaauaaguggugacgauugcguagugaaacccauugaugauagauucgcaaacgcucucuuggccuuaaaugauauggggaaaguaagaaaagauauaccccaauggcaaccaucaaaaggauggcacgacuggcaacaaguuccuuucugcagucaccauuuucacgaguuaauaaugaaggacggaaggaaguuaguagucccauguagaccucaggaugaauuaauaggcagagcucgaaucucucaaggagcggguuggucacuuaaagagacagcgugucuugggaaagcauacgcacaaaugugguccuugauguauuuccaccgucgcgaucuacgacuugcuucuaacgcgaucugcucagcaguacccgugcauuggauuccaacaaguaggacaacaugguccauacacgcucaucaucaauggaugacgaccgaggacauguuaacaguauggaacagggucuggaucgaggauaauccauggauggaggauaaaacuccgguaacaacaugggaagauguaccauaccuuggaaaaagggaggaucaauggugcgguucacuuauuggguuaacgucaagagcaaccugggcacaaaacauuuuaacggccauccaacaagucagaucuuuaaucggcgaugaagaguuucuugauuauaugccaagcaugaaaagguucagaaaagaagaggaaucugaaggugccauuugguga

SEQ ID NO: 23505 - RNA, 9873 nt, Artificial Sequence
  derived and/or modified CDS sequence (opt6) from DENV-3__JQ045692__SS-prME
accucacuuuguuugaugaugauguugcccgcaacucuagccuuucaucuaacuucaagggacggagaaccucguaugaucguugguaaaaacgaaagggggaaauccuuacuauuuaaaacugcaagcggaauuaacauguguacucuuaucgcaauggacuuaggagaaaugugugaugauaccguuaccuauaaauguccuuugaucgcugaagucgaaccggaagauauugauugcuggugcaaccuaacaucgaccuggguaacguaugggacguguaaucaagcuggugaacauagaagagacaaacggucaguagcauuggccccacacgucgguaugggacuagacacgagaacccaaacauggaugucagccgaaggagcauggcgccaagucgaaaaaguugaaacuugggcuuugcgacacccuggguuuacaauacuugcucuauuuuuagcacauuacauaggaacuagcuuaacgcaaaaaguaguaauauuuauuuuacugauguuaguuacccccuccaugacaaugcggugugucggaguaggaaaucgagacuucguggaaggucuaaguggagcaacuuggguggauguggucuuggaacauggcggaugcgugacuacaauggcuaaaaacaaaccaacacucgauaucgaacuacagaaaaccgaagcaacucaauuagcgacucugcgcaaacuauguaucgaaggaaaaauuacgaauaucaccaccgauagccgcuguccgacgcaaggugaagcaauuuugcccgaagaacaagaccaaaauuacgucuguaagcauacauacguagaccgaggaugggguaauggaugcggacuuuuugguaaaggcagcuuaguuacuugugcaaaauuucaauguuuggaaccuauugaagggaaagugguucaauacgaaaaucuaaaguauacagugauuauuacuguacacacaggagaccaacaucagguagggaaugauacccaagguguuacaguagagauaacuccccaagccucaacaguagaagccauacuaccugaguauggcacuuugggucuagaauguaguccucgaacaggauuggauuuuaaugagaugauucuauuaacaaugaagaacaaagcauggaugguacauagacagugguucuuugaccugccccuaccuuggacguccggugcuacaacagaaaccccgacuuggaacagaaaagaacuauuaguaacauuuaaaaaugcgcaugcuaagaagcaggaagugguuguccugggaucacaagaaggugcuaugcauacagcauuaacuggcgcaacagaaauucaaaucucuggagguacaucaauuuuugcugggcaucucaaaugccgacucaagauggacaaauuagaguuaaagggcaugucauaugcuaugugccuuaauacuuucguacuuaagaaagaaguaucugagacgcagcauggaacgauauuaauaaaggucgaauacaaaggggaagaugcaccauguaaaauuccauucucuacugaagauggacaagggaaagcacauaacggacgucuuauuacagcaaacccaguaguuacuaagaaagaagaaccaguuaauauagaggcugaaccgccauucggcgaaaguaauauagugauagguauaggagauaaagcacuaaaaauaaacugguauaagaaagggaguuccaucgguaaaauguuugaagcaacagcaaggggagcacgaagaauggcaauacuuggggauacugcgugggacuucggaucaguaggcggcguguugaacucgcucggaaaaaugguacaucaaauauucgguucggccuauaccgcucuauucucuggaguaaguuggaucaugaagauagguaucggcgucuugcuuaccuggaucggacuuaauaguaaaaauacauccaugucauucucuugcaucguuauaggaauaauaacacuuuaucucggagcugucguacaggcugacauggguugcgcaaucaauuggaagggaaaagaacuaaaaugcggaucuggaauuuucgugacaaaugaaguacacacauggacagaacaguauaaguuccaagcggauucaccaaaaagacuagcuacugcaauagcaggcgcuugggagaauggugucugcggaauuagaagcacaacaagaauggaaaaccuauuauggaaacaaauugcaaacgaauuaaauuacauucuaugggagaauaauauaaaauuaaccguaguaguaggagacauaauaggagugcuagagcaaggaaaaagaacacugacgccacaacccauggaauuaaaauauuccuggaagacaugggguaaagcaaagauuguuacugcagagacacaaaauucuagcuuuauaaucgacggaccaaauacuccagaaugccccagugccucacgcgcauggaacgucugggaaguagaggauuauggauucgggguauuuacaacuaauauuugguuaaaauugcgagaaguauauacccaaucaugugaccaccguuuaaugucagcugcuaucaaagaugagcgcgcuguacaugcagauaugggcuacuggauagaaagccagaagaacggaagcuggaaacuagagaaggcuagcuuuaucgaggucaaaacauguacauggccuaaaagucauacucuuuggucaaauggagugcuggaaucagacaugaucauucccaagagcuuagcuggaccuauaagucagcauaaccaucgcccgggauaucauacucaaacagcagggccauggcaucuagggaaacuggaacuugauuuuaacuacugcgaaggaacuacggugguaauaacggagaacuguggcaccagaggaccgagucuacguacaacuacuguaucaggaaaacuuauucaugaaugguguugucgaagcuguaccuuacccccacuaagauauaugggugaagauggauguugguacggaauggaaauaagaccuauuaacgaaaaggaggagaauaugguuaaaucccugguuucagcggggucaggcaagguagacaacuuuacaaugggagugcucugccuagcgauccuauuugaagagguaaugagagggaaauuuggcaagaaacacaugaucgcggggguacuguucacauucguacuccuauugaguggccagaucacauggcgggauauggcucauacauuaaucaugaucgggucaaaugcuucagacaggaugggaaugggagucacuuauuuagcccuuauugcaaccuucaaaauucaaccuuucuuagcuuuaggcuuuuuccucagaaaacuuacaucgagagaaaaucuacuccuagguguugggcuugcuauggccacgacauuacagcucccugaggauauagaacagauggcaaaugguauugcucuuggucuaaugacucugaaacucauuacgcaauuugaaaccuaccaacuuuggacggcgcuaguaucacuuacauguucaaauacgauauucacauuaacuguagcauggcgaaccgcuaccuuaauacuagcuggaguaucuuuauugccacuuugccagucgaguucaaugcguaaaacggacugguuaccuaugacaguugcugcuaugggggucccgccguuaccauuauucaucuucucucuuaaagacacuccuaaacggagaucauggccauuaaaugaaggaguaauggcaguaggguuaguaucgauucuggcgucuagucuauuacguaacgauguucccauggccggaccccuaguagcuggaggauuacucauagcauguuauguaauuaccggcacaagugcagaucuaacagucgaaaaggcagccgauguaaccugggaagaagaagcggaacaaacaggaguuagccauaacuugaugauaaccgucgacgaugacggcacaaugagaaucaaagaugacgagaccgaaaauauauugacgguacuauuaaaaacagcacuauuaauuguaucagggaucuuuccuuauucaauccccgcuacauuguuaguguggcauaccuggcaaaagcaaacacagcguucugguguacuuugggauguacccucaccuccugaggcacaaaaagcagaacuagaggagggaguuuaucguauaaaacaacaagguauuuuuggcaaaacacaggugggaguaggcguacagaaagagggcguauuucauacgauguggcauguaacaagaggagccguauuaacucacaacgguaaacguuuagaaccgaacugggcuaguguaaagaaggaccugauaucguaugggggagguuggagacuaucugcgcaauggcaaaaaggggaagagguccaagucauugcuguagaaccaggcaaaaacccuaaaaacuuccaaacuaugcccggcauauuccaaacaacaacaggcgaaauuggcgcuauagccuuggacuucaagccaggaacauccggaagucccaucauaaauagagaaggaaaaguggucggacuauacggcaaugguguaguaacuaaaaaugggggauacguuaguggaauagcacaaacgaaugcugaaccagauggcccaacaccugaacuagaagaggagauguucaagaaacgaaauuuaacgauaauggaucuacaucccggcucaggaaagacccgaaaguaucuacccgccauuguaagagaagcgaucaaacguaggcuaaggacguugauuuuggcaccaacuaggguaguugcagcggagauggaagaagcccuaaaaggacugccaaucagguaccagacaacagcaacaaaaagcgaacacacggggagagaaauuguagauuuaaugugucacgccacauuuacaaugagacuucuuagucccguuagaguuccuaauuauaacuugauaauaauggaugaagcacauuucacggaucccgcaaguauagcugcgcggggauacauaagcacacgaguuggcaugggugaggcagccgcaauauucaugaccgcaacaccaccagggacggcagaggcguuuccacaaagcaacgcccccauacaagacgaagaaagagauaucccggagcguagcuggaacaguggaaacgaauggauaacugacuucguuggaaagacgguaugguuuguaccuucuaucaaagccggaaacgacauagcgaauuguuuacggaaaaauggcaagaaaguaauacaacugaguagaaagacauuugacacagaauaucagaaaacgagauuaaaugacugggacuuugugguuacaacagacaucagcgaaaugggugcuaacuucaaggcggaucgagugauagauccaagaagaugccuaaaaccaguuauacucacagacggaccagagagagucauauuggccggaccuaugccaguuacugccgcuucagcagcucaacggcgagggagaguagguagaaauccacaaaaagagaaugaccaguacauauuuacaggacaaccuuuaaauaacgaugaagaccaugcccauuggacggaagcgaaaaugcuuuuggacaacauuaauacuccagagggaaucauuccggcccuauuugaacccgagagagaaaagucagcagcaauagauggcgaguauagauuaaagggcgaaagucgaaagacauuuguagaauuaaugcggcguggugaucuuccaguguggcucgcacauaagguagcuagugaaggaaucaaauacacagaucgaaaguggugcuuugacggagaaagaaauaaucaaauauuagaagaaaauauggauguggagaucuggacgaaagaaggggaaagaaagaaauuacggccacggugguuagaugcucguacuuacucugaucccuuggcacuaaaagaauuuaaagacuucgccgcugguagaaaaucaaucgcguuggaucuuguaacagaaaucggucgaguacccagucacuuagcgcacagaacgcgaaaugcgcuagauaaccuugucauguuacauacaagcgaacauggaggacgagcuuauagacaugcgguggaagaacuaccugaaacgauggaaacauuccuccuauuagguuuaaugauauuacucacuggcggugcaaugcuuuuccugcuaucagggaaagggauaggaaaaacuucaauugggcugauuugugucauagucucgagcggaaugcuguggauggcagauguaccguuacaauggauagcgagugcaauaguacuagaguucuucaugaugguacuauugauaccugagccagaaaaacaaaggacaccucaggauaaucaguuagcguauguaguaauaggaauccugacacuagcagcaauagucgcggcuaaugaaaugggacuucuagaaacaaccaaaagagaccuuggaaugagcaaagagccaggcguaguaucaccaacuucuuacuuagacgucgacuuacauccagcgucugcuuggacacucuacgccgucgccacgacaguaaucacuccaauguuaagacauacaauagaaaacagcacggcaaauguaucguuagcugccauagcuaaucaggcagucguucuaaugggauuagauaaggguuggcccauuaguaagauggaucucggcguaccauuacuagcacucggauguuauucacaagugaacccacuaacauugacggccgcuguauuauugcuagugacacacuacgcaauuauaggucccggucuacaagcaaaagcgacacgggaagcucaaaaacgaacugcagcaggcauuaugaaaaauccaaccguagacgguauuaugaccauugaucuugacccugugauuuaugauaguaaauucgagaaacagcucggacaaguaaugcuacucgugcuaugugcgguucaacucuuguuaaugcgcacaucuugggccuuaugugaggcuuugacauuggcuacugggccaaucacaaccuuaugggaaggaagccccggaaaguuuuggaacacaacaauugcggucaguauggcaaacaucuucaggggaucauacuuagccggugcaggcuuagcauucagcauaaugaaaucagucggcacagguagaagagggacagguucgcaaggggagacacuuggagaaaaauggaagaagaaacucaaucaacugucacgaaaagaauuugaucuauauaagaaaaguggaauaaccgagguagauagaaccgaagcgaaagaagguuugaaaagaggugagacaacacaccaugccgugucaaggggaagugcuaaauuacaaugguucguagaaagaaauaugguaauuccagaaggcagggugauagaccugggguguggaagaggggguuggucauacuauugugcaggccucaagaaaguuacagaagugcgaggauacaccaaagggggaccaggucaugaagaaccuguuccgauguccacuuauggcuggaaccugguuaaauugaugucuggaaaagaugucuuuuacuugccaccggagaaaugugacacucuauuaugcgauauaggagaaaguaguccaucaucuacgguagaagaaagcagaacaauaaggguauuaaaaaugguagagccguggcucaaaaacaaucaauuuugcauuaaaguacucaacccauauaugccaacuguuauugaacaucuagagcggcuacagagaaaguauggagguaugcugguaagaaauccuuuaaguagaaauaguacacaugaaauguauuggauaucaaaugguacagguaauauagugaguucuguuaacauggucucucgauuauuacucaauagguuuacaaugacacaccgccguccaacuauagaaaaggacguagacuuaggcgccgguacgagacauguaaaugccgagccugaaacucccaauauggaugugauaggagagagaauaaaacggauaaaggaagaacauucaucaacuuggcauuacgaugacgaaaaccccuauaaaacaugggcguaccauggaagcuaugaggugaaagcaacugguagugcgaguuccaugauuaacggugucguuaaauugcugacuaaacccugggauguugugccaauggugacucagauggcuaugacugacacgacuccguuuggccaacagcggguauuuaaagaaaaaguagauaccagaacuccucgcgcuaugccagguacaaggaaagugauggaaauaacugcagaaugguuguggcgcacauugggacgaaacaagaaaccucgucuaugcacaagagaagaguuuacaaagaaaguccgaacuaaugcagcaaugggagccguauuuacggaagagaaucaaugggacuccgcuagggcggcuguugaagaugaagaguucuggaaacugguagauagggaacgggaauuacauaaacuaggaaaaugcgguucuugcguauauaauaugauggguaagcgugagaagaaacugggagaguucggaaaagcaaaaggcucgcgugccauaugguacauguggcuuggagcgcguuaucuagaauuugaggcguugggauuucuuaaugaagaucacugguucagcagagaaaauagcuauagcgggguagaaggugaaggcuuacacaaacuaggguacauacuuagggauaucuccaaaauuccaggaggggcuauguaugcagacgauacugcaggaugggacacacggauaacagaagaugaucuucacaaugaggagaaaauaacacaacaaauggauccggagcauaggcaguuagcuaacgcuauauuuaaguuaacuuaccaaaacaaaguagucaaaguucaaagaccaacaccaaagggaacggucauggacauuauaucccggaaagaucaaagggguaguggacaagugggcacauaugguuugaauacguucacaaacauggaagcucaauuaguuaggcaaauggaaggcgaagguguauuauccaaagcagaucuggagaauccacauuuacucgagaagaaaauaacccaaugguuagaaacaaaaggaguugaaagacucaaaaggauggcgauaagcggagacgauugcguagugaaaccaauugacgacagauuugcaaaugcacuacuugcucucaacgacaugggaaaaguaagaaaagacaucccacaauggcaaccaucgaaagguuggcacgauuggcaacaaguuccauucugcucucaucauuuucacgaguugauaaugaaagaugguaggaaauuaguagugcccuguagaccacaagaugaauugaucgggcgagcuagaaucucacaaggagcaggguggucacucaaagagaccgcuugucuuggcaaggcuuacgcacaaauguggagucuaauguauuuccauagacgagaccucagacuugcaaguaaugcgaucugcagugcugugcccgugcauuggauaccuacuagccgcacaacauggucuauacaugcgcaccaucaauggaugacgacagaagacaugcuuacuguuuggaacagaguguggauugaggacaaccccuggauggaagauaaaacuccaguaacuacaugggaagauguccccuaucuuggcaaaagagaagaucaaugguguggauccuuaauuggucuaacgaguagagcgacuugggcacaaaacauacugacugcgauacaacaaguaagaagucuuaucggggaugaagaauuuuuagauuacaugcccucaaugaaacgguuucgaaaagaagaggagucugaaggggcuauaugguaa

SEQ ID NO: 23506 - RNA, 9873 nt, Artificial Sequence
  derived and/or modified CDS sequence (opt6) from DENV-3__JQ045694__SS-prME
acgaguuuauguuuaaugaugauguuacccgcuacauuagcauuccauuuaacaucacgagauggagaaccuagaaugauagugggcaaaaaugaaagagggaaaaguuuacuauuuaaaacugcaucaggaauaaacaugugcacucucauagcaauggaccuuggggaaaugugcgacgacacaguuacguacaaaugcccccugauagcagagguagaaccagaagacauagauugcuggugcaaucuaacguccacguggguaacauacgguacguguaaucaagcuggagaacacagaagagacaaaagaagcgucgcauuagcuccacaugucggaaugggacucgacacaagaacacaaacauggaugagugcagaaggagcauggagacaaguggagaaagucgaaacaugggcacuuagacacccuggguuuacaauuuuagcucuauucuuagcccauuauauaggaacaucuuuaacucagaaaguagugauauuuauauuauuaaugcucguaacucccagcaugacaaugagaugugucgguguaggaaaucgggacuucguugagggacuaucaggagcaacuuggguugauguuguguuggaacaugguggaugugugacuacuauggcuaaaaauaaaccaacauuggauauagagcugcagaaaacugaagccacacaauuagcaacacuucguaaacuguguauagaagguaaaauaacuaacaucacuacagacucuagauguccaacacaaggcgaggcuauucuacccgaggaacaagaccaaaauuauguuuguaaacauaccuacguugauagaggaugggggaaugguuguggcuuauuuggaaaagggagcuuaguaacuugugcuaaauuucaauguuuagagccuaucgaggggaaagucguccaguacgagaaucuaaaauauacugugauuauaacggugcauacuggcgaucaacaucaaguaggaaaugauacacagggugugacagucgagaucacaccccaggcaucaacaguagaagcuguauuaccagaguauggaacccugggacuugaauguaguccuagaacagggcuagacuucaaugaaaugauccuuuuaacaaugaaaaauaaagcauggaugguucacaggcaaugguucuuugauuugccguuaccauggacgucaggugcaacgacagaaacgccaaccuggaaucgaaaagaauuacucguaacuuuuaaaaaugcacacgccaagaaacaagaagucguaguuuuagguucacaagaaggggcuaugcauacggcucuaacuggugcaacagagauucagaacucaggaggcacaaguauuuuugcaggacacuuaaaauguagacuuaaaauggauaaauuggaauuaaaaggaaugucauaugcaaugugccuaaauacuuuuguacuaaagaaagagguaucagaaacccaacaugggacaaucuugauaaaaguggaauacaaaggagaagaugcuccaugcaaaauaccguuuaguacggaagauggucaagguaaggcucacaacggcagguuaauuacggccaacccaguagucaccaagaaagaggaaccuguaaauauugaagcagaaccaccuuucggagaaucaaacaucgugaucgguauuggagacaaggcucuaaagauaaauugguauaagaaagguucaaguauaggaaaaauguuugaggcaacagcacggggugcgagacggauggccauccuaggggacacugcuugggauuuuggaaguguagggggaguuuuaaauuccuuggguaaaaugguacaucaaauuuuugguucugcguauacagcgcuauucucugguguaucauggauaaugaaaauugggauaggcguacuccuaacguggauaggccugaacuccaaaaauacaaguaugucauuuucaugcauaguaaucggaauaauaacacuuuaccugggagcaguuguucaagcugacaugggaugugccauaaauuggaaaggcaaggaacuaaaguguggaagcggaauauuuguaacgaaugagguccauacguggacugagcaguauaaauuccaagcagauucgccgaagagacuagccacugcgauagcgggugcaugggaaaauggagugugcggcaucagaaguaccacgcguauggagaauuuauuguggaaacaaauagcaaacgaauuaaauuacaucuugugggaaaacaauauaaaguuaaccguaguagugggcgauauuauugguguguuggaacaaggaaagagaacacugacuccucaaccaauggaacuaaaguacucauggaaaacuuggggaaaagcaaaaauaguaacugccgagacucaaaauuccagcuuuauaauugacgguccaaacaccccggaauguccgagugcuagucgggcuuggaauguuugggaaguagaagacuauggcuuugguguguuuacuaccaauauauggcuuaaacuucgugaaguuuauacucaaagcugugaccauagauuaaugucugcagccauaaaagacgaacgcgcaguacacgcggauaugggcuacuggaucgaaagucagaaaaaugggaguuggaagcuagaaaaagcgucauuuauagaggugaaaacguguacauggccuaagucgcauacacuguggucaaauggaguauuagaauccgacaugauuaucccaaagaguuuagccgguccaauaucccaacauaaccaucgucccggauaucauacacaaacugcaggccccuggcaucuaggaaagcuagaauuagacuucaauuacugcgaagggacaacuguaguaauuacggagaauuguggaacuagaggaccaagucuaaggaccaccacaguuucggguaaacucauacacgaguggugcugccgaucauguacacugccaccccugcguuauaugggugaagauggauguugguaugggauggagauucgucccaucaacgaaaaagaggaaaauaugguuaaaaguuuagugagcgcugguucgggaaagguagauaauuucacuauggguguacugugccuagcgauccucuuugaagaagugaugcgaggaaaguuuggcaagaaacacaugauagcaggcguauuauucacauucguauugcuucucucaggccaaauaacauggagagauauggcacauacacuaauaaugauaggcucgaaugcuucagauagaauggguaugggcguuaccuacuuagcacucaucgcgacauuuaaaauucaaccauuucuggcguuaggcuucuuuuuacgcaaacuuacaucacgagaaaaccuccuauuaggagucggguuggccauggcuaccacguuacaguugccggaggauauagaacagauggcaaauggaauagcucuuggcuuaaugacacuuaaacuuauaacccaguucgaaaccuaucaacuauggacagcuuuaguuucauuaacuuguucgaacacaauauuuacacuuacgguagcauggcgcacagcgacacuuauccuggcggguguaucuuuacuuccacuaugucaaagcagcucaaugagaaaaacggauugguuaccaaugacaguagcagcaauggggguaccaccguuaccacuuuuuauuuucucgcuuaaagauacacccaaaaggcgaucauggccccuaaaugagggggugauggcuguaggucucguaaguauucuugcuucgucucucuuaagaaacgaugugccaauggcagguccauuaguagcuggaggcuuacucauagcguguuacguuauaacuggaacaagcgccgaucugacgguugagaaagcagcagauguaacaugggaagaagaagccgaacaaacgggcguaagccauaacuuaaugaucacaguagaugaugacgggacaaugaggaucaaagaugaugaaacugaaaacauauugacuguccuacuaaaaacagcacugcuaauugucuccggcaucuucccauauagcauaccagccacacuucuagucuggcacacguggcaaaaacagacgcagagaucaggaguacugugggacguuccuagcccgcccgaaacacaaaaggcagaguuagaggaagguguuuaccgaauaaaacagcaaggcauauuugggaagacgcaaguaggugugggcguccaaaaggagggaguguuucauaccauguggcacguaacacgaggcgcaguauugacgcacaauggcaagcgacuggaaccgaauugggcuucugucaagaaagauuuaauuagcuauggaggggguuggagauuaagcgcacaauggcaaaaaggagaagaaguucaaguaauagcgguagagccagggaaaaaucccaaaaauuuucagacaaugccggguauuuuucagacaacgacuggugaaaucggagcaauagcguuagauuuuaagccaggaacuucugguucuccaaucauuaacagagaaggcaaaguaguaggauuauacggaaauggugugguuacaaagaacgguggauacgugagugggauugcucaaacuaaugcagagccugauggaccuacuccagaacuagaagaagaaauguucaaaaagcggaaucuuacaauaauggaucuccacccuggaagcggaaaaacacggaaauacuugccagcaauaguacgagaagcaauuaaacgcaggcuaaggacuuugauuuuagcaccgacacgaguaguggcagcagagauggaggaagcucucaaaggcuugccaauacguuaucagacuaccgcaacaaaaucagaacauacaggcagagaaauuguugaucuuaugugucaugcgacuuucaccaugagacuauuaaguccgauacgaguuccuaauuauaaccugaucauuauggacgaagcucauuucacugaucccgcaucuaucgccgcacgagguuauauaucaacuaggguggggaugggugaagcggcagccauuuuuaugacagcuacuccgccugguacagcagaagcauuuccacaaucaaacgcgcccauucaagaugaagaaagagauauaccugaacgaucuuggaacucaggaaacgaauggauaacagauuucguaggcaaaacagugugguuugucccaaguaucaaagcagggaaugauauugcaaauugucuaaggaaaaaugguaaaaagguaauacaguugucacguaaaacauucgacacugaauaccagaaaacuaggcuaaacgacugggacuucguuguaacuacugacauaagugaaaugggagccaauuuuaaagcugacagaguaauugauccucgaagaugucucaaaccuguaauacugaccgacggaccggagcgagugauucuagccggucccaugcccgugacagcagcgucagcagcucaacgcagagggcguguggguagaaauccccaaaaagaaaaugaccaauacauauucacagggcagccgcugaauaacgaugaagaucaugcacacuggacagaagcaaaaauguuguuggacaauauaaauacuccagaagggauaaucccagcauuguuugaaccugagagggaaaaaucggccgcaauagauggagaguaucgucugaaaggagaaucuagaaaaaccuuuguugaauuaaugcgacggggcgaccugccagucuggcucgcccauaagguugcuuccgaagguaucaaauacaccgauagaaaguggugcuucgauggagagagaaacaaucaaauacuggaagagaacauggauguugagauauggacaaaggaaggugagaggaagaaauuaagaccucgauggcucgaugccagaacuuacucagauccauuagcacuuaaagaauuuaaagacuuugcugcagggcgcaaaucuauugccuuagaccuaguuacagaaauagggaggguaccaucucacuuagcauauagaacgaggaaugcccuagacaaccuuguuauguuacauacguccgaacacggugggagagcguaucgacaugcaguugaagaacuaccugaaacuauggaaacauugcugcuucuaggacuaaugauacucuugacgggcggugcaauguuauuccuuaugucugggaaggguauagguaaaaccucaauuggucuaaucuguguuauaguauccucagggauguuauggauggcagauguaccacuacaauggaucgcuagugcaauaguauuagaauuuuucaugaugguuuuacuaaucccagaaccugaaaaacaaagaacuccucaagauaaucaauuagcguauguaguaauagguauacucacguuggcggcaauuguagcugcuaaugaaaugggucugcuagaaacaaccaaaagagauuuagguaugucuaaagaaccggguguagugaguccaaccucuuaucuagaugucgauuugcauccagcgucagcguggacauuguaugccguagccacgacuguuauuacgccaaugcuucggcacacuauugaaaauucgacagcuaauguuucucuggcggcuauagcaaaccaagcagugguguugaugggacuugauaaagguuggccaauaucaaaaauggaccuuggaguaccgcuuuuggcccucggaugcuauucccaagucaauccacucacacuaacugcugcgguucuguuacuggucacacauuaugcaauuauaggcccuggucuacaggcuaaagcuacuagagaagcacaaaaacguacagcggccgguaucaugaaaaauccgacaguggaugguauuaugacaauugaucuggacccgguaauuuaugauucaaaauuugaaaaacaauuggggcaagucaugcuauugguauugugcgccguucagcuauuguuaaugagaaccucaugggcauugugugaggccuuaacacuagcaaccggaccaaucacaacacuaugggaagguucuccuggaaaauucuggaacaccacaauagcaguaucuauggccaacauauuccgaggaucauaucucgcaggcgcagguuuagcguuuucgauaaugaagaguguggguaccggaagaagaggcacaggaccacaaggagaaacguugggagagaaguggaagaagaaacuaaaccagcuuaguaggaaagaguucgaccuauacaagaaaagugguaucacagagguugaucggaccgaagcaaaggaaggacuuaaaagaggugaaacuacucaucacgccgucagccgagguuccgcgaaauuacaaugguuuguagaacguaacaugguuauucccgaaggucguguaaucgaucugggaugcgggagaggaggguggagcuacuacugcgcaggacuaaagaaaguaacagaagucagaggauauacaaaaggcggccccggacacgaagaaccaguaccgauguccaccuacggauggaauuuaguuaagcucaugucggguagagacgucuucuaucuaccgcccgagaagugcgacacacuguuaugugacaucggagagagcuccccgagcccgacaguugaagaaucucgaacaauaaggguucucaaaaugguagaacccuggcucaaaaauaaucaguuuugcauaaaaguauuaaauccuuauaugccaacuguuauagaacaccuagagcgcuuacaaaggaaauacggaggaaugcucguuagaaauccuuuaagccgaaacuccacacacgaaauguacuggauauccaacgggacagggaacaucguuucauccguuaauaugguaagcagacuuuuacuaaaccgcuuuacaaugacacaccguaggccaaccauugagaaagacguugaccuaggugcugggacgcgacacgucaacgcagaaccagaaacuccuaauauggacguaauuggcgaaaggaucaaaagaauaaaagaagaacauaguucaacuuggcauuaugaugacgagaacccauauaaaacaugggcauaccacgggucauaugaaguaaaagcaacuggaucagcauccaguaugauuaauggcgucguaaaacuucuaacgaaaccgugggauguagucccuauggugacucagauggcaaugaccgauacuacaccuuuuggccaacagaggguauucaaagaaaaaguggacacaagaacacccaggccaaugccaggcacuaggaagguaauggaaauaaccgcagaauggcuauggaggacacuugggcguaauaagaaaccucgacuguguacgagagaagaauuuaccaagaaaguacgaaccaaugcugcaaugggugccgucuuuacagaagaaaaccagugggauagcgcaagagcugccguagaagaugaggaauuuuggaaacuugucgaucgggaacgagaacuacauaaacuuggaaagugugggagcugcguauauaacaugaugggaaaacgcgagaagaaacuuggugaauuuggaaaagcuaaagggucucgggccauaugguauauguggcuaggagcuagguauuuggaauuugaagcauuagguuuccuaaacgaagaucacugguucagcagagagaacaguuauucaggaguagagggagaaggccuucauaagcucggauauauacuaagagauauaaguaaaaucccaggcggagcgauguaugcagaugauacagccggaugggacacuagaauaacagaagaugaccuccacaacgaagagaagauaacccaacaaauggauccagaacaucgacagcuugcuaaugccauauucaaacuaacauaucaaaacaaagucguaaaggugcaaagaccuacgccuaaggguacagugauggacauaaucaguagaaaagaccaacgcggcucagggcaaguaggcacauauggacuuaacacguucacuaauauggaggcccaacucguaagacaaauggaaggcgagggugugcuauccaaagcagaucuagaaaacccacauuugcuugagaaaaagauuacucaauggcucgaaacggaagguguagaaagacuuaaaaggauggccauuaguggugacgauugcgucguaaaaccaauagaugauagguuugcaaaugcccuauuagcacuaaaugacaugggaaaaguccgcaaagauauuccgcaauggcaaccaucaaaaggauggcacgauuggcagcaggucccauuuugcucacaucacuuccacgaauugauaaugaaggacgggagaaaguuagucguaccauguagaccacaagacgaguugauuggcagagcaagaaucucccaaggcgcaggguggucacuaaaagaaacagcgugccuaggaaaggcuuacgcucagauguggucacuaauguauuuucacaggcgcgauuuaagacuugcgaguaacgcaauaugcagugcaguuccuguacacuggauucccacuucgagaacaacuuggagcauacaugcucaucaccaauggaugacgacugaagauaugcuaacaguuuggaauagagucuggauagaagauaacccauggauggaagacaaaacuccaguaaccacgugggaagauguacccuaucuuggaaaacgagaagaccaauggugcggaaguuuaauagggcuaacaagccgagcgacgugggcccaaaacauuuuaacggcuauccaacaagugcggucgcuuauaggagaugaagaauuucuagacuauaugccgaguaugaaacguuuuagaaaagaagaagaaucagaaggagcuauaugguaa

SEQ ID NO: 23507 - RNA, 9873 nt, Artificial Sequence
  derived and/or modified CDS sequence (opt6) from DENV-3__GU363549__SS-prME
acuucuuuaugucuuaugaugauauuaccugcagcuuuggcauuccaucugacaagucgagacggggaaccaaggaugauaguagguaaaaacgaaagaggaaaaagccuauuguucaaaacugcaucuggaauaaauaugugcacacuaauagcaauggauuuaggggaaaugugcgaugacacuguaacguauaaauguccccauauuacugaagucgaaccggaagacaucgauugcuggugcaacuugaccucaacuuggguaaccuauggaacuugcaaccaagcuggggaacacaggagggacaaacgauccguagcacuagcaccacacguaggaaugggacuagauacaagaacacaaacauggaugucagcagaaggagccuggagacaaguagaaaaaguagaaacgugggcauuaagacauccaggauuuacaauacuugcacucuuucuagcucauuauauaggaacuucuuugacucaaaaagucgucauauuuauucuccuaaugcucguaacaccaucaaugacaaugagaugcguagguguggggaaucgagauuuuguagaaggacuaagcggcgcuacauggguggacguugugcuggaacacggggguugcgugaccacaauggcuaaaaauaaaccaaccuuggacauugaacuccagaaaacggaagcaacacaacuugcaacauuacguaaauuguguauugaagguaaaauuacuaacaucacuacagacucgaggugucccacccaaggugaggcaguauuaccagaagaacaagaucagaacuauguauguaaacacacguaugucgauagaggaugggguaacggcuguggguuauucggcaaaggaucguuagugacaugugcuaaauuucaauguuuagagccaauagaagguaaaguaguacaauacgaaaauuugaaauauacaguaauuauaacagugcacacuggggaucaacaucaagugggaaaugagacacagggcguuaccgcagaaaucacaccacaagccaguaccacugaagcaauccuuccggaauaugggacauuggggcuugaguguucucccagaacgggacuggauuuuaaugagaugauacugcucaccaugaaaaauaaagcauggaugguccacagacaaugguuuuucgauuuaccuuuaccauggacuucaggcgcuacgacggaaacaccgacauggaaucgaaaagagcucuugguuaccuucaaaaacgcccacgcuaagaaacaagaagugguugugcuagguagccaagaaggcgcaaugcauacagccuugacgggagcuacugaaauacaaaacagcggaggaacguccauuuuugcgggucaucuaaaaugucgacuaaaaauggauaaacuagaauuaaaaggaaugucuuaugcaaugugcaccaacacauucguacucaagaaagaaguaucagagacucaacacggaacuauccuaauuaaaguagaauauaaaggugaggaugcuccgugcaaaauuccauucucaacagaagaugaacaaggcaaagcccauaauggaaggcuuaucaccgccaauccagucguaacuaagaaagaagaaccuguuaauauugaagcugaaccaccuuuuggagaguccaacauuguuaucggaauaggugauaacgcccuuaaaauaaauugguauaagaaaggaucaaguauaggaaaaauguuugaagcuacggcuagaggagcucggagaauggcaauuuuaggcgauacagcaugggauuuugggucaguagggggagucuuaaauucauuaggaaaaaugguccaucaaauauucgggagugcguauaccgcacuauuuucaggcguaucguggguaaugaaaauugguauugggguacucuuaacguggauaggucuuaauaguaaaaauacaagcaugucguucucguguauagcgauuggaauuauuacucuauauuugggagcuguugugcaggcugauaugggauguguaauaaacuggaaagguaaagagcugaaauguggcagugguauauuuguaaccaaugagguacauacauggacugagcaauauaaauuucaggcagacucaccuaaaagacuagcaacagcuauugccggugcuugggagaaugguguuugugguauacgaaguacgacaagaauggaaaacuuguuauggaaacaaaucgcaaacgaauuaaauuauauucuuugggaaaauaacauaaaauugacagucguagucggugauacaaucgguguauuggaacaaggaaaacggacacugacuccacaaccuauggaacugaaauauaguuggaaaacauggggaaaagccaagauagucacagcagaaacgcaaaacucuucuuucauuaucgacggaccuaauacuccugaauguccaucugcaagcagagcauggaauguaugggaaguagaagacuaugguuuuggaguauuuacuacaaauauuugguuaaaauuaagagaagucuacacucagaugugcgaucacagauuaauguccgcggccguaaaagaugagcgagccguucacgcagauaugggauacuggaucgaaagucagaaaaauggaaguuggaaauuagaaaaggcuucucuuauagagguaaaaacaugcacauggccaaaaucucauacuuuauggucuaaugguguccuugaaucagauaugauuaucccgaaaaguuuagcagguccgauuucacaacauaacuauaggcccggauaucauacacagacagcaggucccuggcacuugggaaaguuagagcuugauuuuaacuauugugaagggaccacaguagugaucaccgagaauuguggaacaagagggccgucguuacgaaccacgacaguaagcggcaaacuaauucacgaauggugcugucguucuuguacuuugccuccccuccguuauaugggagaggaugguuguugguauggcauggagauaagaccaaucucugaaaaagaggaaaacaugguuaaaagccuaguaagugcagguucgggaaaaguagauaauuuuacaauggguguccucugccuagcgauacuauucgaggaaguaaugagaggaaaauucggaaagaaacacaugauagcugguguuuuucuuaccuuuaugcugcuucuaucaggucaaauaaccuggcgagauauggcgcauacgcucaucaugauuggaucaaaugcuuccgaucguauggguauggggguuacuuaucucgcucuaaucgcuacauuuaaaauucaacccuuccuugcacuugguuucuuucuaagaaaauuaacaucucgcgaaaaucucuugcucggaguaggccuagcaauggcaacgaccauacaauugccugaggacauugaacaaauggcaaacggaauagcucucggauuaauggcucucaaacuuauuacacaauuugaaacauaucaauuauggacggcauuaauaucgcuaacuuguucaaauacuauauucacauugacaguagcauggcguacagcuacccuaaucuuagcaggaguuagucuuuuaccagucugccaaucgagcucaaugcgaaaaacugauugguugccuaugacugucgcggcgaugggggucccaccacuuccguuauucauauuuucacuuaaagauacgcuaaagcgaagaucguggccacuaaacgaaggcgucauggcuguggguuuaguaaguauccuagcuucaucucuacucagaaaugauguaccuauggcaggaccacucguugccgguggguuauuaauugcuuguuaugugauaacaggcacuucagccgaucucaccguugagaaagcagcugacguaacgugggaagaggaggccgaacaaacuggaguaucacauaaucuuaugaucacaguggaugaugauggaaccaugaggauaaaggacgacgaaaccgaaaauauuuuaacaguuuugcuaaagacugcucuacuaauaguuuccgguauuuuucccuauaguauuccggcaacacuucuaguguggcauacuuggcaaaaacaaacccagaggucuggaguacuaugggacguuccgucuccaccagagacucaaaaagcggaacuagaagagggaguauacagaauuaagcaacaagguauccuuggcaaaacacaaguaggcguuggaguucaaaaagaaggagucuuucacaccauguggcauguaacaagaggagcuguccuaacacauaacgguaaacgcuuagaacccaauugggcgucagucaagaaagaucuaauuucuuauggaggaggguggcguuugucugcccaauggcaaaaaggagaagagguccaggugaucgcaguggaaccaggcaaaaaccccaaaaacuuucaaacaaugccaggaaccuuucaaacaacgacaggagaaauuggcgcaauugccuuagauuuuaaacccggcacuucaggcagccccaucauuaacagagaagguaaagugguuggguuauacgggaauggaguaguaaccaagaauggaggauauguuaguggaauugcucagacaaaugccgaaccagaugguccgacaccagagcuagaagaagagauguuuaagaaacguaacuuaaccauaauggaucuacauccugguucagguaaaacgagaaaauaucuccccgcaauagucagagaagccauaaaaagacgccuaagaaccuuaauuuuggccccaacaagaguuguugccgcggaaauggaagaagcccucaaaggcuuaccaauaagauaucagacaacagcuacaaaaagugagcacacuggacgcgaaauaguagaccuuaugagacacgcuacauuuaccaugagguuacuaucuccaguaagagugcccaauuauaauuuaauuauuauggaugaggcucacuuuacagacccggcgucuauagccgcccgaggauauaucucaaccagagucggaaugggagaggcagcagcuaucuuuaugacugcuacgccaccaggaacagcagaugcuuuuccacagucaaacgcccccauacaagacgaagaacgagauaucccagaacgaucuuggaacaguggaaacgaauggauuacagauuuugccgguaaaacggugugguucgucccaagcauaaaagcuggaaaugauauugccaauugucuccggaaaaacggcaagaaagucauucaacuaagccgaaaaacauuugacacggaguaccaaaagacaaaacucaaugauugggacuucguagugacuacugacauaucagaaaugggggcaaauuuuaaagcagacagagucauugauccacguaggugccuaaagccaguaauacuuacagaugggccagaacggguaauccuugcagguccuaugccaguuacaguagcauccgccgcacaaagaagggggagagugggaagaaauccacagaaggaaaacgaccaauauauuuuuacaggccaaccgcuuaauaacgacgaggaccacgcgcauuggacugaagcgaaaauguugcuugauaauauuaacacccccgaagggaucauuccagcauuguuugagccagaaagagaaaaguccgcggcaauagauggggaauaucgcuugaaaggagaaucacgcaaaacuuuugucgaauuaaugcgaagaggagacuugccuguuugguuagcacauaaaguugcguccgaagggaucaaauauacugacagaaaauggugcuuugauggccaaaggaauaaccaaauauuagaagaaaacauggaugucgaaaucuggacaaaggaaggagagaagaagaaacuacgaccuagauggcucgacgcccgaacauacucugauccauuagcgcucaaggaauuuaaagauuucgcagccgggagaaaauccauagcauuagaucugguuacagaaauaggacgcguaccaucccaucuugcccaucguacaagaaacgcauuggacaauuuagugaugcuucacacauccgagcacggaggccgggcguauagacaugcaguagaggaguuaccagaaaccauggaaacacuacuucuacuaggucugaugauacuacuaacagggggcgcaauguuguucuuaauaagcggcaaaggcauuggcaaaacaucaauaggauuaauuuguguuaucgcuucuucuggaauguuauggauggcagaaauuccccuacaguggauagcaagugccaucguccuugaguucuucaugaugguccuccuuauacccgaaccagaaaaacaaagaacaccacaagauaaucaauuagcauaugucgugauuggaauacucacuuuagcagcaauuauugcugcgaacgagauggguuuguuagagaccaccaaacgagaucugggaaugaguaaggaaccagguguaguauccccaacaucguauuuggacguugaccuacauccugcaagugcauggacauuauacgccgucgcgacuacugugauaacaccaaugcuaaggcacacaaucgaaaauaguacagcaaacguuagccuggcugcuaucgcaaaucaagcagugguacucaugggacuggacaaaggcuggccaaucagcaaaauggaucuugguguaccacuccucgcacuaggauguuauucucagguuaacccccugacucuuacagcagcaguuuuacucuuagugacucauuaugcaauaauugggcccggacuacaagcaaaagcuacaagagaagcacaaaaacgcaccgcagcggguaucaugaaaaacccgaccguagacgguauaauuacuauugaccuugacccaguuauauacgauaguaaauucgagaaacaacuagggcagguaaugcuucuagugcugugcgcagugcaauuacuauuaaugagaacgucuugggcgcucugugaagcguuaacauuagcaacuggaccuauaacaacguuaugggaggguucuccuggaaaauucuggaacacaacaauugcuguaaguauggcaaauauauuucgagguucuuaccuugcaggagcuggucuugcuuuuuccauuaugaaaagcguaggaacgggcaagcgagguacuggaucacaaggagaaacuuuaggagaaaaauggaagaagaaauuaaaccaguugagcagaaaggaauuugacuuauauaagaaaucuggaauaaccgaaguugaccgaacagaagcuaaagagggcuuaaaaagaggcgaaacuacucaucacgcuguaagucgaggaucggcaaaacuccagugguuugucgaaagaaauaugguaauucccgaaggucgagugauugaucuuggaugcggaagaggaggauggaguuauuauugugccggacuaaagaaaguaacagaaguaagaggcuauacaaaagguggacccggacaugaagaaccuguaccgaugucuacacaugguuggaauauagucaaguuaaugagugguaaagauguauucuaucugccgccagaaaaaugcgacacccuacuuugcgauauuggcgaaucaaguccuucacccacaguagaggaaucacgaaccauucgcgucuuaaaaaugguugagccauggcuaaagaauaaucaguuuugcaucaagguacuaaacccuuacaugccagcugugaucgagcacuuagaaaggcuucagaggaaacacggugguaugcuaguucgaaacccuuuaucaagaaauucgacucaugaaauguauuggauuagcaacggaacugguaauauaguaaguaguguuaauaugguaagucgucugcuuuuaaacagguucacuaugacacacaggaggccaacuaucgagaaagauguagaucucggcgcgggcacucgacacguuaaugcagagccagaaacgccgaauauggacguaaucggagagcgaauuagaaggauaaaggaagaacauaauuccacuuggcacuacgaugacgaaaacccuuacaagaccugggcuuaccauggaagcuacgaaguuaaggccacaggcucagcaagcuccaugaucaaugguguagugaaacuguuaacaaaaccaugggauguggucccaaugguaacacaaauggcaaugacagauacgacaccauuuggucagcaaagaguauuuaaggagaaagucgauacacgcacaccucgcccaaugcccgggacccgcaaagugauggaaauaacggccgagugguuauggaggacguuagguaggaauaagaggccgaggcuuuguacacgagaagaauuuacuaagaaagugcggacgaaugcagcaaugggagcaguuuuuacagaggaaaaccaaugggauucggcuaaggcggccguagaagacgaagaguucuggaaauugguagaucgggagagagagcugcauaaauuaggcaaaugcggcucuuguguauauaauaugaugggcaagcgagagaagaaacuaggggaauuuggaaaagcuaaagggagccgcgccauaugguacauguggcuaggggcacgauauuuggaauuugaagcccuaggauuccuaaacgaggaucauugguuuuccagggaaaauagcuauaguggcguagagggugaaggccugcauaaguuaggauauauuuuaagagauauaucuaaaaucccugguggcgcuauguacgcagacgacacagcagguugggauacacguauuacagaagaugaucuucauaaugaagagaagauaacgcaacaaaugaaccccgaacaucgauugcucgcuaaugccauuuucaaguuaacauaucaaaacaaaguagucaaagugcagagacccacacccaccgguacuguaauggauauaauaucuagaaaagaucaaaggggaaguggucaaguugguaccuacgguuuaaauacuuuuacaaacauggaagcgcaguuggugagacaaauggaaggugaagguguucucaguaaggcugacuuagaaaacccgcaucuucccgagaagaaaaucacucagugguuggagacaaaaggaguagaacguuuaaaacggauggcaaucucgggggacgacugcguuguuaaacccaucgacgaccgauuugccaaugcacuacuggcucucaacgauaugggaaaaguaagaaaagacauaccacaauggcaaccgaguaaaggauggcaugacuggcaacaaguaccguuuuguucucaccauuuccacgagcuuauuaugaaagacggaagaaaauuaguuguuccaugcaggccacaagacgaguuaauuggacgagcgcguauuucucaaggagcuggguggucauugagagaaacagccugucucggcaaagcauacgcucaaauguggagccuaauguacuuccauagacgcgacuuacgauuagcaaguaacgcaaucuguucagcuguaccgguucacuggguuccaacgucgcgcacaaccuggucaauacaugcucaucaucaauggaugaccacagaagauauguuaacgguauggaaucgugucuggaucgaagauaacccguggauggaagauaaaacuccgguuacuacgugggagaaugucccauaucuugguaaaagagaagaucaguggugugggucacugauuggauuaacaagcagagcgaccugggcgcaaaacauuaguaccgcaauccaacagguaagaucuuuaauuggcaaugaagaauuuuuagauuacaugccaucgaugaaaagauuuaggaaggaagaagaauccgaaggagcaaucugguaa

SEQ ID NO: 23508 - RNA, 9873 nt, Artificial Sequence
  derived and/or modified CDS sequence (opt6) from DENV-3__KJ622197__SS-prME
acaagccuaugccuuaugaugaugcugccugccacccuugcauuucaucuaacuagcagagauggagaaccuagaaugauaguuggaaaaaacgagagaggaaaaucguuauuguuuaaaacagcaaguggcauaaauauguguacacuaauugcaauggaccuaggggaaaugugugacgacacaguaacuuauaaauguccucuaauagcugaaguggaaccagaagacaucgacugcuggugcaaucuaaccuccacaugggugacuuauggcacaugcaaucaagcuggagaacaucggagggacaaacgcucaguagcgcuagcuccucacgugggaaugggauuagauacgagaacucaaaccuggaugucugccgaaggagcauggaggcaaguagaaaaggucgaaaccugggcucuacgacacccgggguucacgauacuugcguuguuccuagcgcacuauauaggcacaagccugacacaaaaagucgucauauuuaucuuacuaaugcuaguaacacccucaauggcaaugcgauguguuggagugggaaacagggauuuuguagaagggcugucgggcgcaaccuggguagacguuguauuagaacauggugguugcguaacaacuauggcuaaaaacaaaccgaccuuagauauagaauuacaaaaaacagaggcaacacaacuugccacauuaagaaaacucuguauagaaggaaaaaucaccaauauuacuacagauucacgaugcccaacacaaggcgaagcuauucuaccagaagaacaagaucaaaauuacgucugcaagcauacuuaugucgauagaggguggggaaaugggugugggcuguuugguaaaggcucacucguuacaugugccaaguuccagugucucgaaagcaucgaagggaaaguggugcaacacgaaaauuuaaaauacacugugacuauuacgguacauaccggugaccagcaucaaguugguaacgacacucaaggaguuacagccgaaauaacuccucaagccucaacaguagaggcaauucuaccugaguacgguacccuaggccuugaauguucccccagaacuggccucgauuucaacgaaaugauuuuacuuacuaugaaaaacaaagcauggaugguucacaggcaaugguuuuucgacuuaccgcuuccguggacuucaggagcuauuacugaaacaccaacauggaacaggaaagagcuucuugugacuuucaaaaaugcucacgcgaaaaaacaagagguaguuguauuaggaucacaagaaggagcaaugcauacagcguuaacaggagccacagaaauacaaaacucaggaggcacuuccaucuucgcuggacaucugaagugucgauuaaagauggauaagcuugaacugaaaggaaugucauacgcuauguguuugaauacauucguccuaaaaaaggaaguaucagaaacacaacauggaacgauccuuauaaaaguagaguauaaaggggaggacgcuccgugcaaaauuccauuuucgacagaggacggacaaggcaaagcgcauaaugggagacuuauaacagcaaauccagucguaaccaaaaaggaagaaccgguaaacaucgaagcugagcccccauuuggcgaaucaaacauaguuaucgguauaggggacaaggcucuuaagauaaauugguacaaaaaaggcagcuccaucgggaagauguuugaagcaacugccagaggugcucgacgaauggcaaucuuaggugacacggcuugggacuucggcagcguugggggcguauugaauagucuagguaaaaugguccaucaaaucuuugggucugcauauacggcuuuauuuggaggaguauccuggauaaugaaaaucggaauagguguguugcuaacauggauaggguuaaacucgaagaacacuucaaugucuuucuccugcauagucauaggaauuaucacguuauaucuugguacagucguucaagcagauauggguugugugauaaacuggaaagggaaagaacucaaaugugggucggguauauuugucacuaacgaaguacacacuuggaccgaacaguauaaauuucaagcugauucaccgaaacgacuugcaacagcaauagccggagcaugggaaaacggaguuuguggcauccguaguaccacacgcauggaaaaccuauuauggaaacaaauugcuaaugaauugaauuacauucucugggaaaauaacauuaaauuaacuguagucgucggagacauuaucggcguauuagaacaaggaaaaagaacucuuacaccacaacccauggaacugaaauauucauggaaaacuuggggaaaagccaaaauuguuacagcagagauacaaaauucuaguuucauaauagauggcccaaacacgccagaguguccgucugcaagccgcgcauggaaugugugggagguagaagacuacggauuuggaguauuuacaacgaacauauggcucaaauuaagagaaguauacacacagacuugugaccauagacuaaugagugcagcaauaaaagaugaaagagccguccaugccgauaugggcuauuggaucgagucacaaaaaaauggcagcuggaaguuggaaaaagcaucauucauugaagugaagacaugcaccuggccgaagagucauacauuauggucaaacgguguauuagaaagugacaugauuauacccaaaaguuuagcagguccaauaagccaacacaaccaccgaccgggauaccauacacaaacagcuggaccuuggcauuuaggcaaacuagaauuagacuuuaacuacugugagggaacaacaguaguaaucacggaaaauugcggaacacgggguccgagucuucgaacuaccacaguaaguggaaaguuaauacacgagugguguugucguaguugcacucuuccuccauugcgguauaugggugaagacggguguugguaugggauggaaauaagaccgauaaaugaaaaagaagaaaacaugguuaaaucacuagucucagcaggaucaggcaaaguugacaauuuuacaaugggcguacuaugucuggcaauacuuuuugaagaagucaugagagguaaauucggaaaaaaacauaugaucgcgggagugcucuuaaccuuuauguuacucuuaucaggccagauuacauggcgcgauauggcccauacuuugauaaugaucgguaguaaugcaucggaucgaaugggaaugggagugacguaccucgcguuaauugcgacauuuaaaauacaaccauuuuuagcgcugggguuuuuccuaaggaaauuaacuucccgggaaaacuuauuguugggaguuggauuagcaauggcaacgacuuugcaauuaccagaagauaucgaacaaauggcaaacggaauagcauuaggauuaauggcucucaaauuaauaacccaauuugaaacauaucaguuauggaccgcauugguaagucuaacauguuccaacacaauuuuuacgcucacugucgcauggaggacagcgacuuuaauauuagcagguguuucucugcuucccguaugucaaaguagcagcaugagaaagaccgauuggcuacccguagcaguagccgcgaugggugucccuccguugccuuuauucauauuuucucuaaaagauacacuaaaaaggagaucauggccuuuaaacgagggugugauggccguaggccucgucuccauucuagcuaguagcuuauuacgaaacgacgucccaauggccgguccauuaguggcugguggucucuuaauugcaugcuauguuauaacaggaacaucugcagauuuaacaguagaaaaagcggcugaugugacuugggaggaggaagcagaacaaaccgguguaagccacaaucucaugauaacuguugaugaugacggcacgaugcgaauuaaagacgacgaaacugagaacauccuaacugucuuauugaagacagcauuacucauaguuuccggaauuuucccuuacagcauaccugcgacacucuuaguuuggcauacguggcaaaagcagacucagcgcucuggugucuuaugggaugucccaagucccccugaaacgcaaaaagcggaauuagaagagggaguauaucgaauuaagcaacaggggauauuugggaaaacucagguuggcguuggagugcaaaaagaaggagucuuccacaccauguggcauguaacccggggagcugucuugacucauaacggaaagagacucgagccaaacugggcuucaguaaaaaaggacuuaaucaguuacggagggggauggagauugagugcgcaguggcaaaaaggagaagaaguacagguaauagcuguugaaccaggacggaaucccaaaaauuuucaaacuaugccaggaauauuccagacaacaacgggagaaaucggggcaauagcauuagauuuuaaaccagggacguccgguagcccuauuauaaaucgagaaggaaaaguaguuggcuuauauggcaauggagucguaacgaagaacggagguuacgugaguggcaucgcucaagcaaaugcugaaccugacggaccgacgccagaacuagaagaggaaauguucaaaaaaagaaauuugacuauaauggaucuucacccaggaagcgguaagacacgcaaguaucuacccgccaucguaagggaagcuauaaaaagaagguuaagaaccuugauccuagcaccaacuagaguagucgcugcagaaauggaggaagcacuaaaaggauuacccauccgauaucagaccacagcaaccaaaagugagcacacggguagggaaauuguagaucuaaugugccaugcuaccuuuacaaugagacuacucucacccguaagaguuccgaauuauaaucuuauaauaauggacgaggcgcauuuuacagacccagcuaguaucgcagcucgcggguacauuuccaccagagucgguaugggagaagcugcggcaauauuuaugacggccacgccuccaggcacggcagaagcauucccacaaucuaacgcaccaauucaagaugaagaaagggacauuccugaacgaagcuggaauuccggcaaugaguggauaaccgauuuuguagguaaaaccgucugguuugucccuaguauuaaagcaggaaaugauauagcgaauuguuugcgaaaaaaugguaaaaaggugauacaauuaucacgaaagacauuugauacggaauaccaaaagacuaaacucaacgauugggacuucguaguaacgacagauauaagugaaaugggagcaaacuucaaagcagaccgaguaauagauccgcguagauguuuaaaaccagugauccugacugacgguccugaaagaguuauauuagcuggcccaaugccgguaaccgcugcauccgcugcgcaaagaagagguaggguggguagaaacccucagaaagaaaacgaccaguacauauucacaggacaaccuuuaaauaacgaugaagaccaugcgcacuggaccgaagcuaaaaugcuccucgauaacaucaauacgccagaaggaauuauaccagcccuuuucgagccugaaagggagaaaucugcagccaucgacggugaauaccgacuuaaaggagaaucaagaaaaacuuucguggaacuaaugagacgaggagaucuuccgguuugguuagcucacaaaguagcgucagaagguauuaaauauacagauaggaaguggugcuuugacggagagaggaauaaucaaauucuggaggaaaacauggaugucgaaaucuggaccaaagaaggugaaaggaaaaaauugagacccagguggcucgaugcaaggacuuauucaaacccucuagcucuuaaggaauuuaaagauuucgcugcaggaagaaaaucgauagcacuugaucucgugacagagauaggccgagucccaagucacuuggcccauagaacgagaaacgccuuggauaaucugguuauguugcauacgucugagcaugguggaagggcauaccgacaugcaguugaagaacuaccugaaacaauggaaacauugcuuuuacuaggguuaaugauacugcuaaccgguggagcaaugcuauuuuuaaucucagguaagggaauaggaaaaacaagcauaggacuaauaugugugauugucucgucgggaauguuauggauggcagauguuccguuacaauggaucgcuagugcgauaguucuagaguuuuuuaugaugguauuacucauuccugaaccugaaaaacagaggacuccucaagauaaccaauuggcuuauguagugauugguauauuaacauuggcagccauuguugcagcgaaugaaaugggguuguuagaaacuaccaaaagggaucugggcaugucaaaggaaccugguguggugaguccaaccaguuacuuggacguagauuuacauccagccagugcauggacacuuuaugcgguugcuacuacaguuauuacaccuaugcugcgucauacuauugaaaauucuaccgcuaauguaagucuugccgcaaucgcaaaucaagcuguuguacuuaugggucuagauaaaggcuggccaauaagcaaaauggacuuagguguaccuuuauuagcauuaggcuguuauagccaagugaauccgcuaacucuaaccgcugcgguacuacuacucguaacucauuaugcaauuauaggacccggcuuacaagcaaaagcgacgagagaagcccaaaagaggacugcagccggcauuaugaaaaacccgaccguagauggcauaaugacaaucgauuuagauccuguuauuuacgauaguaaauucgagaaacaacuaggccaaguaauguuauuaguccuuugugccguucagcuucugcucaugcggacgaguugggcauuaugugaagcacuaaccuuagcaacaggucccauaacaacguuaugggaaggaagcccagggaaauuuuggaauacaacaauagcagucuccauggccaacauuuuucgagguucguaucuagcaggagcagggcuagcauuuaguauaaugaaaucgguugguacaggaaaacgggggacuggcucccagggggaaacucuuggagaaaaauggaaaaaaaaacuaaaccagcuauccaggcgggaauuugaacuuuacaaaaaaucagguaucacagaaguagaccgaacagaagcaaaagaaggccuuaaacguggggaaacaacccaccaugcugucucaagagggagugcgaagcuccaaugguucgucgaaagaaauaugguaauaccagaagguagaguaaucgaucuuggcugcgguagaggaggguggucauauuacugugcgggauuaaaaaagguaacugaaguaagaggauauacaaagggaggaccaggucaugaagaaccagugccaauguccacuuauggguggaauacugugaaacuuauguccggaaaagacgucuuuuacuugccccccgaaaagugcgauacccuacuaugugauauaggcgagucaucuccaagccccacuguggaagaaucgcgaaccauucgcguucuaaaaaugguagaaccauggcuuaagaauaaccaauucuguauuaaagugcucaacccguauaugccaacaguuauugaacaccuugaaaggcuacaaagaaagcaugguggaauguuagugcgaaauccucugucccgcaacaguacccaugaaauguauuggauauccaaugggacuggaaauauaguuuccagcgucaacaugguaucccgacuuuuguuaaaccgcuucacgaugacacacagaagaccaacuaucgaaaaagacguagaucuaggagcagguacucgacaugucaacgcugagccggagacccccaauauggauguaaucggugaacgaaucaaaagaauaaaagaggaacauucgagcacuuggcauuaugacgaugaaaauccuuacaaaacuugggcuuaucacggcaguuacgagguaaaagcaacagguucagcaucaucgaugauaaauggaguagucaaauuacugacuaaaccaugggauguugucccaaugguaacucaaauggcuaugacagacacaaccccuuucgggcaacaaagaguuuucaaagaaaagguugauacacgaacgccacgaccaaugcccgggacucggaaaguuauggaaauaacggcggaguggcuauggagaacacuaggaagaaacaagcgaccuagauuguguacaagggaagaauuuaccaaaaaaguacguacaaaugcugcuaugggagcaguauuuacugaggaaaaucaaugggagagugcuagagcagcaguggaagacgaggaauucuggaaacuaguaggccgagaacgcgaauuacacaaauugggaaaaugugguagcuguguguacaauaugaugggaaaacgugagaaaaagcucggagaauucggaaaagccaaaggcucaagggcuauuugguauaugugguuaggugccagauaucuggaguuugaggcgcuaggcuuuuuaaacgaagaucauugguucucaagagaaaauaguuauucaggagucgaaggagaaggucugcauaaacucggcuauauccuaagagacauaucaaagaucccagggggggccauguacgcggaugauacagcagggugggacacacgaauuacugaagacgaccuacauaaugaagaaaagauaacucaacaaauggauccggaacacagacaauuggcgaaugccauauuuaagcuaaccuaucaaaacaaaguugugaaagugcagcgaccaacgcccaaagguacuguuauggauauaauaucgcguaaggaucagcgaggaucgggucagguuggaacauacggacucaauaccuucacuaacauggaagcgcaacuuauaagacaaauggaaggugaagguguauuauccaaagcagaucuagaaaacccucauuuauuagaaaagaaaauuacccagugguuagaaacgaaagggguggaaagacuaaagagaauggcaauuagcggugacgauugcguaguuaagccaauagaugaucguuuugcaaaugcacuacuagcucuaaacgauaugggaaagguaagaaaggacauaccccaguggcaaccuucgaaagguuggcaugauuggcagcaaguaccguucugcagccaucacuuucaugaacucauaaugaaagauggacgcaagcuuguaguuccuugccggccucaggaugaacucauaggaagagcgcggauaucacagggagcaggauggucucuuaaagaaacggccuguuugggaaaagccuaugcacaaauguggaguuuaauguauuuucauagaagagaucuccgucuugcaagcaaugcaaucuguagugcugugcccguccauuggguaccaaccucccguacgacauggucaauacaugcucaucaucaauggaugacgacugaagacaugcuaacuguuuggaaucguguauggauagaggacaauccguggauggaggauaagacgccugugaccaccugggaagauguaccuuaccuagguaagcgagaggaccaauggugcgggucucuaaucggccuaacaaguagagcgacaugggcccaaaacaucuuaacggcgauacagcaaguccgaucacucauaggggaugaagaauuccuagauuauaugccaucaaugaaacgauuucgcaaagaagaagaaagugaaggggcuauuugguaa

SEQ ID NO: 23509 - RNA, 9873 nt, Artificial Sequence
  derived and/or modified CDS sequence (opt6) from DENV-3__KJ622198__SS-prME
acuagccuaugucuuaugaugaugcuaccagcaacgcuugcuuuccaucuaacgucaagagauggugaaccaagaaugauaguaggcaaaaaugaacgagggaaaucucuauuauucaaaacugcuaguggaauaaauaugugcacucugaucgcaauggacuugggggaaaugugugacgacacaguuaccuauaaauguccgcuaauagcugaaguagaaccggaagauaucgacuguuggugcaaucuaacgucuacuuggguaacauaugggacuugcaaucaagcaggagaacaucgccgggacaaacgaagugucgcauuagcaccucacguagggauggguuuagauacgcgaacccagaccuggauguccgcagaaggggcauggcgucaagucgaaaaaguugaaacaugggcauugagacaucccggauucacgauauuagcauuauuucuggcucauuacauaggaacaucucucacccaaaaagugguaauauuuauuuuacuaaugcuuguuacaccauccauggcuaugcgaugugucggcguuggaaacagagacuucguagaaggacuauccggcgcaaccuggguugaugugguacuagaacacggaggcuguguaacaacaauggcgaaaaauaaaccgacauuggacauagaauuacagaaaacggaagcaacccaacuagccacuuugagaaaauugugcauagaaggcaaaauuacaaauaucacaaccgacucuagauguccaacucaaggagaagccauacucccugaagaacaggaucagaacuacguauguaaacauaccuaugucgauaggggguggggaaacggcugcggacuguuugguaaagguucucuaguaacaugugcaaaauuccaaugucuugaaucuauagaagggaaagugguacaacaugaaaaucuaaaauacacggugacaauaacagugcacaccggcgaucagcaccaagucgguaaugacacccaagguguaacggcugaaauaacuccgcaagcaaguacaguugaagcaauucucccggaauauggaacacucggucuggaaugcaguccacgcacaggcuuagacuucaaugaaaugauacuccuaacaaugaaaaauaaggcuuggaugguucacagacaaugguucuucgaucuuccacugccuuggacgucgggagccauaacagagacacccacuuggaauagaaaagaacuucuaguuacuuuuaaaaaugcucaugccaagaaacaagaaguaguaguuuuaggcucccaagagggcgcgaugcauacugcucuaaccggugcaacagaaauacagaauaguggcggaaccagcauauuugcugggcaucuuaaaugccgcuuaaaaauggauaaacuagaguugaaaggaaugagcuaugcuauguguuuaaauacuuucguucucaagaaagaaguaagugaaacgcaacauggcacuauacuuauuaaaguagaauacaaaggagaggaugcgccuuguaaaauuccauucuccacagaagacggacaaggaaaagcccacaauggacgacugauaacagcgaauccgguaguaacuaagaaagaggaaccuguuaacaucgaggcugaaccgccauuuggagaaaguaauauagucaucgguauuggagacaaagcucugaaaauuaauugguauaagaaaggcucgaguaucgguaaaauguuugaagcaacggcaagaggagcucgccguauggcaaucuuaggagauaccgcuugggauuucgggaguguugguggcguucuaaacagcuuggggaaaaugguucaccaaauauuuggaucugcauauacagcuuuguuuggcgguguauccuggauuaugaaaauuggcauuggcguucuuuuaacauggauaggacuaaauagcaagaacacaaguaugaguuucaguuguauagugauagguauaauaacccuuuaccuaggaacagucguacaggcagauauggguuguguuauaaacuggaaaggaaaagagcugaagugugggagcggcauauucguuacgaaugaaguucauacauggacugaacaauauaaauuccaagcagauagcccuaagagacucgcgacagcuauagcaggcgcaugggaaaacgggguaugugggauacgaagcacuacaagaauggaaaacuuauuauggaaacaaaucgcaaaugaguuaaacuauauauugugggaaaauaauauaaagcuaacggucguaguuggugauauuauugguguacuugaacaaggaaaacguacacugacgccucagccgauggaguuaaaauacaguuggaaaacauggggaaaagcgaaaauuguaacggcagaaauacagaacuccucuuuuaucauagaugguccuaacacacccgagugccccucagcaaguagagcuuggaaugucugggaggucgaggacuacggauucggagucuucacgacuaauauuugguugaagcugagagaaguauauacccagacaugugaccauagguuaaugucugcugcaauaaaagacgagcgggcgguacacgccgacaugggauauuggauagaaagucagaaaaacggaucauggaaauuagaaaaagcaucuuuuaucgaaguaaaaacaugcacuuggccuaagagucacacauuauggagcaacgggguucuagaaagcgacaugauuauaccaaagucucuggcagguccgauaucacaacauaaccacagacccgguuaccacacacaaacugcaggaccuuggcaccuaggaaaacuugaauuagauuuuaauuacugcgaggggacuacagucguuauaacggaaaauugugguacaagagguccaucauugcggacaacaacuguguccggcaaauuaauucaugagugguguuguagaucaugcacauugccuccacuuagauacaugggagaagauggcugcugguacgggauggaaauccgaccuaucaaugagaaagaagaaaauaugguaaaaucguuagugagcgcgggaucagguaaaguagacaauuucacaauggguguccuauguuuagcuauuuuguuugaggaaguaaugagggggaaauuuggcaagaaacacaugaucgcggguguucuuuuaacuuucaugcugcuauuaucaggacaaauaacauggagagacauggcucauacauuaauaaugauagguucaaaugccucugaucguauggguaugggcgugacauauuuagcuuugaucgcuacuuuuaaaauacaaccauucuuagcuuuaggauucuuucuuagaaaacuaacaucacgugagaaccuauuauuaggaguugguuuggcuauggcgacgaccuuacaguuaccugaagauauagaacaaauggcaaaugguauagcucuaggguuaauggcccuaaaauuaauaacacaguuugagaccuaucaacuguggacggccuuagucucucugaccugcucuaacacaauuuucacguuaaccguugccuggcggacagcgacacuaauuuuagcaggcguaucauuacuuccugugugccagucauccucgaugcguaaaacggauugguuaccaguugcaguagcggcaaugggugugccacccuuaccacuuuuuauauuuucccuaaaagauacauuaaagagaagaucauggccucuaaaugaaggcgugauggcuguuggccuugucuccaucuuagcaaguagccuccuucggaaugauguuccaauggcuggaccacucguggcuggagggcuccucauugccuguuacgucauaaccggaaccuccgcagaucuuaccguagagaaagcagcugacguaaccugggaagaggaagcagaacaaacuggagugucacauaauuuaaugaucacgguagaugaugauggaacuaugcgaaucaaagaugaugagacagaaaauauuuuaacaguucuuuuaaagacugcguuacuuauaguaucagguauuuucccguacucaaucccagcuacucuccuaguauggcauacauggcagaaacagacucaaaggucuggcgucuugugggaugugccaucaccgcccgagacacagaaagccgaacucgaggaaggaguauaccgaaucaaacaacaaggaauauuugggaagacgcaaguggguguugguguccagaaagaagguguuuuccacacuauguggcauguuacucguggagcaguguuaacgcacaauggcaaaagacucgagcccaauugggcgagcguaaagaaagacuuaauaagcuacggaggaggauggagacuaagugcccaguggcagaaaggggaagagguacaaguaauagcaguagaaccagguagaaaucccaaaaauuuccagacaaugcccggaauauuucaaacuacuacaggugaaauaggagcaauagccuuagacuuuaaaccuggaacgucagggucuccaaucauuaauagggaaggcaaaguagucgggcuuuacggcaauggaguuguaacaaagaacggaggguauguaagugguauagcucaagcuaacgcagagccggacggaccaacgccugagcuugaggaagaaauguuuaagaaacggaacuuaacaauaauggaucugcauccaggaagcggaaaaacaagaaaauacuuaccugccauugugagagaagcgauaaagagaagacugagaacuuuaauacuugcaccuacaagagucguagcagcugaaauggaagaagcucucaaagguuuaccuauuagguaucagacaacugcaacuaagucggaacacacuggcagagagauaguugaccuuaugugucaugcuacuuucacgaugagauuacuauccccaguucguguuccaaacuauaauuuaauaauaauggaugaggcgcauuuuacagauccagcaaguauagccgcacgaggauauauaaguaccaggguuggaaugggagaagcagccgccauauuuaugacugcaacucccccuggaacagcugaagcauucccucaaagcaaugcaccuauucaggaugaggaacgagauauuccggagcguucauggaacagcggaaacgaguggauaaccgauuucguagguaaaacaguaugguuuguaccgucgauaaaagcggggaaugauaucgcgaauuguuugcggaaaaauggcaagaaaguuauucagcuaucaaggaaaacauuugacacagaauaccaaaagaccaaacuaaaugacugggacuucguaguaaccacggauauauccgaaaugggggccaauuuuaaagcugaucgugucauagacccgagaagaugccuuaaaccugucauacuaacagauggaccggaacgcguuauccuggcagguccgaugccaguaacugcggccucggcggcgcaacgaagagguagaguaggccgcaauccucaaaaagaaaaugaccaauauauauucacgggacaaccauuaaauaacgacgaggaucaugcacauuggacagaggccaagaugcuauuagacaauaucaauacaccagagggcauaauuccagcuuuauucgagccugaaagggaaaagagcgcagcgauugauggggaguaucgacuaaaaggggagucucguaaaaccuucgucgaauuaaugcggcguggugaucucccgguaugguuagcucauaagguugcaagugaagggauaaaauauacggaccgaaaauggugcuucgauggcgaaagaaacaaucaaauucuagaggaaaauauggacguugaaauuuggaccaaagaaggugaaaggaagaaauuaagaccuagaugguuagacgcuaggaccuacucuaauccacuugcacugaaggaguucaaggacuuugcugcagguagaaaaucuauagcucuggaccuagucacugagaucggcaggguaccaucacaccuugcacauagaacaaggaacgcguuagauaaucuuguuaugcuacacacgucugaacauggaggacgugccuaucgccaugcaguugaagaauugccugagacuauggagacuuuauuauuauugggcuuaaugauuuuauuaacaggcggagcuauguuauuuuugauaucgggcaaaggaauugggaaaaccucaauagggcuaaucugugugauuguuucaagugggauguuguggauggcagauguaccacuacaauggauagcaucggcgauagugcucgaguucuuuaugaugguucucuuaauaccagaaccagaaaaacaaagaacuccacaagauaaucaguuggcauacguaguaauaggcauauugacuuuagcagcaauaguugccgccaaugaaaugggauuauuagagacuacaaagcgagaucuuggaaugaguaaagagccaggaguagugucaccuacaaguuaccuagauguugaccugcauccagccucggcguggacguuauacgcaguggcgacaacgguuauuaccccgaugcucaggcacacuauugaaaacagcacagcaaauguaagccuugcagcgauagcuaaccaagcaguaguucuuaugggguuagacaagggauggccaauaucaaaaauggacuuaggaguuccucuacucgcccuaggaugcuauagucaagucaauccgcuaacauuaacagcggcuguccuacuucuuguaacccacuaugcaauuauaggaccuggacugcaagcuaaagcaacacgugaagcccaaaagcguacagccgccgguaucaugaaaaaccccacuguggauggaauuaugacuauagaccuagauccggugauuuacgacucuaaauuugaaaaacaacuggggcaaguuaugcuauugguccuuugcgcaguucagcuccugcugaugagaacaaguugggcacugugugaagcauuaacacucgcaaccgguccgauaacaacucuuugggaagguucacccggaaaauucuggaauacaacuauugccguaucaauggcaaauauuuuccguggaagcuaccuugccggugcgggccuagccuuuagcauuaugaaaucaguagguacagguaaacguggaacaggcucucaaggagaaacauugggagaaaaauggaagaagaaacuuaaccaacuaagucgacgagaguucgaauuauacaagaaaaguggaauaacugaaguugaucgaacggaagcaaaagaaggacuaaaaagaggagaaacaacacaccaugcaguauccagagggagugccaaacugcaaugguuuguagaaagaaauauggucauuccagaaggacgcgucauugauuuaggaugugguagaggaggguggucguacuacugcgcaggacuaaagaaagucacugaaguaagggguuauacaaaaggaggccccggacaugaagaaccaguaccgaugagcacuuauggauggaauaccguuaaacuaaugagcggaaaagauguauucuacuuaccaccugaaaaaugugauaccuuacuaugcgacauaggagagagucucccaucacccacaguugaggaaagccguacuauccgaguuuuaaagaugguugagccauggcucaaaaacaaccaauuuuguaucaaaguacuaaaucccuauaugccaacaguaauagagcaucuagaaagauugcagcguaaacaugguggcauguuaguucgaaacccuuuaucacgaaacucaacucaugaaauguauuggauaagcaauggaaccgguaauauaguuaguagcguuaauauggucucuaggcugcuguuaaacagauuuacuaugacacaucggcgaccaacuauugagaaagaugucgacuugggcgccgggacaaggcacguuaacgccgaaccugagacuccaaauauggaugucauaggcgaaagaauaaaacguaucaaagaagaacauuccuccacauggcauuacgaugacgaaaacccauacaaaacaugggcguaucacgguucuuaugaaguuaaagccacgggaucugcuuccaguaugauaaacggagucgucaaacuacuuaccaaaccuugggaugugguaccuaugguuacucaaauggcaaugacagauacuacaccuuuuggucaacaacgugucuuuaaagaaaaaguagacacacguacuccaaggccaaugcccggcacgagaaaagugauggaaauaacagcugagugguuguggaggacacuagggcguaacaaacgucccagacuuuguacaagggaagaguuuacgaagaaaguacgcacuaaugcagcuaugggcgcugucuuuacagaggagaaucaaugggaaucggcacgcgcggccgucgaagacgaagaguucuggaaguuggugggaagagaacgcgagcugcacaaauuaggaaaaugcgggucauguguuuacaauaugauggguaaaagagagaaaaagcucggugaauuugggaaggcaaaagguaguagagcaauaugguacauguggcuaggugcucgauauuuagaguucgaagcauuagguuuccuaaaugaagaucauugguuuagccgugaaaauaguuacagcgggguugaaggggaagguuuacacaaguuagguuauauacucagggauauuucaaaaauuccggguggggcuauguaugcagacgacacagccggaugggauaccagaaucacagaagacgacuuacauaaugaggagaaaaucacccagcaaauggauccagagcaccgccaguuggccaaugcaauauucaaauuaaccuaucaaaacaaaguaguaaaggugcaacgcccuacuccaaaaggaacuguaauggacauaauuagucguaaagaccaacgugguucuggucaaguuggcaccuacggauugaauacuuuuacuaacauggaagcacaacucauucgacaaauggaaggagagggcguauuaucaaaagcagaucuggaaaauccacaccuacuagagaagaaaaucacucaaugguuagaaacuaaaggaguugaacgacuuaaaaggauggcaauaucaggggaugauugugugguaaaaccuauagaugaucgauuugccaaugcucuacuagcuuuaaaugauaugggaaaaguccggaaggauauaccacaauggcagccuagcaaaggcuggcaugauuggcaacaagugcccuucuguagucaucauuuccaugaguuaauuaugaaagauggaagaaagcuaguagugccaugucgaccgcaggacgaauuaauagggagagcacguauuucacagggagcgggauggagccuaaaggaaacagcuugucuuggcaaggccuaugcacaaauguggucucuaauguauuuucacagacgggaucuaagauuagcguccaaugcaauuugcucagcuguaccaguacauuggguaccaaccagccgcacaacauggucaauacaugcacaccaucaauggaugacuacugaggacaugcuaacaguuuggaauagaguauggaucgaggacaauccauggauggaagauaaaaccccugucacaacaugggaagacguuccauauuuaggaaaaagggaagaucaauggugugggucacuuaucgggcucacaagucgagccacaugggcucaaaacauacuuacagcaauucaacaagucagaagucuuauaggggaugaagaguuuuuagauuacaugccaaguaugaagagauuccggaaagaagaggaaagugagggugcaauaugguga

SEQ ID NO: 23510 - RNA, 9873 nt, Artificial Sequence
  derived and/or modified CDS sequence (opt6) from DENV-3__KJ622191__SS-prME
acuucgcugugcuuaaugaugauguuacccgcuacccuugccuuucacuuaacauccagggauggugaacccagaaugauagucgguaagaaugaaaggggaaaaucacuauuguuuaaaacugcgucgggaauuaacaugugcacgcuaauugcgauggauuuaggugaaaugugugaugacaccguuacuuauaaauguccuuuaauugccgaagucgagccagaagauauagauuguugguguaauuugacuagcacguggguuaccuaugguacaugcaaucaagccggugaacaccgucgagauaaacgauccguggcacuggcgccacauguagguaugggucuugacacucgaacccaaacguggaugucggcagagggagcauggaggcaagucgaaaaaguggaaacuugggcuuuacgacauccggguuucaccauacuggccuuguuccuugcgcacuacauagguacaucgcugacacagaaaguggucauauuuauuuuacugauguuaguaacaccaucaauggcgaugcgaugcguaggagugggaaaucgcgauuucgucgagggccugucuggagcaacaugggucgacgucgucuuagaacauggcggguguguuaccacgauggcuaaaaacaaaccaacacuugauauagaacuccagaaaacagaagcuacccaacucgccacacucaggaaauuauguauagaaggcaagauaacaaauauaacuacugacaguagaugccccacacagggcgaggcuauccuaccagaagaacaagaucaaaacuacguauguaagcauacguacguagauaggggcuggggcaacggauguggacuuuuuggaaaagguucgcuagucaccugugcaaaauuucaaugccuagaaagcauagaaggcaaggugguacaacaugagaauuuaaaauacacugucaccauuacaguucauacaggggaccagcaccaaguaggaaacgacacacagggaguaacggcggaaaucacgccccaagcauccacaguggaagcuaucuugcccgaauacgguacccuaggauuagaguguucgccucgcaccggauuagauuuuaaugaagugauauuauugacgaugaaaaauaaggcuuggaugguccauaggcaaugguuuuuugacuugccccucccauggaccagcggagcaauaacagaaacaccuacuuggaauagaaaggaacuccugguaacauuuaaaaaugcucacgcaaagaagcaagaagucgugguuuugggaagucaggaaggggccaugcauacugccuugacuggagcgacugagauucaaaacagcggagguacuucaauuuucgccggucaucuaaaaugccgauuaaaaauggauaaauuagaacuaaaggguaugagcuacgcuaugugccuaaauacuuuuguacuuaaaaaagaaguuucagaaacucaacacggaaccaucuuaauaaaagucgaguauaaaggagaagacgcccccugcaaaauacccuuuaguacugaagauggccaaggaaaagcacacaauggucgacucauuacggcaaacccuguuguaacaaagaaggaggaaccuguuaauauagaagcggaaccucccuucggagaaucuaauauagucauagggaucggagauaaggcacuaaaaauaaacugguacaagaaaggauccagcaucggaaaaauguuugaagcaaccgcaagaggagcccguaggauggcuauuuugggggacacugccugggauuucggcaguguaggugggguacuuaacagucuaggaaaaaugguucaucaaauauuuggguccgcauauacagcgcuguucggcggaguuucauggauuaugaaaaucggcauugguguguuguuaaccuggaucggacuuaacucgaaaaauaccagcaugucuuucagcugcauaguaauugguauuauaacgcuuuauuuaggaacaguuguacaggcagauaugggguguguaaucaauuggaaggggaaggaauuaaaauguggaucaggaauuuucguaacgaacgaaguacauacauggacagaacaauauaaauuucaagcagauaguccuaaaagguuagcgacggcuauugcaggugcaugggaaaauggugucugcggaauccgaaguacaacgcguauggaaaaucuuuuguggaaacaaaucgcuaaugagcugaauuacauuuuaugggaaaacaauauaaaacucacaguaguagucggcgauauaauaggaguauuagaacaagguaaaagaacguugacaccacaaccaauggaauuaaaauacucauggaagacuugggggaaagcuaaaauagucacagcugaaauccaaaauucaucguucaucauagaugggccuaacacuccggaguguccaagugcaaguagagcguggaacgucugggagguagaagauuacggauuugggguuuuuacuaccaauauaugguuaaaauuacgggaaguauauacgcaaacgugugaccaucgccugaugucagcugcaauaaaggacgagagagcuguucacgcugacaugggcuauuggauagaaucacaaaaaaacggcaguuggaaacuugaaaaagcuucuuucauugaagugaaaacauguacuuggccaaaaagccacacauuguggucaaacggaguccuugagagcgacaugaucaucccuaagucguuagcaggacccaucucacagcauaaucaccgaccugguuaucauacacagacggcugguccauggcauuugggaaaauuagaauuagacuuuaacuacugcgaaggcacgacugugguuauuacggaaaauuguggaacacgagggcccagucugagaacuacuacggugucagguaaauuaauccacgagugguguuguaggagcugcacacugccuccuuugagguauaugggggaagacgggugcugguacggcauggaaauaaggcccauuaacgaaaaagaagagaauaugguuaagucauuagugagugcugguucagguaaggucgauaauuucacuauggguguuuuauguuuggcgauuuuguucgaagaagucaugaggggaaaauucggaaaaaagcacaugaucgcagguguacuacuaacauuuauguuauugcuauccggacaaauaacauggagagauauggcacauacgcuuauuaugaucggaaguaaugcgagcgacaggauggguauggguguuaccuaucucgcauugaucgcaacuuucaaaauacaaccuuuuuuagccuuaggcuucuuccuccgaaaguugacaucgcgggaaaaucucuuacucggagucggauuagcaauggcaacaacuuuacaguuaccugaagacauagaacaaauggccaacgggauagcuuugggguugauggccuugaaauugauaacacaauuugaaacuuaucaacuauggacggcguuaguuucgcugacgugcaguaacacaaucuucacuuuaacaguugcauggcgaacggcgacccuuauccuagcagggguaucgcuccuuccuguuugucagucgagcucuaugcgaaaaacagauuggcugccaguagccguagcugcuaugggcgucccaccacuaccauuauucauuuuuagccuuaaagacacauuaaaacgcagaucauggccacuuaacgaaggaguaauggcgguaggauuagugucaauucuugcaucuagccuuuugcgaaaugaugucccaauggcugggccguuggucgcaggcggucuauuaauugcuuguuacguuauuacuggaacaagugcggaucucacaguagagaaggcagcagauguuaccugggaggaagaggcagaacaaacaggaguuagucauaaucucaugauaaccguggaugaugauggaacaaugcgcauuaaagacgaugaaacagagaacauacuaacaguucuucugaagacugcacugcuaauuguuagcggaauauuuccuuauuccauuccugcaaccuuauuaguuuggcauaccuggcaaaaacagacacaaagaaguggcguacuaugggacguuccuucuccucccgaaacacagaaagcugaguuggaagaaggaguauaccguaucaaacaacaaggaauuuucggaaaaacacaaguuggaguaggcguacaaaaagaaggugucuuccauacaauguggcacguaacaaggggggcaguuuuaacucauaauggaaaaagguuagaaccaaauugggcuagugucaaaaaggauuuaauaucguauggcgguggauggcggcugucugcucaguggcaaaaaggugaagaaguacagguaauagcagucgaacccggaagaaauccaaaaaauuuccaaaccaugccaggaauauuccaaacgacaaugggcgaaaucggagccauagcguuagauuuuaaaccaggaacaagugggucuccaauaauaaacagagaaggaaaaguaguaggcuuauaugguaaugggguaguuacuaagaaugguggcuauguaucuggaauagcucaagcuaaugcagaaccugacggcccuacucccgaacuugaagaggaaauguucaaaaaacgaaaucugaccauuauggaucugcacccaggaaguggaaaaacuagaaaguaucuaccagcgauaguucgagaagcgauaaaaagaagacuuagaaccuugauacucgcaccaacccgaguaguagcagcugagauggaagaagcccucaaaggacugccaauuagauaccagacuacagcaacaaagagugagcacacaggaagagaaauaguagaucucaugugucaugcgacuuucacuaugagauuacuaucaccuguucguguucccaauuauaauuuaaucauaauggaugaggcucauuuuacggacccugccagcauugcagcaagagguuacaucucuacaaggguaggcaugggugaagcggcagcaauuuuuaugacagcaacuccaccuggaacugccgaagcauuuccacaaucaaaugccccaauccaagaugaagaacgugacauccccgaaagaaguuggaauucagggaaugaauggaucacagacuuuguggguaaaaccguaugguucgugccaucuauaaaggccgggaaugauaucgcgaauugucugcgaaaaaauggaaaaaaaguuauucaguuaucgcgaaaaaccuuugauacagaauaucaaaagacaaaauuaaaugauugggauuuuguuguuacuacugacauuucagagaugggagcuaacuuuaaagcugaucgagucauagacccccgacguuguuuaaaacccguaauuuugaccgaugggccagagaggguaauacuagccgggccuaugccaguaacggcagcauccgcugcacaacgaaggggacgggucggaagaaauccucaaaaggagaacgaccaauacaucuuuaccggucaaccacuuaauaaugaugaagaucaugcccacuggacugaagcaaaaaugcuuuuagacaauauuaacaccccugaaggaauaauccccgcuuuauuugagcccgagagggaaaaaucagcagcgaucgauggugaguauagauuaaagggagaaucaagaaaaacauucguagaauuaaugagacgaggggaucuaccaguguggcucgcacacaaaguagccagugaaggaauaaaauauaccgacaggaaaugguguuucgauggagaaaggaacaaccaaauacuggaagaaaauauggauguugaaauauggacgaaagaaggagaacgcaaaaaguuacggccaaggugguuagaugcuaggacauauuccgacccacuugcacuaaaagaauucaaagacuucgcugcugggcgcaaaagcaucgcuuuagaccuuguaacugaaauagguagaguuccuagccaucuggcacacagaacgagaaacgcacuagauaaccugguaaugcuacauacuagcgaacacggaggacgugccuaccgccaugcaguagaagaguuaccagaaacaauggaaacccucuuacuacuuggacuaaugaucuuacuaacagggggcgcaauguuauuccuaaucagcggaaaggguauaggaaaaacaucaauaggacucauuugcguaauagugucaucggguaugcuauggauggcagacguuccauuacaauggaucgcuagcgcgauaguccuggaauucuuuaugaugguacuacucauuccagaaccggaaaaacaaagaacaccucaggauaaccaauuagcguaugucguaauuggaauucuaacacuggcugcaauaguugcagcaaaugaaaugggucuucuagaaacaaccaaacgagaucuagguaugucaaaagaacccggaguugugagcccaacuucuuacuuagauguugacuuacauccugcuuccgcuuggacauuauaugcaguagccacgacaguaauuacgccaaugcuaagacauacaauagaaaacucuacagcaaaugucagcuuagccgcaauugcgaaccaagcagugguauugaugggucuggauaaaggguggccgauuucaaaaauggaucuagguguaccacuuuuagccuuaggauguuacagucagguaaauccuuugacucuaacagcagcagugcuuuuauugguuacacauuaugcuauaauaggaccaggcuuacaagcgaaagcaaccagagaagcacaaaaacggaccgcugcggguauaaugaagaacccaacuguagacggaauuaugacaauugaccuggacccugucauuuaugauaguaaauuugaaaagcaacuaggacagguuaugcugcuuguguugugugcuguacaguuguuauuaaugagaacaucuugggccuuaugugaagcucucacacuggcgacugggccaauaacuacgcucugggaaggcucaccaggaaaguucuggaacacaacuauagcagucucaauggccaacaucuuucguggcaguuaucuggcaggugcugguuuagcuuuuaguauuaugaagaguguugggacagguaaaagaggcacuggaucgcagggugaaacauuaggugaaaaauggaaaaaaaaacuuaaccaacugagccgaagggaguuugaauuauauaaaaaaaguggaaucacggagguagacagaacagaagccaaggaaggacuuaaacguggagaaacaacucaucacgccguaucucgaggaucagcaaaacugcaaugguucguugaaaggaauauggugaucccugaaggaagaguaauagauuuagguugcggcaggggaggauggaguuauuacugugcagguuuaaaaaaagugacggaaguucgugguuacacgaaagguggccccgggcaugaggaaccgguuccuaugaguaccuauggcuggaauacaguaaaauuaaugucaggaaaggauguauuuuaccugccaccugaaaaaugcgacacacuucuaugugacauaggggagaguagcccaucucccacaguugaagaaagccgcacgauccgaguauuaaaaaugguggaaccuuggcuaaaaaauaaucaauuuuguauuaaaguguugaauccauauaugccaacaguaauagaacaucuagaaagauuacaaaggaaacacgggggaauguuaguacgaaacccccuaucucgaaacucgacgcacgaaauguacuggauuaguaaugggacaggaaauauagugucaagugugaauaugguuucacgucucuuguugaaccgauuuacaaugacacaucgucgaccaaccauagaaaaggauguugauuugggagcgggaacgagacacguaaaugcugagccugaaacgccuaauauggauguaauuggcgaaagaauaaaaagaauaaaggaagaacauaguagcaccuggcauuacgaugaugagaacccauauaaaaccugggccuaucacggcucguaugaagugaaagcaacuggaucugcaaguucaaugauaaacggggucgucaagcuacuaacgaaaccaugggaugucguaccgaugguuacccagauggcuaugaccgauacaacaccauuuggccagcaaagagucuucaaagaaaaaguagacacaagaacgccaaggccgaugccuggcacucgaaaaguaauggaaauuacagcugaauggcuuuggagaacuuugggccgaaacaaaagaccucggcuuuguacucgugaggaauucaccaagaaggugagaacaaaugcagcuaugggagcuguuuuuacggaggaaaaccaaugggagagugcuagagcagccgucgaggaugaggaguuuuggaaauuaguaggcagggaacgggaacuacauaaauuagguaaguguggcaguuguguguacaauaugauggguaaaagagaaaaaaaauuaggggaauuugguaaagcuaaaggaucacgagcuauuugguacauguggcuaggagcgagauaucuugaauucgaggcauuagguuuuuuaaaugaagaucauugguuuucaagagaaaauucguauaguggaguagaaggagaaggcuugcauaaacucgguuauaucuuacgugauauuagcaaaauaccuggaggggcuauguaugccgaugacacagcagguugggauacacguauaaccgaagacgaccuacauaaugaagagaaaaucacucaacaaauggauccugaacacagacaacuagccaacgcgauauuuaaauugacauaucaaaacaaaguaguuaaaguccaaagaccaacaccuaaaggcacgguaauggauauaauaucuaggaaagaccaaaggggaucaggccagguugggacauauggacucaauaccuuuacaaacauggaggcacaauuaauacgacagauggaaggcgaaggaguuuuauccaaagcggaccuagaaaauccucaucuucuagagaaaaagaucacucaaugguuagaaacgaaagguguagaaagguuaaagcgaauggcgaucagcggugaugauugugugguaaaaccaauagaugauagauucgcaaaugcauuguuagcucuuaacgacauggguaaaguaaggaaggauauuccucaauggcagccgucuaaagguuggcacgauuggcagcaggugccguucuguucacaucacuuccaugaguuaauaaugaaggauggcagaaaacuugugguaccuugccgaccccaagaugaauugaucggucgugcgagaaucagccaaggugcugggugguccuugaaagaaacggcuugucuugguaaagcguacgcucagauguggucauugauguacuuucauagacgagacuuaagacuugcaucgaaugcuauuuguagcgccgugccgguccauuggguuccuacaucuagaacaacauggaguauucacgcccaucaccaguggaugaccacugaagacauguuaacuguauggaaucguguuuggauagaggauaacccauggauggaagauaagacgcccguuacaacgugggaagauguuccuuauuuagggaaaagagaagaucaaugguguggcucacuuauaggauugaccucacgggcaacaugggcgcagaauauucuaacugcaauucaacaaguaagaagccuaauaggcgacgaggaguuucuagauuacaugccuucuaugaaaagauuccgaaaagaggaagaaagcgaaggggcaauaugguag

SEQ ID NO: 23511 - RNA, 9873 nt, Artificial Sequence
  derived and/or modified CDS sequence (opt6) from DENV-3__KJ622192__SS-prME
acuucauuaugcuuaaugaugauguuaccugcuacacucgcauuucaccugacaucgagagacggggaaccucgaaugauuguagguaaaaaugaaagaggaaaaaguuuauuauucaaaacagcgucagguauaaauauguguacccuaauagcuauggaccuaggggaaaugugcgacgauacaguuacauacaaauguccguuaauugccgaaguggagccugaagacauugacugcugguguaauuuaacauccaccuggguaacauauggaacauguaaccaggcgggugaacauagaagagacaaacguagcgucgcauuagcaccucauguaggaauggggcucgacacccggacucaaacuuggaugucagcagaaggagccuggcgucaaguagagaaaguugaaacgugggcgcuuaggcaccccggauucaccauuuuagcacuguuucuagcucacuauauuggaacaucguuaacucaaaaaguaguaauauucauuuuguugaugcuaguaaccccaaguauggcaaugagaugcgucgguguaggaaacagagacuuuguagaaggacuaucaggugcaacauggguagacguaguauuagaacaugggggaugcguuacaacgauggcgaaaaauaaaccuacacucgacauagagcugcagaaaacugaagcaacgcaacucgccacacugcgaaaauuauguauagaaggcaaaauaacuaacauuacaaccgauucaagaugcccaacccaaggcgaagccaucuuacccgaagaacaagaucaaaauuauguuugcaaacacacuuauguagaucgaggguggggcaauggauguggcuuauucggaaaaggaagucugguaacaugcgccaaguuucaauguuuggaaucaauagaaggcaaaguaguucaacaugaaaacuugaaguauacaguaacaauaacaguucacacaggggaccaacaccaaguaggcaacgacacgcaaggaguaacugcagagauaacaccccaagccaguacaguugaagcaauucuaccugaauauggaacccuuggccuugaauguucgccuagaacgggccuugacuuuaaugaaaugauuuuauuaacaaugaagaacaaggcuuggaugguacacagacaaugguucuuugauuugccacuacccuggacaagcggcgcuaucacagaaacaccaacauggaaucguaaggaauuguugguuaccuucaagaacgcacaugcuaagaaacaagaaguaguagucuuagguagccaagaaggggccaugcauacagcauugaccggugcaaccgaaauucaaaauagcgggggaacuuccaucuuugccggccauuuaaaaugucggcugaaaauggauaaacuugaacuaaaagguaugaguuacgcgaugugcuugaacacuuuuguuuuaaagaaagaagucuccgagacucaacacggaacgauauuaauaaaagucgaauauaaaggagaggacgcaccuugcaaaauaccauuuucaacugaggaugggcaagguaaagcacauaacggcagauuaauaacugcaaacccuguagugacaaagaaggaagaaccaguuaacauugaggcugaacccccauucggagaaaguaauauuguaaucggaauuggugacaaagcucuaaaaauaaacugguacaagaaaggaagcagcauuggcaaaauguucgaggcuacagcacggggugcgcgcaggauggcaauauuaggagauacagcuugggauuucggguccguuggaggaguuuuaaauucgcuagguaagaugguacaccaaauauucggcuccgcauacacugcauuauucggagguguaucauggauaaugaagauagguauaggcguauuauugaccuggauagggcuaaauucgaagaacacaucgaugucguuuaguugcauagucauagggauaauaacauuguaucuggguaccguaguacaggcugauaugggguguguaaucaacuggaaagguaaggaacuaaaaugcgguucggguauauucguuacaaaugaaguacacacauggacggaacaauacaaauuucaagcagauucucccaaaagauuagcaacagcaauagcaggggcaugggaaaaugguguaugugggauacgaucaacgacaaggauggagaaucuacuauggaaacaaaucgcgaaugaguuaaauuauaucuuaugggagaacaauauaaaacuuacgguaguuguuggugacaucaucggcguacuugaacaggguaaaagaacuuuaacaccacaaccaauggaacuuaaauacucauggaaaaccugggguaaggcaaaaauaguaacggcugagauacaaaacucaucauucaucauagauggaccuaauaccccugaauguccuucagccagccgugcauggaauguaugggagguagaagauuacggauuugguguuuucacuacaaauaucuggcugaaacuuagagaaguauauacacaaacaugugaucaccgguugaugagcgcggcaauaaaagacgagagagcagugcaugcugauauggguuacuggauagaaagucagaaaaaugguaguuggaaacuagaaaaggcuaguuuuauagagguuaaaacauguacguggcccaaaagucauacacucuggaguaaugguguccuagaaagugacaugauaauuccuaaaucccucgcagggccgauaucucaacacaaccacagaccagguuaccauacucaaacggcagggccauggcauuuagguaaacuagagcuggacuuuaauuauugugaaggcacaacuguaguaauaacagaaaauugcgggacgcgaggaccgucauuaaggacaacgacaguuaguggaaaacuuauacacgagugguguuguagaucauguacguuaccaccauuaagauauaugggcgaagacggauguugguaugguauggagauacgaccgauuaaugaaaaagaagaaaacauggugaagucacugguaucagcuggcucaggaaaggucgauaacuuuacuaugggcguucuaugucuagcuauuuuauuugaagaagucaugcgagguaaauuuggcaagaaacauaugauagcggguguacuacuaaccuuuauguugcugcuauccggucagauaacuuggcgagacauggcucauacguuaauaaugaucgguaguaacgcuucagaucgaauggguaugggagugacguaucuggcucuaauagcaacuuuuaagauacagccuuuccuugcauuaggauucuuuuuaaggaaauuaacaaguagagaaaacuuauugcuagguguggguuuagcuauggccacuacccuucaauuacccgaagauauagaacaaauggccaauggaauugcgcuuggguuaauggcacugaaacuuauuacccaauuugagaccuaucaauuguggaccgcgcugguaagucuaacaugcucuaauacaauuuucacacugacuguugcguggcguaccgcaacauuaaucuuagcgggcguaucccuguuacccgucugccagucaucuucaaugcguaagacggauuggcucccuguagcggucgcagccaugggaguacccccucucccuuuauuuauuuuuagucuuaaagauacacuuaaaaggcgauccuggccacuaaacgaaggaguaauggccguuggccuaguaaguauuuuagcgucuaguuuacugcgaaaugacguccccauggccggaccacucguugcaggcggacuacuaauugcguguuauguaaucaccgggacuucggcagaucugacuguggaaaaagcugccgacguuacaugggaagaggaggcggaacaaacagguguaucccauaaccugaugauuaccgucgacgaugauggaaccaugcguauaaaagacgacgaaacagaaaacauucuuacaguacuccucaagaccgcacuacuaauagugagcggcauauuuccguacaguauaccagcgacgcuauuaguauggcacacauggcagaagcagacacaacgguccgguguacuuugggaugugccaucuccgccggagacacagaaagcugaauuggaagagggcguauauaggauaaaacagcaagguauauucggcaagacccaagucggggucggagugcaaaaagaaggcguauuucauacuauguggcauguuacaagaggagcggucuuaacacauaauggaaagagacuagaacccaacugggccaguguaaagaaagaucuaaucaguuacggaggggguuggagguugagugcucaauggcagaaaggggaagaaguccaagucaucgcuguugagccgggcagaaauccgaaaaauuuccaaacgaugccagguauuuuucaaaccacuacgggugaaauaggugcuaucgcacuugauuuuaagccuggaacaucaggcucaccaauaauaaaucgugagggaaaaguaguuggccuuuaugguaacggcguagugaccaaaaacgggggauaugucuccgggauagcgcaagcuaaugcggaacccgacggcccuacaccagaacuagaagaagaaauguuuaagaaacgaaaucuaacuauaauggacuuacauccaggaucaggaaagacaaggaaauacuuaccggccaucguacgagaagccauaaaaagaagacuuagaacgcucauauuagcgccgacucguguaguggcugcagaaauggaagaggcucuuaagggauuaccgauuagguaccaaacaacggccacaaagucggaacauacgggacgcgagauagucgaucucaugugucacgccacauuuaccaugcgauuacucuccccagugagaguacccaacuauaaucuuauaauaauggacgaggcacacuucacagaccccgccucaauagcggccaggggguacauaucaacacggguugggaugggagaggcugcagcaauauucaugacagccacaccaccgggaaccgcugaagcauuuccucaaaguaacgccccaauacaagacgaagaacgugauauaccagagcgaagcuggaacucaggaaaugaguggauaacagacuucgucgggaagacaguaugguucguaccuucuauaaaagcaggaaacgacauagcaaauugucucaggaaaaaugguaagaaaguaauucaauugaguagaaaaacauuugauacagaguaucaaaagacaaaacugaacgacugggacuuuguagugacuacugacauaucggagaugggagcaaacuucaaagcggacagaguaauagacccacgaagaugucuaaagcccguuaucuuaaccgacggaccagagagaguuauacuggcagguccgaugccuguaacugcagcaucagcagcacaacgcaggggccgagucggaagaaauccacagaaagaaaaugaucaauacauauuuaccggucagccucuaaauaacgaugaggaucacgcgcauuggacugaagcaaaaaugcuccuagauaauauuaacacaccugaaggcauaauaccugcccuauucgaaccggaacgggagaaguccgcugcaaucgauggagaauauagguuaaaaggugaaagccgaaaaacauuuguagaauuaaugcggcguggggaucucccaguuugguuagcgcauaaagucgcgagcgaagggauaaaguacacagacagaaaaugguguuuugauggagaaagaaauaaucaaauacuugaagagaacauggacguugaaauauggacaaaagagggggaacggaaaaagcuaaggcccagaugguuggaugcacgcaccuauucggaucccuuagcacuuaaagaauuuaaagacuucgcagcagguagaaaaagcauagcucuagaucuaguaacugaaaucggccgcgugccaagucacuuggcgcacagaacgagaaacgcuuuagauaacuuaguaaugcuacacacgagcgaacauggagguagagcauauaggcacgcuguggaagaguugccagaaacaauggagacacuauuacuuuuaggauuaaugauacuguuaacagggggagcaauguuguuuuuaaucucaggcaaggggauaggcaaaacgucgauaggacuuauaugcguuaucgugagcucagguaugcuguggauggcagacguuccucuacaguggauugccagcgcgauaguauuggaguucuucaugaugguacuccucauucccgaaccagaaaaacagcgaaccccacaagauaaucaacuagccuauguggucauaggcauucuuacccucgcggcgaucgucgccgcgaaugaaauggguuuacuugagacaacuaaaagagauuugggaaugagcaaggaacccgggguuguaucacccacaucuuacuuggacguggaucuucacccagcgucggcuuggacccuuuaugcaguagcgacgacaguuauuacaccuaugcugaggcauacuaucgagaacagcacugccaacguaagccucgcugcaauagcaaaccaagcagucguucuaauggggcucgauaaagguuggccaauaagcaaaauggaucuugggguuccacuguuagcucuaggaugcuauucacaagucaacccacuaaccuuaacagcagcgguuuugcuauuagugacucacuaugcaauuauugggccuggauugcaagcaaaggcgacucgcgaagcacaaaaacgaacagcagccgguauaaugaaaaacccaacagucgaugguauuaugacaauagacuuagacccuguuauuuaugauuccaaguucgaaaaacaguuaggacaaguuaugcucuuaguacuuugcgcgguccaacucuuauuaaugagaacgucaugggcucuuugugaggcgcuuacucuggcuacaggaccaauaacaacgcuaugggaaggauccccuggcaaauuuuggaacacaacgauagcaguuaguauggcgaacauuuuuagggguucauauuuagccggugcgggauuagcauuuucgauuaugaagaguguaggcaccggcaagagagguacuggcagccaaggagaaacucuuggagaaaaguggaaaaagaagcuaaaucaguugaguagacgugaauuugagcuuuacaagaaaaguggaauaacugaagucgacagaacggaagcuaaggaggggcuuaaaagaggugaaacaacacaucaugcugugucgcgugguagugccaaauuacaaugguucguagaaagaaauauggucauaccugaggggcgcguaauagacuuagguugcggacgcggugguugguccuauuacugugcaggccucaagaaagugacugaaguccgaggcuacaccaaagggggaccaggacacgaagaaccaguaccaaugucgacuuacggauggaauaccguaaaacugaugucgggaaaggauguauuuuauuuaccgccugaaaagugugacacacuacuaugugauauaggugaauccucaccauccccaacuguagaagaaagucggacuauucgaguauuaaaaaugguggaaccguggcuaaagaauaaucaauuuuguauaaaaguuuuaaaucccuacaugccuacaguuauagagcaccucgaaagacuucagaggaaacauggagguaugcuagucagaaauccuuuaucuagaaauucaacucacgagauguauuggauuuccaacgggacaggaaauauaguuagcagcguaaauaugguuucgcgcuuauuguuaaacagauuuacaaugacacaccgaagacccacgaucgagaaagauguagauuuaggugcggguacaagacauguuaacgccgaaccagaaacuccgaauauggauguaauaggagaaaggauaaaaagaauaaaggaagaacacaguuccaccuggcauuacgacgacgaaaauccauauaaaacuugggcuuaucaugguaguuaugaaguuaaagcaacuggaagugcauccucaaugaucaacggagucguaaaacugcuaacuaagccaugggauguuguuccuaugguuacacaaauggcaaugacggauacuacgccuuucggucaacagagaguauuuaaagagaaggucgauacaagaacccccagaccaaugccugguacucgaaaagugauggaaauuacagcugaguggcucuggaggacgcuaggcagaaauaaaagaccgagauuaugcacuagagaagaguucacuaagaaagugaggacaaaugcggccaugggggccguuuucacggaagaaaaucaaugggaaagugcaagagcggcaguagaagaugaagaguuuuggaagcuggugggcagagaaagagaacugcacaaacugggcaaaugcggaucuugcguauacaauaugaugggcaaaagagagaagaaacuaggcgaauuugguaaggcgaaggguucacgagcaauaugguauauguggcuaggagcacgcuauuuagaguucgaggcuuuaggauucuuaaacgaggaccauugguuuucuagggaaaauaguuauucaggaguagaaggagagggcuuacauaaauuagguuacauucugagagacauuucuaaaauccccggcggagcaauguacgcagacgacacggcugggugggacacuagaaucacagaagaugaccuacauaaugaagagaaaauaacacaacagauggacccugagcauagacaacuagcaaaugcuauauucaaacuuacauaucagaauaaaguagugaaaguacaacgcccaacuccaaaaggaaccguuauggacaucauaucuagaaaggaccagagggguuccggccaaguuggaacauauggauuaaauacuuucacuaacauggaggcgcaguuaauaagacaaauggaaggcgaagguguccuaagcaaagcugaccuggaaaacccacaccuauuagaaaagaagauuacacaguggcuugaaaccaaaggaguagagagguugaagagaauggcuauaucaggagacgauugugugguaaaaccuauugaugauagguuugcaaaugcguuacuggcgcuaaaugauauggggaaaguaagaaaagacaucccacaguggcaaccaaguaaaggauggcacgauuggcagcaaguaccauucuguagccaccauuuccacgaauugauuaugaaagauggacguaaacuuguugugccaugcagaccacaagaugaacuuauaggcagagcaaggauaagucaaggggcaggguggagucuaaaagaaacagcgugucuaggcaaggcuuacgcacaaauguggucucuaauguauuuucauagaagggacuuaagacuagcaucgaacgccauauguucugcagucccuguacacuggguucccaccaguagaacgacauggagcauacacgcacaccaucaauggaugacaacagaagacaugcuaacaguauggaaucguguauggauugaagacaauccguggauggaagacaagacgccggucacuaccugggaggauguaccguauuuaggaaaacgcgaagaccaauggugugguucacuuaucggguuaacgaguagggcuacuugggcucagaacauucuaacagcaauucagcaagugcgaucauuaauaggugacgaggaauuucuggacuauaugcccucgaugaagcgauuuagaaaagaggaggagucagagggagcaauaugguga

SEQ ID NO: 23512 - RNA, 9873 nt, Artificial Sequence
  derived and/or modified CDS sequence (opt6) from DENV-3__KJ622193__SS-prME
acaaguuuauguuuaaugaugauguuaccugccacacuugcuuuucaccuaacuucacgugauggagaaccaagaaugauagucgguaaaaaugagagggguaaaucguuacuguuuaaaacagcaaguggaauaaauauguguacuuuaauagcaauggaccuuggagaaaugugugaugacacaguaaccuauaaauguccgcuuauagccgaaguagaaccugaagacauagacuguugguguaaucuuacgagcacuugggugacauauggaacauguaaccaagcaggagaacacaggagggauaaaagaagugucgcucuagccccacacguaggcaugggucuagauacaaggacgcagacauggauguccgcggagggggcauggcgacagguugaaaaaguagaaacaugggcauuacgccauccaggguucaccauacuagcccuuuuucucgcucauuacauagggacuucuuugacccaaaaaguagugauuuuuauacuguuaaugcugguuacucccuccauggcaaugagaugcgucgguguagguaauagggauuucguagaaggcuuauccggcgccacauggguagauguuguacuagaacacgguggaugugugacaacaauggcaaagaauaaaccuacguuagauauugaauuacagaaaacugaggcuacacaauuagcgacuuuacguaaauuaugcauagagggaaagauaaccaauauaacgaccgauucaagaugcccgacacaaggcgaagcaauuuugccggaagaacaagaucagaacuacguauguaaacauacauacguagaccgagggugggggaauggaugcggacuauuuggcaaggguucuuuagucacaugcgcaaaguuucagugccuggagucuauugaagguaaaguaguccagcaugaaaaucuuaaauauacgguaacaauaacugugcauacgggugaucaacaccaggugggaaaugauacacagggaguaacggcagaaauaacuccccaagcaucuacugucgaagcaauuuugccagaauacggcacucuuggccuugaauguaguccaagaacagguuuagacuuuaacgaaaugauauuacucacaaugaagaauaaggcuuggaugguucacaggcaaugguuuuucgaccucccacuaccauggacaucuggugcgaucacagaaacuccgacuuggaacaggaaagaacuguuagucaccuuuaagaacgcgcacgccaagaaacaaggggucguaguucuaggaucacaggagggagccaugcauacagcucuuacgggugcgacggaaauccaaaauaguggaggaacuucaaucuuugccggucauuuaaagugcagacugaaaauggacaagcucgagcucaaagguaugucuuacgcgauguguuuaaauacauucguacucaaaaaggagguaucagaaacgcaacauggaacgauauuaauaaaggucgaauacaaaggugaagacgcaccgugcaaaauaccuuucucaacagaagauggacaagguaaagcucauaauggaagacuaaucacagcgaaucccguuguaacuaaaaaggaggagccugucaacauagaagcagaacccccguuuggagaaucaaacauaguuaucgguauaggagacaaagcacuaaaaauuaacugguauaagaagggauccaguaucgggaaaauguuugaggcaacagccaggggagccagaagaauggcgauauuaggugacacagcgugggauuuugguucagucggaggaguccugaacucauugggcaaaauggugcaccaaauauuugggucggcauacacggcacuauuuggagguguuagcuggaucaugaaaaucggaauugguguccucuuaaccuggauaggacuaaacaguaaaaauacaucuaugucuuuuucauguauugugauaggaauaauaacauuauacuuagguacugucguacaagcugauauggguugcguaauaaacuggaaagguaaagaguuaaaguguggcucuggcauauucguuacaaacgaaguccacacuuggacggaacaauacaaauuucaagcugacucaccaaaacgucuugcuacggcaauugcaggagcgugggaaaacggaguuugugguauacgaucgacgacaagaauggaaaauuuacucuggaagcagauagcgaaugaauugaauuacauacuuugggaaaauaacaucaaacucacuguaguaguaggggauauaaucggaguuuuggaacaaggaaagagaacacucacuccacagcccauggaauuaaaauacucauggaaaacauggggaaaagcgaaaauaguaacagccgaaauucaaaacucaucauuuaucauugauggucccaacacuccggagugucccucugccucacgcgcguggaaugucugggaaguggaggauuauggguuuggggucuuuacuaccaauauauggcucaaacuuagagagguauacacccaaacgugugaccaucgucuaaugucugcagcaauuaaagaugaacgagcuguccacgcagacaugggauacuggauagaaucacagaaaaacggaucauggaaauuggagaaggcaucauuuauagaagugaaaacauguacuuggccgaaaagccacacgcuauggucuaauggcgucuuggaaagcgacaugauaauacccaagucucuggcaggucccaucucucaacauaaucaccguccggguuaucauacucagacagcgggaccauggcauuuaggcaaacuggagcuugauuuuaauuacugugaagguacuacaguuguaauaaccgaaaauuguggaacaaggggcccaagccuacgaacuacaacuguuagugggaagcucauccaugagugguguugucgaucguguacacuaccaccucugagauauaugggugaagacgggugcugguacgggauggaaauacgcccaauaaaugaaaaagaagagaacauggucaaguccuuaguaucagcagggucaggaaaaguagauaauuuuacgauggguguacugugcuuagccaucuuauuugaagaaguuaugcguggaaaauucggaaagaaacauaugauagcaggaguauuauugacguuuauguuguuauuaagugggcaaauuacuuggcgagauauggcacacacucucauaaugauaggaucaaaugcaucagaucggaugggcaugggagugacuuacuuagccuuaauugcaacauuuaaaauccaacccuuccucgcacucggauucuuuuuacgaaaauuaacaucucgcgagaacuuacuacugggaguugguuuagccauggcaacaacgcuacaacucccagaagacauugagcagauggcaaauggaauagcuuuaggcuuaauggcguuaaaauugauaacacaguuugagacguaucaacucuggaccgcacuuguaaguuugacuuguucaaauacuauauuuacucuaacuguagcauggagaaccgccacauugauacuggcugguguaucucuauuacccgugugucaaagcaguaguaugcgaaaaacagauuggcuuccaguagcagucgccgcuaugggugucccaccucucccucuuuuuaucuucucgcuaaaagauacauugaaacgaagaagcuggccguuaaaugaggggguuauggccguugguuuaguaucaauauuggcuucuagucuccuacgaaacgacguucccauggcgggaccucucguagcuggaggccuucuaauagccugcuacguuauaacaggaacuucugcugaucuaacaguagagaaagcggccgauguaaccugggaagaagaagcggaacagacagguguaucacauaauuugaugauaacgguggaugacgaugguacuaugcguauaaaggacgacgagacagaaaauauccuuacgguuuuacuuaaaacagcucuguuaauugugaguggaauauuuccguauucuauacccgcuacuuugcuugucuggcauaccuggcaaaaacaaacacagagguccggggucuuaugggacgugccaucaccuccagagacacagaaagcggaauuggaggaaggggucuaccguaucaaacaacagggaauuuucgguaaaacccaaguuggaguuggaguacagaaagaggguguauuccauacaauguggcauguuacaaggggagcuguacugacccauaaugguaaaagauuagaaccaaacugggcaagugucaagaaagaccuaaucucguauggaggugguuggcgacucuccgcucaguggcagaaaggugaagaaguacaaguaauugccguagagccggggcgaaacccgaaaaacuuucaaaccaugccugguauauuccaaacgacgaccggagagaucggagcaauagcauuagauuuuaagcccgguacauccgguucaccaauaauaaauagggaggguaaaguaguagguuuauauggcaauggaguaguuacuaagaauggaggcuacguaagcgguaucgcacaggcuaacgcugaaccagacgggccgacaccggagcuggaagaagagauguucaagaagagaaaucuaacuauaauggaucuccauccugguucaggaaagaccagaaaguaucucccggcaauaguuagagaagccauaaaaaggagacuacggacgcugauuuuggcuccgacuagaguaguagcagcggaaauggaagaggcauuaaaaggccuuccgaucagauaccaaacuacagcgaccaaauccgaacauacaggaagggaaauuguugacuugaugugucacgcgacguucacaaugagacugcugaguccaguuagaguaccgaacuauaauuuaaucaucauggaugaggcacauuuuacugacccggcaaguauugcggcaagaggauacauaagcacuagggugggaaugggggaagcggcagccauuuucaugacagcgaccccaccuggaaccgcagaagccuuuccucaauccaaugcuccaauacaggacgaagaacgugacaucccggagaggucuuggaacucagguaacgaauggaucacagauuucguugguaaaacuguuugguuuguaccauccauuaaagcuggcaaugacauagcaaacugcuugaggaaaaaugguaagaaggucauacaauuaaguagaaaaacauucgauacagaauaucagaaaacaaaauugaaugauugggauuuugugguuacuacugauauaagcgagaugggagcuaacuuuaaggcugaccgcgucaucgacccacgcagaugcuuaaagccuguuauuuuaacagacgggccggagagaguaauccuagcgggaccgaugccuguuacagcugccucugcggcacagagacgcgguagaguuggacgaaacccacaaaaagagaaugaccaauauauuuuuacaggacaaccauugaacaaugaugaagaccacgcccacuggaccgaagccaaaaugcuuuuggauaauauaaauacuccugaagggauaauaccggcccuauucgaaccggaacgcgaaaaaucagcggcaaucgacggggaguacagacuuaaaggcgaaaguagaaaaacguuuguugaauugaugcgaagaggagaucuaccgguuugguuagcccacaaagucgccagugaaggaauaaaauauacagauagaaaaugguguuuugauggggaacggaauaaccaaauucuggaagagaauauggauguggaaauauggacaaaagaaggagaacguaagaaacugcggccaagauggcuggaugcacgaacauacucagauccuuuggcacuaaaggaguucaaggacuuugcggcaggacgcaagucaauagcacuggaucuaguaacggaaauuggaagggugccgucucauuuggcccauagaaccagaaacgcauuagauaaccuuguaaugcuccacacaucagaacauggugguagggcguaucgacacgcaguugaagaauuaccugaaacaauggaaacccuuuuauugcuuggauuaaugauuuuguuaaccgguggagcgaugcuguuuuuaauuuccggcaagggaaucggaaaaacuucaauaggacuaaucugcguuauagucuccucaggcaugcuguggauggcagaugugccacugcaguggauugcuucugcaauaguacuugaauuuuucaugaugguuuuacuaauccccgaaccggaaaaacaaagaacaccucaagacaaucagcuggcauauguaguuaucggaauacugacccuugcugcgauaguagcagcaaacgaaauggguuuauuggaaacaacaaaaagagaccuagguaugucgaaagaaccagguguuguaagucccacaaguuaucucgacguugaucuacaccccgcaucagcuuggaccuuauacgcaguagcaacgacaguaauaacaccgauguuaagacauacaauugaaaauucaaccgcaaauguaagccuagcggcaauugcuaaucaagccguaguacuuaugggauuggauaaaggauggccuauaagcaagauggaccuaggaguaccacuauuagcgcuuggauguuauucucaaguaaacccuuuaacucuaacugcggcagucuuauuauuaguaacgcacuaugcaauaaucggaccaggacuucaagcaaaagcaacacgcgaagcucagaaaagaacagcagcugggauaaugaaaaacccaacuguagacgguaucaugacuauagacuuagauccaguuauauacgauaguaaauuugagaaacaacuaggacaaguuaugcucuugguguuaugugcgguccaauuguuauuaaugcguacaucgugggcauugugugaagcacucacacuugcuaccgguccaauaacuacccuaugggaaggaagccccggaaaauuuuggaauacuaccauugcgguguccauggcaaacaucuucagaggaagcuauuuagcgggagcggguuuagcauuuaguauaaugaagaguguagguacaggcaaaagggguacgggcucacagggcgaaacacugggugagaaauggaagaagaaacuaaaccaauuaaguagaagagaguucgaauuauauaagaaaucuggcauaacagaaguagaucgaacggaagcgaaagaagggcuuaaaagaggcgaaacaacacaucaugcaguaagccgaggaagugccaaauugcaaugguucguugaacgcaacauggucauaccggaagggagggucaucgacuugggaugcggacgaggggguuggaguuauuauugugccggacuaaagaaaguaacagaaguccgaggauacaccaaaggcggcccgggacaugaggaaccaguuccuaugagcacauauggauggaacacggugaaauuaaugucgggaaaagacgucuucuaucugccuccagaaaaaugugacaccuuacuaugcgauauuggggaauccucucccagcccuaccguagaagagucgagaacaauucgcguccuuaagaugguagaaccguggcugaaaaacaaucaguucugcauuaaaguucugaauccauacaugccaacugugauagaacacuuggaaagauuacagcgaaaacauggagggaugcuaguaagaaauccccucuccagaaauaguacccaugaaauguauuggauauccaaugguacuggaaauauuguaagcucggucaauaugguuucgcgauuacugcucaacagauuuacgaugacacacagaagaccaacuauagaaaaggaugucgacuuaggugcaggaacucgccacguaaaugcugaaccagaaaccccgaacauggacgugauaggagaaaggauaaagagaauuaaagaggaacauaguaguacauggcauuaugaugaugagaacccauacaaaacgugggcguaucacgguaguuaugaggucaaagcuacuggauccgcuucuaguaugauaaaugguguagugaaauuacuuacaaaaccaugggacguuguuccaaugguuacucaaauggcuaugacagauacaaccccuuuuggacaacaacggguauuuaaagaaaaggucgauacaaggacuccacgacccaugccgggcacgaggaaaguaauggaaauuacggcugaaugguuguggcguacucuaggcaggaacaaaaggccccgucuuugcacucgugaggaauuuaccaagaaaguacgaacaaaugcagcgaugggagcaguuuuuacagaagaaaaucaaugggaaagcgcccgugcagcaguugaagaugaagaauuuuggaagcugguagguagagaaagggaacuucacaaauuagguaaaugugggucguguguuuauaauaugauggguaagcgugagaagaaacuuggugaauuuggaaaggcgaaaggaucaagggccauaugguauauguggcucggcgcacgauaucuggaauuugaagcacucggauuuuuaaacgaagaucauugguuuucuagagaaaauucguauagcgguguugaaggugagggacuucauaaacucggauauauauugcgcgacauuaguaagauuccaggaggcgcuauguaugccgaugauacggccggaugggacacaagaauaacggaagaugaccuccauaaugaagagaaaauaacccagcagauggacccagagcauaggcaacuagcuaaugccauuuuuaagcucacguaucaaaauaaaguuguaaaaguccaaaggccaacaccgaagggaacugucauggauauaaucagucgaaaagaccagaggggaagcggccaggucggaacauaugggcuaaacacuuucacgaauauggaagcacaacuaauucgccagauggaaggagaaggaguccuaagcaaagcagaucucgagaauccacauuuauuagagaagaaaauaacacaauggcuagaaacaaagggagucgaaagguuaaaaagaauggcaaucucaggagacgauuguguugucaagccuauagaugauagguucgcgaacgcccuauuagcuuugaaugauauggguaagguaagaaaagacauaccacaguggcagccuaguaaaggauggcacgauuggcaacaagugccauuuuguucacaccauuuccaugaacuuauuaugaaagauggcagaaaguuaguaguuccauguagaccacaagacgaauuaauaggcagagcucggauaucucaaggcgcagguuggucauuaaaagagacugcgugucuagggaaggcauacgcacaaauguggaguuugauguauuuccaccgacgggaucucagauuagcaucaaaugcaauaugcagugcaguucccguacauugggugccgacaagcagaacuacauggaguauacacgcacaccaccaauggaugacgacugaggauaugcucacaguuuggaauagaguauggauagaagauaacccuuggauggaagauaaaacuccaguaacaacaugggaggauguacccuauuuaggcaagagagaagaucaaugguguggaucuuugauaggguuaaccaguagagcaacgugggcgcaaaauauauuaacagcgauacaacaaguaagaaguuugaucggagaugaggaauuuuuagauuacaugccguccaugaaacgguuuaggaaagaagaggaaagugaaggcgcuaucugguga

SEQ ID NO: 23513 - RNA, 9873 nt, Artificial Sequence
  derived and/or modified CDS sequence (opt6) from DENV-3__KJ622194__SS-prME
acuucauuaugcuuaaugaugauguuaccagcuacacuugcguuccaucuaacaucaagggacggagaaccaaggaugauaguggggaaaaaugaacgaggaaaaagucuucuuuucaaaacagcuucuggaauaaacaugugcacucuuauagcaauggaucugggagaaaugugugaugauacggucacuuauaaaugcccacugauagcagaagucgaaccagaagauauagauuguugguguaauuuaacaucuacgugggucacauacggcacgugcaaccaagcuggagagcacaggagggauaaaaggucaguagcacuugcaccacacguaggcaugggacuggauacacgaacucaaacuuggaugucggccgaaggugccuggcggcaaguugaaaaaguagaaaccugggcacugagacacccaggauucacgauuuuagcacucuuuuuagcucauuauauaggaacaucgcuaacccaaaaaguuguaauauuuaucuugcuuaugcuaguaacccccaguauggcaaugcguugcgucggaguuggaaauagagacuucgucgagggccuaucaggugcuacgugggucgauguuguguuggaacauggaggcugcguaacuacgauggcuaaaaauaaaccuacacuugauauagaacuacagaaaacugaggcaacacaacuggcaacccuucgcaaauuaugcaucgagggcaaaauaacaaauauuacaacggauucaaggugccccacucaaggugaagcuauauuacccgaggaacaagaccaaaauuacgucugcaaacauacauacguugacaggggauggggaaauggaugcggccuauuuggaaaagguucgcuaguaacaugugcaaaauuucagugucuugaauccauagaaggaaaaguuguacagcacgagaaccucaaauacacuguaacaaucaccguacacaccggagaccaacaccaggugggaaaugacacacaagguguaacugcugagauaacuccgcaagccuccacaguagaagcaauuuuaccugaauauggaacgcugggguuagaaugcaguccacggacaggcuuggauuuuaaugaaaugauuuugcugacaaugaaaaacaaggcuuggauggugcauagacaaugguuuuucgaucuaccacuuccauggacuucgggagcaaucaccgagaccccaacauggaauaggaaagaacuacuugucacuuucaaaaaugcacacgccaagaaacaagagguagucgucuugggcagccaagaaggagcuaugcacacagcucuaacgggagcaaccgagauacaaaauuccgggggcacguccauauuugcagggcaccuuaaaugucguuugaaaauggauaaauuagaacuaaaagggaugucuuaugccauguguuuaaacacauuuguucucaagaaagaggucuccgaaacacaacaugggacgauucugaucaaagucgaauacaaaggugaagaugcuccauguaaaauucccuuuucaacggaagacgggcaaggcaaagcucauaauggaaggcucauuacagcuaacccaguuguaacuaagaaagaagaaccagucaauaucgaagcugagccaccauuuggagaaucgaauauuguuauaggcauaggggauaaggcuuuaaaaauaaauugguauaagaaaggcucaucuauuggaaaaauguuugaggcuaccgcuagaggggcuagacggauggcaauauugggggauacugcaugggauuuuggaagcguaggaggaguccuuaacucacuggguaaaaugguacaucagaucuuuggcagcgcuuacacugcacuguuuggaggaguguccuggaucaugaaaauuggaauugguguuuuauuaacauggauaggauugaacaguaaaaauacaaguaugagcuucagcuguaucguaauaggcauaauaacucucuauuuagguacgguaguccaggcagauaugggaugcgugauaaauuggaaagggaaagaacuuaaaugcgguuccggcauuuucgugacuaaugaaguccauacguggacagagcaauacaaauuucaagcugacucuccaaaacgucuagccacggcuauagcaggagcaugggagaacggaguuugugggauucgaaguacuacaaggauggagaaccuucuauggaaacaaaucgccaaugaacuaaacuacauacuaugggaaaauaauauaaaacuaacuguuguuguuggugauauuaucggcguauuagaacaggguaaaaggacacugacaccacaaccgauggaguuaaaauacucguggaaaacaugggguaaagcuaaaauaguaacagcggaaauacaaaauaguagcuuuauaauagaugggccaaacacgccagaauguccaucagcgucaagagcauggaauguuugggaaguggaagauuacggauuuggaguguucacuacaaauaucuggcugaaauugagggaaguauauacacaaacaugugaucacagacucaugagugcugcaauuaaagacgaaagagcggugcacgcugauauggguuauuggauagaaucccagaaaaauggaaguuggaaguuagaaaaagcgucauucaucgaaguaaaaaccugcacauggcccaagucccacacucuguggucuaacggaguacuagaguccgauaugauaaucccaaagucccuugcggguccaauaucucagcauaaucacagaccuggauaccacacacaaacugcggguccuuggcaccucgguaaauuagaacuggacuuuaauuauugugagggaacaacaguaguuaucacagagaauugcggcacaagaggcccuucccuucgaacaacaacuguaaguggaaaacucauccaugaauggugcugucgcucaugcacgcuaccuccauugagauacaugggcgaagauggaugcugguaugggauggaaauccgaccuauaaacgaaaaggaagaaaacauggucaaaucguugguuucagcaggaucaggcaaaguagacaacuucacaauggguguauuaugucuagcuauuuuauuugaggaaguaaugcgagggaaauucgguaagaaacacaugauugcgggagugcuccuaacguuuaugcucuuauuaaguggucagauaacguggcgggacauggcucauaccuugauaaugaucggaaguaaugcaucagauagaauggggauggguguuacauaucuggcguugauagcaacauuuaaaauccaaccguuucucgcuuuaggauucuuuuuaagaaaauuaaccaguagggaaaaucugcuacucggcguagguuuagcgauggcuacuacacuacagcuacccgaagauauagaacaaauggcaaacggcaucgccuugggacuuauggcccuuaagcuaaucacccaauuugaaacauaucaacuauggacggcucuaguuucguuaacaugcucaaauacaauuuuuacuuuaacaguugcauggcgaacagcaacucuuauucuugcuggugucagucuccuaccuguaugucagaguaguucgaugagaaaaacggauugguugccgguugcaguugccgcaauggguguuccaccguuaccacucuuuauauucucgcuaaaggacaccuuaaagcgacguagcuggccucuaaacgagggcguaauggcgguuggucuuguaucuauacuagcaucaaguuuauuaaggaaugacgugccuauggcuggaccauuaguagcaggggguuuauuaauagccugcuacguaauuacagggacaucggcugaccuuacaguagagaaagccgcugauguaacuugggaagaagaagcagaacagacuggugugagccauaaucuaaugauuacgguagacgacgaugguacuaugcgaaucaaagacgacgagacugaaaacaucuugacaguucuacucaagacagcacuauuaauugucucagggauauuuccauacucaauaccggcaacucuauuaguuuggcauacauggcagaaacaaacucaacggaguggcguauuaugggacguaccuaguccuccugagacucagaaggcugaauuagaagaagguguauaccgaauuaagcaacagggaauuuuuggcaaaacucaaguuggagucggaguucaaaaagaagguguauuucacacuauguggcauguuacccgaggcgcaguacuaacucauucagguaaacguuuggaaccaaauugggcgucaguuaagaaagaccuaauuucauacggcggaggauggagacuaucggcacaguggcaaaaaggugaggaagugcaagugauagcgguagagcccggaagaaaucccaaaaacuuccaaaccaugccuggaauauuucaaacuaccacgggugaaauaggcgccaucgcacucgauuuuaaaccaggcacauccgggucucccaucauaaacagagaaggaaagguuguuggccucuacgguaauggugucguaacuaagaaugguggcuauguuagcggcaucgcccaagcaaaugcagaaccagaugggccuacaccugaauuggaagaagaaauguuuaagaaacgcaacuugaccauuauggacuuacauccaggaucuggaaaaacuaggaaauacuuaccugccauaguuagggaggcaauaaaacguagacugcggacucugauuuuagcacccacaagaguaguagcugcagaaauggaagaggcccugaaaggauugccuauacgauaucaaacuaccgcaacaaaauccgagcacacuggacgagaaauaguggaucugaugugucaugcaacuuuuacaaugagauugcuauccccagucagaguuccgaacuacaaucuuauuauaauggaugaagcucauuucacugauccagcuaguauugcugcccgaggauacauaaguacccgaguuggcaugggagaagccgcagcuauauucaugacggcaacaccuccgggaacagcagaggcuuucccucagucuaaugcgccaauccaagacgaagaacgagauauaccagaacguagcuggaacucuggaaacgaauggauaacggacuuuguagguaaaacugugugguuugucccaaguauaaaagcagguaaugacauugcaaauugccuacguaaaaauggcaagaaaguuauccaauuaucaagaaaaacauucgauaccgaauaucagaaaaccaagcugaacgacugggacuuuguagucacgacugacauauccgaaaugggugcaaauuuuaaagcagacagagugauugauccucgaagaugucuuaagccaguuauuuuaacagauggucccgaaaggguaaucuuagcuggaccaaugccugugacagcugcuagugcagcccaaaggagagggcgcguaggacgaaacccgcaaaaagaaaaugaucaauauauuuuuacuggacaacccuugaauaacgacgaggaucaugcacauuggacugaagcgaaaaugcuauuggacaacauaaauacuccagagggaauaauuccggcacuuuucgaaccagaaagggagaaaagcgccgcgauugauggagaauaucguuuaaaaggugagaguagaaagacauucguagagcucaugcgacggggagaucuaccugucugguuggcgcauaaaguagcaucagaggguauuaaauauacugauagaaaauggugcuuugauggcgaacguaauaaccaaauauuagaagagaacauggacguggaaauuuggacaaaggaaggugagagaaagaaacuuagacccagauggcuugaugcaagaacuuacucugacccacuugcuuugaaagaauuuaaggacuucgcagccggacguaaauccauagcguuggaccuagucacagaaaucggucguguaccaucccaccuagcgcacagaacgagaaaugcucuagauaaccuagugauguuacacacgagcgaacaugggggccgagcauauagacaugcaguugaagaacuaccugagaccauggaaacucucuuauuauuagggcuaaugauauugcugacuggcggagcaaugcuauuuuugauaucaggaaaagguauugguaagaccagcauaggucucauuuguguaaucguuagcucaggaauguuguggauggcagauguuccauuacaauggauagcuucagcaauaguauuggaguuuuucaugaugguuuuauuaauaccggagccagagaaacagagaacaccccaagacaaccaacuagcguacguagucauugguauccuaacgcuugcugcgauagucgccgccaaugaaaugggacugcuagaaaccacaaaacgugacuuagguaugucuaaagaaccaggaguaguaucccccacaucauacuuagauguagaucuucauccagcaagugcuuggacuuuauacgcgguugcuacaaccgucauaacaccaauguuaagacauacuauagaaaacucuacagcaaaugugaguuuagccgccauagccaaccaggcuguagucuugaugggcuuagacaaaggauggccgauaaguaaaauggauuuaggcguacccuuacuugcccuugguuguuauagucagguaaacccacuaacuuugacagcagcaguauuauuauuaguuacccauuacgcuauaauaggaccaggacuacaagcuaaagccacucgagaggcacagaaaaggacagcugcugguauaaugaagaauccuacaguggauggcauuaugacaauagaucuggauccuguuauuuacgauucaaaauuugaaaaacaauugggacaaguaauguuacuuguacuuugugcaguccaauuacuucuuaugcggaccuccugggcccuaugugaagcccugacuuuagcaacuggaccuauaacaacccuuugggaggguucacccgguaaauuuuggaacgcuacaauugcuguuucgauggccaauauauuccgaggcucuuaucuugcgggugcaggacuagcauucucaauuaugaaaaguguugggacgggaaagagaggcaccgggucucaaggugaaaccuugggcgagaaauggaagaagaaauuaaaccaauuaucucguagagaauuugaauuauacaagaaaagcggcaucaccgaaguagaccgaacagaggcgaaagaagguuugaaacgaggcgaaacgacgcaucaugcaguaucacgaggaagugcaaaguugcagugguucguagaacgaaauaugguuauacccgaaggacgagugauagaccucggauguggaagaggaggauggagcuacuauugugcaggccuaaagaaaguuacagaaguccgaggcuauacuaaagguggcccugggcaugaagaaccggucccaaugagcacauauggcuggaacacaguuaaauugaugucagguaaagacgucuuuuaucuucccccugaaaaaugugauacacuucucugcgauauuggagagucaucacccuccccgacaguugaagagaguagaacgauacgagugcuaaagaugguugaaccguggcuaaagaauaaccaauucuguauuaaaguuuuaaaccccuacaugccaacgguuauagagcaccuugaaagacuacaaagaaaacaugggggcauguuaguucgcaauccccuuaguagaaauucaacucaugaaauguacuggauuaguaauggaacggggaacauugucagcagugugaauaugguuucacgcuuacucuuaaacagauucacaaugacccauaggcgaccaacaauugaaaaagaugucgaucuaggagcugguacuagacauguuaacgcagaaccggaaacuccuaauauggacguaaucggugaacgcaucaaacggauaaaggaggagcauagcucgaccuggcacuaugaugaugaaaauccauauaagacuugggcguaucaugguucguacgaaguaaaggcuacagggucagcuaguucuaugauaaaugggguaguaaaauuauuaacaaaaccaugggacguaguaccaauggugacacagauggcuaugacugauaccacaccuuuuggccaacagcgugucuuuaaagaaaaaguggauaccagaacgcccagaccuaugccgggaacacgcaagguaauggaaauaacagcugaaugguuguggcgaacuuuaggacgcaacaaacgaccaagacuaugcacaagggaagaguucacaaagaaggucagaacgaacgcugcaaugggcgcuguauuuacugaagaaaaucagugggaaucggcacgagcagcuguagaggacgaagaauuuuggaaauuaguggguagagaaagagaauuacauaaacuuggaaaaugugguucauguguauacaauaugauggguaagagggagaagaaacuaggugaauuugguaaagcaaaagggucgagggcuauaugguacaugugguuaggagcccgcuaucuagaguucgaagcgcuggguuucuuaaaugaggaucacugguucucucgagagaacaguuacaguggagucgaaggagaagggcuacacaaauuaggauauaucuuacgagacauaucaaaaauaccaggaggggcaauguaugcagaugacacugcaggcugggacacacgcauaacagaagacgaucuacauaacgaagagaaaauuacacaacaaauggauccugaacacaggcagcuggcuaacgcaauuuucaaauuaaccuaucagaauaaaguagugaaaguacaacguccaaccccuaagggaacaguuauggauauaaucagcagaaaagaucagcguggauccgggcaaguaggaaccuacggacuaaacacauucacgaauauggaagcacagcucauacgacaaauggaaggagaaggaguacuuucaaaagcagaccuggaaaacccacaucuccuugagaagaaaauaacccaauggcuggaaacaaaaggaguagaaaggcuaaagagaauggccauuaguggagaugacugugucguuaaaccgauagacgauagauuugccaaugcuuuauuggcuuuaaaugacaugggaaaagucaggaaagauaucccacaguggcaaccgucuaaagguuggcacgacuggcaacaggucccguucuguagccaccauuuucaugaauuaauaaugaaagauggaagaaaauuaguaguaccaugcaggccccaagaugaauugauaggacgugccagaauaucgcagggcgcaggauggucacugaaggagacagcuugccuagggaaagcauaugcacaaauguggaguuuaauguacuuucauagaagggaucuaaggcucgcaaguaacgcgauuugcucagcaguuccgguacacuggguaccgacaaguaggacgacuuggucaauacacgcacaucaucaguggaugacuacagaagacauguugacaguauggaauagggucuggauugaagacaauccauggauggaagacaaaacuccagugacuacgugggaagaugucccauaccuaggaaaaagagaagaucaauggugcggcuccuugauuggcuugaccucacgagcuacgugggcgcagaauauccuaacggcaauacaacaaguuagaagccuaaucggcgacgaagaauuucuugauuauaugccuucaaugaaacguuuucgaaaagaagaagaauccgaaggagcaauaugguaa

SEQ ID NO: 23514 - RNA, 9873 nt, Artificial Sequence
  derived and/or modified CDS sequence (opt6) from DENV-3__KJ622195__SS-prME
acaaguuugugccuaaugaugaugcuaccugcgacucuagcuuuccaucugaccucgagagacggugaaccgagaaugauuguagggaaaaaugaaagagguaaaucuuuacucuucaaaaccgccagcgguauaaauaugugcacucucauugcaauggauuuaggugaaaugugugacgauacugucaccuauaaauguccucugauagcggaaguggaacccgaagauauugacugcugguguaaucucacaucuacgugggugacauauggcacaugcaaccaagcgggagaacauaggcgagacaaacgaagcguugcgcucgcuccucauguggggaugggacuugauacuaggacacaaacauggaugagugcugaaggugcauggagacaaguggaaaaaguugaaacuugggcauugaggcacccaggauuuacaaucuuagcauuguuucuagcccacuacaucggcacaucucuuacgcaaaaagugguaauauuuauauuacugaugcuaguaaccccaucaauggcgaugagguguguuggugucggaaacagggauuuuguagaaggauuauccggggcaacauggguagacguaguacucgaacacggagggugugugaccacgauggcgaaaaacaaacccacacuugauauagaauugcagaaaacagaagcuacacaacuggcuacacucaggaaacuauguauagaaggaaaaauaacaaauauuacgacugacagcagaugucccacgcaaggugaagcaauacuaccagaagaacaagaucaaaacuaugugugcaaacacacuuauguugauagaggauggggaaauggcuguggacuuuuugguaaaggaucucucgucacgugcgcaaaauuucaaugucuugaaucaauagaaggcaaaguuguacaacacgaaaauuuaaaauacacaguuaccauaacugugcacacuggugaucagcaucaagucgguaacgauacacaaggaguaacggcggaaauaacgccgcaggcaucaacugucgaagcaauacuaccggaauaugggacacuaggguuagagugcucacccagaacaggucuagacuuuaaugaaaugauauugcucaccaugaaaaauaaggcuuggaugguacaucgacagugguuuuucgaucucccucucccauggacuagcggugcgaucaccgaaacacccacguggaaccggaaagaauugcuaguaacauucaaaaaugcacaugcaaagaagcaagagguuguaguccuaggaucucaagagggcgcaaugcauacugcgcuuacaggagccacagagauacagaauaguggaggaaccagcauauuugccgggcauuuaaagugcagauugaagauggauaaacuagaauugaaaggaaugucauaugcaauguguuuaaacacauuuguucuuaagaaagaagugucggaaacucaacacgguacaauacuuauaaaaguugaauauaaaggugaagaugcgccgugcaaaaucccguuuaguacagaggauggucaaggaaaggcucacaauggacggcuuauaacggcuaacccagugguuacaaagaaagaagaaccagugaacauugaggcggagccaccauucggugaaaguaacaucguuauuggaauaggagacaaagcguuaaaaauaaacugguacaagaaaggaucuagcaucggaaaaauguuugaagcuaccgcaagaggggcacgucgaauggcaauacuaggcgauacagcaugggacuucggcagcgugggugggguuuuaaacagccuugguaaaaugguacaccagaucuuuggaucagcguauacugcucuuuuuggaggcguauccuggauaaugaagaucgggauagguguacuacugacguggauaggguugaacucuaaaaacacaaguaugagcuuuuccugcauaguuauuggaaucauuacccuauaccuuggaaccguuguucaagcagauaugggguguguaauaaauuggaaaggcaaagaacuaaaauguggaaguggaauuuuugucacuaacgaaguucacacauggacugaacaguauaaauuccaagcugauucacccaagagguuagccacagcaauagcuggcgcuugggaaaaugguguuugugguauaagaaguacuacccgcauggaaaaccuucuuuggaaacagauagccaacgaguugaacuauauuuuaugggaaaauaauauaaaguuaacaguuguuguaggugacauuauuggaguccuugaacaaggaaaaagaacauuaacaccucagccuauggaacucaaauauucauggaaaacauggggaaaagcuaagauaguuacggcagaaauacaaaauucauccuuuaucauugauggaccaaauacgccagagugcccuucagcuuccagggcuuggaacgucugggaaguggaagauuacgguuuugguguauuuacgaccaauauuuggcugaaacugagggaaguuuauacgcaaacaugcgaccauaggcuaaugagugcagcaauuaaagaugaacgagccguacacgccgacauggguuauuggaucgaaagucagaaaaauggaucuuggaaacuugagaaggcuucauucauagaaguaaaaacaugcacauggccaaagucacauacuuuguggagcaacggaguacuagagucugacaugaucauaccuaaaagccuagcuggcccuauuucacaacacaaucacagaccagguuaucacacucaaacagcgggaccguggcacuugggaaaacuagagcuagauuuuaauuacugugaggguacaaccguuguaauuacagagaacugugguacuagaggacccucauuacgcacuaccacggugagcgguaaauugauacaugagugguguuguagaaguugcacauuaccaccuuuaagauauaugggagaagauggauguugguacgggauggaaauuagaccaauaaacgaaaaagaagaaaauaugguaaaaagucucguguccgcagggucagguaaaguagauaacuuuacaaugggcgugcuaugucuagcaauacuauucgaagaaguaaugagaggaaaauuugggaagaaacauaugaucgccgguguucuacuaacauucaugcuucuuuugaguggacaaauuacuuggcgagauauggcacauacucucaucaugauagggagcaaugcuagugacagaaugggaaugggcgugacguaccuagcacugauagcaacauuuaaaauucagccauuuuuggcauuaggauuuuucuuaaggaaacugacaucacgagaaaauuugcuucuugguguaggucucgcuauggcuacuacauuacaacugccugaagacauagagcaaauggcuaacggcauagcacuuggacucauggcacuuaaguuaauaacucaguucgagacauaucaguuauggacagccuuagugagucucacauguucaaacacaaucuuuacauuaacaguagcguggaggacugcaacccuaauucuugcaggaguuaguuuacuuccaguuugucaaucaucgucaaugcguaagaccgacuggcuaccuguagcaguugccgcuaugggaguacccccuuuaccacuuuucauuuucagucuaaaagacacauuaaaaaggagaucguggccauuaaacgaaggaguaauggcaguaggacuugucagcauauuagcaucuagccuccuaagaaacgacguuccaauggcagguccguuaguagccgggggauuacuaauagccuguuaugugauaaccggaacuucggcggauuuaacuguugagaaagcagcugauguaacaugggaagaggaagcagaacagacaggcguuagccauaaucuaaugauuacuguagaugaugacggaacaaugagaauaaaagacgaugaaacagagaauauccucacaguuuuauugaagacagcauuauuaauaguauccgggauuuuuccuuauagcauaccugcgacacuauuaguauggcauacuuggcaaaagcaaacccaacggaguggaguucuaugggacguaccuuccccaccagaaacacaaaaagcagaacucgaagaaggugucuaucgaauuaaacagcaggguauauucggaaaaacacaggugggaguagggguacaaaaagaagguguauuccacacgauguggcaugugacaagaggggcaguucuuacucauaaugguaagagauuagaaccaaauugggcaagugugaagaaagaucuaauuucauauggcgguggauggcguuuaucagcacaauggcaaaaaggggaagaaguccaaguuauagcaguagaaccagggagaaaucccaaaaauuuccaaacuaugccuggcauauuucaaaccaccacuggggaaaucggugcuauagcacuggacuucaaacccggcacuucgggaaguccuauuauagaucgagaaggcaaaguaguaggucucuauggaaaugggguaguuaccaaaaacggaggauauguuagcggcaucgcgcaggcaaaugcagaaccagauggaccgacuccagaacuagaagaagaaauguuuaagaaaagaaacuuaacaaucauggaccuacaucccgguucggguaagaccagaaaauauuugccagcaauagugagagaggccauaaagcgacgccuaaggacauugauacuugccccaacacgaguuguugcagcggaaauggaggaagcucugaaaggauugccgauaagauaucagacaacugcgaccaaauccgaacauacgggaagagaaauugucgaucuaaugugccaugcaacauucaccaugaggcuacuaucaccgguuagggugccaaacuauaaucuaauaauaauggaugaagcccacuucacugauccugcgaguauugcagcucgcggauauaucaguacaagaguugguaugggagaggcagcagcaauauucaugacggcaacuccaccaggcacugcugaagcauuuccacagucaaaugcaccgauccaggacgaagaaagagacauaccagagagaaguuggaacucugguaacgaauggauuaccgacuuuguugggaaaaccguaugguucguacccucgauaaaagcagggaacgauauugcaaacuguuuaaggaaaaacgguaagaaaguuauacaauuaucucguaaaacuuuugacacggaauaccagaaaacgaaacuuaaugauugggauuuuguagucacaacagacauaucagaaaugggugcaaauuuuaaagcagauagagucauagauccgcgaaggugccuaaaaccgguuauauuaaccgacggcccagagcgugucauacuugccgguccaaugccuguaacugccgcaucugcugcacaaagacguggacguguaggacggaacccacaaaaagaaaacgaccaauauauauuuacuggccaaccccucaacaaugaugaagaucaugcucauuggacagaagcaaaaaugcucuuggauaauauuaauacgcccgaaggaauaauaccagcccuuuuugaaccagagcgugaaaaauccgcagcuauagauggagaauaccgacuuaaaggagaaucaaggaaaacauucguugaacucaugcgccggggugacuuaccagucuggcuagcucauaaaguagcaucagaaggcauuaaauauacugacaggaagugguguuucgacggcgaacggaacaaucaaauacuugaagaaaacauggacguugagauuuggacaaaggaaggugaaagaaagaaauuaagaccuagauggcuugaugcacgcacuuacucgaauccguuagcuuuaaaagaauuuaaagauuuugcagcgggaagaaaaucgaucgcucuugauuugguaacagagauuggcagagugccuagucaucuagcacauagaacacgaaaugcacuagauaaccuugucaugcuucacacuucagagcauggaggucgugcuuaucgacacgccguagaagaauuaccagagacaauggaaacucugcuucuacugggacuaaugauuuuacuuacgggcggugcuaugcucuuucuaauaaguggcaaaggcauaggcaaaacgucaauaggccuuaucuguguaauuguuucuucaggcaugcuuuggauggcugauguuccguuacaauggaucgcaucugcaauagucuuagaguucuucaugaugguguuguugauaccagaaccagagaaacaaagaacaccgcaagauaaucaacuagcauauguuguuaucggaauacuaacuuuggcagcaauugucgcagcaaaugagauggggcuacucgaaacgacuaaaagagacuuagggaugucuaaggaaccagguguggugagcccaacgagcuauuuagacguagauuuacacccugcaagcgcguggacauuauacgccguugcaacaacaguuauaacgccuauguugcgucauacaaucgaaaacaguaccgcaaaugugagcuuagcagccauagcaaaucaggcaguugucuugauggguuuagauaaaggauggcccauaucgaaaauggaccugggugucccuuuauuagcauuagguugcuacagucaaguaaacccucucacccugacugccgcaguguuacugcuuguaacacacuacgcuauaauagguccaggucuucaagcaaaagcaacucgagaggcccaaaagagaacugcagcuggaauuaugaaaaauccaacuguagacgguauuaugacuauugaccuugaccccgugaucuaugacucaaaauucgagaagcaauuagggcagguuauguuauuaguccugugcgcgguucaauuauugcugaugagaacaagcugggccuuaugugaggcccugacucuagcuacuggaccaauaacaacucuuugggaggggagcccaggaaaguucuggaauacaacuauugcaguaucaauggcaaauauuuuuagagguaguuaccuugcuggagcugguuuagcauuuagcauuaugaaaucuguaggaacuggaaaacgugguacagggucacaaggagaaacacuuggagaaaaauggaagaagaaauuaaaucaacuuucaagaagagaguucgaacuuuacaagaaaucggguauuaccgaaguugaucgaacagaagccaaagaaggacuaaaaagaggugaaacgacacaucaugcuguuagccgagguagcgccaagcugcaaugguuuguagaaaggaacaugguuauaccagaagguagaguuauugaccuaggauguggcagggguggauggaguuacuacugcgcagguuugaagaaaguaaccgaaguucgcggcuauacgaagggcggaccuggccaugaggagccagucccgaugucaacuuacggguggaacacuguaaaacugaugucaggaaaagacguauucuauuuaccacccgagaagugcgauacacuucuuugcgauaucggcgaaaguagccccuccccuacugucgaagaaucacgaaccauuagaguucucaaaauggucgaaccauggcucaaaaauaaccaauucuguauuaaaguuuuaaaucccuacaugccaacagugauugagcaccuggagagacuacaaagaaaacauggagguauguugguaaggaauccucuuucaagaaauuccacacaugaaauguauuggauaucgaauggaaccgggaauauaguaucuagcguaaauauggucucuagauuacuacuuaaucgauuuacaaugacgcacagaagaccgacaauugaaaaggauguagaccuaggcgcggguacaagacauguuaaugcggagccggaaacuccaaauauggauguaauaggagaaagaauaaagcgaauaaaggaggaacacucuucuaccuggcauuaugaugaugaaaacccuuacaaaacuugggcuuaucacgguagcuaugaagugaaagcgacagguucagcaucaucgaugauaaauggcguagugaaauuacuaacgaaaccgugggacgugguuccgauggucacccaaauggccaugacggacacaacgcccuuuggacaacaaagagucuuuaaagagaaaguugauacucgcacuccuagaccgaugccggggacgcgcaaagucauggaaauuacugccgaguggcuauggagaacccuuggccgaaacaaacgaccuagacuaugcacgagagaagaauuuacuaagaaaguaagaacaaaugcggcaaugggagcuguuuuuacagaggaaaaccaaugggaaagugcuagggcagcagucgaagaugaagaauuuuggaagcuggucggaagagaaagggaauuacauaaacuagguaaaugcgguucguguguauacaacaugauggggaaacgggagaagaaacucggugaguucggcaaagcgaagggcagccgcgcgauuugguauaugugguugggagcacgauauuuagaguucgaagcauugggauuuuuaaacgaagaucauugguucucgcgagaaaacuccuauucagguguagaaggagaaggacugcacaaauuaggguacauacuaagagauaucaguaagaucccagguggcgcaauguacgccgaugauacugccggcugggauacuagaauuacagaagacgauuuacauaaugaggaaaagauaacacaacaaauggauccagagcaccgccaauuagccaaugcgauuuuuaaauuaaccuaccagaauaaaguuguuaaaguacagagaccaaccccaaaagguacaguaauggauauaaucagcaggaaagaccagcgcgggaguggucaagugggaaccuauggacuuaauacauuuacuaauauggaagcgcagcucauacggcaaauggaaggugaagggguacucaguaaggcggauuuagagaacccucaucuauuagagaagaaaauuacucaauggcuagaaacaaaaggggucgaacguuugaagagaauggccaucucgggagacgacugcguaguaaaaccuauagacgaccguuucgcaaacgcgcuccuugcguugaaugacaugggcaaaguucgcaaggauauaccccaauggcaaccaaguaaaggauggcaugauuggcagcaaguccccuucuguagccaucauuuucaugaguuaaucaugaaagaugggagaaaacucguuguaccaugccgaccgcaagaugagcucauugggcgggcgagaaucagucaaggagccggauggagucuuaaagaaacugcaugccuuggcaaagcauacgcccaaauguggaguuuaauguacuuucaucggagagauuuaagauuagcuaguaacgccauauguagugcuguaccugugcacuggguuccaacgucuagaacaacuuggagcauccaugcgcaucaucaauggaugaccacagaagauaugcucacuguauggaauagaguuuggauagaggacaauccuuggauggaagauaaaacaccuguuaccacaugggaagauguucccuaccuugguaagcgugaagaccaauggugcggaaguuugauuggauuaacuucacgagcaacgugggcccaaaacaucuuaacagcaauccaacaggugaggucauuaauaggggaugaagaguucuuagauuauaugccuucaaugaaacgcuuccgcaaagaagaagaaagcgaaggcgcaauaugguaa

SEQ ID NO: 23515 - RNA, 9873 nt, Artificial Sequence
  derived and/or modified CDS sequence (opt6) from DENV-3__KJ622196__SS-prME
acaaguuuaugccugaugaugauguuaccugcaacacucgcuuuucaccuaacaagucgcgacggugaaccgcgcaugaucguaggcaaaaaugaaagagguaaaagucucuuauucaaaacggcaucggguauaaacauguguacacuuaucgcaauggacuuaggagaaaugugugaugauacgguaacguacaaaugcccacuaauugcagaaguagaaccagaagacauugauuguugguguaaccuaacaucuacaugggugacauaugggacgugcaaccaagcgggagagcauagaagagacaaaagaucuguagcgcuagcaccgcauguggggaugggauuagacacacguacucaaacguggaugucagcagaaggagcuuggaggcaagucgaaaaaguagaaacaugggcauuaagacacccuggguucacaauuuuggcacuguuccuagcucacuauauaggaacgagucuaacacaaaaaguaguaauuuucauccuacuuauguuagugacaccaucuauggcuaugcgaugcguagguguaggaaacagagauuucguugagggacugaguggagccaccuggguugaugugguccuggaacaugguggguguguaacaacaauggccaaaaacaaaccuacguuagauauugaauugcagaaaacugaagcaacgcaacuugcuacuuuaagaaaacugugcaucgaaggaaaaauuaccaacauuacaacggauucccgaugucccacucaaggagaagcgauauuaccugaggaacaagaccaaaacuaugucuguaaacacacguauguggacagaggauggggaaauggguguggacuuuucggaaaagguucguuagucacaugugccaaauuucagugucuggaaucuauugaaggaaaaguugugcaacaugagaacuuaaaauacacaguuacuaucaccguccacacuggugaccagcaccaaguagguaaugauacacaaggagugacagcagaaaucacaccacaagccaguacgguggaagcuauccuuccagaguauggcacauugggucuagaauguucaccacgcacaggucuagauuuuaaugagaugauacugcuaacaaugaaaaacaaggcuuggaugguccaccgucaaugguucuuugaucuaccauuacccuggacgaguggagcgaucaccgaaacaccuacauggaauagaaaagagcuauuggucacauucaaaaaugcacaugcuaagaaacaggaggucgugguucuggguagucaagagggcgcaaugcauaccgcauuaacaggugcaacugaaauucaaaauucaggcgggacuucgauauuugcaggacauuuaaaaugcagauuaaaaauggacaagcuagaguuaaaaggaaugagcuaugcgaugugcuugaauacauucguucuaaagaaagaaguaucugagacacagcaugguacaauuuuaauuaaaguugaauauaagggagaagacgcuccaugcaaaauaccuuuuucaacugaagauggacaagguaaggcacauaaugguagguuaauaaccgcuaauccggucguuaccaagaaagaagaaccugugaauaucgaagcagaaccuccauuuggagaaucgaauauuguaaucggaauaggugauaaagccuuaaagauaaacugguacaagaaaggaaguucaaucggaaaaauguuugaagcaaccgcacgaggagcuaggagaauggcaauacugggagauaccgcgugggauuuugguucuguaggaggaguacuaaacagucuggggaaaaugguccaucagauuuucggaucagcauauacagcucuauuuggcggagucucauggauuaugaaaauuggaaucgguguuuuacugacauggauaggauuaaacagcaaaaauacuucaaugaguuucucuugcauaguuauaggaaucauuacauuguacuuggggacgguagugcaagcagauaugggaugcguuauaaauuggaaaggaaaggaacuuaaaugcgguaguggaauauuugugacaaaugaaguacacaccuggacagaacaauauaaauuccaggccgauucacccaagagauuggcaacagcaaucgcgggggccugggaaaacggcgucugcgggauccggucaacuacaagaauggaaaaucuacucuggaaacaaaucgcaaaugaacuaaacuacauucucugggaaaauaauauaaaauuaacagugguuguaggggauauaaucggagucuuggaacagggaaagagaacacuaacaccgcagccaauggaauugaaguacagcuggaagacuugggggaaagcgaaaauaguaacugcggaaauacagaacaguucuuuuauaauugauggaccuaauacaccugaaugcccgagcgcgucgcgagcauggaaugugugggaaguagaggauuauggauuugguguuuucacaacaaacauaugguuaaaguugagagaaguauauacacaaacaugugaucaucgacucaugucugcugcaaucaaagaugaaagagcugugcacgcggauaugggcuacuggauugagucucagaaaaacgguagcuggaaacuugaaaaggccucauucauagagguuaaaacuugcacguggccuaaaagccauacccuguggagcaauggaguacuagaaagugauaugauaauaccaaaaagccuagcaggaccaauaucucaacacaaucauagacccggcuaccauacccaaaccgcuggaccauggcacuuaggcaaguuggaguuagacuuuaacuauugcgagggaacaacuguggugauuacagaaaauugugguacuagagggccgucucuuagaacgacgaccguaucugggaaguuaauacaugaauggugcugccguucaugcacucuacccccauugagauacaugggggaagauggauguugguacggaauggagauacgaccaaucaaugaaaaggaagagaacaugguuaaaaguuugguuagugcagggucgggaaagguagauaacuuuacuaugggcguucuaugucuagcgauccuuuuugaggaaguaaugagagggaaguucggcaagaaacauaugaucgccgguguauuacugacguuuauguuauuguuaaguggacaaaucaccuggcgggauauggcccacaccuuaaucaugauuggcagcaacgcaucagauaggauggguauggggguuacuuacuuagcccuaauagccacauuuaaaauucaaccauuccucgcacucggauucuuuuugagaaaauugacgucccgcgaaaauuuacuauuagguguuggacucgcaauggcgacuacucuccaguuaccggaagauauagaacaaauggcgaauggaauagcgcuaggauuaauggcucucaaauuaauaacucaguuugagacuuaccaauuauggacagcguuaguaagucuaaccugcucuaauacgauauucaccuuaacaguagcauggagaaccgccacacuaaucuuagcaggcgucagucuuuuacccguuugccaaucgucuaguaugaggaagacagacuggcuaccuguggcagucgcagccauggggguaccucccuuaccucuauuuauauuuucauuaaaagauacacuuaagcgaaggagcuggccacuuaaugaaggggugauggcugucggucuuguaucgauccuagcuucuucuuuguugcguaaugauguccccauggcuggccccuugguugcaggcggacuacuaauagcauguuacgucaucaccgggacgagugccgaucuaacgguagaaaaagccgcugacguaacgugggaagaagaggcagaacaaacuggaguaagucauaaucugaugauuacuguagacgaugauggaacuaugcgaauuaaagacgacgaaacagaaaauauauugacaguauuauuaaagacugcguuacuuauaguaagugggauauuccccuauucuauucccgccacacuauuaguauggcauacauggcaaaagcaaacacagcggagcggaguacuaugggacguacccaguccaccugaaacacaaaaagcagaauuagaagaagggguguauaggauuaaacaacaaggaaucuucgguaaaacccagguagguguuggaguacaaaaagagggaguuuuccacacuauguggcauguaacaagaggcgcugugcucacccauaauggaaaaagacucgaaccuaauugggcgaguguaaagaaagaucuaauuucauacggcggcggauggcgauugagcgcucaauggcaaaagggcgaggaagugcaagugauagcgguagaaccaggaagaaaucccaaaaauuuucaaacaaugccuggaauauuucaaacaacuacaggagagauuggugcaauagcucuugauuuuaaaccagguacuuccggaagcccuauuaucaacagagaaggaaaaguaguaggacuuuauggaaauggcguugucacgaaaaauggaggcuacguaucuggaaucgcucaagcgaacgccgaaccagaugggccaacaccugaauuagaagaagaaauguuuaagaaaagaaauuuaacaauaauggauuuacacccaggcagcggaaaaacuagaaaguaucugccggcgauaguccgugaagcaauuaaaagaagacuaagaacauuaauauuagcgccaacuagaguagucgcagcagaaauggaagaagcucugaaaggcuugccaauuagguaccagacaacggcaacaaaaagugagcauaccggcagggaaaucguggaccuaaugugucaugcuacuuuuacgaugagauuacuaucacccguacgaguaccuaauuacaaccuuauaauuauggacgaggcucauuuuacugauccugcuagcaucgccgcacgaggcuauauaucaacaagaguuggaaugggagaagcugcugcaauauucaugacugcaacaccaccuggaaccgcugaagcauuuccccaaagcaaugccccaauacaagacgaagaacgugacauacccgaaagaaguuggaacucaggcaacgaguggauaaccgacuucguaggcaaaaccguuugguucguaccuucuaucaaagccggcaaugauauagcuaauuguuugaggaaaaauggcaagaaaguuauacagcugucacgaaaaacauucgauaccgaauaucagaaaacgaaguugaacgauugggacuucgucguuacuaccgacauaagcgaaaugggagcuaacuuuaaagcugaucgagugauugauccgcgaaggugucucaaaccgguaauacugacugacggaccagaaaggguaaucuuggcaggaccgaugccugugaccgcagcguccgcagcacaaagacgcgggagaguaggacguaacccacagaaagagaaugaccaauacaucuuuaccggacagccgcuaaauaaugaugaggaccacgcacacuggacagaagcgaaaauguuacuagacaacauuaacaccccugagggaauaauaccagcacuauuugaaccagaacgugagaaaagugccgcgauagacggcgaauaucgacuaaaaggggaaucuagaaaaacauucguugaauuaaugagacgaggugaucuaccggugugguuagcacauaaaguagcuucggaaggcauuaaguauacugaccggaaaugguguuucgacggcgagagaaauaaccaaauauuagaagaaaauauggauguagaaaucuggacuaaagagggagagcggaagaaauuaagaccaagguggcuagaugcacguaccuauagcaacccacuagcccucaaagaguuuaaagauuuugcugcaggccgaaagucgauugcccuugacuuaguaacagaaauuggaagaguucccagucaccuagcgcauagaacaaggaaugcguuggauaaucucguaauguuacauacgagcgagcacggcggacgcgcuuaccgacaugcagucgaggaauugcccgaaacuauggagacuuuacuacuauuagguuugaugauucuacucacuggaggggccaugcuauuuuugauaagcggaaaagggauagguaaaacuucaaucggccuuauauguguuauagucucaucaggaauguuguggauggcagacguaccacuccaauggauagcaagcgcgauaguacuugaguucuuuaugauggucuugcuaauacccgaacccgagaaacaaaggacuccccaagauaaccaguuagcauaugucguaaucgggauacuuacccucgcggcgauaguugcugcaaaugaaaugggccuccuagagaccacaaagcgagaccuaggaaugucaaaagaaccuggaguaguuagcccaacgucuuaccuggauguagaucuacauccagcuagugccuggacacuuuaugcuguggcuacaacgguaauaaccccuauguuaagacacaccaucgaaaauagcaccgcaaacguaagccuagcugcgauugcuaaucaagcuguaguucugauggguuuggacaaaggauggccuauuaguaaaauggacuuaggagucccgcuguuagcacucggauguuacagccaaguaaacccuuuaacacugacugcggcuguacuauugcuaguaacucacuacgcaauaauuggucccgggcuacaggcaaaagcuacuagggaggcccaaaaacgaacugcugcaggaauuaugaaaaauccuacuguagauggaaucaugaccauagaccuagacccugugauuuaugacaguaaauuugaaaaacaacugggccaaguuauguuacuuguccucugugcuguucaacuccuucucaugagaaccagcugggcguuaugcgaagcacuuaccuuggcaacuggaccgauaacaacacucugggaaggaaguccggguaaauuuuggaacaccacaauugcagucucaauggcuaacauuuucagaggauccuacuuggccggugcggggcuagcauuuucaaucaugaaaucuguugguacagguaaaagagguacugggucacagggagaaacacuuggggaaaaauggaagaagaaacuaaaucaacuaucgcgucgggaauuugaacuauauaaaaagagugguaucacagaaguggauagaacugaagcgaaagaggggcugaaaagaggagaaacgacacaccaugcugugucaagaggcagcgcaaagcuacagugguucguagaacguaauaugguaauuccggaaggaagagugaucgacuuaggaugugguagaggaggcuggagcuacuauugugcaggacuaaagaagguaacggaaguacgugguuauacuaaaggugguccaggucacgaagaaccagugcccaugagcacuuaugguuggaauaccguaaaacuuaugucugguaaggauguauuuuaccuuccuccugaaaaaugcgacacguuauuaugcgacauaggagaguccucaccuucacccacuguggaagaaucacguacaauaaggguacuaaaaauggucgagcccugguuaaagaacaaucaauuuuguaucaaaguacucaauccuuauaugccuacaguuauagaacaccuugagaggcuacaacguaaacaugguggaaugcugguaagaaacccauugucgagaaacucaacccaugaaauguauuggauaucaaacggaacaggaaauauuguuucaucaguaaauaugguuagucgucuccuacugaaucgauucacaaugacacaucgcagacccaccaucgaaaaggauguggaccucggugcaggcacuagacauguaaaugcagagccggaaacuccuaauauggauguuaucggugaacguauaaaaagaauaaaagaagaacauucuaguacauggcauuaugaugaugaaaauccguauaaaaccugggcauaccauggaucauacgaagugaaagcgacuggcagcgcaucaaguaugaucaaugguguaguaaaacuuuuaacuaaaccuugggacguaguuccaaugguuacccacauggcuaugacagauacuacaccguuuggacaacaaagaguuuuuaaagaaaaaguagacacaagaacaccgcggccaaugccuggaacgaggaaagugauggagaucaccgcugagugguuauggcguacucucggucgaaauaaacgaccuagacuauguaccagggaagaauuuacuaagaaaguaaggacuaaugcggcaaugggagccguauuuacugaagaaaaucaaugggagucugcacgugcagcgguagaagaugaagaguuuuggaaguuagugggacgggaaagggagcuacacaaacuagggaaaugcggaaguuguguauacaauaugaugggaaagagagagaagaaacuaggcgaguuugguaaagcuaaagguaguagagccaucugguauaugugguugggugcacguuaucuggaguuugaagcguuaggguuucugaaugaagaucauugguucuccagagaaaauucauacucaggaguugagggagaaggccuacacaaacugggguauauucuuagagauauuagcaaaauaccaggcggugcaauguacgcggacgacacugcggguugggauacgagaauuacugaagaugaccuucauaacgaagagaaaauuacacagcaaauggauccagaacauaggcagcuggcuaacgcaauuuucaaacuaacauaccaaaacaaaguaguaaaggugcagagaccaacacccaaaggaacuguaauggauauaaucucaaggaaggaucaaagggguaguggacagguuggcacuuauggacuaaauaccuuuacgaauauggaagcucaacuaauaagacaaauggagggcgaggguguuuuaucgaaggcagauuuggaaaauccacaccuacucgagaagaaaauuacacaauggcuagaaacaaaaggcguugagcgauuaaaaaggauggcaauaaguggagaugacuguguaguaaaaccuauugaugauagauuugcuaacgcgcuauuagccuugaaugacauggguaaaguacggaaagacauuccacaauggcaacccucuaaaggauggcacgacuggcaacaagugccuuucugcagucaccacuuucacgaacuaauuaugaaagauggacgaaaauuagugguaccuugcagaccucaagacgaauuaaucggacgggcccggauuucccaaggcgcaggcuggagccugaaagaaacagccugcuuaggaaaagcauacgcucagauguggaguuuaauguacuuccaccgaagggacuugagacuagccaguaaugcgauaugcucagcaguaccaguacacuggguacccacaucaagaacaacauggucuauacaugcacaucaucaguggaugacaacugaagauaugcucacaguguggaaucgaguauggauugaggacaauccauggauggaggauaagacccccgucacuaccugggaagacgugccguauuuagguaaaagagaggaucaaugguguggaucauuaauuggucuaaccagccgagcaacaugggcacaaaauauuuuaacggcaauucaacaagugagaucacuaauaggggacgaggaauuucuagauuauaugcccucuaugaaaagauuccgaaaagaggaagaaucggagggagcgauaugguaa

SEQ ID NO: 23516 - RNA, 9873 nt, Artificial Sequence
  derived and/or modified CDS sequence (opt6) from DENV-3__KJ830751__SS-prME
acaagucuauguuuaaugaugauacuaccagcggcacuugcauuucauuugacaucuagagauggagaaccuagaaugauaguagggaaaaaugaacgugguaaaucguugcuguuuaaaacagcaucggguauaaauaugugcacuuugauagcaauggaucuaggugaaaugugugacgacacagugaccuauaaaugcccacacauuacugaaguggagcccgaagauauagauuguugguguaaucuaacaucaacuuggguuacguacggaacauguaaccaagcaggagaacacaggagagauaaacguucaguggcauuagcaccgcacguagguaugggucuagacacgcguacacaaacauggauguccgcagagggugcauggagacaaguugagaaaguggaaacaugggcauuaaggcaccccggauuuacaauacuagcauuguucuuagcucauuacauaggaacuucacuaacccaaaaagucgucauuuucauacucuuaauguuagucacgccuucaaugacgaugagaugcguagggguaggaaaucgugacuuuguagagggauuaucaggugcuacauggguagauguaguccuggaacauggugguuguguaacgacaauggccaaaaauaaaccaacuuuagauauagaacuacagaaaacagaggcaacucaauuagcaacauugcggaaacuaugcaucgaaggaaaaaucaccaauauaacaacagauucaagguguccaacacaaggugaagcugugcuaccagaagaacaagaccaaaauuacgucuguaaacauacauacgucgacaggggaugggggaauggaugcgguuuauuuggaaaagguagccucguaacgugcgcuaaauuccaaugccucgaaccaauagagggcaaaguggugcaauaugaaaaucuaaaauacacuguaauaaucaccguacauacuggagaucaacaccaagucgguaaugaaacacaagguguaacugccgaaauaacuccucaagccaguaccaccgaagcaauuuuaccagaauauggcacacuuggcuuagagugcaguccuagaaccgggcuugacuuuaaugaaaugauacuauuaacuaugaaaaauaaagcguggaugguucaucgucaaugguucuuugaucuuccauuaccgugggcaucuggcgcaacgaccgaaacaccaacuuggaauagaaaagaacuucucgugacguuuaaaaaugcacaugccaagaaacaagaaguggugguguuaggaucucaggagggugcuaugcauacggcacucacaggugcgacugaaauacaaaauucaggcgguacaucgauuuuugcaggacaucugaaaugcagauuaaaaauggauaaacuggagcucaaaggcaugagcuaugccaugugcacaaauacauucguuuuaaagaaagaaguuagcgagacucaacauggaacuauucuaauuaaaguugaguacaaaggcgaagaugcuccaugcaaaauuccuuucucaacagaagacggccaaggcaaggcacauaauggacggcugauaacagcuaauccagucguaacgaagaaggaggagccaguaaauaucgaggccgaaccucccuuuggugaaaguaauaucgugauaggaaucggggacaaugcccucaaaauaaacugguauaaaaagggcagcaguauagguaaaauguuugaggccacggcucgaggcgcgagaagaauggcgauauugggcgacaccgcaugggauuucggaaguguaggugggguuuuaaauucauuaggaaagaugguccaucaaauauuuggaucugcauacacugcacucuuuucaggggucucauggguaaugaaaauagggauugguguucuacuaaccuggauaggacuaaauaguaaaaacacaagcauguccuucaguugcauugcuauagguauaaucacguuauauuuaggagcuguuguacaagcggauaugggcuguguaaucaacuggaagggaaaagaacugaaaugcggaagugguauauuugugacaaaugaaguacacacguggacggagcaauacaaauuucaagcagacagcccaaaaagauuagccaccgcaauugccggugcuugggagaaugggguaugugguauaagaucaacaacaagaauggaaaaucugcuauggaagcaaauugcaaaugagcugaacuauauacucugggaaaacaauauuaaacuuaccguaguggucggugauacaaucgguguccuagagcaagguaaaagaacccuuacgccacagccuauggaauuaaaauacaguuggaaaacaugggguaaagcaaaaauugucacagcggaaacgcaaaauucaaguuucauaauagacggaccgaauaccccugaaugcccuucagccucgcgugcauggaauguaugggaggucgaagauuauggauuuggcguauucacgacgaacauuuggcuaaaauugcgggaaguuuauacacagcugugugaucaucggcugaugagcgccgcagucaaagaugaaagagcaguacaugccgacaugggauacuggauagaaucacaaaagaauggaagcuggaagcucgagaaagcaucguuaauagaaguaaaaacuugcacuuggccaaaaucgcacacacucuggucaaauggcguacuugaaagugacaugauaauaccuaagagcuuagccgguccuauaagucaacauaacuaucgaccuggauaccauacccaaacggcaggucccuggcaucuugguaaacuugaacuagauuuuaauuauugcgagggaacaacggucguuauuaccgagucuuguggaaccagagguccaagccuaagaacuacuacuguuaguggcaaauuaauucacgaguggugcugccgcaguugcacauuaccgccacuaagguauaugggagaggacgguugcugguauggaauggaaauaaggccgaucagugagaaagaagaaaacauggugaaaucgcuggugagcgccggcucagggaaagucgacaauuuuacaaugggaguguuauguuuagccauacuuuaugaagaagucaugagagggaaauucggaaagaaacacaugauagcugggguauuuuucacuuucguauuacuauuaagcggacaaauaacuuggagaaauauggcccacacucugauaaugauuggaucaaacgcaagugacagaaugggcaugggcguaacauaucuagcauugauagcuacauuuaaaauacaacccuuucuggcacuuggauucuuuuugcgaaaauugaccaguagagaaaaucuauuauuaggcguuggauuagcuauggcgaccacguugcagcugccggaugauauagaacaaauggccaacggaauugcacugggauugauggcccuuaaauuaauaacacaauucgaaacauaucagcuauggaccgcauuagugucacugaccugcaguaauaccauguucacauuaaccguggcauggcgaacagcuacacugaucuuagcuggaguuagucugcuaccaguaugccagaguucgucaaugagaaaaaccgauugguuaccgauggccgucgcggcaauggggguuccgccccuuccuuuauucauauuuaacuugaaagacacgcugaaaaggagaucuuggccucuaaaugaaggaguaauggcaguagguuuggucucgauacuugccagcucccuccugaggaaugaugucccaauggcgggcccacuggucgcaggcggauugcucaucgcuuguuauguaauuacagguaccagcgcggaucugaccguugaaaaagcagccgauguuacaugggaagaggaagcugaacaaaccgguguuagucacaaccugaugauuacaguugacgaugaugggaccaugcguauaaaggacgaugaaauagaaaacauuuuaacaguguuacucaaaacagcucucuugauaguaucagggauuuucccauacucuauaccagcaacguugcucgucuggcacacguggcaaaagcaaacacaaagaucagggguacuaugggaugucccaucuccuccagaaacucagaaagcagaacuagaggaagggguuuauagaauaaaacaacaagggauauucggaaaaacucaagugggugugggaguucaaaaagaagguguauuccauaccauguggcaugugacgcggggagcuguucuuacgcauaacgguaagaggcuagaaccuaacugggcuagugugaagaaagaucuaauaucuuaugguggugguuggagauuaucugcccaauggcagaaaggagaggagguucagguaauagcaguagaaccaggcaaaaauccgaaaaauuuccagacgaugcccgggacuuuccaaacuacaacgggagaaauaggcgccauagcuuuagauuuuaagccgggaacgucugguagucccaucauuaacagagaagguaaaguugugggacuauacggaaacggagucgugaccaaaaacgguggauauguauccgguauagcccaaacuaaugcugaaccagacggaccgacgccagagcuagaggaggaaauguucaagaaaagaaaucuaacaaucauggaccuucaucccggcagcgguaaaacccggaaguauuuaccugcuauuguccgugaggcuauuaaacgacgcuuaagaacucuuauacucgcgccuacgagaguaguugcugcagaaauggaagaagcauugaaaggauugcccaucagguaucaaacaacagcaaccaaauccgaacauacaggacgcgaaaucgucgaccugaugugccaugcgacuuuuacaaugcgguuacuaaguccuguucgagugcccaauuacaaucuuauuauaauggacgaagcacauuuuacugauccagcguccauagcugccagggguuacauuagcacgaggguagguaugggagaagcagcagcuauauuuaugacggccacuccucccggaacggcagacgcuuuuccacaaucaaaugcaccuauacaagacgaagaacgagauauacccgagcguagcuggaauagcggaaaugaauggauuaccgacuucgccggaaaaacgguaugguucgucccgucaauaaaggccggcaaugauaucgcaaauugccuucgcaagaaugguaagaaagugauucaauugucaagaaaaacguucgauacugaauaccagaaaacaaaacuaaacgauugggauuucguuguaaccacagauauaucggaaaugggugcuaacuuuaaagcugaucgaguuauagauccuagacguugccuaaaaccgguaauucuaacggauggaccugaaagaguaauauuggccggaccuaugccgguaacagcagccagcgcggcgcaaagacgagggcguguagggaggaacccccaaaaagaaaacgaccaauauauauuuacaggacagccacucaauaaugaugaagaucaugcacauuggaccgaggcuaaaauguuguuagauaacauaaauacaccagaaggcauucuacccgcauuguucgaacccgaaagagaaaaauccgcugcaauagauggagaauaccggcuaaaaggagaaucuaggaaaacauuugucgagcugaugagacggggugacuuaccugucugguuggcucauaagguagcaucugaaggaauaaaauacacagaucgaaaaugguguuuugauggacaaagaaauaaucaaauauuagaagagaauauggaugucgaaaucuggacgaaagagggagaaaagaagaaacuaagaccuagauggcuagaugcucgaaccuauagugauccacuagcccugaaagaauuuaaagacuucgcagccggacgaaaaucaauagcacucgaucuuguuacagaaauuggcagagucccaucucaucuagcacacagaacacguaacgcauuagacaaucuugucauguuacauacaagugaacaugguggacgagcguaucgucaugccguggaagaacuaccagaaacuauggaaacacuuuuacucuugggauuaaugauacuacuaaccggcggugcuauguuguuccuaauaucaggaaaagguaucggaaagacaucuauuggccuaauuugugucaucgcuuccucuggaaugcuguggauggcugaggucccguuacaauggaucgcguccgcaauaguauuagaguucuuuaugauggucuuacugaucccugaaccggaaaagcaaagaaccccacaggauaaucaauuagcguacguagugauuggaauacuaacacuugccgcgauaauugcugccaaugaaaugggauuguuagagacaacuaaaagagacuugggaaugaguaaagaaccuggggugguaucacccacaagcuaccuugacguugaucuacaccccgcuucagcauggacacuauaugcuguugcuacgacaguuauuacucccauguuacgacauacaauagagaacagcacagccaaugucucgcuugcggcaauugcuaaccaggcgguuguacuuauggguuuagauaaaggguggccaauaucaaaaauggaucuuggagucccauugcuagcauuaggaugcuauucccaaguaaacccauuaacauuaacagcagcgguacuucuucugauuacucauuaugcaauuauaggcccaggucuccaagcgaaagcgacaagagaggcccagaaacggacggcagccgggauuaugaaaaacccuacuguugacggaauuaugacgauagaucuggacccgguuauauaugacucaaaauuugagaaacaacuuggucagguuaugcuauuaguccuaugcgcagugcaacuacuuuugaugagaacaaguugggcacuuugugaagcgcuaaccuuggcgaccggaccgaucacuaccuuaugggagggaucaccaggaaaauuuuggaauacuaccauagccguaucaauggcaaacaucuuuagaggaucguaucuggcgggugccggucuggcauuuuccauaaugaaaucgguagguaccgggaaacgaggcacuggaagucaaggagaaacucuuggagagaaguggaagaagaaacugaaucaguuaucucgcaaagaauuugauuuauauaagaaauccgguauaacagaggucgaucguacugaagcaaaagagggucuaaaacggggagagacaacacaucacgcaguuucacgagggagugccaaguuacaaugguuugucgagagaaauaugguaguacccgaggguagaguuauagauuuggguugcggaagaggugggugguccuauuacugcgccggucucaagaaaguuacagaagugcgagguuacacgaaaggaggcccgggacaugaggaaccaguaccaaugagcacuuauggauggaacauugugaaacuuaugucgggcaaggauguauuuuacuugcccccggaaaagugcgacaccuuauuaugugacauuggcgaaagcagcccgucaccaacuguugaagagucucguacuauacgggugcucaaaaugguagaaccaugguugaagaauaaucaguuuugcauaaagguacugaacccuuacaugccaacagugauagaacaucuggaacgccuccaacggaaacauggugguaugcuaguaaggaauccucuuuccagaaacuccacacaugaaauguacuggauaucuaauggaacagguaacaucguuaguucaguuaauaugguaucucgcuuauuauuaaauagauuuacaaugacccauagaaggccuaccauagagaaagacguagauuugggcgcaggcacgagacauguaaacgcagaaccagagacuccuaacauggaugugauaggggaacgcauaaaaagaauaaaagaagaacauaacuccacauggcacuaugacgaugaaaauccuuauaaaaccugggcauaucacggaucauacgaagugaaagcaacugggucagcuagcaguaugauuaauggcguuguaaaacuuuuaacgaaaccuugggacguuguaccuauggugacacaaauggccaugacggauacaacaccauuuggccagcaaagaguuuucaaggaaaaagucgauacacgaacaccaagaccuaugccugggacuagaaaagugauggaaauaacagccgaauggcuuuggagaaccuuaggaagaaacaaaagaccgcgucugugcaccagagaggaauuuacaaagaaggugcgcacaaacgccgcaaugggagcgguuuuuacggaagaaaaucaaugggacagcgcaaaagcagcugucgaagacgaggaauuuuggaaacucguugaccgagagagagaguugcauaagcuaggaaagugcgguuccuguguauauaacaugaugggaaagcgugagaagaaauuaggggaauuugguaaagcuaagggaucuagagcaaucugguauauguggcuaggagccagauaccuugaauuugaagcacugggauucuuaaacgaagaucacugguuuucuagagaaaauaguuauucaggaguggaaggagaaggacuccacaaauugggcuacauauugcgagacaucaguaagauaccagguggugcgauguaugccgacgauaccgcggguugggauacacgaauuaccgaagaugaucuacacaaugaagagaaaauaauccaacaaauggauccagaacaucgucaauuagcuaacgcuauuuuuaaacucacauaccagaauaaagucgugaaaguacaaagaccaacacccacggguacaguaauggacauaauaucuaggaaggaucaaagggguaguggucagguagggacauacggacuaaacacauuuacuaauauggaggcacaauugguccggcagauggaaggugagggcgucuuaacaaaggccgaucuagagaacucgcauuuaccggagaagaaaaucacgcaaugguuggaaacuaaaggaguugaaagguugaaaagaauggcaaucucaggugaugacugugugguuaaaccgaucgaugaucgcuucgcaaacgcgcugguagcuuuaaaugacauggguaaaguaaggaaggacaucccacaauggcaaccuuccaggggcuggcacgauuggcaacaaguuccuuuuuguagucaccauuuucacgaauugauaaugaaggacggaagaaagcuaguuguaccgugcagaccccaggaugagcuuauagggagagcaagaauuagucagggugcgggguggagcuugagggaaaccgccugucucgggaaggcuuaugcgcaaauguggucuuuaauguacuuucacaggagagauuugagauuggcgagcaacgcaauaugcagcgcaguuccaguacacuggguaccgacaucucguacaaccuggucaauacaugcucaccaccaauggaugacuacugaagauauguuaacgguuuggaauaggguuuggauagaagaaaauccuuggauggaagauaaaacuccaguaacgacaugggaaaauguaccguaucuaggaaagagagaagaucaguggugcggaucguuaauaggacugacaucacgcgcaacaugggcacaaaacauuccaacugcaauucagcagguacgaucauuaauuggaaaugaagaauuuuuagacuacaugccaaguaugaagagguuccggaaagaagaagaaucggagggagcaauuugguag

SEQ ID NO: 23517 - RNA, 9873 nt, Artificial Sequence
  derived and/or modified CDS sequence (opt6) from DENV-3__KC762681__SS-prME
acgaguuugugucucaugaugauguuaccagcaacccuagcauuucaccugacaucuagggacggggaaccgaggaugaucguuggcaaaaaugaaagagguaaaucauuacuguuuaaaacugcaagcgggauuaauaugugcacucuaauugcuauggaucucggcgaaaugugugaugauacuguaacuuauaaauguccgcugauuacagaaguugaaccggaggacauugauugcugguguaacuuaacaucaacaugggucacuuacggcacuugcaaccaagcgggagaacaucggagggauaaaagaucaguggcauuagcuccacacguagguaugggacucgauacacgaacucaaacuuggaugucggcagaaggagccuggcgccaaguugaaaaaguagagacgugggcauucagacacccuggcuuuacuauauuagcuuuauuucucgcgcacuauauaggcacuucacucacacaaaaagugguuauuuucauucuacucaugcuugugacaccaucuaugacaaugagauguguagggguuggaaaccgugauuuuguggaaggguuaucgggggcaaccuggguagacguugugcuggaacaugguggguguguaaccacaauggcgaaaaauaaaccgacauuagauauagaacuacagaaaaccgaagcaacacaacuagcgacccuucggaaacuauguauagaaggaaaaauaacaaaugucacaacggacucaagauguccgacacaaggagaggccauacuuccugaagaacaagaccaaaacuacguauguaaacauacguacguugauagaggaugggguaaugguuguggauuguucgggaaagguagucucgugacaugugcuaaauuccaaugcuuggaguucauagaagggaaagugguucaacacgaaaauuuaaaauauaccguaauuaucacgguacacacgggagaccaacaucaaguuggaaaugaaacccaagggguaacggcugaaauaacaccacaagcuagcacuguagaagcgauauuaccagaguaugguacacuggggcucgaauguuccccgcgaacugguuuagauuuuaaugagaugauauuacuaacaaugaaaaauaaagccuggaugguccauagacaaugguuuuucgauuuaccucuaccauggacaagcggcgcaacaacugaaacaccaaccuggaacaagaaagaacuucuaguaacuuucaaaaaugcccaugccaagaaacaagaaguagugguacuaggaucccaagaaggcgcuaugcauacugcacuuacaggagcuacugaaauacaaaccucuggagguacaucaaucuucgcuggacaucuaaaaugcagauuaaaaauggauaaauuagaauuaaaaggcaugucauaugcaauguguuuaaaugcauucguauugaagaaagagguuucagaaacacaacacgggacaaucuuaauaaaaguugaguauaaaggcgaggaugcgcccugcaaaauaccauuuucaacagaggauggucaaggcaaagcacauaauggucgccucauaaccgccaauccaguagucaccaagaaagaagaacccguaaacauugaagcagaaccacccuuuggagaaucuaauauaguaauuggcauaggugauaaagcauuaaaaaucaacugguacaagaaagggucaagcauuggaaaaauguuugaggccacugcacggggcgcaagacggauggcaauacucggagauacagcaugggauuucgggagcguaggcggagugcucaacagucuagggaaaauggugcaucaaauuuuugguuccgcuuauacggcuuuauucucagggguaucuuggauaaugaaaauuggcauagguguacuuuuaacauggauaggacuuaauucgaaaaauacaagcaugucauuuucuuguauaguaauaggaauuaucacccucuauuuaggggcaguaguacaagcagacauggguugcguaaucaacuggaaaggcaaagaauuaaaaugcggaucuggaauauuuguuacuaaugaagugcacacauggaccgaacaguauaaauuccaggcagauagcccuaaacgucuugcaacggcaauugcuggugccugggaaaauggaguguguggcauuagaagcacaacgcgaauggagaauuuguuauggaaacaaauugcgaaugaauuaaacuacauacucugggagaauaacauuaaacuaacuguaguaguuggcgauauaaucggcguuuuggaacaaggaaaaagaacacuaacaccccaaccaauggaucucaaauauagcuggaaaacguggggaaaagcgaaaauagugacugcugagacacagaauaguucauuuauaaucgacggacccaauacacccgagugcccaucagcgagccgcgcuuggaauguaugggagguggaggacuacggcuuuggaguauucacuacaaacauauggcuuaaacuuagggaaauguacacacaauuaugugaucacagguuaaugagcgcugcagucaaagaugaacgagcuguccacgcagauaugggcuacuggaucgaaagucagaaaaauggaagcuggaaauuagaaaaagcuagucuaauagagguuaaaacuugcacauggcccaaaagccacaccuuauggaguaauggaguucuugaaucagauaugauuauacccaaaucauuggcugguccgguaagccaacacaacuacagaccgggguaucauacccagacagccggcccauggcauuuaggaaaauuagaacucgacuuuaacuauugugaaggcacgaccgugguaaucacugaaaauuguggaacgcgugguccaucgcuacgaacaacaacuguaucaggaaaacuaauccaugagugguguugucggaguugcacauuaccaccucuuagauauaugggagaagauggcugcugguauggcauggaaauacguccuauaaacgaaaaagaagagaauauggugaaguccuuaguuucagcugguucaggaaagguagauaacuuuacgaugggcguauuaugcuuggccauacuauuugaagaaguaaugagggguaaauuugguaagaaacacaugauagcaggcguauuguuuacguuuguauugcuguuaucuggucagauaacauggagagacauggcgcguacucugaucaugaucgguagcaaugcauccgauaggaugggcaugggcguaacauauuuggcuuuaauagcuacauucaaaauucaaccauuccuggcacuagguuucuuuuuaagaaaacuaaccucaagggaaaacuuauuauuaggcguuggacuagcgauggcgacgacucuucaauuaccagaggauauagaacaaauggcuaauggcauagcucucggccuaauggcauuaaaacuaaucacacaauucgaaacuuaucaauuauggacagcuuuagucagcuugauguguagcaacacgauguucacacucaccgucgcauggagaaccgcaacuuugauuuuagcagggauauccuuauugcccgucugccagucaucaaguaugagaaaaacagacuggcuaccaguuacgguugcagccaugggaguucccccucugccucuguuuauauuuagucuaaaagauacacucaagagaagaucguggccccucaaugagggaguaauggccgugggacugguaucaauucucgccaguucuuuauuaagaaacgacguaccuauggcuggcccgcucgucgcugguggccuucuaaucgcuuguuaugugauuacgggcaccagugccgaccuaacaguagaaaaagccgcagauguaauuugggaggaagaggcagaacagaccggagugagccacaacuuaaugauuacgguugacgacgacggcacaaugagaaucaaagaugaugaaacugaaaacaucuuaacaguauuacuaaaaacggcauugcuaauaguuucgggcauuuuucccuacucgauuccggcaacucuauugguguggcauacguggcaaaaacaaacgcaacgcucagguguucuaugggauguuccuagucccccggaaacacaaaaagcggagcuagaagaagguguauaucguauuaaacaacaaggcauauuuggcaaaacacaggucgguguuggaguucaaaaagaaggcgucuuccacaccauguggcauguaacccgaggagcaguauuaacacacaacggcaaaagauuagaaccaaauugggcuucuguuaagaaagaucuuaucucguacggcggagguuggcgccuuucagcucaauggcaaaaaggcgaagaaguucaaguaaucgcuguugaacccggcaaaaauccuaagaacuuucaaacaaugccagguauauuccaaacuaccaccggugaaauaggagcgaucgcucuagauuuuaaaccaggaacaucagggagucccaucaucaauagggaaggcaagguagucggucucuauggaaacggugugguaacuaaaaacgguggauacgugaguggaauugcucaaacgaacgcagaaccagaugguccuacacccgagcucgaagaagaaauguucaaaaagaggaacuuaacuauaauggaucuacacccggggagcggaaagacuagaaaguaucuuccagcuauagucagagaagccauuaaaaggagguuacgcacgcucauacuagccccuacuagaguuguggcagcagagauggaagaagccuuaaagggacugccgauacgauaccagacaacugcaacuaaaucagcccacacaggaaaagaaauaguagaccuuaugugccacgcaacauuuacaaugagacuacuaucgccugugcguguaccuaauuacaauuuaauuauaauggacgaagcgcacuucacagauccagcgucgauagcggcgagaggauauauaaguacacgaguggggaugggagaagcagcagcaauuuucaugacggcgacaccuccaggcaccgcugaugcauucccucaaucaaaugcccccauacaagacgaagaacgggauauaccugagagauccuggaacucaggaaaugaguggaucacugauuucgccggaaaaacgguuugguucguaccaagcauuaaagcagggaaugauauugcgaacugccuccgcaaaaauggcaagaaaguaauucaacucucaagaaagacuuuugauacugaguaccagaaaaccaagcucaacgacugggacuuuguaguaaccaccgacauaagugaaaugggagcaaauuuuaaaacagaccggguaauagacccaagacgcugcuuaaaaccaguuauacuuacugacggaccagaaagaguaauccuugcuggaccaaugccaguaaccgucgcgucugcagcacaacgaagagggcgaguggguagaaacccacagaaagagaaugaccaguauauauuuaccggacaaccauuaaacaacgacgaagaccaugcacauuggacagaagcuaaaauguuacuagauaauaucaacacuccugaaggaaucaucccagcgcuguucgagccagaaagagagaagagugccgccaucgacggagaguaucgccuaaagggagaaucacggaaaaccuuuguggaguuaaugaggagaggagaccucccagucuggcuugcacauaaaguugcaucggagggaauaaaguacaccgauagaaagugguguuuugauggagagaggaacaaucaaauauuagaagaaaacauggacguagagauauggacgaaagaaggagagaagaagaaacuacggccacgcuggcuugaugccagaacguauagcgauccguuagcacugaaggaguuuaaagauuucgccgcagguagaaagagcauagcgcuugacuuggugacagaaaucggucggguuccaagucaucuggcacacagaacuagaaaugcauuggauaauuuaguaauguuacauacuagcgaacauggagguagagccuauagacaugcgguggaagaauuaccagaaacaauggaaacacugcuauuacucgguuuaaugauuuuauuaaccggaggugcuauguuauuccuaauaucaggcaaaggaaucgguaaaacuuccauugguuuaaucugcguugucgcuucaagugggauguuauggauggcagauguaccccuacaauggauagcaucggcaauaguccuagaguucuuuaugaugguauuacuaauuccugaaccugaaaaacaaagaacaccccaggacaaucaguuagcauacguaguaauagguauauuaacccuagcagcaauagucgcagcaaacgaaaugggacuacucgaaaccacaaaaagagacuuggggaugagcaaagaacccgguguuguuucgccuacuucuuacuuggacguggauuuacauccagcgucagcuuggacuuuauacgcagucgccacuacuguaauaacgccgaugcugaggcacacuauugagaacuccacugcaaacgucucccuagcggcaaucgcaaaccaagcaguuguacuuaugggccuugauaagggauggcccauuucgaagauggaucuagggguaccauuacuagcacuaggauguuauucccaagugaauccacucaccuuaacagcagcggucuuacuauuaguuacucauuaugcaauuauuggaccuggauuacaagccaaagccacaagagaagcucagaaaagaacagcagcagguauaaugaagaauccuacgguagacggaaucaugacaauugaucuagacccgguaaucuaugauagcaaguuugaaaaacaacuugggcaaguaaugcuccuaguucuaugcgcuguccaauugcuucuaaugagaacgaguugggcauuuugugaggccuuaacucuugcaaccggaccuauaacgacguuaugggaaggaucaccggguaaauucuggaacacgacaauagcaguuagcauggcaaacauauucagaggaucguaccuggccggcgcuggccucgcuuuuucgauaaugaaaagcguaggcacggguaaacgaggaacgggaucccaaggugaaacuuuaggagaaaaauggaagaagaaacuaaaucaauuaagcagaaaagaauuugaucuuuauaagaaaagcgguauaacagaaguagaccguacagaagcgaaagaaggauugaaaagaggugagaucacgcaucacgccgugucacggggcagugcaaaacuacaaugguuuguagagagaaacaugguaauaccagaaggcagaguaauugaccuuggguguggacgaggugguuggaguuauuauugcgcgggauugaagaaagugacggaagugcgaggguacacgaaaggugguccgggccacgaagaaccugugccaaugucaaccuauggauggaacauagucaaauugaugagugguaaagauguauucuaccugccaccugaaaaaugcgacacacuacuaugcgauauaggcgaaucgucgccuucuccaaccguagaagaaagcagaacaaucagggucuugaaaaugguagaacccugguuaaagaauaaucaauuuuguaucaaaguacugaacccauauaugccaacgguuauugaacacuuagaacgucuacaacgaaagcacggcggaaugcuaguaagaaacccauugagccgaaacucaacucacgagauguauuggauuaguaacggaaccgguaauaucguaucaucaguaaauaugguaucuagacuauuguuaaacagauucacuaugacacauagacggcccacgauagagaaggauguggaucuaggugcggguacuagacauguaaaugcagaacccgaaacgccuaauauggacguuauaggagaacguauuaggagaaucaaagaggaacauucaucgacauggcacuaugaugaagaaaauccguacaaaacuugggcguaccaugguaguuaugaaguaaaagcgacagguucagcuucuucaaugauaaauggaguuguuaaacuccuuacaaaaccgugggacguaguuccgacgguaacacaaauggccaugacugacacaacuccuuucggccaacaacgaguuuucaaagaaaaaguugauacacgcacuccaaggccaaugccaggaacaaggaaagcaauggagauaacagcagaaugguuauggcguacucuaggccgaaauaaacgcccaagauuguguacuagagaggaguucacaaagaaagugagaacuaacgccgcgaugggcgccguguuuacggaggaaaaucagugggauucggcuagagcugccguagaggacgaggaguuuuggaagcuaguugaucgugagagagagcuacacaaauuaggcaaauguggaucaugcguauauaauaugauggggaaaagagaaaagaaguuaggcgaauuugguaaagcaaaaggaucucgagcgauaugguauauguggcuuggagcacgauauuuagaauuugaggcacucggauuuuuaaaugaagaucacugguuuaguagagaaaacucuuuuucaggcguagaaggugaaggcuugcauaaacuaggauauauuuuaagagauaucuccaaaauaccagggggagcuauguaugcugaugauacagcagggugggauacacgaauaacagaagaugauuuacacaaugaggagaaaauaacucaacaaauggacccggaacacagacaauuggccaaugcuauauucaaauuaacauaccaaaacaaaguaguaaaaguacaacguccgacaccaaaaggaacaguuauggacaucauaucgcggaaggaccaaagggguucaggacaggucggaacauaugggcuaaauaccuuuaccaacauggaagugcagcugauuaggcaaauggagggagaagguguauuaucuaaagcugacuuagaaaacccacaucuauuagaaaaagaaaucacucaaugguuggaaacgaagggggucgaaagguugaaaaggauggcaauaucaggggacgauugcguaguaaagccaauagacgaccgauuugcugacgcgcugcucgcauugaacgauaugggaaaaguacgaaaagauauaccacaguggcaaccuucuaaaggauggcaugacuggcaacaaguaccguuuugcagucaucauuuucaugaacuuauaaugaaagauggcagaaaauuagucguaccuugucgcccucaggaugaauugauaggcagagcacguauaucacaaggagccggguggucucuaaaagaaacugccugcuugggaaaagcauaugcacagaugugggcuuuaauguauuuucaucgacgcgaucugagguuggcaagcaaugcaaucuguagugcaguaccuguacacuggguuccaaccagucguacaacguggucgauucacgcacaccaccaauggaugacgacugaagacauguugacaguauggaaucgaguuuggauagaggauaaccccuggauggaggauaaaacgccuguaacuacuugggaagaugucccuuaucucggaaaaagagaagaucaaugguguggcucacuaaucggauuggccucacgggccaccugggcgcaaaacauccugacagccauccaacaaguacgcaguuuaauuggaaacgaggaguuccuagacuauaugccaaguaugaaacgauucaggaaagaagaagaaucagaaggugcaaucugguaa

SEQ ID NO: 23518 - RNA, 9873 nt, Artificial Sequence
  derived and/or modified CDS sequence (opt6) from DENV-3__KC762684__SS-prME
accagccuuugccuaaugaugauguuaccagcaacacuagcauuucauuugacgucucgggauggagaaccucgcaugauaguagggaaaaacgaaagaggaaaaagucuauuauuuaaaaccgcuaguggaaucaauauguguacuuugauagcuauggaucuuggagaaaugugcgacgacacuguaacauauaaauguccacuaauaacagaaguagaaccugaagacauugauugcugguguaaucuuacaucaaccugggugacuuaugggacguguaaccaagcuggagaacauaggagggacaaaagauccguugcauuagcgccucauguagguaugggccuugacaccagggcucaaacguggaugucagcggaaggagcauggagacaagucgaaaaaguugaaacaugggcauuuagacauccuggauuuacaauccuugccuuauuucuggcccauuauauugggacaagucugacccaaaaaguaguuauauucauauuguuaaugcuaguaaccccuucgaugacuaugagguguguuggcguaggcaauagagauuucguugaaggacucucaggagcgacauggguagaugugguuuuagaacauggagguugcguaaccacaauggcgaaaaacaaaccgacacuagauauagaacuacagaaaacugaagcaacucaacucgcaacacugaggaaacuaugcaucgaagguaaaauaacaaacguaacgacugauuccaggugucccacccaaggagaagcaauauuacccgaagaacaagaccaaaacuacgucugcaaacacacguacguagauagaggauggggaaauggaugcggguuauuugguaaaggaucuuuaguaacgugugcaaaauuccaaugucuggaacuaauagaaggaaaaguaguacaacacgagaaucugaaauauacgguuucuauuacaguccacacuggugaucaacaccaaguuggcaaugaaacacagggggucacagcagagauaacaccucaggcuucaacagucgaagcuauacuacccgaguauggaacauuaggucuagagugcucaccacggacuggauuagauuucaacgaaaugauucuacuaacaaugaaaaacaaagcguggaugguccacaggcaaugguucuuugaucuaccccuaccauggacaucgggugcuacaacagaaacucccacuuggaauaagaaagaauuauuagucacuuuuaaaaacgcccaugccaagaaacaagaagucgucguacucggcagucaggagggugccaugcauacugcauugacuggugcuacggaaauacaaaccagcggagggacauccauauucgcaggacacuugaagugucgauuaaagauggauaagcuagaacucaaagggaugaguuaugcuaugugcaguaacgcauucguacuuaaaaaggaaguaucagaaacacaacauggaacuauuuuaauaaagguugaauacaaaggugaggacgcacccugcaagauaccuuuuucaaccgaagacggucaagguaaagcacacaauggaagauuaaucaccgcgaauccuguugugacuaagaaagaagaaccaguaaacaucgaagcggaaccuccauuuggcgaguccaauauaauuauaggaaucggagauaaagcacugaaaaucaacugguauaagaaaggcagcaguaucggaaagauguuugaagcaacggcccguggagcccgucgaauggcgauacuaggugacacagcaugggauuuuggcaguguaggaggaguucugaauaguuuaggaaaaaugguucaucagauauuuggcagugccuauacugcucuauuuaguggagugucguggaucaugaaaaucgguauugguguccuucucacuuggauaggccuuaauucaaagaacacuucaaugucauucucauguauuguaaucggaauaaucacccuauaccuuggggcggugguucaagccgauaugggauguguuauuaauuggaaagggaaagaacuuaaaugcggcagugguauuuucgugacgaacgaaguucacacauggaccgaacaauauaaauuccaagcugauucaccaaaacgacuagccacggcuauugcuggagcaugggaaaacggaguaugugguauuaggucaacgaccagaauggagaaccuguuauggaagcagauagccaaugagcuaaauuacauauuaugggaaaauaauauaaaauugacaguaguuguuggcgauauuauaggaauacuggagcaaggcaaacgcacauuaacuccgcagccaauggaguugaaguauucauggaaaacauggggaaaggcaaagauagucacggcugagaugcagaauaguaguuucauaauagacggcccgaauaccccggaauguccuaaugcgucuagagcguggaauguuugggagguagaagacuacgguuuuggaguauucacaacaaacauauggcuaaaauuacgggaaauguauacucagcuaugcgaucauagauuaauguccgccgcaauuaaagacgaaagagccguacaugcagauauggguuacuggaucgaaucgcagaaaaacggcaguuggaagcuagaaaaggcuucgcuaaucgaagucaagacauguacauggccaaaaucucacacguuguggucaaauggcguacuagaaagugauaugauuauaccuaaguccuuggccggaccaauuagucaacacaacuaucgaccuggauaccauacgcaaaccgcaggaccauggcauuuaggcaaauuggaauuagauuuuaauuacugugaaggcacaaccguaguuaucaccgaaaacugcggaacccgagguccuaguuugcgcaccacaacgguuucaggaaaacuuauucaugaauggugcugcagaucguguacccuaccuccucuaagauauaugggagaagauggauguugguaugguauggaaauaagacccauaaaugaacgagaggaaaauauggucaagucauuaguaagugcuggcucaggaaaaguagauaauuucacgaugggcguuuuauguuuagccauuuuauucgaagaaguaaugagggguaaauucggcaagaaacauaugauagcuggcguauucuuuacuuuuguacuacuauugucagggcaaauaacguggcgugauauggcaagaacucuuauaaugaucgguucaaacgcuucagaccggauggggaugggagucacguaucucgcacuuauagcaacuuuuaaaauucagccuuuucuagcacucggcuuuuuccuacgaaaacugaccucgcgagaaaaccugcuucuaggcguaggacuagcuauggcaaccacucuacaacucccagaggauaucgaacaaauggcgaaugguauagcacugggauugauggccuugaaguuagucacucaauucgagacauaucaauuauggacagcguuaguuucuuugaugugcucuaauaccauuuucacucuuacagucgcauggcgaacggccacucugaucuuagccggaauuucguuauuaccguuaugccagucuaguggaaugagaaagacagacugguuaccgaugacgguugccgcuaugggcgucccgccauuaccucuauuuaucuuuagucuaaaggauacacucaagaggaggagcuggccacuaaaugaaggaguuauggcuguggggcuuguauccauuuuagccucaaguuuauugcgaaacgauguaccuauggcuggaccacugguagcugguggauuacucauugcauguuacguaauuacgggaacgagcgcugaucuaacagucgaaaaagcggcugacgucacgugggaagaagaggcagagcagacugguguaagccauaaucugaugauaacuguagaugaugacgguacuaugcggauaaaagaugaugaaacugaaaauauucuaacgguucuccugaaaacggcuuugcuaauaguuucuggcauauucccuuacucaauaccagcaacguuacuuguauggcacacuuggcaaaaacaaacgcagcgguccggcguacugugggacguuccaucgccuccugaaacacagaaagcggaacuggaagaaggugucuauaggauaaagcaacaagggauauucggaaagacucaaguaggaguuggaguccaaaaagaaggcguuuuucauacaauguggcaugucacuagaggugcaguacuaacauauaacgggaaaagacuagaaccuaauugggcauccgucaagaaagauuuaaucucguacggaggcggauggcgacuaagcgcacaauggcagaaaggggaagaaguacaaguuaucgcaguugaaccgggcaaaaauccuaagaauuuccaaacgaugcccgguaucuuccaaacgacaacaggcgaaaucggcgcaauagccuuggauuuuaaacccgggaccucugguaguccgaucaucaauagagaagggaaggugguuggacuauaugggaauggagucguaacuaagaacggggguuauguaucaggaauagcucagacaucugcagaaccagauggaccuacgccagaauuagaagaagaaauguuuaagaaacgaaauuuaacuauuauggacuugcauccaggaagcggaaaaacaaggaaauaucuaccagccauagugagagaagcgauaaaaagaagauuacgaacauugauccuagcgccaacccguguagucgcugcugaaauggaagaagcguugaaagggcugcccauaagauaucaaacaacagccacuaaaucggaacacacuggcaaagagauuguagaccuaaugugucaugcuacauuuacaaugagguuacuaagcccaguacguguaccaaacuacaaccuuauuaucauggacgaagcacauuucacagaccccgcaaguauagcugcgagaggauauauaaguacaagaguagguaugggcgaagccgcggcaauuuucaugacugcuacuccuccuggaacggcagaugcuuuuccgcagucaaacgccccaauacaggacgaagaacgagauauaccagaacggucuuggaauaguggaaacgacuggauuacagacuuugcuggaaagaccguaugguuugucccgaguaucaaggcggguaaugauauugcaaauugucuacgcaaaaauggaaagaaagucauucaauuaucacgaaaaacauucgacacagaauaucagaaaacaaaacugaacgacugggauuucguaguaaccacagauaucagugagaugggagcuaauuuuaaagcggaucguguuauagacccacguagauguuuaaaacccgugauucuaacggacggaccggaaagaguaauacuagcagggccaaugccaguaacgguagcaagugccgcucaaagaagaggcagaguaggcagaaauccacaaaaagaaaacgaucaguauauauucacaggacaaccacucaauaacgacgaagaccacgcucauuggacugaagcaaagaugcuccucgauaauauuaacacaccugaggguaucauuccugcauuauucgaaccugagagagagaaaagcgcagcuauagauggugaguauagacuaaaaggugagagucguaaaacuuuuguagaguuaaugagacggggugacuuaccgguuuggcuugcacauaaaguagcaucagaagguauuaaauacacagaucggaagugguguuuugauggcgagagaaacaaccaaauccucgaagaaaacauggacgucgaaaucuggacaaaagaaggugagaaaaagaaguuacgaccaagauggcuugacgcccguacuuauucagauccauuagcguugaaggaauuuaaggauuucgccgcgggaaggaagucaauagcucucgaucuaguuacagaaauugggagaguaccuagccauuuagcacauagaacuagaaacgcucuagauaauuuaguaaugcuucauacgagugagcacggagggagggcauaccgucaugcaguagaagaacuaccagagacaauggaaacacucuuacuucugggauugaugauucuucuuacaggaggaguuauguuauuuuuaauuuccgguaaagggguugguaaaaccucuauagguuugauaugcguuguagcaucgagcaguauguuauggauggcagauauucccuugcaauggauagcaucagcuauaguauuagaauuuuucaugaugguauuacuaauuccagagccggaaaagcaaaggacgccacaagauaaccaacuagcuuauguaguuaucggaaucuuaacucuagcagcaauugucgcugcuaacgaaaugggcuuguuagaaacuacaaaaagggacuuaggaaugucaaaagagccaggugucgucaguccaacaagcuaccuggacguggaucuacacccagcauccgcauggacucuuuaugcaguggcaacgacuguuaucaccccaaugcuaagacauacaauagaaaacaguacagcuaauguaaguuuagcagcgauugcuaaucaagccguuguguuaaugggucuugauaaaggauggccaauuucgaaaauggaccuagguguaccccuauuggccuuaggcugcuacagccaaguaaacccgcucacacuaacugcagcaguauugcuucucgucacucauuacgcaauuauaggucccggauuacaagcuaaggcuacaagagaggcacaaaagcgaacugcagccggaauuaugaaaaacccuacuguagacgggauaaugacaauagacuuagauccaguuauuuaugauaguaaauuugaaaaacagcugggucaagugaugcuacucguuuuaugugcaguucaacuacuacuaaugagaaccaguugggcauucugcgaggcucuaacacuugcaacaggcccgauuacaacguuaugggaagggucuccagguaaguucuggaauacaacaauagcugugucuauggcuaacauuuucagagguucauaucuagcaggcgcaggacuugcguuuuccauaaugaaaagcguagggacgggaaaaagaggaacuggaagccaaggagaaacuuuaggagaaaaguggaagaagaaacuaaaccaacuaucuagaaaggaauuugaucuguauaagaagucuggaauuacugaaguugacagaacagaggcuaaagagggacuaaaacgaggcgaaauuacgcaucaugcagucagccgaggauccgcaaagcuacaaugguucguggagaggaauauggucaucccagaaggacgcguaauagauuugggaugcggaaggggaggcugguccuauuauugcgcagggcugaagaaaguuacagaagucagagguuauaccaaggguggucccggacacgaggaacccguacccaugaguacuuacggauggaauauagugaagcucaugucugguaaagauguuuucuacuugccaccagaaaaaugcgacacacuauuaugugauauaggugaauccaguccuucucccacaguugaggaaagucgaacuauaaggguucuaaaaaugguagagccguggcuuaagaauaaccaauuuugcauaaagguauuaaacccuuauaugccagcggucauugaacaucuagagcggcuacagcgcaaacauggaggcaugcuaguaagaaacccacuguccagaaacucaacacaugagauguauuggauaucaaacgggacaggaaauauagugucuucagugaauaugguuagcagauuacugcugaacagauuuacuaugacauacaggcgcccuacuauagaaaaagacguugaucuaggggcuggcacacgacauguaaaugcugaaccagaaacuccaaacauggaugugauaggagagagaauaagaagaauaaaagaagaacacuccucuacauggcacuaugacgaugaaaauccauauaagacaugggcuuaccauggguccuaugagguaaaagcaacaggaucagcuucgagcaugauaaauggcguaguuaaacuacuaacaaaaccaugggacgugguuccuacaguuacacaaauggcuaugacugacacuacccccuuuggacaacaacgugucuucaaagagaaaguggauacaaggacgccaaaaccaaugccagggacacgaaaagucauggaaauaacagcagaaugguuauggagaaccuuaggacggaauaagagaccucgguugugcacucgugaagaguucaccaagaaagugagaacaaacgccgcaaugggagcaguauucacggaagaaaaccaaugggauagcgcacgcgcggcaguagaagacgaagaauuuuggaaauuaguggaucgagaacgagaauuacauaaacuaggaaaaugugguagcugcguauauaauaugauggguaagagagagaagaaacucggugaguucggaaaagcaaaaggcagucgagcgauuugguauauguggcuaggagcgagguauuuagaauuugaggcuuuaggauuccuaaacgaagaccauugguuuagcagagaaaacucuuacagugguguggaaggggaagguuugcacaaacugggauauauucuucgagacauauccaaaauaccaggcggagcaauguacgcugaugauacagcgggaugggauaccagaauuaccgaagaugaccuccauaaugaggagaaaauuacucagcaaauggauccagaacaucgacaacuugccaaugcaauauuuaaauugacuuaucagaauaaaguagugaaaguacagcgaccaaccccaaaaggaaccguaauggauauuaucucacggaaagaccaaaggggaucgggacaaguugggacauauggcuuaaauacguuuacgaauauggaggcacaauugauaaggcaaauggagggagaaggaguuuugucuaagacagauuuggaaaauccgcauuuacuagagaagaaaauaacacaaugguuagagaccaaaggaguggaacgcuuaaaaagaauggccaucucaggagacgauugcguaguaaaacccauagacgaccgcuucgcaaaugcguuauuggcguugaaugacaugggcaaagugcgcaaagauauaccucaguggcaacccucaaaaggguggcacgauuggcagcaaguaccuuuuuguucacaucacuuucaugaauugauaaugaaagacggacgcaaacugguggugccgugccgaccacaagacgaacuuaucggucgcgcuaggauuagccaaggugcagguuggucauuaaaagaaaccgcaugccucggaaaggcuuacgcgcaaaugugggcuuuaauguauuuucaucgacgggaucugcguuuggcaaguaaugcuaucugcucagcugugccaguacauuggguaccaacaagcagaaccacauggucgauacacgcacaucaccaauggaugacuacagaggauaugcuuacuguauggaaccggguuuggauugaagacaacccauggauggaggacaaaacaccagucacgaccugggaggacguaccuuaucuaggcaaaagagaagaucaaugguguggaucucuuauaggacuaaccucuagagcuaccugggcccaaaacauacuaaccgcaauacagcaaguacgaagccuaauaggcaaugaggaguuccuagauuauaugccaucgaugaagagauuuaggaaagaggaggagucugagggugcuauaugguaa

SEQ ID NO: 23519 - RNA, 9873 nt, Artificial Sequence
  derived and/or modified CDS sequence (opt6) from DENV-3__KC762686__SS-prME
acaagucuaugccuaaugaugaugcuuccagcaacguuggcauuccaucugaccucacgagauggugaaccaagaaugaucguugguaaaaaugaaagaggaaagagcuugcuuuucaaaacagcaucugguauuaauauguguacacugauagccauggauuuaggugaaaugugugacgauaccguuacauacaaaugcccucuaauuaccgaaguagaaccugaagacauagacuguugguguaaucuaaccagcaccuggguaacuuauggcacuugcaaccaagcaggagaacacaggcgcgauaaaagauccguagcucuggcuccucacguugguaugggauuggacacucgagcacaaacguggauguccgcagaaggagcauggcgacaagucgaaaaaguagaaacaugggcauuucgucacccaggguuuacgauauuagcuuuauuccuugcacacuauauagguacaaguuugacccaaaaaguagucauauucauucugcugaugcuagucaccccuuccaugacgaugagauguguagguguaggcaaucgcgauuuugucgaagguuugucaggcgcgacuuggguugauguaguauuggaacaugguggauguguaacaacaauggcuaaaaacaaaccuacccucgacaucgaacuacagaaaacagaagcaacacaguuagccacucuacgcaaacucugcauugaagggaaaauaacgaaugucacuacagauucacgauguccuacacaaggagaagcuauacugccagaagaacaagaccaaaacuauguaugcaaacacacauaugucgauagaggauggggaaaugggugcgguuuauucggaaaggguagucucguaaccugcgcuaaauuccaaugucucgaauuuaucgaagguaaaguaguacaacacgaaaacuugaaauauacagugauuauaacaguacauacgggagaucaacaccaaguagguaaugaaacacaaggaguaacagcagaaauaaccccucaagcuagcacuguugaagccauacuaccagaauacgggacacuuggauuagaaugcaguccacgcacuggucuugauuucaacgagaugauacuguugacuaugaaaaauaaagccuggaugguacauaggcaaugguucuucgaucugccauuaccauggaccaguggugccacaaccgagacaccuacuuggaauaaaaaggaauuacucguaacuuucaaaaaugcgcaugcgaaaaagcaagagguaguaguucucgguucacaagaaggugcaaugcauaccgcacucacaggggcaacugaaauucaaacaucugguggaaccucgauuuucgcgggucaucuuaaauguagauuaaaaauggauaaauuggaacugaaaggcaugucuuacgccaugugucugaacgcuuuuguucuaaagaaagaagugagugagacucagcauggaacaauucuuaucaaaguggaauauaaaggagaagaugcgccauguaagaucccauuuagcacagaagacggucaaggaaaagcacauaauggacgucuaaucacagccaaccccguuguuaccaagaaagaggaaccaauuaacauagaagcugaaccaccauucggggaaucgaauauaguaauugggaucggcgauaaagcguuaaaaauaaauugguacaagaaagguucaucaauagguaaaauguuugaggcaacggcaaggggagcucggcgcauggcaauauuaggcgacacugcaugggacuucggaaguguuggaggcgugcuuaauucuuuaggaaagaugguacaccaaaucuuuggguccgcguauacagcauuauuuucuggugugucuuggaucaugaagaucggaauugggguacuguuaacauggaucgggcucaauaguaaaaauacaucuaugagcuucucaugcauaguaauagguaucauaacucuuuaccuaggggcaguuguucaagcugauauggggugcguaaucaauuggaaaggaaaagagcuaaaauguggcagcggaauuuuuguuacuaaugaaguucauacuuggaccgagcaauacaaguuucaggcagacucaccuaaaagauuagcaacuacgauagcaggcgccugggaaaauggcguuugugguauacguagcacaacacguauggaaaaccuucuauggaaacaaauugcaaacgaauuaaacuauauacuaugggaaaacaacauaaaacuaaccguuguaguaggggauauaauaggugugcuugaacaaggaaaaaggacguuaacgccacaaccuauggaacuuaaauauagcuggaaaacaugggggaaagccaaaauuguuacagcagaaacacagaacuccucauuuauaauagaugggccuaacacgccggaguguccauccgcuucucgggcauggaauguaugggagguagaggauuacggauuugguguauuuacuacuaacauuuggcucaagcuaagggaaauguauacgcagcuaugugaucauaggcucaugagcgcagcaguaaaagaugaaagggcuguucaugcagauaugggguacuggauagaaucacagaaaaauggaucguggaaguuagagaaagcgucuuugauagaagucaaaacauguacguggcccaaaagucauacccuuuggaguaauggagucuuagaaagugacaugauaauaccaaaaucacucgcaggaccaguuagucaacacaaucauagaccaggguaucacacucaaaccgcuggacccuggcauuuagguaaacuagagcuugauuuuaauuauugcgaaggaaccacugucguaaucacugagaauugugguacuagagggccaucacuaagaacaacaacagucagugggaaauuaauucaugaauggugcuguagauccuguacgcuuccacccuuacguuauaugggagaagauggguguugguauggaauggaaauaaggccaaucaaugaaaaggaggaaaacaugguaaaaucgcuuguuagugcagguagcggaaagguugauaauuucaccauggguguauugugccuagcgauucucuucgaagaaguaaugagagguaaguuuggcaagaaacauaugaucgccgguguacucuucacuuuuguauuauuacuaucuggccagaucacguggagagauauggcacguacgcugauaaugauaggaucuaacgcaucagauagaaugggaaugggaguaacauaucuagcccuuaucgcuaccuuuaaaauucaaccguuucuagcucuuggauucuuccuaagaaaauuaaccuccagggaaaaccuuuuauugggaguagguuuggcaauggccaccacauuacaacuaccagaggauauagaacaaauggcaaauggcauagcuuuaggucugauggcauuaaaacuaaucacacaauuugagacauaccaauuauggacagccuuaguaaguuuaauguguuccaacacaauauucacucucacgguugcguggcggacagcuacgcugauacuagcaggaauuagcuuauuaccaguuugccagaguucaucaaugcguaaaacagauugguuacccguaaccguggcagcuaugggaguuccgccccuaccccucuuuaucuuuuccuuaaaagacacucuuaaaagacgauccuggccucuuaaugaaggugugauggcaguaggauuagugaguauacuagcgucaucacuacuacgaaacgauguuccaauggcaggcccguuaguagcugguggauuauuaauagcaugcuacguuauuacaggaacuucagcagauuugacaguagaaaaagcagcagauguaauaugggaagaagaagcugaacaaacggggguuagucauaauuuaaugauuacuguagacgacgauggaacaaugagaauuaaagaugacgaaacagagaacauauuaacaguucuucugaaaacggcgcucuuaaucgugucuggaauauuucccuauucgaucccugcuacuuugcuaguauggcacacuuggcaaaaacagacucagagaucuggaguucugugggauguccccucaccaccagaaacacaaaaggcagaacucgaagaaggcguuuacagaaucaaacaacaggguauauuugguaaaacacaagugggaguugggguccagaaagaagguguguuucauacaauguggcaugucacucgcggugcaguacucacucauaauggcaagagacuugaacccaauugggcuagcguuaagaaagaccuaauuucguauggagggggauggagacuaucggcgcaauggcaaaaaggagaagagguucagguuauagccguugaaccgggcaaaaauccuaaaaacuuucagaccaugcccgguauauuucaaacuacaacuggggaaauaggggcuauugcauuagacuuuaagccaggaacaucugguucacccauaauuaauagagagggaaaaguagucggcuuauacgguaaugggguaguuacgaagaaugggggauaugucagcgguaucgcucaaaccaaugcugaaccagacgguccuacaccagaauuagaagaagaaauguuuaaaaagcggaauuugacgauuauggaucuacacccaggaagcggcaaaacacggaaauaccuaccggcaaucguacgugaagccauaaaacggcgguuaaggacucucauauuggcucccaccagagucguugcagcggaaauggaagaagcacuuaagggacuaccuauaagauaucagacaacagcuacuaaaucggcacauacaggaaaggaaauaguugacuugaugugucaugcaacauuuaccaugagacucuuaucaccgguacgaguuccgaauuacaaucuuauaauuauggaugaggcacacuucacagacccugcuucuaucgcagccagagguuacaucucaacuaggguagggaugggggaagcagcagcgauauuuaugacugcaaccccaccaggaaccgcagaugcuuuuccacaaaguaaugcaccaauccaagaugaagaaagagacauaccggaaagaucguggaacagcgguaaugaauggauaacugauuuugcaggaaaaacaguuugguucguuccuaguauaaaagccggaaacgacaucgcgaacugucuuaggaaaaacgggaagaaaguuauccaauuaucucgcaaaacuuucgacacugaauaucagaaaaccaaacuuaacgauugggacuucgugguuacaacagacauuagcgaaaugggagcaaauuuuaaagcagacagggucaucgaucccaggagauguuugaaacccguaaucuuaacggaugguccagaacgcguaauauuagcagguccuaugccgguuaccgucgcuucugcagcccaacgaagaggaaggguagggcgaaacccgcaaaaagaaaacgaccaauauauauucaccgggcaaccucuaaacaacgacgaagaccaugcacauuggacugaagcaaaaaugcuucucgauaauaucaacacaccagaaggaauuauaccugcucuauuugagccggagcgagagaaaagugcagcaauagacggagaguacagguuaaagggagaaucccguaagacauucgucgaacuaaugagaagaggagacuuaccuguauggcuugcucauaaaguggcaucggaaggaauuaaauauacagaccggaagugguguuucgauggcgaaagaaacaaccaaauuuuggaagaaaauauggauguugaaauuuggacgaaagaaggugagaaaaagaagcuaaggccacgaugguuagacgcgcguaccuauucggacccauuagcauuaaaagaauuuaaagacuuugcugccgggagaaaaagcauugccuuagauuuaguuacggaaaucggucgcgucccuagucaucuugcgcacaggacaagaaacgcccuugacaaucuuguuauguugcauaccuccgaacacggcgggagggccuacagacaugcaguagaagaauuaccggaaacuauggaaacacuauugcuacucggauuaaugaucuuauugacagggggagcuauguuauucuuaauaucggggaaaggaauagguaaaaccucgaucgggcuaauaugcguaguggcaucaaguggcaugcucuggauggcugacguuccacugcaauggauagcaagugccaucgugcuggaguucuucaugaugguuuuauuaauaccagaaccugaaaaacaacggacaccccaagauaaucaguuagcauacgucgugauagguauacuaacuuuagcugccauuguagccgcaaacgaaauggggcucuuggaaacuacgaaaagagaucuagguaugagcaaagagccgggaguuguaaguccgaccagcuaucuagacguagacuuacaucccgccagugcauggacauuauaugcgguagcaaccacaguaaucacgcccaugcuaagacacaccauagagaacucaacugccaacguaucacuagcagcgauugcuaaucaagcuguuguacugaugggacucgauaaaggauggccgauaucaaaaauggaucugggaguaccccuacuugcguuagguugcuauagucaaguaaauccucucacacuaacugcagcgguguuauuauuagugacacauuaugcaauuaucgguccugguuuacaagcuaaagccacaagagaagcccagaaacgcaccgcugcagguaucaugaagaacccaaccguugacggaauuaugacuaucgaucuugacccugucauauacgacucaaaauucgaaaagcagcuaggccagguuauguuauuaguacuuugugcgguucaacuacuauuaaugagaacguccugggcguucugugaggcuuuaacauuggcaaccggaccaauaacgacccuuugggaggggucaccaggaaaauucuggaacacaacuauagcaguaucuauggcuaacauauuuaggggaucauaucuggccggggcuggucuagcauuuucgauuaugaaaucgguagguaccgguaaacggggcacggguagucaaggugaaacacuaggcgagaaauggaaaaagaaguugaaccaauuaucccggaaggaguucgaccuauauaaaaagucgggaauaacugagguugauagaacagaggcaaaggagggucuaaaaagaggcgaaaucacucaucaugccguuucaagaggcucugcuaaacuucagugguuugucgaacguaacauggucauaccagagggacggguaauagaccuuggcugcgggagaggaggguggaguuacuauugugcaggccucaagaaagugacagaagucaggggauacacaaaagguggaccagggcaugaagaacccguucccaugucaacauauggcuggaauauugucaaacucaugucgggaaaagauguauucuaucugccaccugaaaaaugugacacucuauuaugugacauaggugaaucaagcccuucuccuaccguugaagaaagcaggacaauccgaguauuaaaaaugguagaaccguggcucaaaaauaaccaguuuugcauuaaaguacugaacccauauaugccgacggucaucgaacaucuagaaagauuacaaaggaaacauggagguauguuaguucggaauccauugucucgaaacaguacacacgagauguacuggaucucaaaugguacagguaauauaguuucaucuguaaauaugguauccagauuacuauuaaaucgauucacgaugacacaucguagaccgacaaucgaaaaagacguggauuuaggagcaggaacgcggcaugugaaugcagagcccgaaacaccgaacauggacguuauaggagaacgcaucagaagaauaaaggaagaacacucauccaccuggcauuacgacgaggaaaauccuuauaaaacaugggcuuaucacgguucguacgagguaaaggcuacuggaagugcaagcucuaugaucaauggaguaguuaaacuauuaacaaaacccugggacguaguuccuacugucacgcagauggcaaugacggauaccacaccauucggucaacaacgcgucuuuaaagagaaggucgacacgcgaacacccagaccuaugccuggaacaaggaaagccauggaaauaacagccgaguggcuauggcguacucuuggaagaaauaaaagaccacgacuauguacucgugaagaguucaccaagaaagucagaacuaaugcugcaaugggugcaguauucacugaggaaaaccaaugggacagcgcaagagcagcaguugaagacgaagaauuuuggaaauuaguugaucgagaaagagaguuacauaaacuagggaaaugcgggucaugcguauacaauaugauggggaaaagggaaaagaaguuaggagaauuugguaaagccaagggaucucgagcgaucugguauauguggcuaggcgcucgauauuuagaguucgaggcuuuagguuuccucaaugaagaucacugguucaguagagaaaacagcuuuagugguguagaaggcgaaggauugcacaagcuagguuacauucugagagacauuucuaaaauaccaggcggugccauguacgcagacgacacagcugggugggauacacggauaaccgaggaugauuuacacaacgaggagaaaauuacucaacagauggagccugaacauagacaauuagccaaugcuauauuuaaauuaacauaccaaaacaagguuguaaaaguucagagaccuacgccaaaagggaccgucauggacauaauaucaaggaaagaucaaagagggucaggacaaguugggaccuauggauuaaacacauuuacaaacauggagguacaauuaauacgucaaauggaaggagagggaguauuaucgaaagcagauuuggaaaauccacauuugcuagagaaggaaauaacucaaugguuagaaaccaagggaguagagaggcuuaaacgaauggcuaucaguggugaugauuguguugugaaaccaaucgacgaucguuucgcggaugccuuacuugcucuaaaugauaugggaaaagucagaaaagauauaccacaauggcaaccaucaaagggauggcaugacuggcaacaggucccauuuuguagucaucacuuucacgaacuaauaaugaaagacgggcgaaaacucguggucccaugucguccccaggacgagcuaauugguagagcccggauaucacaaggagccggguggucacuuaaagagacagcuuguuuagguaaggcuuacgcucagaugugggcauuaauguacuuucauagacgagaccuccgguuggcgaguaacgcuauuugcagcgcaguucccguccauugggugccgacaagccgaacgaccuggucaauacaugcacaucaucaauggaugacaacugaagauaugcuaacuguguggaauagaguauggauugaagauaacccuuggauggaagauaaaacuccuguaaccaccugggaagacguaccuuaucuugguaaaagggaagaucaguggugcgguucucuaauaggacuugcuaguagagccacaugggcacaaaauauacucaccgcgauccaacaaguaagaucucucaucggaaacgaggaauuuuuagacuauaugccauccaugaaaagauuccguaaagaagaggaaucugaaggagcgauaugguga

SEQ ID NO: 23520 - RNA, 9873 nt, Artificial Sequence
  derived and/or modified CDS sequence (opt6) from DENV-3__KC762685__SS-prME
acuucguuaugccucaugaugauguuaccugcgacuuuagcauuucacuugacgucaagagacggagaaccaagaaugauaguugguaaaaaugaaagaggaaaaucccuguuauuuaaaaccgcgucaggaauaaacaugugcacucuuaucgcaauggaccucggagaaaugugcgacgauacgguuaccuacaaauguccguuaauaacagaaguagaaccagaagacaucgauugcugguguaaucuaacaaguacauggguuaccuauggaacauguaaccaagcaggggaacauagacgcgauaaacgauccguggcacuggcgccccacguaggaaugggucuggauacccgagcacaaaccuggauguccgcggaaggagcuuggagacaaguggaaaaaguagaaacuugggcguucagacacccaggauuuaccauauuggcauuguuccuugcacauuacauuggaacuucacuuacacaaaaaguagucauuuucauuuuacuaauguugguaaccccaagcaugacuaugcguugugugggaguaggaaacagagauuuugucgaaggacuaucaggggcgacauggguagacguuguccucgaacacggcggaugcguaaccacaauggcuaaaaacaaaccaacauuggauauugaacuacagaaaaccgaagcaacgcaauuagcuacuuugcgaaaauuaugcaucgaagggaaaauaacuaauguuaccacugauucgagaugcccaacacaaggagaagccauacugccagaagaacaagaccaaaauuacguguguaaacauacauacguggauagaggaugggguaacggauguggauuauucgguaaaggaucauuaguuacaugcaccaaauuucaaugucuagaguucauugaaggaaaaguaguccaacacgaaaauuuaaaauauacagugauaaucaccguacauacuggagaucaacaucaaguaggaaaugaaacucaagguguuacagcugaaauaaccccacaagcgucuacaguggaagcaauucuuccagaauauggaacucuaggacuagaaugcucaccgcgaacaggucuggacuucaacgagaugauacuucuuacaaugaaaaauaaagcauggauggugcauagacaaugguucuuugaucuaccacucccuuggacgagcggagccaccaccgaaaccccaacauggaauaagaaagagcuucuuguuacauucaaaaaugcucaugcuaagaaacaagagguagugguucuuggaucccaagaaggagcaaugcauacagcacuaacaggugcaaccgaaauccaaacgagcgggggaacuucaauuuucgcaggacauuugaaaugucgauuaaaaauggacaaauuagagcucaaagguauguccuaugcaaugugucuaaacgccuuuguuuugaagaaagaaguaucagaaacgcaacauggaacaauccugauuaaaguagaauacaaaggcgaagaugcgccguguaaaauuccuuuuagcacagaagacggacaaggaaaagcacacaacgggagguugauuacagcuaauccaguggugacuaagaaagaagaacccguaaacauagaggcggaaccaccguuuggugaguccaauauagucaucgguauaggugauaaagcacuaaaaauaaacugguauaagaaagggucaaguaucggaaaaauguuugaagcaacagcuagaggagcucgcagaauggcuauauuaggagauaccgcuugggauuucgguucggugggcggcgugcucaacucauuaggaaaaaugguucaucaaaucuucgggucugcauauacagcuuuauuuucuggagugaguuggauaaugaaaauagguauaggaguacuucuuacauggauaggacugaacagcaaaaauacgucgaugaguuuuucguguauuguuaucgguaucauaacacucuaucuuggagcagugguucaggcugacaugggaugcguaauaaacuggaaaggaaaagaauugaaaugcggaucgggaauuuuuguuacaaacgagguucauacauggacggaacaauacaaauuccaagcagacaguccuaaaagauuagcuacugcaauugcuggggcaugggaaaauggaguauguggaaucagaaguacaacccgaauggaaaaccuacuauggaaacaaauugcaaacgaacucaauuacauauugugggaaaauaauauaaaauuaacuguuguuguaggggauauaaucgggguucuugaacaagggaaaaggacgcuaacgccgcaaccgauggaauuaaaauauucguggaaaacaugggguaaagcaaagaucguaaccgcugaaacucaaaacucuaguuucauaauugacgguccuaauacaccugagugcccuagcgcauccagggcauggaauguaugggaagucgaagacuauggguucggcguuuuuacaacuaacauauggcuaaagcuacgugaaauguacacgcaauuaugcgaucacagacucauguccgcagcagucaaagaugagagggcaguacacgcagacaugggauauuggauugaaucgcagaaaaauggaagcuggaaauuagaaaaagccaguuuaauagaaguaaaaacguguacguggccaaaaucgcacacuuuauggucuaauggcgugcuagaguccgauaugauaauuccaaaaucauuagcaggaccgguuucucaacacaauuauaggccgggcuaucacacucaaacagccgggccauggcaucucggaaaauuagaacuagauuucaacuauugcgaaggaaccacaguggucaucacagaaaauugcggaacacggggucccucccuaagaaccacaacgguaaguggaaaauuaauucacgaaugguguuguagauccuguacauuaccaccacucagguauaugggagaagacgguuguugguacgggauggaaauuagaccaaucaaugaaaaagaagagaauaugguaaagagucuuguuagcgcgggcagcgguaaaguugauaacuucacgaugggaguguuaugcuuggcaauacuguucgaagaaguaaugcgaggaaaauucgguaagaaacauaugaucgcggggguauuauucacuuuuguauuauuguuaaguggucaaauaacauggagagacauggcacggacuuuaauaaugauaggaagcaaugcgagugaccggaugggaaugggggucaccuaucuggcacuaauagcaacuuuuaaaauccaaccauuuuuagcauuggguuucuuuuuacggaaguugacgagcagggaaaaucuuuuacuuggcguaggucuggccauggcgacuacucuacaacucccagaagacaucgaacaaauggcaaacgggauagccuugggccuuauggcauuaaaacugauuacacaauuugaaacuuaucaauuauggacugcauuaguaucacuaauguguuccaauacaauauucacguuaacagucgcuuggaggacggcaacucugauacucgcaggaauaucgcuauuaccaguaugucaaaguucgagcaugagaaaaacugauuggcugccgguuacaguagccgcgaugggcgucccgccgcucccuuuguuuauauucucacugaaagacacauuaaaaagacguucuuggccccuuaaugaggggguaauggccguuggccuugugaguauacuagcuaguagccuauuaagaaacgauguaccaauggcagguccccuaguggccgguggacuguuaauagcauguuacgucauaaccgggacaagugcagaccuaacuguagaaaaagcagcggacguaaucugggaagaagaggcugaacaaacaggaguuagccauaaucuuaugauaacagucgacgaugaugguacaaugcgaauuaaggacgacgaaacagaaaauauacuuaccguucugcucaaaacagccuuauuaauaguuucuggaaucuucccauacaguaucccagcaacuuuguuaguauggcacacuuggcaaaaacaaacacaaagaagcggggugcuaugggacguuccuaguccuccggaaacucagaaggcagaauuagaagagggaguauacagaauaaaacaacaagguaucuucggaaaaacccaaguaggagucggaguccaaaaggaaggaguauuucauacaauguggcacguuacgaggggagcuguacugacucauaacggaaaaagauuagagcccaauugggcaagcgucaagaaagacuuaauaucauacgguggugguuggcgacuaucggcccaauggcaaaaaggagaagaaguacaggugauagcuguagagccuggcaaaaaucccaagaauuuccagacgaugccagggauauuucagacaaccacgggagaaauaggugcuauagcgcuggauuucaaaccaggaacgucaggcagccccauaaucaauagagagggcaaaguaguaggauuauacggaaacggagugguaacuaaaaauggugguuauguaagugggaucgcacaaacuaaugccgaaccagauggcccuaccccggaauuagaggaagaaauguuuaagaaacgaaaccuaacaauaauggaucuacauccagggaguggaaaaaccagaaaguaucuuccugcuauagugagagaagcgauaaaaagaagguugagaaccuuaauuuuagcaccgaccagaguuguggcggcugagauggaagaagcacuuaaaggacugccuauuagauaucagaccacagcaaccaaaucagcucacacaggaaaagaaauuguagaucugaugugccaugcaacuuucacaaugaggcuuuuaucaccaguacggguuccgaauuauaauuugauaauaauggaugaagcacacuucacagaccccgcaucaauagccgcuagaggcuacaucaguaccaggguugguaugggagaagcugcugcaauuuuuaugacggcaacaccaccgggaacugcagacgcauuuccacagucaaaugcaccaauucaggacgaagaaagagauauucccgaaagaagcuggaacagugguaaugaauggauaacggauuuugcuggaaaaaccgugugguucgugccuagcauaaaagcugggaaugauauugcaaacugucuaaggaagaauggaaagaaagucauucaguugucuagaaaaacauucgauacugaauaucaaaagacaaaacugaaugauugggacuucguuguaacuacagacauuucugagaugggugcaaauuucaaagcugaucgcguaauugaucccagacgaugcuuaaaaccaguuauucuuacggauggaccggaacgcguaauuuuggcuggaccaaugccgguaacaguagcaagugccgcgcaacgcagaggacgcgucggaagaaauccccagaaggagaacgaucaauacauauuuacgggacaaccguugaacaacgacgaggaccacgcgcacuggacugaagcgaagaugcuauuagauaauaucaauacaccagagggcauuauccccgccuuguuugaacccgaaagggaaaaguccgcggcuauagacggugaauacagacuaaaaggagaaagucgaaagacauuuguagagcuaaugcgacgaggagauuuacccguaugguuagcgcacaaagucgcgucggagggaauaaaauacacagaccgaaaaugguguuucgacggugaacgaaacaaccaaauucuagaggagaauauggacguagaaauauggacaaaggaaggagagaagaagaaacuucgaccgagauggcuugaugccaggacauauagcgauccacuagcuuuaaaagaauuuaaggacuucgcagcaggaagaaaaaguauugcgcuagaucucguaacagagaucggacggguaccuagucaccuagcccaucgaacacgcaaugcucucgauaauuuaguaauguugcauacaagcgaacacggaggccgagcauaucgucaugcaguugaagaauuaccagagacaauggaaacauuguugcuauuaggguugaugaucuuacugacuggcggagcaaugcuguuucucauaagugguaaagguauuggaaaaacaaguaucggccuuauuugcguuguugcaucuucuggcaugcuauggauggcggacguaccccuacaauggauagcuucagcaauaguauuagaauuuuucaugauggugcugcuuauacccgaaccagaaaagcaaagaacaccacaagauaaccaauuagcauauguaguaaucggaauauuaacccucgcggcgauaguagcagcaaaugaaauggggcuucucgaaacaacgaaaagggauuuaggaaugaguaaagagccugguguaguaagcccaaccaguuaccuggacguggaccuucauccagcaucagcauggacuuuauaugcgguggccaccacaguaauuacgccaauguuacgucacacaauagaaaauaguacugcuaauguaagucuagccgcgauugcuaaccaagcaguaguucucaugggucuagauaaagguuggccgauuagcaaaauggauuuagguguaccgcuccuggcacuagguugcuauucacaagucaacccacucacccucacugcagccguacugcuuuugguuacccauuaugcgaucauagggccagguuugcaagcaaaagcuacgagagaggcgcagaaaagaacagcugcuggaaucaugaaaaauccaacaguugaugguauuaugacaauagauuuagauccgguuauuuacgacuccaaguuugaaaaacaguugggucaagugaugcuucuaguccugugcgccgugcaauuacuucugaugcgcacaaguugggcuuuuugcgaagcauuaacauuagcuacugggccgauuacuacauuaugggaagguaguccugggaaauuuuggaacaccacaauagcugugaguauggcaaauaucuuucggggaaguuacuuagccggugcaggauuagcuuucucaauuaugaagaguguugguacagggaaaagaggaacagguucucagggggagacacuuggagagaaauggaagaagaaacuuaaucaauuaucaagaaaagaguuugaccuguauaagaaaucuggcauaacggaaguugaucguacugaagcaaaagaaggacuuaaaagaggagaaaucacacaccaugcaguaucaagaggaagugcuaaacuacaaugguuuguugaacguaacaugguaaucccagaagggcgaguaauugaucugggaugcggucgaggugguuggaguuauuauugugcgggucuaaagaaaguaacagaaguuagaggcuauacuaaaggcgggccaggacaugaagaacccgugccgauguccaccuacgguuggaauaucgucaaacuuaugucaggcaaagauguauuuuauuuacccccagaaaagugugauacguuacuaugcgauaucggagaaucgucaccgucaccaacuguggaagaaagucgaacuaucagaguccuaaaaaugguagaaccauggcuuaaaaacaaccaguuuuguauuaaaguccuaaacccguacaugcccacggucauagagcaucuagagcgacugcaaagaaagcauggcggaauguugguucguaacccacuaucacgcaauagcacucaugaaauguacuggauuagcaacggaacaggaaacaucguaucaucuguaaauaugguaagcagacuacugcuaaauagguuuacuaugacucacagaagaccuacaauagaaaaagacguagaccugggagcaggcacacgucacguaaaugcagaacccgagacacccaauauggacguuaucggggaaagaauaagaagaauuaaagaagaacacucaaguacauggcacuaugacgaagaaaacccguacaaaacaugggcauaucacggaucauacgaggucaaagcaaccggauccgccuccucgaugauaaaugguguaguuaaauugcuuacuaagccaugggaugugguacccacaguaacucaaauggcaaugacugacacaacuccguucggacaacaacguguauuuaaagaaaaagucgacacucguacuccccgaccaaugccuggcacgcgaaaagccauggaaauuacagcugaaugguuguggagaacauugggucgcaauaagcgccccagauuguguacuagagaagaguucaccaagaaaguuagaacuaacgccgcaaugggggcaguguucaccgaagagaaccaaugggauagugcucgugcugcuguggaagaugaagaauuuuggaaauuaguugauagagaaagagaguuacauaaauugggaaaauguggaucuugcgucuauaacaugauggguaaaagagagaaaaaguuaggugaauuuggaaaagcuaaggguuccagagcgauaugguacaugugguuaggagccagguacuuagaguucgaagcacuaggauuccugaacgaagaucauugguuuucuagagaaaacucguucuccggaguggagggagagggcuuacauaaacuaggguacauacuacgggauauaucuaaaauuccggguggugcaauguacgccgacgacaccgcaggaugggacacacggauaacagaggacgaucuacacaaugaagagaaaauaacacaacaaauggaaccagaacaucggcaauuagcaaaugcgauauucaaauuaacuuaucagaauaaaguagucaagguccaaagaccaaccccaaaagggacuguuauggauauuauuucaagaaaagaucaaagaggaagcggacaaguaggaacauaugguuuaaauaccuucacaaauauggaaguacaguuaauuagacagauggaaggcgaagguguguuaagcaaagcagaccuagagaauccccaccuguuagaaaaagagauaacccaguggcuagaaacaaaaggaguggaacgacuaaaaaggauggcaauaucaggagaugacugugucgucaaaccgauugacgaucgauuugccgaugcguuauuagcuuuaaaugauaugggcaaaguucgaaaggacauaccccaauggcagccaucgaaaggguggcaugauuggcaacaaguaccuuuuuguucacaccauuuccacgagcuuauaaugaaagauggacguaaauugguaguaccaugucgaccucaagacgaauugauaggucgcgcuagaauuucccaaggggcugguuggucucucaaggaaacagcaugccuagguaaagcguacgcacaaaugugggcacuaauguauuuccauaggagagaucuccgacuggcaucgaacgcaauuugcucagcgguaccaguacauuggguuccaacgucuagaacuaccuggaguauccaugcccaucaucaguggaugaccaccgaggauauguugacaguuuggaaucguguauggauugaagacaauccuuggauggaggauaaaacccccgugacaacaugggaagacguaccguauuuagguaaacgagaggaucaauggugugguagucuuauaggacuggccucucgcgcgacuugggcccagaauauuuuaacagccauucaacaagugagaaguuuaauaggaaacgaggaguucuuagauuauaugcccuccaugaagcgauucagaaaagaagaggaaucagaaggggcuauuugguag

SEQ ID NO: 23521 - RNA, 9873 nt, Artificial Sequence
  derived and/or modified CDS sequence (opt6) from DENV-3__KC762687__SS-prME
acgagucucuguuuaaugaugauguuaccagcaacguuagcauuucauuugacaagucgagacggcgaaccacgaaugauaguagggaaaaaugaaagagguaaaucccuguuguuuaaaacugcuucuggaaucaacaugugcaccuugauagcuauggauuuaggcgaaaugugcgacgacacuguaaccuauaaauguccuuugauaacugaaguggaaccagaagacauagacugcugguguaauuuaacaucaacauggguuaccuauggaaccuguaaucaagccggugaacaccgcagagacaaaagaucaguggcauuggcaccucacguaggaaugggacuagauacacgugcucaaacauggaugagugcagaaggcgcuuggcgacaagucgagaaaguagaaacaugggcuuuucgucacccaggcuuuacuaucuuagcacuguuuuuagcgcauuacaucggaacuucucuuacacagaaaguaguaaucuucauauuacugauguuagugacuccaucuaugacgaugcgguguguaggaguaggaaaucgugauuuuguggaaggauuauccggagcaacguggguugacguaguacuagagcauggaggcugugugacgacaauggcgaaaaauaaaccuacgcuagauauagaacuucagaaaacugaggcaacacaauuagcaacgcucagaaaacuuuguauagaaggaaaaauuaccaacgugacaaccgacucgcgcugcccaacccaaggggaagccauacuaccugaggaacaagaccaaaauuacguuuguaaacauacauauguugauagggguugggggaacggcugugggcuuuuuggaaaagguucacuuguaaccugcgcuaaauuucaaugcuuagaguuuauagaaggaaaagugguccaacaugaaaaucugaaauacaccguaauaauaacuguacacacuggggaucaacaucaagugggaaacgaaacgcaaggcguaacugcugaaauaacgccccaagcaucaacgguagaagcaauucuucccgaguacgggacacuuggacuggaaugcucaccacgaacuggguuagauuucaaugagaugauauuacuaacaaugaaaaauaaagcauggaugguacaccgucaaugguucuuugaucugccauuaccuuggacaaguggagccacuacugaaacaccaaccuggaacaagaaagaacuucuuguaaccuucaagaaugcacacgccaagaaacaagaggugguaguacuuggaucucaagaaggcgcaaugcacacggcguuaacuggagcgacggaaauccaaacaucgggaggaacgaguauuuuugcaggucaccugaaaugccguuuaaagauggauaaacuugagcuaaagggcaugaguuacgcgaugugccuuaacgcguucgugcuaaagaaagaaguaagugaaacucaacaugguacgauucuaauuaaaguugaguauaagggugaggaugcaccaugcaaaauuccauucucaacagaagacgggcaagggaaggcacacaacggaagguuaaucacagccaacccaguaguagugaagaaagaagaaccgguuaauauagaggcagaaccacccuucggagaaaguaauauaguuauugguauuggagacaaagcacugaaaauaaauugguauaagaaagguaguagcauaggcaaaauguuugaagcuacagcacguggagcaaggcgaauggccauuuuaggcgauacagcaugggauuuugggucuguaggagguguucucaacagccucggaaaaaugguacaucaaauauucgggucugcauauacggcucuguucucuggagugagcuggauaaugaaaauuggaaucgggguacuucuaacguggauuggccuaaauagcaagaacacauccaugaguuuuuccuguaucgugauagguauaauuacgcuauacuugggagcagugguccaggcagauaugggauguguuauaaauuggaaaggaaaagaauugaaauguggcucaggcauuuuugucaccaaugaaguacauaccuggacugaacaauacaaauuccaggcggacaguccuaaaagacuugcuacggcaaucgccggcgcgugggaaaaugguguaugcgguauaagaucaaccacaagaauggaaaaucuucucuggaaacagauagcaaacgaauugaacuacauuuuaugggaaaauaauauaaaauuaacggucgucguaggagauaucaucggaguauuagaacagggaaagcgcacacuaacgccacaaccaauggaacugaaguauaguuggaaaacguggggaaaggcaaaaauuguaacugcagaaacccagaacagcucguuuauaauagauggaccaaauaccccagagugucccagcgcgaguagagcauggaacguaugggaagucgaggacuacggauuuggaguuuucacuacaaacaucuggcuuaaacuacgugaaauguauacucagcucugugaucacaggcugaugagcgcugcgguuaaagacgaaagagcaguacacgcugacaugggcuauuggauagaaagucagaaaaauggaucuuggaaacucgaaaaagcgucguugauugaaguaaagaccuguacguggccuaaaucucauacacuauggaguaacggaguauuggaaagugacaugaucauaccuaaaucucuagccgguccggucucccaacacaauuacaggcccgguuaucacacacaaacugcagguccauggcauuuaggaaaguuagaacuugauuuuaauuauugugaaggaacuacuguugucauaaccgaaaacugcggcaccagagggccaucacuaagaacaacuaccguaucagguaaacucauacacgaauggugcugcagaaguuguacgcuaccgccacucagauauaugggugaggauggauguugguacggcauggaaaucagaccaaucaaugaaaaagaagaaaacaugguuaaaagccugguaucggcaggauccggaaagguugauaauuuuacaaugggcguacuuuguuuggccauucuuuucgaagaaguuaugcgggguaaguuuggaaagaaacacaugaucgccggggugcucuuuacuuuuguguuauugcucuccggccaaaucacauggcgugauauggcuaggacauuaaucaugaucggaaguaaugcaagugaucguaugggaaugggugucacuuaccuagcucuuauagcgacauuuaaaauacaaccauuucuagcauuaggauucuuucuacgaaaauuaacaucgcgagagaaccuccuguuaggaguaggacucgcaauggccacaacacuccaauuaccagaggauauugaacaaauggcuaaugggauagcacuaggauuaauggcauuaaaauuaauaacucaauuugaaacuuaucaguuauggacugcauuaguuucauuaaugugcucgaacacuauauucacuuuaacaguagcuuggagaacagcuacguuaauacucgcuggaauuucuuuauucccggugugccaaucaaguucaaugcgaaaaaccgacugguuacccgucaccguugccgcgaugggagucccaccauuaccgcuauucauuuuuaguuuaaaagacacacuuaaaagaagaaguuggccauuaaaugaaggaguaauggccgucggcuuagugucaauauuagcaaguagccucuuacggaaugacguuccuauggcaggaccauuaguugcgggaggacuacucaucgcauguuacguaauaaccggaaccucagcagaucuuaccguagaaaaagcagccgacguaauuugggaagaagaagcagagcaaacuggaguaucacacaaccugaugaucaccguagacgaugacgguacaaugagaauaaaagaugaugaaaccgaaaacauucucacagucuugcuuaaaaccgcauuauugauuguaucugggaucuuccccuacaguauaccugcaacgcuuuugguauggcauacauggcaaaagcaaacgcagcgcuccgguguauugugggaugucccgagcccucccgaaacacaaaaagcugaguuagaggaagguguguaucgaauaaagcaacaaggaaucuucggaaaaacacaaguaggaguggggguccagaaagaggguguuuuccacacaauguggcacguaacuagaggagcaguguugacgcauaacgguaaaagauuggaacccaacugggcuagugucaagaaagaucucaucucuuacgggggaggauggaggcuuagugcacaguggcaaaagggggaggagguacaaguaaucgcuguagaaccagguaaaaacccuaagaauuuccaaaccaugccaggaacauuccaaaccacuacaggcgaaauaggugcuauagcauuagauuuuaaaccgggaacuagcgguucuccaaucauuaaucgcgaaggaaagguagucggacuauacggaaacggaguuguaacuaaaaauggcggguauguaucgggaaucgcucaaacaaacgcggaacccgacgguccuacaccggagcuugaggaagaaauguucaaaaagaggaauuuaacuauuauggauuugcacccagggucaggcaaaacaaggaaauacuugccugcaauaguucgagaggcaauuaaaagaagauugagaacucugauauuagcaccaacacgagucguagcggcggaaauggaagaagcauuaaaagguuuaccgauccgguaucaaacuacagcuacaaaaagugugcacacgggcaaagaaauuguugaucuuaugugucaugcuacauuuacgaugagguuauuaucacccguaagaguuccuaacuacaauuuaauuauuauggacgaagcccauuucacagauccugcgucaauagcugccagggguuauaucaguacuagagucggcaugggugaagcagcagcuauuuucaugacagcaaccccaccugguacugcggaugcuuuuccacaaucgaaugcuccaauacaagaugaggaaagagauauuccugagcguagcuggaacucaggcaacgaauggauaacagacuucgccgguaaaacagucugguucgugccaaguaucaaagcggguaaugauauagcgaauugucuacguaagaaugggaaaaagguaauacaguuaucuaggaaaaccuuugauacugaguaccaaaagacgaaacuaaacgauugggauuuuguaguaacaacugauauauccgaaaugggggccaacuucaaagcagauagaguaauagacccgcgaagaugcuugaaaccuguuauacuuacagacggcccagagagagugauacuagcaggccccaugccggucacaguagcaagcgcagcccagcgccgaggucgggugggucguaauccucagaaagaaaacgaucaauauauuuuuacuggccagccauuaaacaaugacgaagaucacgcacauuggacagaagccaagaugcuuuuggauaauauaaauacuccugagggcauaauuccagcacucuuugaaccggaacgagagaaaucugcugcaauugauggagaguauagacuaaaaggagaaucucgaaaaacauuuguggaacuuaugagaagaggugaucuaccaguuuggcuugcacacaaggucgccucagaagguaucaaauacaccgaucgaaaauggugcuuugacggcgagagaaacaaucagauccuagaagaaaacauggaugucgaaaucuggacuaaagaaggcgaaaagaagaaacuaagaccaagaugguuggaugcuagaacuuauucagacccauuagcauugaaagaguucaaggauuucgcugccgguaggaaauccauagcuuuagaucucguuaccgaaauaggucgaguaccuucucaccuugcacauaaaacacguucagcuuuagacaauuuaguaaugcugcacacguccgaacauggcggacgugcuuaccgacacgcuguagaagaauuaccggaaacaauggagaccuuauuacuauuaggacuaaugauacuacuaacugguggggccaugcuauuuuuaauaucugggaaaggcauaggcaagacgaguauaggccuuauaugugucguugcaucaagugguaugcuauggauggcugauguuccuuuacaauggauagcaucagcgauaguacuugaguucuuuaugaugguguuguuaauaccggaaccagaaaagcaacgaaccccgcaggauaaccaguuggcauaugugguaauuggaauacuuacguuagcugcaauagucgcugcgaacgagaugggccuacuggaaaccacuaaaagggaucuagggaugucuaaggaaccuggaguagucucaccgacaucguaccuagauguagaucugcacccugcuagugcuuggacgcuauacgccguggcaacaacugugauaacgccaaugcuuagacauaccaucgaaaauaguacugcgaaugucucguuagcagcaauugcgaaucaagccgugguucuaaugggauuggauaaagguuggccaaucucuaagauggaccuagguguaccccuguuagcccuggguugcuacagccaaguaaauccucuaacauugacugcagccguacuuuuacucgucacacauuaugcaauaauugguccaggccuacaagccaaagccacgagagaggcucaaaagagaacugcagccggaauuaugaagaaccccaccguggauggcaucaugacgauagauuuagaccccguuauuuaugacucuaaguuugaaaagcagcugggccaggugaugcuguuaguacuuugugcgguacaguuacucuuaaugaggacaaguugggcguuuugugaagcucucacauuggcaacaggacccaucacaacgcuaugggaagguaguccaggaaaguuuuggaacaccacuauagccguuagcauggcuaacaucuuuaggggcaguuauuuagcuggagcuggguuggcauuuaguauuaugaagucaguggguacaggcaaaagaggcacaggaucucaaggugagacuuugggagaaaaauggaaaaagaaacuaaaccaacuuucgcgcaaagaauuugaccuauacaagaagucggguauaacugaaguagaccguacagaagcaaaagaaggguuaaagagaggcgaaauaacacaucaugcgguuucacgagggucugcaaaauugcaaugguucguagaaagaaauauggucauaccagagggucgaguuauugauuuaggaugcggucgaggcggcuggucauauuauugugcaggacuuaagaagguaaccgaaguucguggauauacaaaagguggcccaggccaugaagaaccaguaccuaugucgaccuacggauggaacauagucaaacucaugagcggaaaagaugucuuuuaccuacccccugagaagugcgauacacuccuuugugauauaggagaaucaaguccaucuccaacuguagaagaaucgagaaccauaagagugcuuaagaugguggagccguggcuuaagaacaaccaauuuugcauuaaaguauugaacccuuacaugccaaccgucauagaacauuuagagcgacuacaacgcaaacacgguggaaugcuggugcguaauccgcucucaagaaacucaacucaugagauguauuggauuagcaauggaaccggaaauauagucagcaguguaaacaugguaucaagacugcucuuaaaccgcuuuacaaugacacaucggagacccacaauugagaaagauguagaucuaggugcggggacucgacacguaaaugcugaacccgaaaccccgaacauggacguaauaggcgaacgaaucagacgcaucaaagaagaacacuccucaacuuggcauuacgacgaggaaaacccuuacaagacgugggcauaucacgguuccuaugaggugaaagcaacaggaagugccucaaguaugauaaauggcguaguaaaauuguuaacaaagcccugggacguagugccgacuguaacucaaauggccaugacggauacaacucccuucggucaacagagaguuuuuaaagaaaaaguagauacccgaacaccaagaccaaugcccgggacccgaaaagccauggaaauuaccgcagaaugguuguggagaacauugggaagaaauaaaagaccaagacuuugcacccgagaggaauuuacuaagaaaguuagaaccaaugccgcuaugggugcuguauuuacagaggaaaaucaaugggacucagcaaaggcagcgguagaagaugaagaauuuuggaaguuagucgacagagagagggaauuacauaagcuagguaagugcggaucuuguguauacaacaugauggguaagcgggagaagaaauuaggagaguuuggcaaagcaaaaggcucgagagcaaucugguauauguggcucggagcgcguuaucuugaauuugaagcauugggauuuuuaaaugaagaccauugguuuagccgggaaaauucuuuuucuggaguugaaggcgaggguuuacauaaauugggauauaucuugagagacauaagcaaaauaccugguggcgcuauguaugcggacgauaccgcuggaugggacacaaggauaacagaagacgaucuccauaacgaagagaaaauaacccaacaaauggauccugaacaccgacagcuagcuaacgccaucuucaaacuuaccuaucagaauaaaguaguuaaggugcagaggccaacaccaaaaggaaccguaauggacauaauuucgaggaaagaucagagagggaguggacaaguaggaaccuauggauuaaacacuuuuacaaacauggagguacaacucauccgacaaauggaaggcgaagguguacugucaaaagcagaucuagaaaacccucauuuauuagaaaaagaaaucacucaaugguuagaaacaaaaggagucgagagauuaaaacgaauggcaauaucaggcgaugacugcguuguaaaacccauagacgaccgauuugccgaugcacuacuugcuuugaacgauaugggaaaaguacggaaggauauuccacaauggcaaccuucuaaggguuggcaugauuggcaacaaguaccuuucuguagucaccauuuucacgaacucauaaugaaagacgguaggaaacuugugguuccuugucguccacaggacgagcugauagguagagcaagaauuucgcagggagcggggugguccuuacgcgaaacagcuugucucggcaaagcauaugcacaaaugugggcacugauguacuuucauagaagagauuugaggcucgcaaguaaugcaauauguagugcuguuccgguacauuggguuccgacgucuagaacgaccugguccauucacgcucaccaccaguggaugacgaccgaagacauguugacuguguggaaucgcguuuggauagaagacaaccccuggauggaagauaagacuccaguaaccacaugggaagauguaccauaucuaggaaaaagagaagaucaauggugcggcucacuaauaggccuagccagucgugcaacuugggcacagaacauucuaacugcaauccaacaaguaaggaguuugaucgguaaugaggaauuuuuagacuacaugccuagcaugaaaagauuucguaaagaggaagaguccgaaggagccauaugguaa

SEQ ID NO: 23522 - RNA, 9873 nt, Artificial Sequence
  derived and/or modified CDS sequence (opt6) from DENV-3__KC762688__SS-prME
acaagucuaugccuuaugaugauguuaccugcaacucuagcauuccauuuaacaagucgagauggggaaccaagaaugaucgugggcaaaaaugaaagaggaaaaaguuuacucuucaaaacugcaucagguaucaacauguguacacuaaucgcgauggacuugggugaaaugugugaugauacuguuacauacaaaugcccccucauaacugaaguagaaccagaagauauagacuguuggugcaaucucaccucuaccuggguaacguaugguacuugcaaucaagcgggagaacacagaagagacaaaagaaguguagcuuuagcaccacauguuggaaugggucuagacacgagagcacaaacguggaugucugccgaaggggcguggagacaaguugaaaaaguugaaacaugggcauucagacauccaggauucacaauucuagcgcuauuccuagcacauuauaucgguacgucucugacacaaaaaguagucauauuuauuuuguuaaugcuuguaacaccgaguaugacaaugagauguguuggaguugguaaccgagauuuugucgaaggucuuaguggagcgacauggguugacguaguccucgaacacggaggauguguaacaacgauggcuaaaaacaaaccuacucuugauauagaacuacagaaaacugaagcaacacaauuagcaacucuccgaaaauuguguauagaaggaaaaauaacaaacguaaccacagauagcagaugcccaacacaaggagaagcaauacuaccagaagaacaagaccaaaauuacguguguaaacacaccuacgucgaccgcgguuggggaaaugguugugggcuauuugguaaagggucccuaguaacuugcgcaaaauuucaaugucuagaguucauagaaggaaaaguagugcaacacgaaaacuugaaauacacaguuauaauaacaguucauacaggagaccaacaucaaguaggaaacgagacacaaggagucacugccgagauaacuccacaagcaaguacgguagaagccauuuugccagaguaugguacccucggucuagaauguucgccaagaacgggucuagauuuuaacgaaaugauuuugcuaacaaugaaaaacaaagccuggaugguacauagacaaugguucuuugauuuaccacuaccauggacaucaggugcaaccacagagacaccgacauggaauaagaaagaguuacucguuacuuucaaaaaugcucaugccaagaaacaagaaguaguaguccuagguagucaggaaggugcuaugcacacagcuuuaaccggggcuacagaaauacaaacaagcgggggaacaaguauauucgcuggacacuuaaaaugucgacuuaaaauggacaaauuggaacuaaaaggcaugaguuaugcaaugugucuaaaugcuuuuguucugaagaaagaaguaucagaaacucaacacggaacuauucuaaucaaaguagaauauaaaggugaagaugcuccauguaaaaucccauuuaguacugaggacggucaaggcaaagcucauaacgguagguuaauuacagcaaauccaguggucacuaagaaagaagaaccugucaacauugaagcagaaccgccuuuuggagaaucaaacaucguaauugguauaggcgauaaagcucuaaaaauaaacugguauaaaaagggcucaaguauaggaaaaauguuugaagcuacugcccgaggagcuagaagaauggcgauacucggagauaccgcaugggacuuuggaucgguugggggcgucuuaaauucauuaggaaaaaugguccaucagauauuuggcuccgccuacaccgcauuauuuucaggaguauccuggauaaugaaaauugggauaggcguauuauuaacauggauaggucuaaauagcaaaaauacgaguaugaguuuuaguugcaucguuauugggauaaucacauuauauuuaggggcaguaguacaagccgacauggguuguguuauaaauuggaaagggaaagagcugaagugugguucuggaaucuucguaacaaaugaaguucauaccuggacagaacaauacaaguuucaggcugacaguccaaagagacuugcaacagcaaucgcgggugcgugggaaaacgggguaugugguauuagaucaacuacaagaauggagaaccuacuuuggaaacaaauugccaacgaauuaaauuauauccuaugggaaaacaauaucaaauugacgguagucguaggagacaucaucgggguacuagaacaagggaagagaacacuaacaccucagccaauggaauuaaaguacucuuggaaaacuugggguaaagcaaaaaucguaacugcugaaacucaaaauagcucguuuaucauagacggaccuaauacuccugaauguccuucggcgaguagagcguggaauguaugggaaguugaagacuacggauuuggugucuuuacuacgaauaucuggcugaagcuaagagaaauguauacacagcuaugcgaccacagauuaaugucagcugcaguaaaagaugaacgcgcgguacaugcagauaugggauacuggauugaaucucagaaaaaugguucguggaaguuagaaaaagcaucgcugauagaggucaaaacauguacguggccgaaaagccacacauuauggaguaaugguguauuagaaucggauaugauuauuccuaagagcuuagcagggcccgucucucaacauaacuaccggcccggauaucauacacaaacugcagggccauggcaccuugguaaauuggaguuagauuuuaauuauugugaaggcaccacuguuguaauaacggagaacugcggaacaagaggaccaucuuugcggacuacgacaguaaguggaaaauuaauccaugaguggugcugcagaucguguacacucccuccacugagguauaugggagaagauggcugcugguacggaauggaaauaagaccuaucaacgaaaaagaagagaacaugguaaaauccuuaguaucggcagguaguggaaagguagauaauuuuacuaugggaguccuauguuuagccauacuguuugaagagguaaugagaggcaaauucgguaagaagcauaugauugcagggguauuguuuacauucguucuacuguugaguggucaaauaacauggagggacauggcaagaacauugauaaugauuggguccaacgcaucggauaggaugggcaugggagugacguaccuagcccuaauagcuacuuuuaaaauccaaccauucuuagccuugggauuuuucuuaagaaaguugacaaguagagaaaaccuccuauuagguguaggacuugcaauggcuaccacacuccaauugccagaagacaucgaacaaauggcgaacgguauugcacuaggucugauggcucuaaaauuaaucacccaauuugagacauaucaacuauggacggccuugguaagccuaauguguaguaauacuuuauuuacgcuuaccguagcauggagaacagcgacucuuauauuagcugggauauccuuacugccaguuugucaaucaagcucgaugagaaaaacagacuggcuaccaguaacaguugcagcgaugggaguaccuccguugccauuauucauuuuuagccuaaaggauacuuuaaagaggagaagcuggccgcugaacgaggggguaauggcaguaggucucguaucaauuuuagcuaguucgcuacuaagaaaugauguuccgauggcagggccuuuaguagccggaggauuguuaauugcauguuacguaaucacggguacauccgcagacuuaaccgucgaaaaggcagcagacguaauaugggaagaagaagcugaacagaccggugugucacauaauuuaaugaucacaguagacgacgacgggaccaugagaauaaaagaugacgagacagaaaacauuuuaacaguauugcuaaagacggcacuguuaauagucucgggcauauuuccauauagcaucccagcaacauuguuagucuggcauaccuggcagaaacaaacacaaagaucuggcguauugugggauguuccauccccacccgaaacacaaaaggcagaacuagaagaagguguauauagaauaaagcaacaaggaauauucgguaagacucaaguuggaguagguguacaaaaggagggcguuuuccacacaauguggcauguuacccgaggggcugugcuuacacauaaugggaagagguuggaacccaauugggccucggucaagaaagauuugaucucguauggcggcggauggcggcugucagcacaauggcaaaaaggugaggagguacaaguaauugcgguagaaccuggcaaaaacccuaagaacuuucaaacuaugccagguauauuucaaacuaccacgggagaaauuggcgcuauagcccucgauuuuaaacccgggacaaguggauccccuauuauuaaccgggaaggaaagguaguaggauuguacgguaaugguguaguaacuaagaacggagguuacguuucaggcauagcucaaacuaaugcggagccagauggcccaaccccagaguuagaagaggaaauguuuaagaaaaggaaucucaccauaauggaucuucacccggggagcggcaaaaccaggaaguauuuaccagcuauugucagagaagcaauuaaaagacgguuacgcacacuaauucuugcgccaacuagaguugucgcagcggaaauggaagaagccuuaaaaggauuaccuauaagauaucaaacuacagcaacaaagagugcacacacaggcaaagaaauagucgacuugaugugucacgcaaccuuuacaaugcggcuucuaucgccagugcgcgucccuaacuauaaccugaucaucauggacgaggcacacuuuacagaucccgcuucaauugcugcccgggguuauauuaguacaagggucggcaugggcgaagcggcggcuauuuucaugaccgcaacaccaccgggaacagcagacgccuucccccagucgaaugcacccauacaagacgaggagcgagauauuccugagcgcucguggaacucggguaacgaauggauaacagacuucgcaggaaaaacagucugguuuguuccaucgauaaaagcugguaaugauauagcaaauugucuaaggaaaaauggcaagaaagucauacaacugucucgcaaaaccuuugauaccgaauaucagaaaacaaaauuaaaugacugggauuuuguuguaacaacagacauuucugaaaugggagcgaacuuuaaagcggauagagucaucgauccacgucguuguuuaaaaccagucauacucacagauggaccugaaagaguaauacuagcuggacccaugccugugacaguagccagugcugcgcaacgaagaggcagggugggucguaauccccaaaaagaaaaugaccaauauaucuucacugggcaaccuuuaaacaaugacgaagaccacgcgcacuggacagaagcgaagaugcucuuagauaacauuaauacaccagaagguauaauacccgcucucuucgagccagaaagagaaaagagugcagcaauagacggagaguaccguuugaaaggagagucucgaaagacuuucgucgaauuaaugcgacgaggagauuugccaguauggcuggcccacaaagucgccucagaggggaucaaguauacagaucgaaaauggugcuucgacggugaacguaauaaccaaauauuagaagaaaacauggacguagaaaucuggacuaaagaaggagagaagaagaaacugcgccccagaugguuggacgcgaggacauacagugauccucuugcacuaaaagaguuuaaagauuuugcagcgggacguaaaucaauagcauuagaucuaguaacggaaauaggacgcguuccaucacacuuagcacaucggacucgaaaugccuuagauaaccucguaauguugcauacgucugagcacggcggcagggcauaucgacacgcaguugaggaguuccccgaaacuauggaaacauugcuacuacuaggucuaaugauauuacugacggguggggcaaugcuauuuuuaauaucaggcaaagggaucggcaaaacgagcauaggccuuaucuguguuguugccaguucuggcaugcuauggauggcagacguuccccuucaauggauagcgagcgcaaucguucuggaguucuucaugauggugcugcuuaucccagaaccagaaaaacaaagaacaccgcaggauaaucagcucgcauacguuguuaucgguauacuaacacuugcagcuaucguagccgcaaaugaaaugggucucuuagaaacaacaaaacgugauuuggggauguccaaggaaccagggguagugucaccaacaucauacuuagacgucgauuugcacccugcgucagccuggacacuuuaugcagucgcaacaacugugauaacgccaaugcugcgucacaccauagaaaauagcaccgcgaaugugucuuuagcagcaaucgcaaaccaagccguaguauugauggguuuggauaaaggcuggccgaucuccaaaauggacuuagggguuccguuacuagcguuaggauguuauagccagguaaauccucuuaccuuaaccgcagcagucuuacugcuaguaacacacuacgccauuauuggcccgggauuacaagcgaaggcaaccagggaagcucagaagcgcacugcugcagguauaaugaaaaaccccacuguggauggaauaaugacuauagauuuagauccaguuauauaugacuccaaauuugaaaaacaguuaggccaaguuauguuauuaguauuaugugcaguucaacuuuuauugaugcgaacaagcugggcauucugugaggcccugacauuggccaccggaccgauaacuacuuuaugggaagggucuccgggaaaguucuggaacacaaccaucgcggucagcauggcaaacauauucagagggucuuaucucgcgggugcgggccucgcguuuucaauaaugaagucgguaggcacaggcaagcggggcacaggaucacaaggcgaaacacuaggggaaaaauggaaaaagaaacucaaccaacuuagucgaaaagaguucgauuuauacaagaaaucuggcauaacugaagucgaucgcacggaagcuaaggaaggccuaaagaagggagaaauuacacaccaugcgguuagccgaggauccgcaaaauugcaaugguucguugaacggaacaugguaauccccgagggcagaguuauugaccucgggugcgggcgaggaggguggagcuacuauugcgcuggucugaagaaaguaacugaaguuaggggcuauaccaagggugggccaggacaugaagaaccgguucccaugucgacauacggguggaacauuguaaaacucaugucuggaaaagacgucuuuuaccucccuccagagaagugugacacacucuuaugugacauuggagaaucuucaccaucgccaacaguagaagaguccagaacuauaaggguauuaaaaaugguagagccguggcucaaaaacaaccaauucuguauaaagguacuuaauccuuauaugccgacugugauugaacauuuagaacguuuacagcgaaaacacgguggaauguuaguaagaaacccuuuaucuagaaauucgacgcaugaaauguauuggaucaguaauggcacggguaauauagucucuaguguaaauauggucagucgacuuuuauugaauagguucacaaugacacaucgaaggccuacuauugaaaaggauguugacuugggugccgguacuaggcacguaaaugcagagccugagacaccgaauauggacguaaucggagagaggauaagacgcauaaaagaggaacacucgucgacauggcacuaugaugaagaaaacccuuacaagaccugggcguaucaugguucuuaugaaguaaaagccacgggaucugcaaguucuaugaucaacggcgucgugaaguugcugacuaaaccgugggacguagucccaacaguaacccaaauggcgaugacugacacaacaccauucggccaacaaagagucuuuaaggaaaaaguggauacaagaacaccaaggccuaugccaggcacacgcaaagcaauggaaauaacggcagaaugguuauggcggacguuaggucguaacaaacgaccaaggcucuguacucgcgaagaguuuacuaagaaaguaagaacuaaugccgcgaugggcgccguauuuacagaggaaaaccaaugggauagugcuagagcugccguagaggacgaggaguucuggaaacuuguagaucgcgagcgggaacuccauaaacucggcaaauguggaucaugcguguacaacaugaugggaaagagagaaaagaaacucggagaauuugguaaagcuaaaggaaguagagcuauuugguacaugugguugggugccagauauuuagaguucgaggcgcuuggcuucuugaaugaagaucacugguuuagcagagaaaacucguuuucaggugucgaaggagagggacugcauaaauuaggauacauacuucgugacauaaguaaaauaccuggcggggccauguaugcugaugauacugcuggaugggauacaaggaucacugaagaugacuuacacaaugaagaaaagauaacacagcaaauggauccagaacauagacaacuugccaacgcaauuuucaaauuaacauaccagaauaaagucguaaagguacaaaggccaacuccuaaagguacaguaauggacauuauaaguaggaaagaucaacguggcaguggacaaguagggacauauggauugaacacauucacaaauauggaaguacagcugauacgacagauggaaggagaaggaguauuaagcaaggcagaucuggagaacccccauuuacuggaaaaagaaauuacccaauggcuagaaacuaagggggucgaacgguuaaaaagaauggcaauuagcggagaugauugcguuguaaagcccauugacgaucgauuugcugacgccuuacucgcauuaaaugauauggguaagguucgaaaagauauaccacaauggcaaccaucgaaaggauggcaugacuggcagcagguuccuuucuguucacaccauuuucacgaacuuauaaugaaagauggucgaaaguugguuguaccaugccggccucaggacgaguuaauaggucgagcgaggauaagccagggggcaggauggucgcuuaaagaaacagcaugccuugggaaggcauacgcacaaaugugggcacuaauguauuuccauagaagggaucuaagauuggcuaguaaugccaucugcagcgcugucccaguucacuggguuccaacaagcagaacgacuuggaguauacaugcacaucaucaauggaugacaaccgaagauaugcuuacuguauggaaccgcgucuggauugaagauaaucccuggauagaagacaagacaccaguaaccacaugggaggaugucccauauuuaggaaaaagggaagaccaauggugugggucacuaauaggucuggcuucccgggcaacuugggcucaaaacauacugacagcaauccaacagguaagaagccuaaucggaaacgaagaauuuuuagauuauaugccuucuaugaaaagguuucguaaagaggaagaaagcgaaggugcaauuugguag

SEQ ID NO: 23523 - RNA, 9873 nt, Artificial Sequence
  derived and/or modified CDS sequence (opt6) from DENV-3__KC762689__SS-prME
accucucugugcuugaugaugaugauaccggcuacgcuugcuuuccaucuaacaagccgcgauggagaaccgcgcaugauaguagguaaaaaugaacgugggaaaucucuucuauuuaaaaccgcaagcgggauaaauaugugcacacugauugcuauggacuuaggggaaaugugugacgacacuguaacauauaaauguccuuuaaucaccgaaguagaacccgaagauauagauuguugguguaaccugacaaguaccuggguuacauacgggacaugcaaccaagccggagagcaucgacgagauaaacgaaguguagcacuggcgccacaugucggcaugggauuagauacaagggcgcaaacauggaugagcgcagaaggagcuuggagacaagucgaaaaaguagagacaugggcauucaggcauccgggcuuuacaauacucgcuuuguuucuagcacacuacauuggcacaucacucacgcaaaaaguaguaauuuucauacuauuaaugcuaguaacuccaaguaugacuaugcgauguguaggagugggaaauagggacuuugucgagggacuuucuggugccaccugggucgaugucguucuagaacauggaggguguguuacaacaauggccaaaaauaaaccaacauuagauauagaauuacagaaaacagaagcuacacaauuagcaacacugaggaaacuaugcauagaagguaaaauaacaaauguaacaaccgacagccgaugcccgacgcaaggggaggcaauacuacccgaagaacaagaucaaaauuacguguguaaacauacuuacguagauagggguugggguaacggauguggacuguucgguaaaggaucguugguuacaugcgccaaauuccaauguuuagaauuuauugaaggaaaaguaguccaacaugagaauuugaaauauacaguuauaauuacaguccauacaggagaucaacaucaggugggaaaugaaacacaggguguaacggcugaaauaaccccucaggcuuccacaguagaggcuauacucccugaguauggaacacuaggccuagaaugcuccccacgaacaggacuugacuuuaaugaaaugauccuucucacuaugaaaaacaaagcauggaugguacauaggcaaugguuuuucgaccugccauugcccuggacgucuggggcaacaacugaaacuccaacauggaacaagaaagagcuacucguuacauucaaaaacgcacacgcuaagaaacaagaaguugucgugcuugggagccaggagggggccaugcauacagcauuaacgggcgcaacugaaauccaaacgagugguggcacaucgauauuugcuggacauuuaaaauguagauuaaaaauggauaaauuggaguugaaagggauguccuacgcaaugugcuuaaaugcauuuguucuuaagaaagaagucucagaaacucaacauggcacuauucuuauaaaagucgaauacaagggugaggaugcuccguguaagauacccuuuucaaccgaagacggucaaggaaaagcacauaacgguagguuaauuaccgcaaauccaguugucaccaagaaagaagaaccuguaaauauagaggcugaaccuccauuuggggagaguaauauaguaauaggaauuggagauaaagccuuaaaaauaaauugguauaagaaaggaucaagcauaggaaaaauguuugaggccacagcaaggggugcccgcagaauggcuauccuaggagauacggcaugggacuuugggucagugggagguguacucaacucauuaggaaaaaugguucaccaaauuuucggaagcgcauacacugcucuuuuuaguggugugaguuggaucaugaaaaucgggauugggguacuacuaaccuggaucggcuuaaauaguaagaauacaaguaugucuuuuucauguauaguaauaggaauuaucacauuauaucugggagcgguuguacaagcagauauggguugcgugauaaacuggaaaggaaaagaauuaaaaugcggcagugggauauuuguaacaaacgaggugcauacauggaccgaacaauauaaauuucaagcagacagcccuaagaggcuagcaacugcaaucgccggagcaugggagaauggcguauguggaauacguucaacaacaagaauggaaaaucuacucuggaaacaaaucgcaaaugaacugaauuauauucucugggaaaacaauauaaaauugacaguggugguaggggauauuauaggagugcuugaacaaggaaaaagaacucuaacgccgcaaccgauggaguuaaaguacagcuggaaaacuuggggaaaggcuaaaauuguaacagcggaaacgcagaauaguucguuuauaauugauggcccuaacaccccagaauguccaucagcuagccgagcuuggaacguaugggaaguugaggauuacggauuuggcguauuuacgacuaauauuuggcuuaaauugagagaaauguauacacaauugugcgaccaucgccuaaugagugcagcaguaaaggacgagagagcggugcacgcugacaugggauauuggauagagagucaaaagaauggaucuuggaaacuagaaaaagcaagccucauagaaguaaaaacguguacauggccaaaaagccauacucuauggucuaacggcguucuagaaagugacaugauuauuccaaaaucacuagcggggcccgucucacaacauaacuauagaccgggauaccacacacagacggccggaccguggcaccuugguaaacuggaacuagacuuuaauuauugcgagggcacaaccguaguuauaacagaaucaugugguacuagaggucccuccuuaagaacuacgaccguuuccgggaaacuaauacaugaaugguguugccgauccuguacauuacccccacuaagauauaugggcgaagacggguguugguacggcauggaaaucagaccuauaaaugaaaaggaggaaaacaugguaaagucgcuugugucggcgggauccggaaaaguugauaacuuuacuauggguguuuuauguuuagcgauacuauuugaagagguaaugaggggaaaauucggaaagaaacacaugauugccgguguuuuguucacauuuguacuauuacuaagcggucaaauuacauggagagacauggcacgcacucuaauaaugauagguucuaacgcaagugauagaauggguaugggcguaacuuauuuagccuugauagcaacguuuaaaauucaaccguuuuuagcccuagguuucuucuugagaaaacuaacaagcagagaaaaucuacuccuuggaguaggauuggcuauggcuacaacacuacaacucccagaggauauagaacaaauggcgaacggaauagcauuagguuuaauggcacuuaaauugauaacgcaauucgaaaccuaccaacucuggacggcgcuugugucacuaauguguaguaacacaauauucacguugaccguggcauggaggacggcaacgcuaauauuagcaggaaucagcuuauugcccgucugccagaguucgucaaugagaaaaacggauuggcuccccgugacgguugcugcuaugggggugcccccacuaccacuguucaucuucucacuaaaagauacacuuaaacgccgauccuggccccucaacgagggaguuauggcaguaggucuaguaaguauacuagcuagcucacuauuaaggaaugacguuccaauggcugguccauuaguggcuggaggccuccuaauagcaugcuauguaauaaccggaacuagcgcugaucuuacuguggaaaaagcagccgaugucauaugggaagaagaagcggaacaaacugguguaucucacaaucuaaugaucacuguugacgaugacggaaccaugagaaucaaggacgacgaaaccgaaaauauuuugacagugcuacugaaaaccgcccuccuuauaguuaguggaauauucccauacuccaucccugcaacccuauuaguauggcacacauggcaaaaacagacucaaagaagugguguacuuugggacgugccuucuccuccugaaacccaaaaagcagagcuagaagaaggaguauaucgcauaaaacagcaagguauauucgguaaaacgcaagugggagucggcguacaaaaggaaggaguguuucauacgauguggcacgucacacguggagcaguuuuaacucacaaugggaaaaggcuagagccuaacugggcuucagucaagaaagacuuaauaaguuacggcggcggauggcgguuaagugcccaauggcagaaaggugaagaaguacaagucguagccguagaaccggguaagaaucccaaaaacuuucaaacuaugccaggcaucuuccaaacgaccacaggugaaauaggagcaauagcucuagacuuuaagccaggaacaucuggcagcccuauaaucaauagggaaggcaaaguaguugguuuauauggcaauggaguaguaaccaaaaaugguggauauguuagcgguaucgcccaaaccaaugcagaaccugacggaccaacuccugaucuggaggaagaaauguucaagaaacgaaauuuaacaaucauggaucuacacccuggauccggaaagacgagaaaauaucucccagccauaguacgagaagcuauuaaaagaagacuaagaacucuaauuuuggcgccaacgagaguggucgcugcugaaauggaagaagcccuaaagggauuacccauuagauaucagaccacggcaacaaaaucaguucacaccggcaaagaaauaguagaccuaaugugccaugcaaccuuuacaaugagacuccuaagucccguuagaguacccaauuauaaccuaauaauaauggaugaggcgcauuucacagauccagcgucaaucgcagcccguggguacaucucuacucgaguagguaugggagaagcagcggccauuuucaugacagccacaccaccugguacagcugacgccuuuccacaaaguaaugcuccaauacaagaugaagaaagagacauaccagaaagaaguuggaauagugguaaugaauggauuacugauuuugccgguaagacuguaugguucguucccucuaucaaagcggggaaugauauugcgaacuguuuaaggaaaaaugggaagaaaguaauucaauuguccagaaaaacuuuugauaccgaauaccagaaaacuaaauuaaaugauugggauuuuguuguaacaacagauauaucggaaaugggugcaaacuuuaaagcagacagaguuauugacccaagaagauguuuaaaaccaguuauauuaacagacgguccagagagagucauauuagcaggaccuaugccugugaccguugccagcgcagcccagaggagaggaagagugggcagaaauccucaaaaggaaaaugaccaauauauuuuuaccggacagccucucaacaaugacgaagaucacgcucacuggacugaagcaaagaugcuucuagauaacauaaauacaccagaagggauuauacccgcacuuuucgagccggagagagaaaaaucagcagccauagauggcgaguaccgccuuaaaggagaaagcagaaagacuuucguggagcuuaugcgacgaggugauuuaccugugugguuagcacacaaagucgcuucggaggggaucaaguauaccgacaggaaauggugcuuugauggggaacgcaauaaucaaauccuggaggaaaauauggacguagaaauuuggacaaaagagggcgagaagaagaaacucagaccaagauggcucgaugcaagaacuuauucggauccuuuggcauugaaggaauuuaaagauuuugcugcgggacgaaaaaguauagcauuagaccucguuaccgagauuggaagagucccuagccaccuugcuuauagaacucguaacgcacuagauaaucuugugaugcuucauacaagugagcauggaggacgugccuaucgucacgcugucgaagaauugccugagacgauggaaacccuccuuuuacucggucuaaugaucuuacugacaggaggcgcaauguuguucuugauuucgggcaaaggaauuggcaagacaucaauugggcuuauuugcguuguugcaucaagugguaugcuuuggauggcugauguuccgcuucaguggauugcuucggcaaucguacuagaguucuucaugaugguuuuauuaauuccagagccugaaaaacaacgaacgccccaagauaaccaacucgccuauguaguaauagguauacuaacuuuggcagcgauaguggccgcgaaugaaaugggucuauuagagacaacaaagcgggauuuaggaaugaguaaagaaccagguguuguuucaccaaccuccuacuuggacguggauuugcacccggcauccgcauggacacuguaugcaguggcgacgacuguaauuacacccaugcuccgacauacgauagaaaauuccacagccaacguaucuuuagcagcuauagcgaaucaagcaguuguucuaaugggcuuagauaaaggauggccaaucucgaaaguagauuugggcguaccccuguuagcccuagguugcuacagccagguaaauccuuugacauugaccgcggcaguucuacuacuuguaacgcacuaugcuauaauagggccgggauugcaagcaaaagcaacgcgcgaggcccaaaaacgaacggcugcagggauuaugaaaaacccaacuguggauggaaucaugacaauagacuuagacccaguaaucuacgauagcaaauucgaaaaacaacuuggucagguaaugcuacugguuuugugcgccguacaacuuuuacuaaugcgaacaaguugggcauuuugcgaagcacugacuuuagcgacaggccccauaacgacccugugggagggaucaccaggcaaauucuggaacacuacuaucgccgugagcauggccaauauauuucggggaucuuacuuagcuggcgcuggauuagcauucagcauaaugaaaaguguagggacggggaaaagaggaacagguucucaaggcgagacgcuaggcgaaaaauggaagaagaaauugaaccaauuaagucgaaaagaauuugaucuauauaagaaauccgguauaaccgaaguggauagaacagaagcaaaagagggauuaaaaagaggagagacgacccaucaugcagugagcagaggcucggcuaaacuucagugguuuguugagagaaauaugguuaucccagaaggucgggugauagauuuaggcugcggucguggcggauggaguuacuauugcgcaggacucaagaaaguaaccgaagugcgggguuacaccaaaggagggccggggcacgaagaacccguaccuaugucaaccuauggguggaacauuguaaaguugaugaguggaaaagauguauuuuauuuaccacccgaaaaaugugacacguuacugugcgacauuggagaaucgaguccaaguccaaccguagaggaaucgaggacaauaagaguuuuaaagauggucgagccuugguugaaaaauaaucaguuuuguauuaagguacuaaaucccuauaugcccacaguaauagagcaucuagagagauuacaacgcaaacacggcggaaugcuggugagaaacccacuauccagaaauucgacacaugaaauguauuggauaagcaaugguacuggaaauaucguaucuucuguaaauauggugagucgacuacuauuaaaucgauucacaaugacccacagaagaccgacaauugagaaggauguggaccugggagcggguacaagacacgugaaugcugaaccagaaaccccgaacauggauguaauaggcgaacguauuagacggauuaaagaagaacauagcaguacuuggcauuacgaugaagaaaacccguauaagacaugggcuuaucaugguucuuacgaaguaaaagcuacggggucugcuucuucgaugaucaauggugucgucaaauuacuaacaaaaccaugggacguuguucccacagucacucaaauggcuaugacagauacuaccccauuugggcaacagcgaguauucaaggaaaaaguagauaccagaacaccaagaccgaugccuggaacaagaaaagccauggaaauaacggcugaaugguuauggcgaacguuagggagaaauaaacgaccacgcuuguguacucgagaagaguucacaaagaagguccgaacaaaugccgcaaugggagcgguuuucacagaagaaaaucaaugggauagugcacgagcagccguagaggaugaggaguuuuggaaauuaguggaucgugaacgagaauuacauaagcuagguaaaugcgguuccuguguuuauaacaugaugggaaaacgagagaagaaacuaggcgaauuuggaaaagcgaaagggaguagggcuaucugguauaugugguuaggagcgagauaucucgaauuugaggcauuaggguuuuugaaugaggaucacugguuuagucgagagaacagcuuuucugguguagaaggagaaggacuacauaagcuagguuauaucuuacgugacauaagcaaaauuccaggaggggcgauguaugcagacgauacggccggcugggacacuagaaucacagaggaugacuugcacaaugaagagaaaaucacacaacagauggacccagagcacaggcaauuggcaaaugcaauauucaaacugacuuaucagaauaaagugguaaaaguucaaagaccuacaccuaagggaacugucauggauauaaucaguagaaaagaucaacguggaucaggucaaguaggcacguauggucuuaauaccuuuaccaacauggaaguacaauuaauaaggcaaauggaaggugaaggaguauuaucaaaggcagacuuagaaaacccccaucuacuugaaaaagaaauuacccaguggcucgagacgaagggaguagaacgauuaaaaagaauggccaucaguggcgacgauugugugguaaaaccuaucgaugaccguuucgcagaugcacuccuugcauuaaaugauaugggcaaaguaaggaaagacauuccacaguggcaaccuagcaaagguuggcaugauuggcaacaagucccuuuuuguucacaccacuuccaugaauuaauaaugaaggacggcagaaagcuaguaguaccauguaggccccaggaugaauuaauugggagggcccgaauaagucaaggggcuggcuggucacugaaagaaacagcauguuuggggaaagcauaugcucaaaugugggcauugauguauuuccaucgucgugaucuaagauuagcuucaaaugcaauauguagcgcaguaccugugcacuggguaccaacaucgcguacgaccuggaguauccacgcacaccaucaauggaugacgacagaagacauguugacaguguggaauaggguauggauagaagacaauccguggauggaagacaaaacaccagugacaacaugggaagacguuccauaccugggaaagagagaggaucagugguguggaaguuuaauagguuuggcuaguagggccacuugggcccaaaauauucucacagcaauacaacagguccgaagccucauugguaaugaagaguuucuggacuauaugcccucaaugaaaagauuccgaaaggaggaagaaagugagggugcuauaugguga

SEQ ID NO: 23524 - RNA, 9873 nt, Artificial Sequence
  derived and/or modified CDS sequence (opt6) from DENV-3__KC762690__SS-prME
acgucccuaugucuuaugaugaugcuuccugcaaccuuggcauuucaucuaacuuccagagacggggaaccaagaaugauuguuggcaaaaaugaacgcgguaaaucucugcuguuuaaaacagcgagcggaauaaacauguguaccuuaaucgcuauggaccuaggagaaaugugugaugacaccgugacauauaaauguccucuuauaacugaaguggaaccagaagacauugauugcugguguaacuugacaagcacauggguaacguacgguacuugcaaucaagcuggagaacacagacgcgacaaacgaucuguugcucuagcuccgcacgugggaaugggacuugauacuagggcucaaacauggaugucugcagaaggugcauggcgccaaguggaaaaaguggagaccugggcauuuagacacccagguuuuacuauauuggcucuuuuccuggcgcacuacauaggaacuucacucacccaaaaagucgucaucuucaucuugcuaauguuagugacuccgaguaugacuaugcguugcgugggaguaggaaaccgagacuucguagaaggcuugaguggcgcuacauggguugacgucguacuugaacauggaggguguguaacgacuauggccaaaaauaaaccaacacuugacauagaacuccagaaaaccgaagcgacacagcuagcuacguugcgcaaacuaugcaucgaagguaaaauuacgaacgugacuacagauucaagaugcccaacccaaggagaagcaauacugcccgaagaacaagaccagaauuacguguguaaacauacuuacguggaccgugguuggggcaacgggugcggauuauuuggaaaaggcagcuuaguaacuugugcgaaauuucaguguuuagaauuuauugaagguaaaguaguacagcacgaaaaucuuaaauacacaguuauuaucacuguacauacgggagaccaacaccaaguaggaaaugaaacccagggaguaacagcagaaauaacaccucaagccaguacaguagaggcaauauuaccggaauacggaacccuaggucuagagugcaguccacguacaggccucgacuuuaaugaaaugauacuauugacaaugaaaaauaaagcguggaugguccacaggcagugguuuuucgaccuuccuuuaccauggacgucuggagcgaccacugaaacuccaacauggaacaagaaagagcuauuaguuacauucaaaaaugcucaugccaagaaacaagaggucgucguccucgguucccaagaaggcgcaaugcauacugcacuuacgggggccacggaaauucaaacauccggagguaccucuaucuuugcuggucacuugaaaugucggcugaaaauggauaaacuagaacugaaaggcaugucguaugccaugugucuaaacgcguuuguccuaaagaaagagguaucugaaacgcaacauggaaccauuuuaauaaaaguggaguauaaaggcgaagacgcaccaugcaaaauaccauucaguacagaggaugggcaagggaaagcucacaacggaagacuaauaaccgccaauccuguagucacuaagaaagaagaaccaguuaauaucgaggcagaaccaccauuuggcgagucaaauaucguaauaggaauaggggauaaagcgcuuaaaauuaauugguauaaaaagggaucaagcauagggaagauguucgaagcuacagcccgaggugcacgaagaauggcaauuuuaggggacacugcuugggauuucggcucgguagggggaguccuaaacucguuaggaaaaaugguacaccagauauuuggaucggcuuauacagcguuguuuucuggaguaucauggaucaugaaaauagggaucggcguauuguugaccuggauuggucuaaauucuaaaaauacaaguaugagcuuuagcugcauaguaauuggaauaauuacauuauauuuaggcgcuguuguucaagcagauaugggauguguuauaaauuggaaagguaaagaauuaaaaugcgguucugguauuuucguuacaaacgaaguccacaccuggacugaacaguacaaauuucaagcagauucuccuaaaaggcuagcgaccgcuaucgcuggugcaugggaaaauggcguaugcggcauacgaucuaccacccguauggagaaccucuuauggaaacaaauugccaaugagcucaacuauauauuaugggaaaauaacauuaagcucaccguuguaguuggagacaucaucgggguacuugaacaagggaaacgaaccuugaccccacaaccgauggaauuaaaguauaguuggaaaacauggggcaaggcaaaaaucguaacagcagaaacgcaaaacucauccuucauuaucgauggaccaaauaccccggaguguccuucagcuaguagggcuuggaauguuugggaaguagaagacuauggguucggugucuucacuacuaacauaugguuaaaacuaagggaaauguauacacaauuaugcgaucacagacuaaugucagcugccguaaaagacgagagggcaguccacgcggauaugggauauuggaucgaaagucagaaaaacgguaguuggaaauuagaaaaggcaagucuuauagaaguaaagacauguacauggccuaaaucacacacacucugguccaaugggguacuugaaagcgacaugauaauuccuaaaagccuagccgggccggucagucaacacaauuaucgaccuggauaccacacgcaaacggcuggcccauggcauuuaggcaaacuggaguuggauuucaauuauugugaggggacaacuguuguaauuacagaaaauuguggcacucgagguccaucucuacggacaaccacuguaagcgguaaacuuauucaugaaugguguuguagguccugcaccuuaccaccuuuacguuacaugggugaagacgguuguugguacgguauggagauaagaccaauuaacgaaaaagaagaaaauaugguaaagucacucguaagcgcaggaagugguaaggucgauaacuuuacaauggguguuuugugcuuagcaauacuauuugaagaaguaaugagaggcaaauuuggcaagaaacacaugauagcggguguucuguucaccuuuguguuacuauugaguggacaaauaacuuggcgagauauggcacgaaccuuaauaaugaucggaaguaaugcauccgaucgcauggguaugggcguaacauaucuagcuuuaauugcgacauucaaaauccaaccuuucuuggcucuugguuucuuccuccgaaaauuaaccaguagggaaaacuuguuacucggaguaggucuugcuauggcaaccacauugcagcuaccggaagauauagaacaaauggcaaaugguauagcgcuagguuuaauggcccuaaaacuuauaacacaauuugaaacuuaccaauuguggacggcauugguuagucuaauguguucaaauaccaucuuuacccuuacaguggcuuggcgaacagccacuuuaauucuagcugguauaucucuccucccgguaugccagucauccuccaugagaaaaacagauuggcugccuguuacagucgcugcuauggggguaccuccgcuaccguuauuuauauuuucccuaaaagauacauuaaaaagacgcaguuggccccuuaaugagggaguuauggcuguaggccuagucucgaucuuggcaagcucgcuucugagaaaugacguaccuauggccggacccuuagucgcagggggacugcucauagcuugcuauguaaucacagguacuucugcggaccuaaccguugaaaaagcagccgaugucauaugggaagaagaagcggagcagacagguguuagccauaacuuaaugauuacuguagaugaugacggaacuaugcgaaucaaggacgacgaaacugagaacauacuaacaguacugcuaaaaacagcacuucuaauagucagcggcauuuuuccauacaguauaccagcuacucucuuaguauggcauacuuggcagaaacagacacaacggagcgguguucugugggacguuccuucgcccccugagacucagaaggcggaauuagaagaaggaguuuaucguauaaaacaacaagguauauucggaaagacacaaguaggagugggagugcaaaaggaagguguuuuucauaccauguggcacgugacgcguggugcagugcucacccacaacggaaaacguuuagaaccaaauugggcaucuguuaaaaaggaucuuauaucauacggaggagguuggaggcugucagcucaauggcaaaaaggagaggagguacaaguaauagcgguggaaccuggcaaaaaccccaaaaauuuccaaacaaugccaggcauauuucaaacaacuacgggagaaaucggcgcaaucgcguuagauuucaaaccaggaacaagcgguucuccaauuauaaaccgugaggguaaggugguuggacucuacgggaaugguguggucaccaaaaacggagguuauguguccgguaucgcucagaccaaugcagaaccagauggcccgacaccagaauuagaagaagaaauguucaagaaaaggaaccuuacaauaauggacuuacauccugguagcggaaaaacgaggaaguaucuaccagccauaguacgugaagcaauaaaacguagacugagaacuuuaauacuagcaccaacuagaguuguggcagcugaaauggaagaggcccucaaaggcuuaccaauacguuaucaaacuacagcaacaaaaucugcacacacgggcaaagagauuguagauuuaaugugccaugccaccuuuacaaugagauuauuaucaccggugagggucccgaauuauaaucuaauuauaauggaugaagcacacuuuacagauccagccucaauagcagcucggggauauauuucaacucgggucggaaugggugaggccgcggcuauauuuaugacagcuaccccucccggaacagcagacgcuuuuccacagucaaacgcuccuauccaagaugaagaacgcgauauuccagaaagauccuggaauagcggaaacgaauggauuaccgacuucgcaggaaaaacuguaugguucguuccaaguauaaaagcagguaacgauaucgcaaauuguuugagaaagaacgguaagaaaguaauccaauugaguaggaaaacuuuugauacggaguaucagaaaacuaaauuaaaugacugggacuuuguaguaacaaccgauauuucagagaugggcgccaacuuuaaagcagaccgagucauugauccaagaagaugccucaaaccuguuauauuaaccgaugggccggaaagaguaauuuuagcagggccgaugcccgucacgguagcuagugcggcacaacguagaggucgagucggaagaaauccacagaaagaaaaugaucaauauaucuucacgggacaaccccucaacaacgaugaagaucacgcacacuggacugaggcaaagauguuacuugauaacauaaauacuccugaaggaauuauacccgcgcuguucgaaccugaacgggaaaagucagcggcaauagacggcgaauacagacuaaaaggugaaucgcgaaagacuuucgucgaacuuaugcgcagaggugaccuaccuguaugguuagcacauaagguagccucggaagguauaaaauacaccgacaggaaauggugcuucgacggagaaaggaauaaccaaauauuagaggaaaauauggauguugaaauauggacaaaagaaggugagaagaagaaacuacguccucgguggcuggacgcaagaacuuauuccgauccacuagcacugaaagaguucaaagacuucgcagccgguagaaagucuauugcauuagaucuuguuacagagauaggcagaguucccucucaccuggcucaucguacaagaaaugcucuagauaaucugguaauguuacacacaucugaacauggagguagagcauaucgucacgcuguggaggagcugccugaaacgauggaaacacuauugcuguuagggcugaugauuuuauuaaccggaggcgcaauguuguuuuuaaucucuggaaaaggcauagguaaaacguccauaggcuuaaucugcgugguugcaaguaguggaaugcuauggauggccgauguaccacuacaauggaucgcaucagcgauaguguuagaguucuucaugaugguccugcugauacccgaacccgaaaaacaacgcacaccucaagauaaucagcuagccuacguugucauuggaauuuuaaccuuagcggccauuguugcagcuaaugaaaugggucuauuagaaacgacuaaaagagauuuaggaaugucgaaagaaccugguguaguuucacccacaaguuaucucgacgucgauuuacauccagcauccgcauggacacuguacgcaguugcaacaaccgugauaaccccuauguuacgacacacaauagaaaauucgaccgcaaaugucucucucgcggccauugcgaaccaagcaguuguuuuaaugggcuuagauaagggauggccaaucaguaaaauggauuugggugugccauuauuggcacuaggauguuacucucaaguaaaccccuuaacacuaaccgcagcaguacuacuccuaguaacucauuacgcuaucauuggaccuggacuucaggcaaaagcuacccgagaggcucagaaaaggacagcagcugggauuaugaaaaauccgacaguugacgggaucaugacgauagaucuagauccaguaauauacgauagcaaauuugaaaagcaacuaggucaaguaauguuauuagugcuaugcgccguacaguuacuacucaugagaacaucgugggcauuuugcgaggcucuaacacuggcuaccggaccaauaacuacguuaugggaagguucgccgggaaaauucuggaacacgacaauagcagugaguauggcgaauauauuuagaggaucauaccucgccggagcuggcuuagcauuuucuauaaugaaaucaguuggaacuggaaaacgaggcaccggcucucagggagaaacgcugggggaaaaauggaagaagaaacuaaaccagcugucacgaaaagaguucgaccuuuacaagaaaucaggaauaacagaaguagauaggacagaagccaaagaagguuuaaaacguggagaaaucacacaccaugcugucaguagagguucagccaaauuacaaugguuuguggaaaggaacaugguuauaccagaaggaagaguaauagaccucggaugugguagggguggaugguccuauuauugcgcaggacuaaagaaaguuacugagguaagaggauacacaaagggcggacccggucaugaagaaccgguaccaaugucuacauauggcuggaacauaguuaaacucaugaguggaaaagacguauuuuaccuaccgcccgaaaagugugacaccuugcuuugcgacauaggugaaagcucaccuagcccuacugucgaagagagcaggaccauucggguucuaaaaaugguggaaccauggcucaaaaauaaccaguuuugcaucaaaguacuaaacccguacaugccgacgguuauugaacaccuagagagacuacaaagaaagcacggaggaaugcuuguacguaacccacuuucacgaaacucaacgcacgaaauguacuggauaucuaaugguacuggaaauaucguaagcucaguuaacaugguuaguaggcuacuccuaaauagguuuacgaugacacaucgaagaccuacuauugaaaaggauguagaucuuggcgcugguacccgacauguaaaugccgagcccgaaacaccaaacauggacguuaucggcgagagaauuagaaggauaaaagaagaacacaguucgaccuggcauuaugacgaagaaaacccauauaagacaugggcauaucauggaaguuacgaaguaaaagcaacugggagcgcaagcucuaugaucaauggagucguuaaacuauuaaccaagccgugggauguaguaccaacugugacucagauggcaaugacugauacaacaccuuucgggcaacaacggguauuuaaggagaaaguugauaccagaaccccacgaccaaugcccggcacuagaaaagcaauggagauaacagcagaguggcucuggcgaacucuaggaagaaauaagcgcccuagauuauguacgcgugaggaauuuacgaagaaagugagaacaaaugccgcuaugggugccguuuuuacugaagagaaucaaugggauagugcucgcgcagcgguugaagaugaagaauuuuggaagcugguugauagggaacgggaacuucauaaacuaggaaaauguggaaguuguguuuacaauaugauggguaaaagagaaaagaagcuaggagaguucgguaaagcuaaaggaucaagagcuaucugguauauguggcuaggagcuagauacuuagaguucgaggcauugggauuccucaaugaagaccauugguucucgcgcgagaacucguuuucgggcguagaaggggaaggacugcauaaacuagguuacauuuuacgagauaucaguaaaauuccagguggagcaauguaugcggacgacacugcuggaugggauacgcgaauaacggaagaugaucuacauaaugaagagaaaauuacacaacagauggagccagaacaccgacaauuagcaaaugcaaucuuuaaauuaacauaucagaauaaaguugugaaaguacaaagaccuacgccgaagggcaccgugauggauauaauuaguagaaaagaccaacgugguuccggccaaguaggaacguacggguuaaauacauuuacaaauauggaggugcaacugauacgacaaauggaaggcgagggagugcugaguaaagccgaucuagaaaauccacacuugcuugaaaaagaaauuacacagugguuagaaacuaaagggguagaaagacugaaaagaauggcaaucaguggagaugacugugucguuaaacccaucgaugaucgcuuugcugacgcacuuuuagcauugaacgauaugggaaaagucagaaaagauauaccccaauggcaaccaucuaaagguuggcaugacuggcaacaagucccauucuguucacaucauuuucacgaauuaaucaugaaagauggccguaaacuugucgugccaugcaggccacaagaugaacuaauaggcagagcgcgaauuagccaaggcgcaggguggucacuaaaagagacugcaugucuugggaaggcguaugcucaaaugugggcgcuaauguacuuucauagaagagauuugaggcucgcuaguaaugcgaucuguagcgcuguaccgguccauugggugcccaccucccgaacaacauggucaauacacgcacaccaucaauggaugacaacagaagauauguuaacaguuuggaauaggguauggauagaagauaauccuuggauggaggacaaaacuccaguaacgacuugggaagauguuccauacuuaggaaaacgugaagaccaauggugugguaguuuaauuggacuagcuucaagggcaaccugggcucagaacauucucaccgcaauucagcagguaagaaguuuaauuggcaaugaagaauuuuuagacuauaugccuagcaugaaaagguuucgaaaagaagaagaaucggagggggcuauaugguaa

SEQ ID NO: 23525 - RNA, 9873 nt, Artificial Sequence
  derived and/or modified CDS sequence (opt6) from DENV-3__KC762691__SS-prME
acauccuuauguuugaugaugauguuaccggcuacccuugcauuucauuuaacuucaagagacggagaaccacgaaugauaguagguaaaaaugaaagaggaaagagcuuacuguuuaaaacagcaucagggauuaacaugugcacauuaauagccauggaucuaggagaaaugugcgaugauacaguaacauauaaauguccgcuuauuacagaaguagaacccgaagacauagauuguugguguaaccucacaucaacauggguuaccuaugggacuuguaaccaagcuggugaacauagaagagacaaaagaagcguugcuuuggcaccccacguaggcaugggucuugauacuagagcacagaccuggaugagcgcagaaggggccuggcgacaaguugaaaaaguagaaacuugggccuuuaggcauccggguuuuaccauacuggcauuguuuuuagcacacuacauagguacaucauuaacccaaaaaguaguuauauuuauauuacuaaugcuuguuacccccaguaugacgaugcgcugcguaggagugggaaaucgagacuucguugaaggccuuagcggugccacaugggucgacgugguuuuagaacauggaggauguguaacgacaauggcuaaaaacaaaccuacacuggauaucgaauuacagaaaacugaggcaacacaauuagcuacgcucagaaaauugugcauugagggaaaaaucacuaacguaacgacugauucucguuguccaacucaaggcgaggcuauuuuaccugaggagcaagaucaaaacuauguguguaaacacacauauguagauagaggaugggggaacgguuguggccuguuuggcaaaggcagccuagucacaugcgcuaaauuccaaugucuagagcucauugaaggaaaaguaguacaacaugaaaaccuaaaauauacaguaauaaucacuguucacacaggagaucaacaucagguagggaaugaaacacaaggaguaaccgcagaaauaacuccccaagccagcacuguagaggccauuuuaccggaauacggcacacugggauuagaguguuccccaaggacaggacuagauuuuaacgaaaugauucucuuaacaaugaaagauaaggcguggaugguacauagacaaugguucuuugaucuuccacugccuuggacaucaggagcuacuacagaaacaccaacuuggaacaaaaaggagcuguuaguaaccuucaaaaaugcacacgccaagaaacaagaagucgucgugcuugguucacaagaaggagcgaugcauaccgcacuaacuggugcuacagagauacaaacuagcgggggaacuagcauauuugcagggcaucucaaauguagacuaaaaauggauaaacuagaacuaaaagguaugucauauacuauguguucaaacgcuuuuguguuaaagaaagaggucagcgaaacacaacacggaacaauucuaauaaagguggaauacaagggugaagaugcaccauguaagauaccauuuucaacugaggacggucaggggaaagcacacaauggaagauugauuacggcaaacccuguggucacuaagaaagaagaaccugucaacauagaagcagaaccucccuuuggggaauccaacauaauaauagggauuggggacaaagcucuuaaaauuaacugguacaagaaagguucuucgaucggaaaaauguuugaggcuacagcuagaggagcgcgaaggauggcuauauuaggggacaccgccugggacuucgggaguguugguggggugcuaaacagcuuagggaaaaugguccaucagaucuuuggaucagcuuauacagcacuauucucaggcguuucauggauuaugaaaaucggaauagguguguuacuaacguggauagggcuaaacuccaagaacacaucaaugucauuuucauguaucgucauaggcauuauaacucuauacuuaggcgcuguuguacaggcagacaugggauguguaauaaauuggaaaggaaaagagcuaaaauguggaagugguauauucguaacaaacgagguacauaccuggacagaacaguauaaauuucaagccgauagcccgaggagacuagcaacugccauugcaggggcgugggaaaacggaguaugcgggauuagaaguacuacucguauggaaaaccuacuuuggaaacagauagcgaaugaauuaaacuacauacucugggaaaauaauauaaaguuaacaguagugguuggcgauacaauagguguauuggaacaaggcaaacggacucuuacuccacaacccauggaacugaaauauucuuggaaaacuuggggcaaagcaaaaauuguaacugccgaaacacagaacucaaguuucauaauagacggacccaacacucccgaauguccuaaugcaagcagagcauggaacguuugggaaguggaagacuauggguuuggcguauucaccaccaauauauggcuaaaauugagggaaauguacacacaguuaugugaucaccgcuugaugagugcagccgucaaagaugaacgagcaguucaugcagacauggguuacuggaucgagucccagaaaaacgguagcuggaaguuggaaaaagcuagucugauagaaguaaaaacuuguacauggccgaaaucacacacauuguggaguaacggaguacucgaaagcgauaugauuauuccaaaaucauuggcgggaccaaucucacaacauaacuacaggcccggcuaccacacucaaacugcaggaccauggcaucugggaaaacucgaacuugauuucaacuauugcgaaggcacgacaguaguuauaacggaaaauugcggagcgcgaggaccgucuuuacgaacaacgacaguuagcgguaaacuaauacacgaaugguguugucgaaguuguacauugccaccucuccgcuacaugggggaagauggguguugguaugguauggaaauucgccccauaaaugaaaaggaagagaacaugguaaaaucucucguuucagcuggaaguggcaaaguggacaauuucacuauggggguucuauguuuggcuauucuauuugaagaagucaugagagggaaauucggaaagaaacauaugauugcaggaguguuguucaccuuuguauuguuacuaagcggacagauuacuuggagggauauggcucgaacuuuaauaaugauagguuccaaugcaucagacagaauggggaugggugucaccuaucuagccuuaaucgcgacauuuaaaauacaaccuuuucuggcccugggauucuuucuaagaaaguuaaccucaagagaaaaucuauuauuaggugucgggcuugcuauggcaacgacucuacaacugccugaagauauagaacaaauggcuaacggaauagcccuaggauuaauggcauuaaaacuaauuacacaauuugaaaccuaucaacuauggacugcguuaguaucccugauguguaguaauacgauauuuacucucaccguugcauggaggacugcuacuuugauccuggcagggauaucguuauucccaguaugucagucaagcuccaugagaaaaacagacuggcuaccaaugacagucgcagcuauggguguuccaccauugccucuguuuauauucucacugaaggauacacuuaaacguaggucguggccucuaaaugaaggaguaauggcaguuggguuaguuucaauuuuagcauccucauuacugcguaaugauguaccaauggcuggcccucugguagccggugguuuauugauagcgugcuaugugauaacggggacuucugcagacuuaaccguugaaaaagcggcggauguuacaugggaagaagaagcagagcaaacuggcguuucccacaacuugaugauuacuguugacgacgacgggacaaugcgaauuaaggacgaugagacggagaacauccuaaccguacuacuaaagacagcgcuguuaauaguuagcgggauauuccccuauucuaucccggcuacgcuauugguauggcauacuuggcaaaaacagacacagcgcaguggaguacuaugggacguuccgaguccuccugagacucagaaagccgaauuggaggaaggagucuauagaauaaaacagcaagguauuuuuggaaagacgcaaguaggagucggaguacaaaaggaaggagucuuucauacaauguggcaugugacuagaggagcuguacugacuuacaauggaaagagauuagagccuaauugggcauccguaaagaaagacuuaauuuccuaugggggcggauggcguuuaucagcgcaauggcaaaaaggagaagaaguacaagucauugcaguagaaccugggaaaaaccccaaaaauuuccaaacuaugccugguauauuccaaacuaccacaggagaaauuggugccauugcucuagacuucaaaccaggcacauccggaagcccaaucauaaaucgugaaggcaaggugguaggucuguauggcaauggagugguuacaaagaacgggggauauguuucagguauugcgcaaacuaaugcagaaccugaugguccgacccccgaacuagaggaagagauguucaaaaagcgaaacuuaacaaucauggaucuacacccagguucagguaagacuagaaaauacuuaccugccauuguuagagaggcgauaaagcgcagacuaaggacacuaauucucgcaccaacucguguuguagcugccgaaauggaagaagcgcuaaaggguuugccuauaagguaucaaacuacugcaacaaaaagugaacacacugguaaagagauaguggacuuaaugugccacgcaacauuuacuaugagacucuuaaguccuguaagaguaccgaauuacaauuugauuaucauggacgaagcacacuucacugauccggcaucaauagcagcucgaggcuauauuuccacaagaguagguaugggcgaagcagcugccaucuucaugacggcaacuccacccggaacagcagacgcuuucccacaaucuaacgcaccgauccaagaugaggaaagagauaucccagagagaaguuggaacucugggaaugauuggauaacagacuucgcuggcaaaaccguaugguuugugccaagcauaaaggcugguaaugauauugcaaacuguuugcguaaaaacgggaagaaagugauacagcucucaagaaagacauucgacacggaauaccagaaaaccaagcucaacgauugggauuuuguaguaacaacagacauaagugagaugggagcuaacuucaaggcggauagaguuauagacccaagaagauguuuaaagccagucaucuuaacagaugggccggagcgcgugauacuagcuggccccaugccaguaacaguagcgagugcugcccaaagaagaggaaggauuggaagaaacccacagaaagaaaaugaucaguacauuuuuaccggacaaccacuaaauaaugacgaagaccaugcccauuggacugaggcgaaaauguuauuagauaauaucaauacaccugaaggcauuauaccugcacuuuuugaaccggaacgagaaaaaucggcagcgauugacggggaguaccgacugaaaggagaaaguagaaaaaccuuugucgaacucaugcguagaggggacuuaccgguuuggcuugcacacaaaguagcaucagaaggaauaaaauacacagauagaaaaugguguuuugauggugaaagaaacaaucaaauacuugaagaaaacauggacguugaaaucuggacaaaggaaggggagaagaagaaacuuagaccgagguggcuugaugcgcgaacguacucagaucccuuagcauuaaaggaauuuaaagacuucgcagccgguagaaagucaauagcacuagauuugguuaccgaaauuggucgaguuccaagccaccuagcucaccguacaagaaaugcauuagauaacuuagucaugcuacauaccagugaacauggaggacgagcauauagacaugcaguagaggagcucccagagacgauggaaacccuucuacuacuaggguugaugauuuuacucacagguggggccaugcuauuucuaaucuccggaaagggaguggggaagacuucaauaggacuuauaugugucguugcgaguucggguauguuauggauggcggauauuccacuccaguggaucgcaucggccaucguccucgaguucuuuaugauggugcuacuaaucccagaaccugaaaaacaaagaacgccccaggauaaucaauuagcguacguaguaauugggauccuaacacuugcagcaauuguggcugcgaacgagaugggccugcuggaaacaacuaaaagggauuuagggaugagcaaagaaccaggagugguuucuccaacaucuuaucuugacgucgaccuucaccccgcuagugcauggacucuuuacgcaguggccacgacagugauaacaccaaugcuucgucacacuauagagaauagcacugcaaacgugagcuuagcggcaaucgcgaaucaagcgguaguacuuaugggacuagacaaagguuggcccauuucaaaaauggauuuaggcguccccuugcuggcuuuaggauguuauagucagguuaauccauugacguugacagcagcaguguuauugcuaguaacccauuaugcgaucauagggccugguuugcaggcuaaagcaacaagagaagcucaaaagagaacagccgcuggaauuaugaaaaauccaacaguugauggaauaaugacaaucgaucuggauccagugauuuaugacucuaaguucgaaaaacaauuaggacaaguuaugcuucuaguacuaugugcagugcagcuacuucuaaugagaacgucgugggcguuuugcgaagcgcuuaccuuagcaacgggacccauaacuaccuuaugggaagguuccccagguaaguucuggaauacuaccauugcgguaagcauggcaaauauauuuagaggaucguaccuugcuggcgcaggacuugcuuuuucaauuaugaaaucagugggcacuggaaaaagaggaacaggaucacaaggcgaaacacuaggagaaaaauggaagaagaaauuaaaccaacuaaguagaaaagaauuugauuuauauaagaaaagcgguauaacggagguagacagaacagaagccaaagaagguuugaaaagaggcgaaaucacacaucaugcugucaguagaggauccgcaaaauuacaaugguucguugaaagaaauaugguaauuccggaaggacgcguaaucgaucuaggguguggaaggggcggauggucauacuauugugcuggccugaagaaagugacugagguccgagguuauacgaaaggaggaccaggacacgaggaaccaguaccaaugucaaccuacgguuggaacauagucaaacuaauguccggaaaagauguauucuaucuuccuccagagaaaugugacacacucuuaugcgauauuggugaaucaucgccuucgccaacugucgaagaaucucgaaccauaagaguacucaaaaugguugaaccuuggcucaaaaacaaccaauucugcauaaagguauugaauccguauaugccgacuguuauagagcacuuagaaagacuccagaggaaacacggaggaaugcugguaaggaauccguuaucgcgaaauucuacacaugagauguauuggauaaguaacggaaccgggaauauaguaucgucuguuaacauggucuccagacuauugcuaaacagguuuacaaugacuuauagaaggcccacaauagaaaaagacguugaccugggugcagguacucggcauguuaacgccgaaccggaaacacccaacauggacguuaucggagaaagaauccggaggauaaaagaagaacacucgucuacguggcauuaugaugaugaaaacccuuauaaaaccugggcauaucaugggucauacgaagugaaagcaacuggaucagccucaucuaugauaaauggaguuguaaaacuauuaacaaaaccaugggauguaguaccgacuguaacacagauggcaaugaccgauacaacaccauucgggcaacaaagaguuuuuaaagaaaagguugauacacggacaccaaaaccaaugcccgguacuagaaaggucauggaaauuacugccgaguggcuguggaggacauugggccggaauaaacgaccuaggcuguguacaagggaggaauuuacgaagaaagugagaacuaaugcugcuaugggagcaguauuuacagaagaaaaucagugggauucagcaagagcggcaguggaagacgaagaguucuggaaauuaguagaucgagagcgagaauugcacaaauuaggaaaauguggaagcugugucuacaauaugaugggaaaaagagagaagaaacuuggagaauuuggaaaagcgaaaggaucgcgagccauuugguauauguggcuaggugccagauaccuagaauuugaggcuuuagguuuccuaaacgaagaccauugguuuucacgagaaaacaguuauucuggagucgaaggagaaggccuacauaaauuaggguauauucuaagggauauuucaaaaauuccagggggagcuauguacgccgaugauacagcaggcugggauacacgcauuacugaagaugaccuacauaacgaggagaaaauuacgcagcagauggauccagagcacaggcagcucgcgaacgcuauuuuuaagcuaacguaucagaacaaaguaguuaagguacaaagaccgacuccaaaggggacggucauggauaucaucucacguaaagaucagcgagggucaggucaagugggcaccuaugggcugaauacauuuacuaauauggaggcccagcuaauacgacaaauggaaggagaggggguucucucuaagacagacuuagaaaauccacaccuacuagaaaagaaaauaacgcaaugguuagaaaccaaaggaguagaaagacuaaaaaggauggcaauuucgggugaugauugugucguaaagccaauugacgauagauucgccaaugcucuauuagccuugaaugauaugggcaaaguaaggaaggauauaccucaguggcaaccaaguaaaggauggcaugacuggcaacaaguuccguuuugcucgcaucauuuucaugaguuaauaaugaaggacggaagaaaauugguaguuccauguagaccgcaggaugaacuaauaggacgggcaagaauaucacaaggcgcaggguggucauuaaaagaaacagcuuguuuaggaaaggcuuaugcucaaaugugggcauuaauguauuuccacagacgugaucucagacuagcgagcaaugccaucuguucagcagucccaguacacuggguacccacguccagaacaacauggucuauacacgcucaccaccaauggaugacaaccgaagauauguuaaccgucuggaacagaguuuggauagaagacaacccuuggauggaagauaaaacaccaguaaccacaugggaggacgugccuuaccucggaaaacgugaagaccaauggugcggaucacucauaggauuaaccucucgugcuacaugggcacaaaauauacugacagcgauccaacaaguccgaaguuugaucgguaaugaagaauuucuagauuauaugccaaguaugaagcgcuuccgaaaggaagaggagucagagggagcaauaugguag

SEQ ID NO: 23526 - RNA, 9873 nt, Artificial Sequence
  derived and/or modified CDS sequence (opt6) from DENV-3__KC762692__SS-prME
acuuccuugugucugaugaugauguuaccggcaaccuuagcuuuccaccuaacauccagagacggagaaccuagaaugauuguagggaaaaacgaaagggguaaaucauuacuauuuaaaacugcgucggguaucaauauguguacauugauugcuauggaucugggggaaaugugugaugauacaguaacauacaaaugcccucuuauaacagaaguggaaccagaagauauugauugcugguguaacuuaacaaguaccuggguuacauauggaacguguaaccaagcaggagaacauaggagggauaaaaggucuguagcauuggcgccgcacgucggaauggguuuagauacccgcgcacaaacauggaugagugcggaaggagcauggagacaaguggagaaaguugaaacaugggcauucagacauccagguuuuacaauacuugcccuauucuuagcucacuacauaggcacuucauuaacucaaaaaguuguaauuuuuauucuacuaaugcuuguuacaccgaguaugaccaugagaugugucggaguaggaaaccgcgacuucguagagggucuuagcggggcaaccuggguagauguaguauuggagcaugguggguguguaacaacgauggcgaaaaauaaaccaacccuugacauagaacuccagaaaacggaagcaacacaacuugccacccucagaaaauuauguauagagggaaaaauaacgaauguaacuacggauagcagaugucccacccaaggugaagcuauucuaccugaagaacaagaucaaaauuacguguguaaacacacuuacguugauagaggauggggaaauggcuguggacuauuuggaaaaggaucacuugucacuugugcaaaguuccaaugucuugaacuaauugaaggcaaagucguccaacaugaaaaccuuaaauacacaguaaucauaaccguccauacgggugaccaacaccaaguuggaaaugagacucaaggcguuacagcagaaaucacaccucaagcaucgacaguugaagcaauauuacccgaauacgggacuuugggacuggaauguucaccaagaacgggccuggauuuuaaugagaugauucugcuaacgaugaaaaacaaggcuuggaugguacauagacaaugguucuuugauuuaccacuccccuggacgucaggagcgacgacggaaacuccaacauggaacaagaaagaauugcucgugacauuuaaaaaugcccacgcaaagaaacaagaaguaguuguuuuaggaagucaagagggcgcuaugcauacugcauugacaggcgccacugaaauucaaaccucaggaggaacaaguaucuuugcaggccaccuuaaauguagauuaaaaauggauaaacuagaauugaaaggaaugagcuaugccaugugcucgaaugcauucgugcuaaagaaagagguuucggaaacgcaacauggaaccauucuaaucaaaguggaauacaaaggugaggaugcuccuuguaaaauaccuuucucgacagaagaugggcaagggaaggcucauaacggcagauuaauaacagcuaaccccgucgucaccaagaaagaagaaccaguaaauauagaagcugaaccuccuuuuggagaauccaacauaauaauugguauaggugauaaagcucucaaaauaaacugguauaaaaaggguucauccauagggaaaauguuugaagcgacugcacguggggcuagaagaauggcaauucucggugauacagcgugggacuuugguucaguaggagggguuuuaaauucauuaggaaaaaugguucaucaaauauucgguucugcauauacggcauuauuuucagguguaucuuggauaaugaagauugggauagggguucuccuaacuuggauaggguugaacucuaaaaauaccuccaugucauuuaguuguauagugaucggaauaauaacgcuuuaucuaggcgcagugguacaagcagauaugggaugcguaaucaacuggaaaggaaaagaauuaaaaugcggcagcggaauauuuguuacuaaugagguucacacauggacagagcaauacaaauuucaagcagacaguccgaaaaggcuugcaacagccauuguuggagcgugggaaaauggaguguguggcauuagaucaaccacgaggauggaaaauuuacuuuggaaacagauagcaaaugaacuaaauuacauacuaugggagaauaauaucaaacuaacugugguaguaggggauauaauugguguacuugaacaagguaaaaggacauuaacuccacaaccuauggaguugaaauauuccuggaaaacaugggggaaagcaaaaauagugacugcagagauccaaaacaguucuuuuauuauugacggcccuaacacaccagagugcccgaaugccucuagagcauggaacguuugggaaguagaagauuacggauucggcguauuuacgacgaacaucugguugaaacuucgugaaauguacacacaguuaugcgaucauagacuaaugucggcagccguaaaggaugaaagagcugugcaugcggacaugggauauuggauagaaucgcagaaaaaugggaguuggaaacuugaaaaggcaagucugauagaaguaaagacaugcacuuggccgaaaucgcauacuuuguggagcaauggaguauuggaaucggauaugauaauaccaaaaucacuagcaggccccauaagucaacauaauuaccggcccggguaucacacacaaacagcagggccauggcaucucggaaaacuagaguuagacuuuaauuauugugaagggacaacugugguuaucacggaaaauugugggacaagggguccuucacuucgcacuacuacggucagcggaaaacuuauucaugaauggugcugcagauccuguacacuaccgccuuuacgauauaugggggaagauggauguugguaugguauggagauacgaccaaucaacgaaaaagaagaaaauaugguaaagagcuuaguuucagcggggucaggaaaaguugauaauuucacaaugggcguacuuugccuagcuauccuauucgaagaaguuaugcgggguaaauucggcaagaaacacaugauagcuggaguauuauucauguucgucuuauuauuaucuggucaaauuaccuggagagauauggcacgaacauuaaucaugauagggucuaaugcaucugacagaaugggaaugggaguuacuuaccuagcacucauagcuacguucaaaauacaaccauuccuagcccuaggauucuuucuacgaaaacucacgucacgugagaaucuauugcucggugugggucuugcaauggccacaacucuucaacuuccugaagacauagaacaaauggcuaauggaauugcccuaggauuaaugguauuaaagcuaauaacacaauuugaaacuuaccaacuauggacugcacugguaagccuaacuugcucuaacacaaucuucacccuaaccguagcauggagaacggccacauugauuuuagccggcacgagucuucuaccagugugucaaucaaguucgaugcgaaaaacugauugguugcccaugacaguggcagcgaugggcgucccaccauuaccgcucuuuauuuuuagccucaaagacacucuuaagagacggucauggccauugaaugaagguguaauggccguaggccuggucucaauucuugcgucaagucuccuuagaaaugauguuccaauggcagguccguugguagccgguggauuacuaaucgcgugcuauguuauuacaggaacuucggcggacuugacaguugagaaagcugcagauguuacuugggaagaagaagcagaacaaacaggcguuucacauaacuuaaugauaacuguugacgaugauggaaccaugaggauaaaagacgacgaaacugagaauauucucacuguucuacugaaaaccgcacuacuuauuguaaguggaauauuuccuuauucaauucccgcaacucuauuaguauggcauacauggcaaaaacaaacucaacgaucgggaguacuuugggaugugccaucgccgcccgaaacgcagaaagcggaacucgaagaggguguguacaggaucaaacaacaagguauauucggcaaaacacaaguaggcguaggaguucaaaaagagggugucuuccauacuauguggcacguuacaagaggcgcaguccugacauacaacggaaaaagacucgaacccaacugggcaucagucaagaaagauuuaauaucauacggggguggcuggcgacuaucggcacaauggcaaaaaggcgaagaaguacagguaauagcuguugaaccagggaaaaauccuaaaaauuuccaaacaaugccgggcauuuuccagacuauaacgggagaaauaggagcuauugcacuagauuuuaaaccaggcacuucgggaucuccaauaauaaaucgcgaaggcaagguuguaggccuuuaugguaacgguguuguuacuaaaaauggaggguaugucuccggcauugcccagacuaaugcggaaccggacgguccgaccccggagcuagaagaagaaauguucaaaaagcgcaaccuaacuauaauggauuuacacccaggcucagguaagaccaggaaauacuugccgaccauaguaagagaggcgauuaaaaggagauugagaaccuuaauacuagcacccacgagagugguugcggcugaaauggaagaagcauuaaaagguuuaccuauacgauaucaaacaaccgccacuaaaagugagcacacaggaaaagaaaucguagaccuaaugugccacgcaacuuucacaaugaggcuucugucgccaguaaggguaccaaacuauaauuuaauuauuauggacgaagcgcauuuuacugacccugcgagcauugcugcaagaggauauauaucgaccagagucggcaugggcgaagcagcugcaauuuucaugacagcgacaccaccuggaacagcugaugcauuuccacaaaguaaugcuccaauacaagaugaagaaagagacauaccagaacgaagcuggaacagcggcaacgacuggauuacugacuuugcggggaaaacagucugguuuguucccuccauuaaggcuggcaaugauauagcaaauuguuugaggaaaaacggcaagaaaguaauacaguuaaguagaaagacuuucgauacagaguaucagaaaacuaaacugaaugacugggauuucguaguaacuacggauauuagugaaaugggugcaaacuuuaaagcagaucgaguaaucgacccaaggcgcugucucaaaccaguaauccugacugacggcccagaaagaguaauauuagccgggccaaugccuguaaccguugccagcgcagcacaaagaaggggaagaguagguaggaacccccagaaagaaaaugaccaauauauuuuuaccggucaaccuuugaauaaugacgaggaucaugcucauuggacagaagcgaaaauguuauuagauaauauaaacacucccgaaggcaucauccccgcauuguucgaacccgagagagaaaagucugcagcaauugauggugaguauagacucaagggcgaaagcagaaaaacauuuguugaacuuaugcgacguggugauuugcccgucuggcuggcacauaagguagcaagugaggggauuaaauacacugacagaaaaugguguuucgauggugaacgaaacaaccagauacuagaagagaauauggacguagaaauuuggacaaaggaaggggagaaaaagaaacuuagaccaagauggcuggaugcccgaacuuauucugacccauuagcucuuaaagaauuuaaagauuuugcagcaggccgcaaaucuauagcacuagaucucguuaccgaaauagggagaguucccucacaccuagcucacagaacgcgaaacgcacuagauaaccuugucauguuacacacaucagagcacggcggcagagcuuaccgucaugccgucgaagaacuuccagaaacaauggaaacucuccuacuccucgguuuaaugauccuacugacaggaggagcgaugcuguuuuuaauaucugguaaagggguugggaaaacauccauuggacuuaucugugucguagcuucaagugguaugcuauggauggcggauauaccauugcaauggauagccucggcuauaguuuuggaauuuuucaugaugguuuuauuaauaccagaaccagaaaaacaaaggacgccccaagauaaccagcuagcguauguggugauugggauacuuacccuagcugcuauaguggcugcuaaugaaaugggacuucucgaaacgaccaagagagaucugggaaugaguaaagagccaggaguaguaagcccgacaucguaucuugacguagaucuucaucccgcuucagcuuggacauuguaugcuguagccacaacuguaaucacuccgaugcuccgacacacaauagaaaacuccacggcaaaugugucacuugcugcgauagcuaaucaagcaguuguacuaauggguuuggacaagggcuggccgauaagcaagauggauuuagguguaccacuauuggcguugggcugcuacucgcaaguaaacccacuaacacuuacggccgcaguacuacuacuugugacccauuaugcaauuauuggaccugggcuacaggcaaaggcaacgcgagaagcucagaagaggacugcagcugggauuaugaaaaauccgacgguagacgguauuaugacuauagaucucgacccggucauauacgacagcaaauucgagaaacagcuaggccaaguaauguuacucgucuuaugugccguucaacuauuacuuaugcguacauccugggcauuuugcgaagccuugacauuagccacagguccuauaacaacguugugggaagguucucccggaaaauuuuggaacacaacaauagcagucucuauggcuaauaucuuucguggaagcuauuuagcuggagcaggauuggcuuucaguauaaugaaaucaguugguacaggcaagagaggaaccgguagucaaggugaaacucuaggugaaaaauggaagaagaaauuaaaucagcucucucgcaaagaguuugaccucuauaaaaagagcggcaucacugaaguagaucguacggaagcuaaagaaggccugaaacguggugaaauuacgcaccacgccguaagcagagggagcgcaaagcuccaaugguucguagaacguaacaugguuauuccagaaggaagagugauagaucuagguugugguaggggugguuggucguacuauugcgcuggacucaaaaaggugaccgaaguccgaggauauacgaagggaggccccggacacgaagaaccugucccaaugucuacuuacggguggaauauuguaaaacuaaugucagggaaagauguauuuuauuuaccacccgaaaaaugugacacuuuacugugcgacauuggggaaucgagucccuccccuacaguugaagaaucacguacaauucguguguugaagaugguggaaccaugguugaaaaacaaucaguucugcauaaaaguacugaauccauauaugccaacuguuauagaacacuuagaaagacuacaaagaaaacacgguggcaugcuugugagaaacccacugucaagaaauagcacccaugaaauguacuggauuagcaauggaaccggaaauauugugaguagugucaacauggucagucguuuguuguuaaauagauuuacgaugacuuacagacguccuaccauagaaaaagacguugaucuuggagccggaacgagacauguuaaugcagagccagaaacaccuaacauggauguuaucggagaaagaauccgcagaauaaaagaagaacauucuaguacauggcacuaugaugaugaaaauccguauaagacgugggcguaucauggaaguuacgaaguuaaagcaacuggaagugcaucaucaaugauaaauggcguaguuaaacuacugacaaaaccgugggauguaguaccaacaguaacgcaaauggcaaugacagacacaaccccauucggacagcaaaggguguuuaaggaaaaaguggauacccggacgccaaaaccaaugccagggacaaggaaaaucauggaaauaaccgcaggcuggcuauggcgaacauuaggcagaaauaaaaggccgcgauuauguacucgugaagaauuuacuaagaaaguuaggacaaaugcugcaaugggagcgguuuuuaccgaagaaaaucagugggauucagcgagagccgcaguugaagacgaagaauuuuggaaauuaguugauagagaaagagaacuacauaaacagggaaaaugcggauccugcguauacaauaugaugggaaagcgugagaagaaauugggggaauuuggaaaagcaaaggguucgcgggcuauuugguacauguggcugggcgcacguuauuuggaauuugaagcgcucggcuuucuaaaugaggaccauugguucuccagggaaaauucauauuccgguguagaaggggaaggucuacauaaacuugguuauauuuugagagacauuagcaaaauaccagggggagcuauguaugcagaugacacagcagggugggauacgcgaauuacggaggacgacuuacacaaugaggagaaaauaacucaacaaauggauccugagcacagacaacuagcaaaugcaauauuuaaacucacauaucaaaacaagguuguaaaagugcaacgacccacacccaaggguacagucauggacauuauaucucgaaaagaucaaagaggaucaggucaaguggggacguauggucuaaauaccuuuacgaauauggaagcucaacuaauaaggcaaauggaaggcgaagguguccuaucaaagacagauuuagagaacccacaucuacuugagaagaaaauaacccaaugguuagaaacaaaaggagucgaacggcuaaaacgcauggcaauuucaggagaugacuguguuguaaaaccaauagaugacagauucgccaaugcacuacuggcacuaaacgacauggggaagguuagaaaggauauaccucaauggcaaccaaguaaaggauggcaugacuggcagcaagucccauuuuguucucaucauuuucaugaacucauaaugaaagauggucguaauuuaguaguacccugcagaccccaagacgaauugauaggacgugcuaggauaucacaaggcgcggguuggagcuuaaaagaaaccgcaugcuugggaaaggcuuaugcacaaaugugggcccuaauguacuuccauaggagagaucuacgcuuagccucuaaugcaauaugcucugcagugccagugcacuggguaccuacaucaagaacgacauggucuauacaugcgcaccaccaauggaugaccacagagaauaugcuaacaguauggaaccgaguguggauugaggauaaucccuggauggaagacaagacaccaguuaccacuugggaagacgucccuuauuugggcaagagagaagaucagugguguggaaguuugauaggacuaacaucacgagcgaccugggcucagaauauucugacggcaauccagcaagugaggagcuuaauuggaaaugaggaguucuuagauuauaugccaucgaugaagcgauuucguaaagaggaggaaucagaaggagcuauaugguga

SEQ ID NO: 23527 - RNA, 9873 nt, Artificial Sequence
  derived and/or modified CDS sequence (opt6) from DENV-3__JQ920481__SS-prME
acuucccuuugcuugaugaugaugcugccugcaacguuggcauuccacuugacgucuagagacggggagccccggaugauagugggcaaaaaugaacgagguaaaucacuucuguuuaaaaccgcuagugguauaaauauguguacacugauagcaauggacuuaggugaaaugugugacgacacgguuaccuauaaaugcccacuuauuacagaaguugagccugaagacaucgauuguuggugcaauuugacaucuacauggguaacguacggaacuuguaaucaagcaggagaacauagacgugauaaaagaaguguugcauuagccccacacgucggaauggggcucgauacacguacucaaacguggaugagcgccgaaggcgcuuggagacaaguugagaaagucgaaaccugggcuuuucggcauccaggcuuuacaaucuuagcacuauuucuagcacacuauaucgguacgucauuaacacaaaaaguagucauuuucauccuuuuaaugcuaguaaccccaucuaugacaaugaggugcguuggagucggaaacagagacuuuguagaaggacuguccggugcaacauggguggaugucguacuggaacaugggggcugcguuacaacaauggccaaaaacaaaccuacacuugacauugagcuucagaaaacggaagccacacaauuggcaacuuuacguaaacuaugcauagaggguaaaauaaccaacguaacuacagacucucgguguccaacccaaggggaagcaauauugccagaggaacaagaccaaaauuacgucuguaaacacacguaugucgauagaggauggggcaaugggugcggucuauucggcaaaggaucgcuugugacgugugccaaauuucaguguuuagaaagcauagaaggcaaagccguacaacaugaaaaccuaaaauauacuguuauaauaacuguacauacuggggaucaacaccaaguuggaaaugaaacucagggagucacagcagaaauuacaccccaagcauccacuguugaggcaauccuaccagaauacggaacauuagggcuggaaugcagcccuaggacgggcuuagauuucaacgagaugauacuguuaacuaugaaaaauaaagccuggauggugcauagacaaugguucuuugaccucccacuacccuggacaucgggugcuacgacagaaacaccuacauggaauaagaaagaacuauuaguaacauuuaaaaaugcacaugcuaagaaacaggagguuguaguacuaggaagccaagaaggugcaaugcauacagcgcugacaggagcaacagaaauacaaaccaguggaggaacaaguaucuucgcgggacauuuaaaauguagguuaaaaauggauaaacuagaauugaaaggcaugucuuaugcuaugugccuaaacgcuuucguacuaaagaaagaaguuagcgaaacacaacauggcacaauacuaauuaaaguagaauauaaaggggaggaugcuccuuguaaaauaccauuuaguacugaagauggucaagguaaagcgcauaacgguagacuaauaacagcaaacccuauagucacuaagaaagaagaaccggugaacauagaggcagaaccaccuuuuggugagagcaauauuguaauaggcauaggagauaaagcacuaaaaauaaacugguacaaaaagggaucuagcauugguaaaauguuugaggcuacggcaaggggugcucggcguauggcaauacuuggcgacacugcgugggauuuugguucagugggcggaguacuaaacucucuugggaaaauggugcaccaaauuuucggcagugcauacacagcauuauucucaggugucucguggauuaugaaaauuggaauagguguacugcuaacguggauagggcuaaacaguaaaaauacguccaugagcuuuagcuguauaguuauugggauuauuacacucuaucugggugcaguuguccaagcugacauggguugugucauaaacuggaaaggaaaagaacugaaaugcgguuccggcauuuucguaacuaaugaaguacacacauggacagagcaauauaaguuucaagcagauaguccuaaaaggcuugccacagcaauagcgggagcgugggagaauggagucugcggcauaagaagcacaacacgcauggagaaucuucuguggaaacagauagcaaaugaacuuaacuacauauuaugggagaauaauauaaaauuaacagucguuguuggagaugugauaggaguacucgaacaagguaagagaacuuugacuccccaaccaauggaacuuaaguacucauggaaaacguggggaaaggcaaaaauagucaccgcugaaacucaaaauucuaguuuuauaauugacggaccaaauacuccugagugcccaucagcaucaagggcuuggaaugugugggaaguugaagauuauggauucggaguauuuacaacaaacauuugguugaaauuaagagaaauguacacacaacuuugugaccauagauuaaugagcgcugcagucaaagaugaacgggcuguacacgccgacaugggcuacuggaucgagagccaaaagaauggaaguuggaagcuagaaaaagccucauuaauagaaguuaaaaccuguacauggccgaaaagccacaccuuguggucaaauggaguuuuagaaucagauaugaucaucccgaaaaguuuagcugguccuauaucacaacauaauuauagaccaggguaccauacgcaaaccgcaggccccuggcacuuagggaagcuagaauuagacuucaacuacugugagggaacuacagugguuauaacagagaauuguggaacuaggggaccuucucucagaacuaccacaguuaguggaaaauuaauucaugaauggugcugcagaagcuguacuuuaccuccacuuagauacaugggagaagacggaugcugguaugguauggaaauuagacccauuaacgaaaaggaggaaaauaugguaaaaucauuagucucagcugguuccggaaaagcugauaauuuuacgaugggcguauuaugccuggcaauucuuuuugaagaaguuaugcgagggaaauucgguaagaaacauaugauugcaggagcauuauuuacauuuguucugcuacuuucaggucaaaucacauggagagauauggcgcacacuuugauaaugauuggcucuaaugcuagcgacaggauggggaugggggucacuuaccuggcacuaauagcaaccuucaaaauucaacccuuuuuggcacuaggauuuuuccuacgcaaauuaaccucccgugaaaaucugcugcugggagugggccuugcgauggccaccacccuccaauugccggaggauauagaacaaauggcuaaugguaucgcucuuggccuuauggcauuaaaacuaaucacccaauucgaaacuuaucaauuauggacagccuuaguuagucuuaugugcucaaacaccauauuuacguuaaccgucgcuuggagaaccgcaacgcuuauacuugcgguaaucucguuguuaccaguuugucaaaguucaagcaugcgaaagacugauuggcuaccuaugacgguggcagcaaugggagucccuccucuaccacuauuuauuuuuaguuugaaagauacgcugaaaagacgaucauggccucuaaaugaagguguaauggcagucggacuuguaaguauuuuagcuaguucauuucuaagaaacgauguaccaauggcuggaccccugguagcgggaggucucuuaauagcauguuacguuauaacuggaacaucggccgaucuaacagucgaaaaagcagcugauguaacaugggaagaagaggcugaacagacuggcguaucacauaaccucaugauaacgguagaugaugacggcacaaugcggauuaaggaugacgaaacugaaaacauacuuaccgugcuacuaaaaaccgcacuacuuauaguaagcggaauauuccccuauaguauacccgccacuuuauuaguuuggcacacuuggcaaaagcagacucagaggagugguguacugugggacgugccgucucccccugaaacucaaaaagcagaauuagaagaaggcguguacagaauaaagcaacaaggcauauucgggaaaacacagguuggagugggaguacaaaaagaaggaguuuuucauacaauguggcauguaacacgcggagcugugcucacacauaacgguaaacgauuagaaccaaauugggccaacgucaagaaagaucucauaagcuacggcggaggguggaagcuaucagcacaauggcagaaaggugaagagguccaaguuaucgcaguggaaccaggcaaaaaucccaaaaauuuccaaacaaugccaggcauuuuucaaacuacaacuggugaaauuggcgccaucgcucucgauuuuaagccaggaacaagugggucaccaauuauuaauagagaagggaaagucguuggucuuuauggaaacggaguggucacuaaaaacggaggauacgucaguggaauugcucaaacgaacgcagaaccugauggacccacgccugaguuagaagaagaaauguucaagaaaagaaauuuaacuauuauggauuuacauccaggcucagggaagacaaggaaauacuuaccagcuauaguacgugaagccauuaaaagacgacucaggacacuuauauuggccccaacaagaguugucgcugccgaaauggaagaagcgcugaagggauugccgaucagauaucaaacaacagcuacgaaaagugagcacacuggaagggagaucguugaccucaugugucaugcuacauucacaaugagauuacuaucuccagugcguguacccaacuacaauuuaaucgucauggacgaagcgcauuucacugauccugccaguauagccgcucgggguuauauuagcacaagagucggaaugggggaagcggcggcaauuuucaugaccgcuacaccaccaggaacggcugaugccuuuccacaaucaaaugccccaauucaagaugaggaacgggauauucccgaacgaagcuggaacucagggaaugaauggauaacugauuucgcgggcaaaacgguaugguucguccccucaauaaaagcugguaacgauauagcgaauugucuacgcaaaaauggcaagaaagucauucaauuaagcagaaaaacauuugauacagaauaccagaaaacaaaacuaaacgacugggauuuugucguuacaacagacaucagugagaugggugcuaauuuuaaagcagaucgagucaucgauccacgucgauguuuaaaaccugucauucuuaccgacggaccggaacgagucauacucgcaggacccaugccagugacaguagcgucugcagcccaaaggcgaggacgagucgguagaaacccucaaaaagaaaacgaucaauacauauucacuggucaaccccuuaacaaugaugaggaucacgcccacuggacggaggcuaaaauguuauuggauaacauuaauacucccgagggaauaauaccagccuuauuugaaccggaacgagagaaaucggcggcuauagauggugaauacagacuaaaaggggagagucggaaaacguuuguggaauuaaugcggagaggugaccucccaguaugguuggcccacaagguugcaagcgaagguauaaaguacacagaucguaaaugguguuuugauggggagagaaacaaccagauauuggaggaaaacauggauguagagauauggacaaaagagggcgagaaaaagaaacuucgaccgagauggcuugaugccagaacuuauucagacccauuggcacugaaagaauuuaaagacuuugcagcaggaagaaaaucuauugcccuagaucugguuacugagauaggucgaguccccucacaccuagcacauagaacacgaaacgcgcuugacaaccuuguaauguuacauaccucagaacauggugguagagcguauagacaugccguagaagaauugccggagacuauggaaacacuacuuuuauuaggucugaugaucuuacuaacaggaggggccaugcucuuucuaaucagugguaaagguauuggcaaaacgucgauugguuugaucugcgucguugcuucuucaggaauguuguggauggcagauguaccauugcaauggaucgcaagugcaauagugcucgaguucuuuaugaugguuuugcugauaccggaaccggaaaaacaacguacaccucaggauaaucaauuagcuuaugucgugauuggaauacuaacucuggcagcuauaguagccgcuaaugaaaugggacuuuuagaaacaacaaaaagggauuuaggcauguccaaagaaccaggagugguaaguccgacaucauauuuagacguugaucugcauccggcaucugccuggacacuuuacgccgucgcgacuacugugauaacaccaauguugagacacacaauugaaaauucuacagcuaacgucucucuggcagcuauagcuaaucaagccguuguacuaaugggacuagacaaaggcuggccgaucuccaaaauggaccuaggcguaccacuacuugcccuuggcugcuacagucaaguaaauccacuuacguugacagcagcugucuuacuccuagucacgcauuaugccauaauaggaccuggacuucaggcuaaagcuacaagagaagcgcagaaaagaacagcagcgggaauuaugaagaauccuacuguagauggaaucaugacaaucgacuuagaccccguuauuuaugauaguaaauuugaaaaacaauugggacaagugauguugcuaguacuuugcgcuguucaacuuuuauuaaugaggacgucaugggcauuuugugaagcguuaacgcuggcaacggguccaauuacuacauuaugggagggaucaccaggaaaauuuuggaauacuaccauugcaguaagcauggcuaauauuuucagaggcaguuauuuagcaggggcgggacuagccuuuucaauaaugaaaucgguagguacaggcaaacgaggaacagguucgcagggagagacacugggggaaaaauggaagaagaaauuaaaucaauuaucgcguaaagaauuugaucuauauaagaaaucggguauaacagaaguugauaggacggaagcaaaagaaggacuaaaacgaggugaaauaacucaucaugccguaaguagagggucugcuaaguuacaaugguuuguagaacgaaacaugguaauccccgaaggaagggucauagaucucggcugcggcagaggaggguggucguauuacugcgcuggauuaaagaaaguuacagaaguacgcggcuacacuaaaggcggaccaggacaugaagaaccgguucccaugucaacguauggcuggaauauagugaaguuaaugucugguaaagacguauuuuaccugccgccagagaaaugugacacuuuacuaugugauauaggagagucaagucccuccccgaccgucgaagaaaguaggacuauucgugucuuaaaaaugguugaaccuuggcugaaaaauaaucaauucugcauaaaggugcuuaauccguauaugccaacgguuauagaacaucuagaaagacuccaaagaaaacauggagguaugcuaguaagaaacccauuaucgagaaauaguacccacgaaauguauuggauaagcaacggaacaggcaacaucguaagcucugugaacaugguaucaagacuacuguuaaaucguuuuacgaugacccaccgacggccgaccauagaaaaagacguagaucugggugcagggacaagacaugucaaugcggaaccugaaaccccaaacauggauguaauuggugaacguauccggcgaauuaaagaggagcacuccucaacuuggcauuaugaugaugaaaauccguacaaaacaugggcauaucacgguucauacgaaguaaaagccacaggaucugcaaguuccaugaucaacgggguuguaaagcuacuaacaaaaccaugggauguagugccuauggugacacaaauggccaugaccgauaccacuccauucggucaacaacgcguauuuaaagaaaagguagacacgcgcaccccacgcccaaugcccgguacaagaaaaguuauggagauaaccgcagaauggcuuuggcgcacccucggacguaauaaacguccaagacucuguacuagggaggaauuuaucaagaaaguuagaacuaacgcugcgaugggugcaguguuuacugaagaaaaucagugggauucagcuagagcugcaguugaagacgaagaauuuuggaagcuaguugaucgggaaagagaacugcauaaacuaggaaaguguggaucuuguguuuauaacaugaugggaaaacgugagaaaaaguuaggugaguuuggaaaagcgaaaggaucaagagcaauaugguauaugugguuaggagcacgguaccuagaauuugaagcucuuggauuuuuaaacgaagaccauugguucagucgugaaaauucguauagugguguugaaggugaaggacuacauaaacuaggcuauauucuuagagauauaaguaagauuccagguggcgccauguacgcugacgauaccgcugggugggacacaaggauaacagaagacgaucuacacaaugaagaaaagauaacgcaacaaauggacccagaacauagacaguuagcaaaugcgauuuuuaaauuaacguaccaaaacaaagugguaaagguucaaagaccuacgccuaaaggaacagucauggacauuaucaguagaaaagaucaacggggaaguggucaaguggggacauauggucucaacacuuucacaaacauggaggcgcaauugauuagacaaauggagggugaaggaguauuauccaaagcggaucuagaaaacccacacuuauuggagaagaaagugacccaaugguuagaaacuaaaggaguagaacgacucaaacguauggcaauauccggagaugauugcgugguaaagccuauugaugaccgguucgcaaacgcgcuucuggcacuaaaugauaugggaaaaguaaggaaagacauaccacaauggcagccaaguaaaggauggcaugauuggcagcagguacccuucuguagccaccacuuccaugaacucauuaugaaggaugggagaaaacuggucgucccauguagaccacaagacgaauuaauagggagagcuagaauuucacagggugcaggcuggagcuugagagagacggcaugcuuagguaaagcguaugcacaaaugugggcuuuaauguauuuucaccgaagagaccugcgauuagcuuccaaugcgauauguuccgccgucccugugcauuggguaccaacaucacgaacuacauggaguauucacgcgcaucaccaauggaugacuacugaagauaugcuaaccguuuggaaccguguuuggauagaagauaaccccuggauggaagacaagacgcccguaacaacaugggaagacgugccguauuuaggcaagagagaagaccagugguguggaucauuaauaggcuuaacauccagagccaccugggcacaaaauauacuaacagcaauacagcaaguuagaucucucauaggaaacgaagaguuuuuagauuacaugcccucaaugaaaagguuuaggaaagaagaagaaucugaaggugcgaucugguag

SEQ ID NO: 23528 - RNA, 9873 nt, Artificial Sequence
  derived and/or modified CDS sequence (opt6) from DENV-3__JQ920483__SS-prME
accagucuuuguuuaaugaugauguuaccagcaacguuggcuuuccaucuaacaucgagagauggagaaccgagaaugauagugggcaaaaaugagcgugguaaaagucuacuauuuaagacagcuucagggaucaauaugugcacacuaauagcaauggaucuaggagagaugugcgacgauacaguuacauacaaaugcccguuaauuacagagguugaaccagaggacauagauugcuggugcaauuugacaaguacauggguaaccuacggaacauguaaccaagcaggagaacaucgccgggauaagagaucuguggcauuagcgccacacgucggaaugggacucgacacccgcacucagacauggaugagcgccgagggugcauggcgccagguugaaaagguggaaacuugggccuucagacaucccgguuuuacuauuuuagcacucuuuuuagcacacuauaucgguacaagcuuaacucagaaaguugugaucuucauauuacuaaugcuuguaacgccaucuaugacaaugagaugcguuggggucgggaaucgagacuuuguugagggacucucgggggcaacauggguugauguagucuuggaacacggcgggugugugaccacgauggcuaaaaauaagccaacucuggauaucgaacuacaaaaaacugaggcuacacagcuugcgacauuaagaaaacuuugcauugaaggcaaaauaacaaaugucacaaccgacucacguuguccgacacaaggagaagccauuuuaccagaagaacaaaaucaaaacuacguguguaagcauacauauguugaccgagguugggggaaugguugugguuuguucgguaaaggcagcuuaguuacuugugcuaaguuccaguguuuggagucaauagaaggcaaagccguucaacacgagaacuuaaaauacaccguaaucauaacgguacacaccggugaccaacaucaagugggcaacgaaacucaaggggucacugcggagauuacaccccaagccagcaccguggaagcuauacugccggaauacggcacucuuggauuggaauguaguccaagaacugggcuagauuuuaaugagaugauccuacuuacuaugaaaaacaaagcauggaugguacacagacagugguuuuuugacuuaccauugccauggaccuccggcgcaacaacagaaacaccaaccuggaauaagaaagaacuacugguaaccuuuaagaaugcucacgcgaaaaaacaagaaguaguaguacuuggaagucaggagggggcaaugcauacagcacucacaggcgcgacggaaauacaaacgagcggcgggaccucgauauuugcaggccauuugaaaugucgacuaaagauggauaaacuugaauugaaagggaugagcuacgcuaugugucuuaacgcauucguucuaaaaaaagaaguuucagaaacacagcauggcacaauauugauuaaaguagaauacaagggcgaagaugccccaugcaaaauaccauucaguacugaagacggacaagguaaggcucauaauggccggcuuauaacagccaauccaaucguuaccaaaaaagaagagcccgugaauauagaggcugaaccaccauuuggugaaagcaauauagugauagguauaggcgauaaagcauuaaaaauaaauugguacaaaaaagguagcuccaucgguaagauguucgaagcaaccgcacgaggggcacguagaauggcuaucuugggugauacagcuugggacuucggaucuguuggcgggguacucaauagccuuggaaaaaugguucaccaaauuuuuggaucggcuuauacugcucuauuuucagguguaagcuggauaaugaaaauuggaauaggcgugcucuuaacauggauugguuuaaacucgaaaaacacgucgaugaguuuuucguguauugucauagguaucauaaccuuauacuugggugcagugguucaggcugauaugggcugcguuauuaauuggaaaggaaaagaguuaaaauguggaucagguauuuucguaacaaacgaaguccauacguggacugagcaauacaaauuccaagcagauucuccaaagcgacuugcaacugcuaucgcaggagcaugggaaaacgguguguguggaauucguagcacuacacgaauggaaaaccucuuauggaaacaaaucgcgaacgaacucaauuacauucuaugggaaaacaauauaaagcuaacuauaguggucggagauguaauuggcguguuggagcaagguaaaaggacauuaacaccccaaccuauggaacucaaauacucauggaaaacaugggguaaggcaaagauaguaacagcagaaacacaaaauaguucauucauuauagacggucccaauaccccagaauguccaagcgcuagccgugcauggaacguaugggaaguugaagauuacggcuuuggaguuuucacgacuaauauauggcuaaaguugagagagaaauacacccaauuaugugaccacagguuaaugagugcagcagugaaagaugaaagggcuguacacgccgacaugggcuauuggauagagucgcagaaaaacggauccuggaaauuggaaaaagcuuccuuaaucgaaguaaaaacauguacauggccaaaaucccacacgcuuuggucaaacgguguccuugaaucggacaugauaaucccgaaaaguuuagcaggaccuaucucacaacauaauuauagaccuggcuaccauacccaaacagcagguccuuggcaucuaggaaaguuagaauuagauuuuaacuacugugagggaacaacagucgugaucacggaaaacuguggaauuagaggaccgucccugagaaccaccacagucucuggaaagcuaauacaugaaugguguuguaggucauguacgcucccaccccuccgauacaugggagaggacggauguugguacggcauggagauucgaccgauuaaugaaaaggaggaaaacaugguaaagucacuagucucagcuggcucaggcaaaacagacaauuuuacuaugggcguguuaugcuuagccauccucuucgaagaaguaaugagagggaaauuuggaaaaaagcauaugauugccggugcauuauuuacguucguacugcuucuaucagggcaaauaacauggcgggauauggcucacacauuaauaaugauuggauccaaugccagcgauagaaugggcaugggagucaccuaucuugcacuuauagcgacauucaagauccaaccuuuuuuagcacuuggauuuuuccuaagaaaauuaacaagcagagaaaaucuucuauuaggagugggucuugcaauggcuaccacauugcaguugccagaagauauugaacaaauggcuaauggcaucgcucuaggauugauggcuuuaaaacuuauaacacaauuugaaacauaccaauuguggacagcacuuauuaguuugauguguucgaauacaauauuuacuuuaacaguagcuuggagaacggcaacacucauauuggcaguuauuucgcucuuacccguuugucagaguucaucaaugaggaaaaccgauuggcucccaaugacagucgcagcgauggggguaccacccuugccguuauuuauauuuagucucaaagauacucugaaaagacgcaguuggccauuaaacgaaggugucauggcaguuggacuagugucuauauuagcuuccucguuuuuaagaaacgauguuccaauggcggggccguuaguugcaggcggauuguugaucgccuguuacgucauaacuggcacaucggcggacuuaacuguggaaaaagcagcagaugucaccugggaagaagaggccgaacaaacaggcgugagucacaacuuaaugauaaccguagacgaugauggaacgaugcgaauuaaggacgacgagacggaaaauauccuaaccguacuuuuaaagacagcacuacucauaguaagugggauauuuccauacucuaucccagcaacauuacuaguuuggcauacuuggcaaaaacaaacacaaaggagugggguauugugggacgugccgaguccaccagaaacucaaaaagcagaacuagaagaaggcgucuacagaauaaaacaacaaggcauauuugguaaaacacaaguaggaguggggguacagaaagaaggcguauuucacacuauguggcacguaacgcgaggugcaguguugacccauaauggaaagcgacuagagcccaauugggcuaacguaaaaaaagacuuaauaucauaugggggaggauggaaacugucggcgcaauggcaaaaaggagaagagguccaaguaauagcaguagaaccagggaaaaacccaaaaaauuuccagacgaugccggguauauuccaaacaacaacuggagaaaucggggcgaucgcguuagacuuuaaaccgggaacgucuggcucuccaaucaucaauagagaaggaaaaguaguuggauuauauggaaaugguguuguaacaaaaaacggugguuauguuucggguauugcgcaaacuaaugccgaaccagaugguccaacgccugaauuagaggaagagauguuuaagaaaagaaaucuuacaauaauggaucuacauccgggaucaggaaagacuagaaaauaucucccugcaauaguacgcgaagcuauaaagagaagacuucgaacucuuaucuuagccccuacacgaguuguugcagcagaaauggaagaagcauugaaaggacuccccauucguuaccaaacaacagcgaccaaaucugaacacaccggcagagagauaguggaucuaaugugccacgcaaccuuuacaaugaggcuccugucuccuguacguguuccuaauuacaauuuaauuguaauggacgaagcccauuuuacagaccccgcgaguauugcagcucgagguuacauaucaaccagaguugguaugggagaagcagcagcaauauuuaugaccgcaaccccaccggggacugcagaugcauuuccacaauccaaugcucccauacaagacgaagaacgggauauccccgaaagaaguuggaauucggggaaugaauggaucacagacuuugcagguaagacggugugguuugugccauccauaaaggcggguaacgacauagccaauuguuugcgaaaaaaugguaaaaaaguuauucaacuaagucgaaagacguucgacacugaauaucagaaaacuaaacugaacgacugggauuuuguaguuacaaccgauauuucugagaugggugcaaacuucaaagcugauagaguuauugacccacguaggugccuuaaaccagugauacucacagaugguccagaacguguaauucuugcgggaccaaugccuguaacgguagcuucggcagcgcaaagaagaggcagagucggaaggaauucccaaaaagaaaaugaucaauacauuuucacagggcaacccuugaacaacgaugaggaucaugcucacuggaccgaggcaaaaaugcuccuggauaauauaaauaccccagaggguauaaucccggcauuauuugaacccgaacgugagaaaucagcagccauugauggcgaauaucgcuuaaaaggugagagcagaaaaacauuugucgaauugaugagaagaggugaucucccagucuggcuagcacauaagguagcaucugaaggaaucaaauacacagauaggaaauggugcuuugauggugaacgcaacaaucagauucuagaagaaaauauggauguagaaaucuggacgaaagaaggagaaaaaaaaaaacuacgaccaagaugguuggacgcaagaacauauagcgauccuuuggcgcuaaaagaguuuaaagauuucgcugcgggccgcaaaagcauagcguuggaccuugugacggaaauaggaagaguaccaagucacuuagcucaucgaacuagaaaugcacuagauaaucuaguaaugcuucacacauccgaacauggggguagagcauauagacacgcuguugaagaacuaccagagacuauggaaaccuuauuauuguugggccuaaugauacuccugacagggggagccaugcuauuccugauaucugguaaagggaucggaaaaacaucgauuggucuaauuugcgucguagccaguucaggaauguuauggauggccgacguaccauuacaauggauagcgucagcuauaguuuuggaauuuuucaugaugguccugcugaucccagaaccagaaaaacaaagaacaccacaagacaaucaauuagccuauguaguuauugggauucuuacauuagcagccauagucgccgcaaacgaaauggggcugcuugaaacuacgaaacgagaucucgguaugucuaaagaaccaggcguggugucuccuacuucuuauuuagacguagaucuacacccagcaagugcauggacacuauacgcgguagcaaccacaguaaucacgccaaugcuuagacacacuaucgaaaacuccacagcaaacguaucauuagcggcaaucgcaaaccaagcugugguacugauggggcucgacaaagguuggccuauaucaaaaauggauuuagguguaccuuuauuggcucucgguuguuacagccaagugaaccccuuaacccugacugcugcggugcuuuuacucguaacucauuacgcaaucauaggccccggacuccaagcaaaggcaacacgugaggcucaaaaaagaacagcugcaggaaucaugaaaaauccgacaguagacggaauaaugacaauagaucuagauccaguuaucuacgauagcaaauuugaaaaacaacugggucagguaaugcuucuuguacuaugugcgguucaacugcuacuaaugagaaccaguugggccuucugugaagcacuaacucuggcuaccggccccauaacaacgcuuugggagggaagucccggcaaauucuggaacacaaccauagcuguaucgauggcaaacaucuucagagguagcuauuuagcgggagcagggcuggcuuuuucuauuaugaaaucaguaggaacuggaaagagaggcacugguucucaaggagaaacuuuaggagaaaaauggaagaaaaagcugaaccaacuaaguagaaaagaauuugauuuauauaagaaaucuggaauaacagaaguugaucggacagaagcuaaggaaggccuuaaaagaggagaaauaacgcaccacgcgguauccagagguagcgccaaauuacaaugguuuguggagagaaauaugguaauaccggaaggacgugugauugaucuagguuguggacgagguggauggucauacuauugugcuggacuaaaaaaaguaacggagguacgagguuacacaaagggggguccuggacaugaagaacccguuccuaugucuaccuauggcuggaauauagugaagcuaaugaguggaaaagaugucuucuaucucccaccugaaaaaugugauacgcuccuaugugauauaggugaauccucaccuucgccgacaguugaggaaucaaggacgauacgaguauugaagaugguugagcccugguugaaaaauaaccaauucuguauaaaaguauuaaacccauacaugccaacagucaucgagcacuuggagagauuacaaaggaaacauggggggauguuaguacgcaauccacuaucaagaaacucgacccaugaaauguauuggaucagcaacggaacuggaaacaucguaucuucuguaaauaugguauccaggcuccuuuugaauagauuuacuaugacacaccgucggccuacaauagagaaagacguagacuugggagcaggaacuagacacguaaaugcggaacccgaaacaccgaauauggacgucauaggggagaggaucaggagaauuaaagaagaacauaguaguaccuggcacuaugacgaugaaaauccuuauaaaacgugggcauaccacgguagcuacgaggugaaggcuacaggaucagcgucaaguaugauaaaugguguaguaaaauuacugacuaaacccugggaugucgucccaauggucacgcaaauggccaugacugauacaacaccguuuggucagcaaagaguuuuuaaagaaaagguugacacgcggacaccacgcccgaugccgggaacgcguaaaguaauggaaauaacugccgaguggcuauggcgaacacuugggcguaacaagaggccacgacuguguacccgagaagaauucauuaagaaaguaagaacaaacgcugcuaugggagcgguauuuacugaagaaaaucaaugggauucagcacgagcugccguagaagaugaagaauucuggaaacuaguagacagagaaagagaacuccacaaauugggaaaguguggaagcuguguuuacaauaugaugggaaaaagagaaaaaaaacuaggagaguucggcaaagcaaaagguagccgagcuauaugguauaugugguuaggagcccguuauuuagaguuugaagcucuagguuuuuuaaaugaagaccauugguuuucuagggaaaauucucauaguggaguugaaggagaggguuuacacaaacuuggauauaucuuaagggacauuucgaagauuccaggcggagcgauguaugcugaugauacggcaggaugggacacaagaauuacagaagaugaucuucacaaugaagaaaaaauaacacaacagauggauccagagcaccgucagcuagcaaacgccauauuuaagcugacguaucaaaacaaggucgugaaaguucaacguccaacacccaaggguacaguaauggacauaaucagucgcaaagaucaaagagguucaggccagguuggaacuuacggacucaauaccuuuacaaauauggaagcucaacucauucgucaaauggaaggggagggaguccuuuccaaagcagacuuagagaauccacaccuguuagagaggaaagucacgcaauggcuagaaacaaagggcguagaacgacuaaagcggauggcaauuucaggagaugauugcguaguaaaaccgauugaugauagauuugccaacgcgcugcuagcucuuaaugacaugggaaaaguaagaaaagauauaccccaguggcagcccucgaaagguuggcacgacuggcaacagguaccauuuuguucacaucacuuccacgaacugauuaugaaagauggaaggaaacuuguagugcccugucgcccacaggacgagcugauagggagagcucguaucagucaaggagcuggcuggucuuugagagaaacagcauguuuggguaaggccuacgcacaaaugugggcucuaauguacuuucaccgaagggaucuacgauuagcaucuaaugcuauauguucagcgguacccguucacugggucccgacaucaaggacaaccuggucgauacaugcacaccaccaguggaugacuacggaagacauguuaacaguauggaaccgaguguggaucgaagauaauccauggauggaagacaaaacaccgguaacaacgugggaagacguaccuuaucucggcaaacgagaagaucaauggugugguucauugauaggacuuaccucccgagcaacgugggcacaaaauauccugacagccauccaacaaguccgcagcuuaauaggcaaugaggaauucuuggauuacaugccauccaugaaacgcuuucgaaaagaagaggaauccgagggugccauaugguaa

SEQ ID NO: 23529 - RNA, 9873 nt, Artificial Sequence
  derived and/or modified CDS sequence (opt6) from DENV-3__JQ920482__SS-prME
acgucauuaugccuuaugaugaugcuccccgcgacucucgcauuucaucuuacaucaagggacggagaaccaaggaugauaguaggcaaaaaugaacgagggaaaucguuguuauuuaaaacggcaagcggaauaaauauguguacacuuaucgcaauggauuugggugaaaugugugacgauacuguuacauauaaauguccgcuuauaacagaagucgaaccggaagauauagauugcuggugcaacuuaacuucuaccuggguaacauauggaacaugcaaccaagcuggugagcacagaagggacaaacguaguguagcucuagcaccccacgucggaaugggcuuggauacgcgcacucaaacuuggauguccgcugaaggugccuggagacaaguagagaaaguggaaacuugggcauucagacacccgggauuuacgaucuuagcauuauuccuggcgcacuacauagguaccagcuuaacacagaaaguuguaauauucauuuuguuaaugcucguaacuccaucuaugacuaugaggugcguagggguugguaaucgcgacuucguagaaggccuuucaggcgcgacuugggucgauguugugcuagagcacggaggaugcgucacaacgauggcuaaaaauaaaccaacuuuagauauugaacuacagaaaacugaagcuacucagcuagcaaccuuaagaaaacuaugcauagagggaaagauaaccaauguuacaacagacaguagauguccaacgcagggcgaagccauacuuccggaagaacaagaucaaaacuaugucugcaaacauacguacguugacagagguuggggaaacggaugcggccucuuuggaaaagggagccuuguaacaugugcgaaguuccaaugucuugaaaguauagagggaaaagcggugcaacaugaaaaccuaaaguacacagucaucauuaccguucacacaggagaucagcaucagguuggaaaugaaacacaaggagugacagcugaaauaacgccccaagcgucuaccguagaagcuauauuacccgaauaugguacacugggauuagaaugcucuccgcguacaggauuagauuuuaaugagaugauacuacucacgaugaaaaacaaagccuggaugguccacagacaaugguucuuugaucuuccccucccuuggacuagcggagcuacuacagaaacgcccaccuggaauaagaaagaguuauuggugacauuuaagaacgcacaugccaagaaacaggaaguaguaguauuagguagucaagaaggugcaaugcacacugcacugacaggcgcaacugaaauacaaacgaguggaggaacaucuauuuuugcaggucacuugaaaugcagauuaaaaauggauaaacuugaacuuaaagguaugagcuacgcaauguguuuaaaugcauuugugcuuaagaaagaaguaagugaaacccaacaugguacuauuuugauaaaaguagaguauaaaggugaagaugcucccuguaaaauacccuucucaacagaggacggccaaggaaaagcacauaauggucguuuaauuacagcaaacccaauuguuaccaagaaagaggaaccaguuaacaucgaggcagaaccucccuucggagaguccaauaucguuauagguauuggagacaaagcauuaaaaaucaauugguacaagaaaggaucgucgauuggaaaaauguuugaagcaacugcaagaggugcacgacguauggcaauacuuggagauaccgcaugggacuuuggaucagucggaggcguauugaacucuuuaggcaaaaugguacaucaaauauuugggucagcuuacacagcuuuguuuucuggcguauccuggaucaugaaaauugguauaggaguccucuuaacuuggauuggauuaaacagcaaaaauacuucuaugucauucagcuguauaguuaucggaauaauaacuuuguacuuaggagcaguaguucaagcagauaugggauguguaauuaacuggaaagguaaagaacuaaaauguggcaguggaauauuugucacgaaugaaguucacacuuggacagagcaguauaaauuucaagcggacagcccuaagagacuugccacggcaaucgcuggugcuugggaaaauggaguuugcgggauaagauccaccacccgcauggaaaaucuucuauggaaacaaauugcuaaugaauugaauuauauuuuaugggaaaacaacauuaagcuaaccauagucguaggugauguuauagguguauuggaacaagggaaaaggacacuaacgccucaaccgauggaguuaaaauauaguuggaaaacuugggggaaggcaaaaauagugacagcagagacacaaaacucauccuucauaauugacgguccuaauacaccugaguguccauccgcaagccgagcguggaacguaugggagguagaagauuaugguuuuggaguuuucacuacgaauauauggcuaaaauuaagagaaaaguacacacaguuaugugaucauagauuaaugagcgcagcuguaaaagaugaaagagcaguccacgcggacaugggauauuggauagaaucucagaaaaacggaagcuggaaacuugaaaaagcaucacuaauagaagugaaaacguguaccuggcccaaaagucauacacuguggucgaauggaguacuagaauccgacaugauaauuccaaaaucacucgcaggcccgauuucacagcauaauuaccguccagguuaccauacucaaaccgcuggaccuuggcaucucgguaaacuagaacucgauuucaacuauugcgaaggaaccacgguuguaauaaccgaaaauugcggaaucagggggcccaguuuaagaacuacgacagucucagguaagcuaauccacgaaugguguuguagaaguugcacacuuccacccuuaagauacaugggagaagauggguguugguacggaauggaaauacgacccauuaaugagaaggaagaaaacauggucaagagucuagugucagcagggaguggaaaaacagacaauuucacaaugggagucuuaugccuagcaauacuuuuugaagagguaaugagaggcaaauuuggcaaaaagcacaugauugccggugcucuauucacguuuguguuacugcuaaguggacaaauaacauggagggacauggcccauacuuuaauuaugauaggcuccaacgcaagcgacaggauggguaugggugugacauaucuagcacuaauagcaaccuucaagauacaacccuuucuagcguuaggauucuuuuuacgcaaacugacuucgcgugagaacuuacucuuagggguggguuuagcaauggcuaccaccuuacaacuaccagaagauauagaacaaauggcgaauggaauagcauuaggccuuauggcuuuaaaauugauuacacaauucgagacauaccaacuuuggacggcacuaauaucucuaaugugcuccaacacaauuuuuacgcuaacagucgcuuggcgcacagcaacauugauuuuagcaguaauuagucucuuaccuguaugccaaucaagcaguaugaggaaaacugauugguuacccaugacugucgccgcaaugggagucccaccccuuccucuauuuauauuuagcuugaaggauacauuaaaaagaaggaguuggccgcugaaugaagggguaauggcugugggucuggugagcauauuagcaagcuccuuccuuaggaaugacgugccaauggccgguccauuagucgccggaggucuacugauugcguguuacgucauuacagguacuucagcugaucuaacuguagagaaagcugccgaugugacuugggaagaagaagcugaacaaacaggaguuucgcacaauuuaaugauuacaguugacgacgacgguacuaugcgaaucaaagacgacgaaacggaaaacauacuaaccguauuacuuaagacugcacuucucauuguaagugguauauucccauauucaauaccugccacuuuguuaguuuggcauacuuggcaaaaacaaacacaacgcaguggaguguugugggauguaccaagucccccugagacucagaaagccgaacuggaagaagggguuuaucgcauuaaacaacaaggaauauuuggcaagacccaagucggagucggcguacagaaagagggaguauuucacacaauguggcaugugacccgaggugcagucuuaacgcacaacggcaaaagauuagaaccgaacugggccaauguuaagaaagacuuaauaucauacggcgggggauggaaauuaagcgcacaauggcaaaagggagaggaaguacaaguaauagcaguugaacccgguaaaaauccaaagaauuuccaaacuaugccagggauuuuccaaacuacuacuggggaaauaggagcaaucgcgcuugauuuuaaaccaggaacgucagguucuccuauuauaaaccgggaggguaaggucgugggucuuuacggaaacgggguugucaccaaaaacggcggcuauguaucuggaauagcccaaacaaaugcagagccggacggaccaacaccagaacuagaagaggagauguucaagaaacgcaaucuaacaauuauggauuuacaccccggaaguggaaaaacgcgaaaauaccuuccugcaaucguaagagaagcaauuaaacgucggcucagaacucugauacuagcuccgacuagaguuguggcugcagagauggaggaggccuugaagggacugcccauucgauaucaaacaacugcuacaaagagugaacacacuggaagagagauagucgaucuaaugugucaugccacauuuacuaugcgucuguugucacccguucgcguacccaacuauaaccuaauuguaauggacgaagcacacuuuacggaccccgcgaguauagcagcaaggggguacauaucaacacgaguuggcaugggcgaggcugcggcaauauucaugacugcaacgccucccgguacagcggaugcauuuccccaguccaacgccccuauucaagacgaagaaagagacauuccggagcgaucuuggaacagcggaaaugaguggaucacggauuuugcagguaaaaccgucugguuuguuccgagcauaaaagcagguaacgauaucgcaaacuguuuacguaaaaauggaaagaaagugauccaauugagucguaaaacuuuugauacggaauaccagaaaacgaaacugaacgacugggauuucguagugacuacagacauuucagaaaugggugcuaauuuuaaagccgauaggguaauugauccuagacguugccuaaagccuguaauucugacagauggcccagaaagagucauucuagcagguccaaugccuguaacgguugcaagcgccgcccaaagacguggaaggguaggucgaaacucccagaaggaaaaugaccaguacauauuuacagggcaaccccuaaauaaugaugaagaucacgcacacuggacagaagcuaaaauguuauuagauaauauaaauacgccugaagguaucauaccugcacuuuuugagccggaaagggaaaaaucugcggcaauugauggugaauacagacuuaaaggagaaucaagaaaaacguucgucgaacuuaugcgucgaggugauuugccuguuuggcuagcccacaaaguggcaagcgaaggcauaaaguacacagauagaaaaugguguuucgacggugaaaggaauaaucaaauauuagaagaaaacauggacguagagauauggaccaaggaaggcgaaaagaagaaacugaggccgagaugguuagaugcgaggacauauucggacccacuugcucucaaagaguucaaagacuucgcugcuggucgaaaauccaucgccuuagacuugguaacagaaauaggacgugugccaucccaucucgcacauagaacucguaacgcauuagacaauuuaguaaugcugcacacauccgagcauggcggacgugcauaccgacacgcaguugaagaacucccggaaacgauggagacauuguuacuauuggguuuaaugauccuguuaacaggaggugcaaugcuauuuuuaauuucuggaaaggggauugguaaaacaucaauaggcuugaucuguguagucgccucuuccggaaugcucuggauggcagauguaccacuacaauggauugcaucagcuauaguacuagaguucuuuaugaugguguuacuuaucccagaaccugaaaagcaaagaacuccccaagauaaccaguuggccuauguaguaauuggaauccuaacucuugcagcuauuguugcugcaaaugaaaugggacuccuugaaacaaccaaaagagauuuagggaugaguaaggagccagggguugucagcccaaccaguuaucuagacguugaucuacauccugccagugcguggacauuauacgcaguagcuacuacgguaauaacgccaauguuacgccacacaauagaaaauucuacagcuaacgugagcuuagcagccaucgcaaaucaagcuguuguccuaaugggguuagauaaaggauggccaauaaguaaaauggacuugggcguuccguuauuagcucuuggauguuauagccaagucaacccacuaacucuuaccgcugcugugcuauuacucgucacacacuacgccaucauagguccgggguugcaagcgaaagcaacucgcgaagcacagaagcgaaccgcagccggaaucaugaaaaaucccacgguugaugguauuaugacgauagauuuggauccaguaaucuaugacucuaaauucgaaaaacaauuaggccaggugaugcuauugguucucugcgcuguccaacucuugcuuaugagaaccuccugggcauucugugaagcccuaacgcuagcaacaggaccuauaacgacacugugggaaggaucccccgggaaauuuuggaacacuacaauagcgguaaguauggcaaauauuuuccgagguagcuaucuggcaggagcuggucucgcauucuccaucaugaaaucgguuggaacagguaaaagagguacgggcagccaaggcgaaacauugggagagaaguggaagaagaaacuaaaucaguugaguagaaaagaauuugacuuauacaaaaagagugggauaaccgaaguagauagaacugaagcuaaggagggacucaagaggggugaaaucacgcaccacgcgguaucacgggguagugcaaaguugcagugguuuguggaaagaaacauggugauaccggaagguagagugaucgacuuaggcugcgguagaggaggauggucguauuauugcgcaggcuuaaagaaaguuacagaagucagggguuauacuaaagggggcccuggucacgaagaaccaguaccuaugucuacauaugguuggaauauaguaaaacuaaugucugguaaagaugucuucuauuuaccaccagagaaaugugacacgcuccucugugauauaggcgaaaguagucccagccccacaguugaggaaagccgaacgauaagaguacuuaaaaugguagaaccguggcuaaagaauaaucaguuuuguauuaaaguuuuaaacccuuauaugccaacugucauagagcauuuagaaagacuccaacggaaacauggagggaugcucgugcggaauccucuuaguagaaauuccacacacgagauguacuggauuucuaacgggacagguaauaucgucucaucggugaauaugguaaguagguuauuacuaaaucgcuucacgaugacucauagaagaccaacaaucgaaaaggacguagauuuaggagcuggcacaaggcaugugaacgcagaaccagaaaccccaaauauggacguaauaggagagaggauacgccgaauaaaggaggaacacucaucaacguggcacuaugaugaugaaaauccguacaaaacuugggcauaucauggaaguuacgaagucaaagcaacuggaagugcuaguucuaugaucaacggaguaguaaaacuguuaacgaagccaugggacguugucccuaugguaacucagauggcaaugacugacacaacuccauuuggacaacaacggguguuuaaagaaaaaguagacacaagaacaccacgcccgaugccgggaacgcgcaaaguuauggaaauaacagcagaauggcuguggagaacucuaggaagaaacaaaagaccucgauuauguacccgugaggaguucauuaagaaagugagaacaaacgcugcaaugggggcaguuuuuacagaagaaaaucagugggauuccgcuagagcugcaguugaggaugaagaauuuuggaaauuaguugacagagaaagggagcuucacaaauuagggaagugugguaguugcguuuauaacaugauggggaaacgcgaaaagaaacucggagaauuuggaaaagcgaaagguuccagggccauuugguauaugugguuaggcgcucgcuaccuugaguucgaggcuuuagguuucuuaaaugaagaucacugguuuucaagggaaaauucucacuccgguguugaaggugagggacuucacaaauugggauacaucuugcgagauauauccaaaauaccaggaggagcuauguacgccgaugacacagcaggcugggacacacguauuaccgaagaugaucuccauaaugaagaaaagauaacgcagcaaauggauccggagcauagacaguuggcaaacgccauauucaaguugacauaucaaaauaaagucguaaaagugcaaagaccgacaccgaaaggaacaguaauggauauuaucucuagaaaagaccaaagagggucuggccaggugggaacauauggucuuaauacauuuacaaacauggaagcgcaacucauacggcaaauggagggagagggggucuuaucaaaggcagaucuugaaaauccucaccuucuugaaaagaagguaacacaaugguuagaaacgaaaggagucgaacggcugaagagaauggcaauaucaggugacgacugcguugugaaaccuauagaugacagguuugcgaaugcgcuccuagcacuuaaugauaugggcaaagugagaaaggauauaccucaauggcagccaucgaaaggauggcacgauuggcaacaaguuccguuuugcagccaucauuuccaugaacuuauuaugaaagauggaagaaaauugguaguaccauguagaccacaagacgaacuaauuggacgggcgcggauaagccaaggcgccggauggaguuuaagggagacagcaugccucggcaaggcuuaugcccagaugugggcauuaauguauuuucacagaagagauuuaagauuagcaucaaacgccauauguucagcaguaccgguacacuggguaccaaccaguaggacuacguggucaauucacgcacaucaucaauggaugacaacagaagauauguugaccguuuggaauagaguauggauugaggacaacccauggauggaggauaaaacaccaguuacaacaugggaagauguaccauaccuaggaaaacgggaggaucaaugguguggcagucuaauuggauugacaagccgggcaacuugggcccagaacauacugacagcaauccaacagguaagaucucucauuggaaacgaagaauuuuuggauuacaugccaucaaugaaaagauucaggaaagaagaagaaagugaaggugcaauaugguaa

SEQ ID NO: 23530 - RNA, 9873 nt, Artificial Sequence
  derived and/or modified CDS sequence (opt6) from DENV-3__JQ920484__SS-prME
acgagcuuguguuuaaugaugaugcugccggcaacauuagcauuccaucugacaagucgagacggggaaccaaggaugaucguuggcaaaaaugaacgagguaaaucacuauuauuuaaaacagcaagcggaauuaauaugugcacacucaucgcgauggaucuaggagaaaugugcgaugauacaguuacauauaaauguccauuaaucacagaaguggaaccggaagacauugauuguuggugcaauuuaaccucgacaugggugacauaugggacaugcaaccaagcaggagaacaucgcagagauaaaagauccguagcucuagcaccucaugucggaauggguuuggacacgcgcacccaaaccuggaugucggcagaaggagcauggcggcaaguggaaaaaguugaaacuugggccuuuagacauccaggauucaccauccucgcacuauuuuuagcacauuauauagguacgucauuaacgcaaaaaguagugauuuucauuuuacugauguuaguaacaccgucaaugacuaugagaugcguaggagugggaaaucgagacuucguugaaggacuuaguggagcaacgugggucgauguuguauuagagcauggaggaugcguaacgacaauggccaaaaauaaaccaacucuugacauagaauuacagaaaacugaggcuacacaacuagcaacccuaagaaaacuuugcauugaaggaaaaauaaccaaugugacgacggauucacguugcccgacucaaggagaggcaauacucccagaagaacaagaccaaaauuacguuuguaaacauaccuauguagauagagguuggggaaauggguguggauuauuuggaaaagggagucuagucacaugugcaaaauuucaaugcuuagaguccaucgaagggaaggccgugcaacacgaaaaccuaaaguauacugucauuauaacagugcauacgggggaucaacaccagguaggcaaugaaacacaaggagucacugcggagauaacuccacaggcaaguacaguggaagcaauuuuacccgaauauggcacccuaggacuagaguguucaccuagaacaggauuagauuuuaacgaaaugauauuauuaacaaugaaaaacaaggccuggaugguacacaggcaaugguuuuucgaccugccuuugccuuggacaagcggggcaacaacggagacaccuacauggaauaagaaagaacuauuaguuacauuuaaaaaugcacaugccaaaaagcaagaaguaguaguucuugguagucaggaaggcgcuaugcauacggcacuaaccggagcaaccgaaauacagaccagcggcggcaccagcauauuugcuggacaucuaaaaugucggcuaaagauggacaaacuugaauuaaaaggaaugucuuaugccaugugcuuaaaugcauuugugcuaaagaaagaaguuucagagacacaacauggaacaauccuaauaaaaguggaguauaaaggagaagaugcaccuugcaaaauaccuuucaguacugaagacgggcaaggaaaggcacacaacggacgacuaauuacggcuaaccccauagucaccaagaaagaggagccaguuaauauagaagcugaaccgccuuuuggugagagcaacaucguaaucggaaucggagacaaagcacucaaaauaaauugguacaaaaagggaaguaguauagguaagauguuugaagccacagcaaggggugcaaggcguauggccauauuaggagacacagcaugggacuucgggagcguagggggaguacuaaauaguuuagggaagaugguucaucagauuuucgguagcgccuauacagcacuauuuucugggguauccuggauuaugaaaaucggaauaggaguuuuauuaaccuggaucggccuaaauucaaagaauacuagcaugucuuucucuuguauugugauaggaaucauaacacuuuaucuaggugcagucguacaagcugauaugggauguguaauaaauuggaaagggaaagagcuaaaguguggaucgggaauauuugucacuaaugagguucacaccuggacagaacaauacaaguuccaagcggacucuccaaagagacuggccacagccaucgcuggcgcaugggaaaauggaguauguggaauacgcaguaccacaaggauggaaaauuugcucuggaaacagaucgcgaaugaacuaaauuauaucuuaugggaaaauaauauuaaguugacgauaguagucggagaugccaucgggguucuagaacaagggaaaagaacuuugacaccgcaacccauggaauuaaaauauucuuggaagacgugggggaaagcuaagaucguaaccgcugagacucagaauaguaguuucaucauugauggaccaaacacaccggaaugcccauccgccuccagggccuggaauguuugggaaguugaagauuacgguuucggagucuucacaacaaauauuugguuaaaacuccgagaaaaauacacucaauuaugugaccauagguuaauguccgcugcagugaaggacgaaagagcaguccaugcggacaugggguauuggauugagucccagaaaaauggaucauggaaauuagaaaaagcaucauuaaucgaagucaaaacguguacauggccaaagucacauacgcuauggucgaacggaguucuagaaagugacaugauaauaccaaagagucuugcuggaccaauaucccaacauaacuauagaccuggauaccauacccaaacagcuggaccuuggcauuugggaaaacuagaacucgacuuuaauuacugugaggggacaacgguagucaucacggaaaacugcgggauucguggaccaucacuacggacaacuaccguauccggaaaguuaauacaugaauggugcuguagaaguugcacauugccaccuuuaagauauaugggcgaagacgggugcugguaugguauggaaauacguccaauaaaugaaaaagaggaaaacauggucaaaagucuaguaucugccggcucgggaaaaacagauaauuucaccaugggaguacuaugucuugcgauauuauucgaggaggucaugcgcggaaaauucggcaagaagcauaugauagcaggagcucucuuuacauuuguauuguuguugagugggcagauuaccuggagggauauggcgcauacgcuuaucaugaucgggaguaacgcaagcgaccgaaugggaaugggagugaccuaccuagcauuaaucgcgaccuucaagauccaaccguuucuagcacuaggauucuuuuuacgcaaacucacuucacgugaaaacuuacucuuaggcgucggccucgcaauggcaacaacuuugcagcuuccagaggauauagaacagauggcuaacggaauagcucucggucuaauggcacuuaaacuaauuacccaguucgaaacuuaucaauuguggacugcccuuauuucuuuaauguguucaaacacaaucuucaccuuaaccgucgccuggcggacagcuacucuaauacucgcaguuauaaguuuguuaccaguaugccaguccucgaguaugcgaaagaccgauugguugccaaugacagucgccgcgaugggaguaccgccacuuccacucuuuauauuuucuuuaaaagacacacuaaaaaggagaagcuggccccucaaugaagguguuauggcagucgguuuagugagcauuuuagcgaguagcuucuuaaggaaugauguaccaauggccggcccgcucgucgcgggaggacuauugauugccuguuaugucauaacggguacaagugcagaucuaaccgucgagaaagcagccgacguaacaugggaagaagaagcugaacaaacugguguaucucacaaucuaaugauaacuguggaugaugaugguacgaugcgaauuaaagaugacgaaacagaaaacauauuaaccguucuguugaaaacagcauuacucauagucagcggaauuuucccauauucaaucccugcaacguuacuuguauggcacacauggcaaaaacaaacacaacguaguggcguuuuaugggauguaccuaguccaccugaaacacaaaaggccgaguuagaagaaggaguguaucguauaaaacagcaaggcauuuucggaaagacucaaguagggguaggaguucaaaaagagggggucuuccauacgauguggcacguaacgagaggugccguguuaacuuauaaugguaaaagauuagaaccaaauugggcaaacgucaagaaagacuuaaucagcuauggaggaggauggaagcugagugcgcaauggcaaaaaggcgaagagguacaaguaauagcaguagaaccagguaagaaucccaaaaauuuucaaaccaugccuggaaucuuccaaacgacgacuggagaaauaggcgcaauugcacucgacuuuaaaccggguacaagugguaguccgauuauaaauagagaaggaaaagucgugggcuuauaugggaauggcguggucacaaagaacggagguuauguuucagguauagcucaaacgaacgcagaaccugacggccccacaccagaacuagaggaggaaauguuuaagaaacguaauuuaaccauuauggaucuucauccaggcagcggaaaaacucgaaaguaucuaccggcaauaguaagggaggcaauaaagaggcgccugagaacccucauucuagccccuacaagagucguugcagcugaaauggaggaagcacugaaaggauuaccaauaagauaucagacgacagcuacaaaaagugaacacacugggagagaaauuguugaccuaaugugucaugcaacguuuaccaugagacuccucagcccagugagggucccgaacuauaaucucauagugauggaugaagcccacuuuacagauccugcauccauagcagcccguggcuacauaucgacacgaguugggaugggagaggccgcggcaauuuuuaugacagccacgccgccuggaacagcagacgcuuucccccaaucaaacgcuccaauucaagaugaagaaagagauauuccugagagaaguuggaauaguggaaacgaauggauaacagacuucgcaggaaaaaccgucugguucguuccuucuauaaaggcaggaaaugacauugcaaacugccugcguaaaaacggcaaaaaggucauucaacuaucaagaaaaacauuugacacugaguaucagaaaacgaaauugaaugauugggacuuuguaguaacaacagauauaagcgaaaugggagcaaacuucaaagcugacagaguaauugauccuagaaggugcuuaaagccagugauuuuaaccgaugggccagaaagaguuauacuagcagguccaaugccagugacuguagcaucagcagcccaaagaagaggcaggguaggccgaaacagccaaaaagagaaugaucaguauauuuuuacagggcaaccacuaaauaaugacgaagaucaugcacauuggacagaagccaagaugcuccuagauaauaucaauacgccagaaggaauaauucccgcucuguuugagccugaaagggaaaaauccgcagcaauugauggagaauauagguuaaaaggcgagucuagaaaaacauucgucgaacucaugcgcagaggcgaucucccagugugguuagcgcauaaagucgcaucagaagggauaaaauauacagacagaaaaugguguuuugauggagagagaaacaaccagauacucgaggaaaacauggaugucgagauauggacaaaagaaggugagaagaagaaacuacgaccgagauggcuggaugcucgaacguauucugauccccuagcacuaaaagaguucaaagauuucgcagcagguagaaaaucgauagcacucgaccuuguaaccgagauaggaagaguuccgagccauuuagcucaccgaaccagaaaugcacuagauaaucugguaaugcuacauacaucggaacauggagggagggcuuauagacacgccguagaggaacugccagagacaauggaaacguuauuauuacuaggacucaugauuuuauuaacaggcggugcaauguuauuucuuaucucuggaaaaggaauuggaaagaccucaauugguuugauauguguagucgcgucgucaggcaugcuauggauggcagacgugccacuucaauggauagcauccgccaucguacuagaguucuuuaugaugguacuucuuauuccugaaccugaaaaacaaagaacuccgcaagauaaucagcuugcguauguaguaaucggcauuuuaacauuagcagcaauaguagcagcaaaugaaaugggauuacuagaaacuacgaagagagaccuaggaaugagcaaagaaccuggaguagugucucccacuucauauuuagaugucgaucuacauccagcuucggcuuggacauuauaugcuguugcaaccacagugauuacaccuaugcucaggcauaccauugaaaacucuaccgcaaauguaucccuagcugcgauagcgaaucaagcagucguuuuaaugggacuagauaaaggcuggccuauuucaaaaauggaccuaggcgucccucuauuggcauuaggauguuauucccagguaaaccccuuaaccuugacugcugcuguacugcuuuuagugacacauuaugcaaucauugggccuggacugcaggccaaagcuacaagggaagcucagaagcgcaccgccgccggaauuaugaaaaacccaacuguagauggcauaaugaccauugauuuagauccuguaauauaugauaguaaauuugagaaacagcuuggacaagucaugcuucuagugcuuugcgcgguacagcugcuacuuaugcguacuucuugggcauuuugugaggcuuuaacucuagcaacaggcccgauuaccacccuaugggaagggagcccagguaaauucuggaauacuacaauagcggugucaauggcgaacauauuccguggcuccuaucucgcaggagcuggguuggcauuuucgauaaugaaaagcguagguaccgguaaacgggggaccggcucacaaggagaaacacuaggagagaaauggaagaaaaagcuaaaucaguuaaguagaaaagaauuugacuuauauaagaaaucagggaucaccgagguugauaggacagaggcaaaagaggguuuaaagcggggagagauuacccaccaugcgguuagcagaggauccgcaaaacuacaaugguucgucgaacgcaauaugguaauacccgaaggacgcguuauagaucuuggaugcgguagaggcggcuggucguacuacugugcaggauuaaagaagguaacagaaguucgugguuauacgaaaggugguccaggucaugaagaaccaguucccaugucaacauacgguuggaacauaguaaaacugaugaguggaaaggacguauucuaucuaccgccggaaaagugugauacauuacugugcgauauaggagagaguuccccaucuccuacaguagaggaaucacgaacaauuagaguacucaaaaugguugagccguggcuaaagaauaaucaauuuuguaucaagguuuuaaaucccuacaugcccacaguuaucgaacacuuagaacgacuacagagaaaacacgggggcaugcuuguacguaauccgcuaagucgaaacuccacgcaugaaauguauuggauuucuaacggaacgggaaauauaguaagcucaguaaauaugguuucuagauuauuacuaaauagauucacaaugacgcauaggagaccaaccauagaaaaagacgucgaucugggagcggggacacgacauguuaaugcggaacccgaaacuccgaacauggauguuauaggcgaaagaaucagacgaauuaaagaagaacauucgucgaccuggcauuacgaugaugaaaauccauacaaaacaugggcauaucacggcucauaugagguaaaggcaacgggaucagcuucuucaaugauuaacgguguuguaaaauuauuaacuaaacccugggauguuguuccuaugguuacgcaaauggcaaugacggauaccacaccuuuuggucaacaaagaguauucaaggaaaaagucgauacucguacuccccgaccgaugcccggaacaagaaaagugauggaaauaacagcagagugguuauggcgcacucuuggaagaaauaagagaccaagacucuguaccagagaagaauuuaucaagaaagugcguaccaacgccgccaugggcgcuguuuuuacagaggagaaccaaugggauucugcacgagcugcuguugaagacgaagaauuuuggaagcuaguugacagggaacgcgaacuacauaaacuaggaaaauguggcagcuguguauauaacaugaugggaaagcgagagaagaaacuuggagaguucgggaaagcuaaagggagcagagccauaugguauaugugguuaggugcacguuaucuagaguucgaggcuuuaggguuucuuaacgaggaccacugguucucacgagaaaauucucauucaggaguugaaggagaagguuuacauaaacuaggauauauacugcgagauaucagcaaaauaccaggaggugccauguaugccgaugacacggcgggcugggauacgcguauaacugaggaugauuuacacaaugaagagaaaauaacacagcagauggacccugagcacagacagcuagcgaacgcuauauuuaaacuaacauaucaaaauaaaguagucaaaguacagaggccuacgccaaaaggcaccgugauggauauaauuagcagaaaagaccagagaggaucagggcaaguuggcacauacggauuaaauacguuuacuaacauggaggcccagcugauacgccaaauggaaggggagggaguauuaucaaaagcagaucuagaaaauccccaucuauuggagaagaaaguuacacaauggcuagaaacuaaaggcguagagaggcuuaaacgaauggccaucaguggagacgauugcguuguuaaacccaucgaugauagauuugcgaacgcauugcuagcgcuuaacgacaugggcaaaguuaggaaagacauuccucaauggcaacccucuaaaggcuggcaugauuggcaacaagucccauuuugcucacaccauuuccaugagcuuauaaugaaagauggccgaaaacuggugguaccaugccgaccacaagacgaacuuauugggcgggcaaggauaucacagggagcuggauggucgcuccgugagacugcguguuuaggcaaggcuuacgcacaaaugugggcuuuaauguacuuucaucgaagagaucucagacuagccucaaaugcaauauguucagcaguuccuguacacuggguaccuaccucacgcaccaccuggucuauccacgcacaccaucaguggaugacgacugaggauaugcuaacaguauggaaucgugucuggaucgaggacaacccauggauggaagauaagacuccaguaacaacuugggaagauguaccauaccuaggaaagagagaagaucaaugguguggaucuuuaauaggacuuaccuccagggcgacaugggcacaaaacauuuuaacugccauucaacaaguaaggagccucauagguaacgaggaguuccuugacuacaugccaaguaugaagcgcuucagaaaggaggaagaaucggaaggggcuauaugguaa

SEQ ID NO: 23531 - RNA, 9873 nt, Artificial Sequence
  derived and/or modified CDS sequence (opt6) from DENV-3__JQ920486__SS-prME
acaucgcuuugucuuaugaugauguuaccagcaacacuugcauuucaucuuacaucuagagauggagaaccacggaugaucguaggcaaaaacgaaagagggaaaucucuauuauucaaaacagcuucagguauaaauaugugcacucugauagcuauggauuugggugaaaugugugacgacacagucacuuauaaauguccucucauaacagaaguggaaccggaagacaucgauugcugguguaaucugacgucgacauggguaacuuauggaaccugcaaucaagcaggagaacaucgacgagacaaacguuccguagcacuggcgccacaugucgggaugggauuagauacgaggacacaaacauggaugucagcagaaggagcuuggcgccaagucgaaaaaguagaaacuugggcauucagacauccaggcuuuacgauccuggcacuuuucuuagcccauuacauugguacaucacugacccaaaaaguaguaauauuuauucuucuuauguuagucacuccuucuaugacuaugagaugcguagggguaggaaaccgagauuuuguagaaggacugucuggcgccacguggguagacguuguauuagaacaugguggcugcguaacuaccauggcuaaaaauaaaccuacacucgauauagaacuacagaaaaccgaagccacucaauuggcaacuuugagaaaauugugcauugaagguaaaauaacaaacgucacuacagacaguagauguccaacgcaaggggaagcaauauugccugaagaacaagaccaaaauuacgugugcaaacauaccuauguagauagagggugggguaauggcuguggcuuauucgggaaagguagucuagugacaugugccaaauuucaauguuuagaaagcauugaaggaaaagcaguacaacaugaaaacuugaaauacacuguuauaauaacgguacauaccggggaucaacaccaagucgguaaugaaacccaaggagucacagcugaaauaacuccacaagccucgacgguggaagcgauacuacccgaauauggcacccucggauuagaauguucgccacgaacgggauuagauuucaacgaaaugauacuuuuaacaaugaaaaauaaggcuuggaugguacauagacagugguucuucgacuugccgcuuccauggacaagcggagcuacaacggaaacucccacauggaacaagaaagaacuauugguaacguucaaaaaugcacacgccaagaaacaagaaguagugguacucggaucccaagaaggggcgaugcauaccgcauuaacuggugcuacugagauccaaacaagugguggaacgucaauauucgccggucacuuaaaaugucgucuaaaaauggauaaauuagaacuuaaaggcauguccuaugcaaugugccucaacgcuuuuguucucaagaaagaagucagugaaacucaacacggcacuauacuaauaaaaguagaauauaaaggggaagaugcaccaugcaaaauuccauuuuccacugaagacggucaaggaaaagcucauaacgggagacuuauaacagcuaauccuauaguaacuaagaaagaagaaccgguaaacauagaagcugagcccccuuucggggaaaguaauauuguuauaggaaucggagauaaagccuuaaaaaucaacugguauaagaaagguaguucgauagggaaaauguuugaagcaacugcacguggugcaaggagaauggcuauauuaggagauacggcaugggauuuugguagugucgguggaguacuaaauucuuuaggcaaaauggugcaucagaucuuuggauccgcguacaccgcucuauuuucaggaguaucauggauaaugaaaauugggaucggcguacuucuaacguggauagggcuaaacucuaaaaauacaagcaugaguuucucuugcauaguaauagguauaauaacuuuauaccuaggagccgugguucaagcugacaugggguguguaauaaauuggaaaggaaaagaacuaaaaugcggaucgggcaucuucgucacuaaugaaguccauacauggaccgagcaguacaaauuucaagcagauucacccaaaagacuagccacugcaauugcuggagccugggaaaauggagucuguggcauaagauccacaacacgaauggaaaauuuauuauggaagcaaauugccaaugaacuaaauuacauuuuaugggaaaacaauaucaaacuuacaaucgugguaggcgacgccauagguguccuugaacaaggcaaaaggacccugacuccacagccuauggaacugaaauacucauggaaaacuuggggaaaagcuaaaauaguuacggcagagacacaaaacucaucuuuuauaauagaugguccuaacacuccugaauguccaucagcuucucgugcauggaauguuugggagguagaagacuauggcuuugguguguucaccacaaauauuugguuaaaauugcgagaaaaauauacacagcuuugcgaucacagacuaaugucagcggcugugaaagacgaaagagcugugcacguugauauggguuacuggauugaaucacagaaaaacgguucauggaaacuagaaaaagcaucauugaucgaggucaaaacauguacauggccuaaaucgcauacacucuggaguaaugguguauuagaaagcgauaugauuauaccuaaaucccuagcugguccgauuucucaacacaacuauagacccggauaccauacccaaacagcaggacccuggcauuuagguaaguuagagcuagauuuuaacuacugcgaggguaccaccgucgugauaacggagaauugcggcauuagaggcccaucacuccgaacuacaaccguaagcggcaaacugauucaugagugguguugccguucuuguacccuacccccacuacgcuauaugggagaagauggcuguugguaugguauggagauucggcccauaaaugaaaaagaagaaaauaugguuaaaucgcucguaucggcaggcagcgguaagacugacaacuucacaaugggcguacuuugucuugcaauacuauuugaagaaguaaugagggguaaauuuggcaagaaacauaugauagcgggcgcacuguuuacauuuguauuguugcuuaguggucaaauaacguggcgcgauauggcucauacuuuaauaaugauaggaaguaacgccucggauagaaugggcauggguguaacuuaucuagcucucauagccaccuuuaagauacaaccuuuucuagcguugggcuuuuuccuccgaaaguuaacuagccgagagaauuuacuucucggcguaggcuuagccauggcaacaacauuacaacuuccagaagauauugaacaaauggcaaauggaauugcacuaggcuuaauggcacuaaaauuaauuacccaguuugagacauaccaacucuggacagcauuaauuagccugauguguuccaacacaaucuuuacacuuacggucgccuggaggaccgcgacucucauuuuagccgucaucagccuacuaccuguaugucaaucgucgucaaugcggaagacagacugguuaccuaugaccguugccgcaaugggcgugccaccauuacccuuauucauauuuucauuaaaggauacauuaaagcgaagaucauggccuuugaaugagggagucauggcuguagggcugguaucuauacuugcgagcaguuuucucagaaacgacguuccaauggcugguccuuuagucgcaggagggcucuuaauugcguguuacguaaucaccggcacgucagcugaucuaaccguugaaaaggcagcagauguuacuugggaagaagaagccgaacagacaggcguuucucacaacuuaaugauaacaguugacgacgauggcacaaugagaauaaaagaugacgagacagaaaauauacuuaccguauuacuaaaaaccgcuuuauugauuguaucagguauauuuccauauaguauaccggcuacuuugcuggucuggcacaccuggcagaaacagacccaaaggucaggagucuugugggauguaccaagucccccagaaacacaaaaggcugaauuagaggaaggaguauaccgcauaaaacaacaagguauauuuggaaaaacgcaaguagggguugguguucaaaaggaaggaguauuucauaccauguggcauguuacucgaggagccguacuuacacauaacggcaaacgauuagaaccaaauugggcaaacguuaagaaagacuuaauuucguacggagguggauggaaacugucagcucaguggcagaaaggagaggaaguacagguaauagcaguggaacccggcaaaaaucccaaaaacuuccaaacuaugccuggaauauuucagacuacgaccggggaaauuggagccaucgcauuggacuuuaaaccagggaccagcggguccccaauaauaaacagggaggggaaaguagugggacucuacggcaauggaguugugacuaaaaacgguggauaugucuccggaauagcacaaaccaaugcagaaccggauggcccuacuccggaacuagaagaagaaauguuuaagaaaaggaaccugacuauuauggacuuacauccagggucaggaaaaaccagaaaauauuuaccagcgauagugagagaagccauaaaaaggcgucuacggacauuaaucuuagccccgaccagagucguagcugcagaaauggaagaggcauugaaaggcuuaccgauacgcuaccaaacaacagccaccaaaucggagcauacuggcagggagaucgucgaucuaaugugccaugcuacuuuuacgaugagacuuuugagccccguaagaguaccuaauuauaaucuaaucguaauggaugaggcacauuuuacugauccagcgaguauagccgcccguggcuacauaaguacuagaguuggaaugggagaagccgcagcuauauucaugacugcuacuccaccggguacagcugaugccuucccacaauccaacgcuccaauccaagaugaagaacgggauauuccugaaaggagcuggaauagcgguaacgaauggaucacggauuuugcagguaaaaccgucugguucgucccuagcaucaaagcuggaaacgauauagcaaauugucugcguaaaaaugguaaaaagguaauucaacuaaguagaaaaacguuugauacggaauaucagaaaacuaaacucaaugauugggauuuuguugucacuacagauauaucagaaaugggcgcgaauuuuaaagcagaucgggugaucgacccacgucgcugccucaaaccuguaauacucaccgaugguccagagagaguaauucucgcagguccuaugccgguaacuguagcuucugcagcccaacgcagagguagaguaggaaggaacucacaaaaagaaaaugaucaauauauuuuuacuggacaaccucuuaauaaugaugaagaccacgcucauuggaccgaagccaaaaugcuucuugacaauauaaacacaccugaaggaauaaucccagcacuauuugaaccagagagagaaaagagcgcugcgauugauggagaguaucgcuugaaaggggaaucucgcaagaccuuuguagaacuaaugaggcgaggugaucugccgguuugguuagcucauaaaguagcaagcgaaggaauaaaauacacagacagaaaaugguguuuugacggugagagaaacaaucagauacuugaagaaaacauggauguagaaauauggacaaaagagggggagaagaagaaauugagacccagauggcucgacgcccguacuuacagugacccccuagcccucaaggaguuuaaggauuuugcagcugguagaaaguccauugcccuggaccuuguaacagaaauagguagaguacccagccaccuagcucaccgaacaagaaaugccuuagacaacuuagucauguugcauacuagcgaacacgguggacgagcuuacaggcaugccguugaagaauuaccagaaacaauggaaacacuacuucuccucggacuaaugauacuccugaccggcggagcuaugcuauuucucauaaguggcaaagguauagggaaaacaaguauaggauugauuugcgucguugcaaguucaggaaugcuauggauggcagacguaccccugcaauggauugccucagcaauaguuuuggaauuuuucaugaugguacucuugauaccagaaccugaaaaacaaagaacaccacaagauaaucaauuagcuuacguuguuauaggaauccucacucucgcugcaauaguagcagcaaacgaaaugggcuuacuagagacuacuaaacgagauuuaggaaugucuaaagagcccggaguaguaucaccgacgucuuaucuggauguggaucuacauccugcaagcgccuggacacuuuacgccguugcaaccacugugauuaccccaauguuacggcauacuaucgaaaacaguacugcaaacgucucuuuggcggcuauugcuaaccaagcgguuguacugaugggucucgauaaaggcuggccuaucucaaagauggaucuagguguaccgcuguuagcauugggaugcuauagucaaguuaauccauuaacguuaaccgccgcaguauuauuauuaguuacccacuacgccaucaucggcccaggauugcaagccaaagcaacaagagaggcacaaaagcguacagcagcagguauaaugaaaaauccgacuguugauggcauaaugaccauagauuuagauccgguaaucuaugacagcaaauuugagaaacagcuaggacaaguaaugcuacuugugcuuugcgccguacaacuccuuuuaaugagaacuucaugggcguucugcgaagcucuuacguuggcaacgggaccgauuaccacguuaugggaaggaucaccgggcaaguucuggaacacaacgaucgcaguaaguauggccaauauuuuuagggguagcuacuuagcuggugcuggacuagcauuuucuauaaugaaaucaguggguaccgggaaacgaggaacaggaucccaaggagaaacgcuaggggaaaaauggaagaagaaacuuaaccaacucucccguaaagaauuugacuuguauaaaaagaguggaauuacagaaguugauagaauagaagcaaaagaaggacucaaaagaggagaaauaacgcaucacgcaguaucaagagggucugcuaaauuacaaugguucguugaacguaauauggucauacccgagggaaggguaauugaccuuggaugugggcgaggaggauggucauauuacugcgcaggucuaaagaaaguaacagaagugcguggauauacaaagggcgggccagggcaugaagaaccugucccuaugagcaccuacggauggaauaucguuaaacucaugagcgggaaagauguauucuaucuuccucccgaaaagugugacacacuuuugugcgauauaggagaaucaucgccaucaccaacaguagaagaaucuagaacaauacgagugcuaaagaugguagaaccauggcuuaaaaauaaccaauucugcauuaaaguucuaaauccauauaugccaacagucauagagcaucucgaacgucugcagagaaaacaugguggaauguuaguacgaaaucccuugucuaggaacucaacucacgaaauguacuggauaucaaauggaacagguaacauagucaguucaguaaacaugguaagucgacuacuucuaaaccgcuuuacuaugacgcauagaagaccaacaauagagaaagauguagaccucggagccgguacacgacaugucaacgcugaaccagaaaccccgaacauggauguaaucggcgagaggauuagacggauuaaagaagaacacucgucgacauggcacuaugaugacgaaaauccauacaaaacaugggcguaucaugggucuuacgaggugaaagcaacugggagcgcaucaucgaugauaaauggaguaguaaaacuucugaccaaaccuugggacguagucccaaugguaacacaaauggccaugaccgauacaacaccguucggacagcaaagaguauucaaagaaaaaguugauacuagaacaccuagacccaugccugguaccaggaagguaauggaaauuacagcagaguggcuuuggagaacgcuaggccgcaacaaacguccacguuugugcacaagagaagaguucauuaagaaagucagaacuaacgcggcaaugggagcaguguuuacugaagaaaaucagugggauagcgcuagagcagcaguugaggacgaagaguucuggaaguuaguagauagagaacgagaacuucauaaacuagggaaaugcggcucguguguauacaauaugauggggaagcgagagaagaaauuaggagaguuuggcaaagcaaaaggaucacgcgccauaugguauauguggcuaggagcccgcuacuuagaguucgaagcucuuggauuuuugaacgaagaucacugguuuaguagggaaaacucacauagcggagucgaaggagaaggccugcacaaacuuggcuacauauuacgggauauaagcaaaauaccaggaggagcuauguacgcugacgauacugcugguugggacacacggaucaccgaagacgauuuacauaacgaagagaaaauaacacagcaaauggacccagaacaccgacaacuggcgaacgcaaucuuuaaacuaacguaucaaaauaagguuguuaagguucaacgacccaccccaaaaggaaccguaauggacauaauaucacgaaaagaccaacgugggucaggccaaguaggaaccuauggacuuaauacuuuuacgaacauggaagcacaacuaauacgacaaauggaaggagaaggagucuuaaguaaagcagaccuagaaaacccacauuuguuagagaagaaaguaacacagugguuggagacaaaaggagucgagagacugaaaagaauggcaauuaguggcgaugauuguguuguaaaaccaauagacgauagguucgcuaaugcuuugcucgcuuuaaacgauaugggaaaagugcguaaagacaucccgcaauggcaaccuucaaaaggauggcaugauuggcaacaaguaccauuuuguagucaucacuuccaugaacuuauaaugaaagacggaagaaaacucguuguuccaugccgaccacaggacgaacuuaucggccgagcccgaaucucacagggggccggauggaguuuaagagagaccgcaugucuuggcaaagcauacgcacagaugugggcauuaauguauuuccaccguagagaucuaagguuagcuagcaaugcaauauguucugcgguaccugugcacuggguaccgaccucacgcaccacguggaguauccacgcucaccaucaauggaugacgacagaagacauguugacaguguggaaucggguuuggauagaggauaacccguggauggaagauaaaacaccgguaacaaccugggaggacguaccguauuuaggcaaaagagaagaccaauggugcggcucucuaauaggauugacaaguagggcaacuugggcacagaacauucuaacggcaauacaacaaguacggucccuaauaggcaaugaagaguuccuggacuacaugcccagcaugaaacgcuuucgcaaagaagaagaaucugagggagcuauaugguga

SEQ ID NO: 23532 - RNA, 9873 nt, Artificial Sequence
  derived and/or modified CDS sequence (opt6) from DENV-3__JQ920485__SS-prME
acuagcuuauguuugaugaugaugcucccggcaacauuagcauuucauuuaacaagccgggauggagaaccaaggaugauaguaggcaaaaaugaacgcggaaaaucucuacuuuuuaaaacagcuucagggauuaacauguguacacuuauagcuauggauuugggagaaaugugugaugauacaguaaccuauaaaugcccacuuauaacagagguggaaccugaggacauagacugcuggugcaaucuuacgucaacaugggugacauaugggacaugcaaccaagcgggagaacaucggagagauaaacguucaguggcacuugcaccccauguaggaauggggcuagauaccaggacgcaaacauggaugagugcagaaggagccuggagacaagucgagaaaguagaaacaugggccuuccgucauccagguuuuacgauauuagcuuuauucuuggcacauuacauaggaaccagcuuaacccaaaaaguggugauuuuuauacuauuaauguuagucacgcccucuaugacuaugagguguguuggggucggaaauagagauuucguugaagguuuaucgggagccacauggguggaugugguauuggagcaugguggaugcguuacaacgauggcuaaaaauaaacccacucucgacaucgaauuacagaaaacagaagcgacucaauuagccacacuccgaaaacuauguauagaaggaaaaaucacaaauauaacaacggacagccgguguccaacccaaggcgaagcgaucuugcccgaggagcaagaucaaaacuacguguguaaacauacguauguagacagaggaugggguaaugggugcggauuauucggaaaaggaucucuggugacuugcgcaaaauuccaauguuuagaaaguaucgaaggcaaagccguacaacaugaaaaccugaaauauacaguuauuauaacgguacacacgggagaccagcaccaaguagguaacgaaacucaagguguaacagccgaaauaacaccucaggcuuccacuguggaagccauacucccugaauaugggacauuagggcuugaaugcucacccaggacaggacuggacuuuaacgaaaugauucucuugacgaugaaaaauaaggcauggaugguacauaggcaaugguucuucgauuuaccucuuccuuggacaucaggggcaacaacagagacaccaacguggaacaagaaagaauuacugguaacauuuaaaaacgcacaugccaagaaacaagaagugguaguauugggaucccaagaaggagcuaugcauacagcccuaacaggagccaccgaaauccaaacgagcggagggacaaguauuuuugcuggacacuuaaaauguagacucaaaauggauaaauuggagcuuaaagguaugucauaugcaaugugccuaaaugcuuucguucuuaagaaagaaguaagcgaaacgcagcaugguacuauuuugauuaaaguggaguauaagggagaagaugcuccuuguaaaauuccauuuaguacugaagauggacaggggaaggcucauaauggacgacuuauuacagcuaacccgauaguaacgaagaaagaagaaccuguuaauauagaggcagaaccaccguuuggagaaucuaauauaguuauuggaauuggcgauaaggcuuugaagauuaauugguacaagaaagguagcuccauugguaaaauguuugaggccacagccagaggggcuaggcgaauggcuauauuaggugauacagccugggacuucggaucaguaggugguguccuaaauucauugggaaaaaugguacaccaaauauucggaucggcauacacugcguuauucucgggcguaaguuggauuaugaagaucggaauagggguguuauugaccuggauuggacuaaacagcaagaauacaagcaugagcuuuagcugcauaguuaucgggauaauaacucuuuacuuaggcgcaguaguacaggcagauauggguugugugaucaauuggaaaggaaaagaguugaaauguggaucagggauuuuuguuaccaaugaaguacacacguggacagaacaauauaaauuucaagcugacagcccaaaacguuuagcaaccgcuauagcaggggcaugggagaacgggguauguggcauuagaaguacaacuagaauggaaaacuuguuauggaagcaaauagcaaaugaacuuaacuacauucugugggaaaauaauauaaaauuaacuauaguuguaggugauguaauagguguauuagaacagggaaaaaggacauuaacaccacaaccgauggagcuaaaauauucuuggaagacuugggguaaagcuaagauagucacagccgagacucaaaauuccucuuuuauaauagauggaccaaacacaccggaaugcccaagugccagcagagcguggaacguuugggaagucgaagauuaugguuucggaguuuuuacgaccaauaucugguuaaaauuaagagaaaaacauacucaauuaugcgaucacaggcuaaugucugccgcuguaaaagacgagcgagcuguacaugcagauaugggcuauuggauugaaucucagaaaaaugggagcuggaaauuagaaaaagcgucuuuaauagaaguuaaaacauguaccuggccaaaaucacacaccuuauggucaaaugggguauuggagucagauaugauaauaccuaaaucccuugcagguccaauaucgcagcacaacuaucgcccagguuaucacacucagacggccgguccauggcaccuuggaaagcuggaauuagauuucaauuacugugaaggcacuacagugguaaucacagaaaauuguggaauacggggaccgucucuucgaacaacaaccguaucagggaaguugauccaugaaugguguuguagaaguugcacauuaccaccacuacgcuacaugggagaggaugguuguugguauggcauggaaauacgaccaauaaaugaaaaagaagaaaauaugguuaaaaguuuagugagcgcagguaguggaaaaacugauaacuuuaccauggguguacuauguuuagcuauucuauucgaagaagucaugagaggaaaguuugggaagaagcauaugauugcaggagcccuguuuacguucguauuacuuuuguccggacaaaucacauggcgagauauggcgcacacuuuaauaaugauaggcagcaaugcaucggacagaaugggcaugggagugacguaccuagcucugauugcaacuuuuaaaauacaaccauuucuugcuuuaggguucuuuuuaagaaaguuaacgaguagggaaaaccuuuugcuuggaguuggauuagcuauggcaacgacacuccaacuccccgaagauauugagcagauggcuaauggaauugcacugggacuuauggcgcuaaaacuuauaacgcaauuugaaacuuaucaacuguggacagcguuaauaucgcucaugugcaguaacacuauuuuuacucucacgguggcauggcguaccgcaacccuaauccuagcggucauaucacuccugccuguuugccaaucgaguuccaugcguaaaacggacuggcuuccaaugacagucgcggccauggguguaccaccuuuaccccuauuuauuuuuaguuugaaggauacacuaaaacgcaggagcuggccuuugaaugaaggaguaauggccgugggauuaguguccauucuagcgaguucauuuuugcgaaaugauguaccuauggcagguccuuuaguagcuggaggacuuuuaauugccuguuauguuauuacaggaacuagcgcggauuugacaguagagaaggcugcagaugucacaugggaagaagaggccgaacaaacaggggucagucauaaucuaaugaucacaguagaugacgaugggacuaugaggauuaaagacgaugagacagagaacauuuuaacaguauuacuaaaaacagcuuuguuaauagugaguggaauuuucccguauucaaucccggcgacuuugcucguauggcacacuuggcaaaagcagacacaacgaagcggagucuuaugggauguuccaucgccaccagaaacacaaaaggcugaacucgaagaagguguauacagaauuaaacaacaagguauuuuuggcaagacgcagguuggagugggaguacaaaaggaggggguuuuccacacuauguggcauguaacucguggagccguuuugacucauaacgguaaacgauuagaaccaaauugggccaacgucaagaaagaucuuauaagcuauggugguggcuggaaacuuagugcgcaguggcagaagggagaagaaguacaaguuauagcaguggagccugguaagaauccgaaaaauuuucaaacaaugcccggaauauuccaaacaacgacuggagagauuggugcaauugcacuagacuucaaaccaggaacaucuggaucacccauaauuaacagagaaggaaaaguagugggguuauaugguaauggcguagucaccaaaaauggaggcuaugucucuggaauugcgcaaacgaaugcagaaccugacggucccauuccagaacuugaagaagagauguucaagaaacguaauuuaacgauuauggauuuacauccuggauccggaaaaacccgaaaauaucuaccugcaauuguacgugaagccaucaagcgaagacucaggacacucauauuagcacccacuagggucgucgcugcggaaauggaggaggcgcuaaaagguuuaccgauaagguaucaaacaacggcaaccaaauccgaacacacaggaagagaaaucguagaccucaugugucacgcaacguuuacuaugaggcuauugucuccuguccguguaccaaacuauaacuuaaucguaauggaugaagcgcauuucacugaucccgcaucaaucgcugcccgaggcuauaucucaacacgaguggguaugggagaagcagccgcaauauuuaugacggcuaccccuccaggaacagcagacgcauucccacaaucgaacgcaccgauacaagaugaagaaagagauauuccugaaagauccuggaacucugguaaugaauggauaacagauuucgccggaaagacgguaugguucguaccaagcauuaaggcagggaaugacaucgcaaauuguuugcgcaagaacgguaagaaaguaauacaacucucacgcaagacuuuugauaccgaauaucaaaagacaaaacugaaugacugggauuuuguuguuacaacugauauuucagagaugggugcaaauuuuaaggcagauagagucauugacccacgaagaugucucaaaccuguaaucuuaacggauggaccagaacgcguaauccuggccgggcccaugccugugacaguggcaucugcagcgcagcgcagaggucggguaggaagaaauucacaaaaagaaaacgaccaauauauauuuacaggacaaccauugaauaacgacgaagaccacgcgcauuggacagaggcaaaaaugcuguuagauaauaucaauacccccgaagggauuaucccagcauuauuugagccagaaagagaaaagagugcagccauagacggugaauacagguuaaaaggugaaucaaggaaaaccuucguagaacuuaugaggcggggagacuuaccagucugguuagcacacaaaguagcaucagaagguauuaaauauaccgauagaaagugguguuucgacggagaaaggaauaaucaaauccuagaagaaaacauggacguggaaauauggacuaaagaaggagagaaaaagaaacuacguccuagauggcuagaugcuagaacuuacagcgauccguuagcauuaaaagaguuuaaagauuuugcagcaggacgaaaauccauagcacuagacuugguuaccgaaauagggcgaguccccagccacuuagcacauagaacgcgaaacgcauuagauaaucuagugaugcugcacacuagcgaacacgguggcagagcauaucgccacgcagucgaagaguugcccgaaacaauggaaacgcuuuuacuuuuaggucuaaugauacuucuuacugggggagcgaugcuguuucuaaucucgggaaagggcaucgguaaaacaagcaucgguuuaaucuguguaguagccuccagugggaugcuauggauggccgaugucccguuacaauggaucgcaucggcgauugugcuugaguucuuuaugaugguuuuauuaauaccugaaccagaaaaacagagaacaccucaagauaaccaguuagcguacgucguuauuggaauacuuacucuggcagccauaguagcugcaaaugaaaugggccuauuagaaacaacaaaacgagaucuuggcaugucgaaagagcccgggguugucuccccaacuuccuauuuagacguagaucuacaucccgcuucugcauggacguuauaugcugucgcgacuacaguaauaacaccgaugcuccgccacacaaucgaaaauucuacagcuaauguaaguuuggcggcaauugcaaaucaggcugugguuuugaugggucuugauaaaggauggccaauuuccaaaauggauuuagguguaccccuauuagcauuaggguguuacucacaagugaacccguugacauuaacagcagcaguauuacuauuaguuacucacuaugccaucauagggcccgggcuccaggccaaggcuaccagggaagcacagaaaagaacagcugcuggaaucaugaaaaauccgacuguugauggaauaaugacgauagacuuggacccgguaaucuaugauagcaaauucgaaaaacaacucggucaaguaaugcuguugguccucugugccguccaauugcuucuaaugcgcacgaguugggcguucugugaggcucucaccuuggcuaccggaccuauaaccacacucugggaagguucuccggguaaauucuggaacacaacaauugcggugagcauggcgaauauauuccguggaucauaucuagcaggggcuggauuagcuuucucgauaaugaaaucggucggaacagguaaaagaggaacgggaucucaaggagagacauuaggcgaaaaauggaaaaagaaauuaaaucaguuaaguaggaaagaauuugauuuguauaaaaagaguggaauaaccgaaguagacaggauugaagcaaaagagggucuuaagcgaggagaaauaacccaccacgcuguauccagaggaagugcaaaacuucaaugguucguggaaagaaauaugguaauuccggagggaagagugauugauuuaggauguggacgggguggaugguccuacuacugugcaggucuaaagaaagucacugaagugaggggcuacacuaaaggcgggcccggucaugaggagcccgucccaaugucaacuuacggguggaauauagucaaauuaaugagcggaaaagacguguuuuaccuaccgccggaaaaaugcgacacacuucugugugacauaggagaaagcagucccagucccacgguagaagagucuagaacaaucagaguccuaaaaaugguagagcccuggcugaaaaacaaucaguucuguaucaaaguauuaaacccuuauaugccgacaguuauagagcacuuagaacgacuacaaaggaaacaugguggaaugcuaguaagaaacccgcuuagucguaauaguacacaugaaauguacuggauaagcaacggaacggguaauauagucucgaguguaaauaugguuaguagauugcuccucaacagauucacuaugacacaccgaaggccaacaaucgaaaaggauguagauuugggggcaggaacacgacacguuaacgcugagccggagacgccaaauaugaaugugauaggcgagcguauaagacggauaaaagaagaacacaguaguacauggcauuacgaugacgagaacccguauaagaccugggcauaccacggaaguuaugaagucaaagcaaccgguucagcaucuucaaugauaaauggcguaguaaaacuacuuacaaaaccaugggauguaguuccaaugguaacucaaauggccaugacugauacuacacccuucggucaacaacgagucuuuaaggaaaaagucgacacaaggacgccgagaccaaugccagggacucguaaggucauggaaauaacagcugaaugguuauggcgaacauugggccgcaauaagagacccagauuaugcacgagggaagaauuuaucaagaaaguucguaccaaugccgccaugggagcuguauucacggaggaaaaccaaugggauucggcaagagcagccguagaggacgaagaauuuuggaaauuggucgauagagaaagagaauuacauaaauuaggaaaauguggcucauguguauacaauaugauggguaagcgugagaagaaauuaggugaguucggcaaagcuaaaggaucaagggcaauaugguauaugugguuaggcgcuagauaucucgaauuugaagcacugggcuuccuaaaugaagaccacugguuuucaagagaaaauagccauaguggaguugaaggcgaggguuugcauaaacuugguuacauccucagagauauaagcaaaauuccuggaggugcaauguaugccgacgacacugcagguugggacacucgaauaacugaagaugaccuacauaaugaagagaagaucacccaacaaauggacccggaacaucgacaacuagccaacgcuauauucaaguuaacauaucaaaauaaaguagugaagguucaaagacccaccccuaaaggaacugugauggacaucauuucacgaaaagaucaacgaggaaguggacaggucggcacuuacggauuaaacacauucacuaauauggaagcucaauugauaagacaaauggagggcgagggcguuuuaaguaaagccgaucuugaaaauccucacuugcuggaaaagaagguuacacaguggcuagagacgaaaggaguggagcgucuuaagagaauggcaauaaguggggacgauuguguagugaaaccuauagaugauagauucgcaaacgcuuuacuugcguuaaacgauaugggaaaaguacgaaaagauaucccgcaauggcagccaagcaaaggauggcaugacuggcaacagguuccguuuugcagucaucacuuucacgaacuuauuaugaaagacggccgcaaauuaguaguuccgugcagaccucaagacgaauuaauuggcagagcucggauaagccaaggugcuggauggucuuuacgcgaaacagccugcuuggguaaagcauaugcacagaugugggcguuaauguacuuucauaggagagaucuaagacuggcauccaaugcaaucuguuccgcggucccaguacacugggugccaacuucaaggaccacguggagcauacaugcucaccaucaauggaugaccacggaggacaugcuaacgguauggaauagaguauggauagaggacaacccauggauggaagacaagacaccaguuacaacuugggaagauguaccuuaucuugguaaaagagaggaucaauggugcggcagcuugaucggcuugacgucacgggcgacaugggcccaaaauauucuaacagcaauacaacaagucagaucauugauagguaaugaagaauuucuagacuacaugccuucaaugaaaagguuuagaaaagaagaagaaccugagggagcaauaugguaa

SEQ ID NO: 23533 - RNA, 9873 nt, Artificial Sequence
  derived and/or modified CDS sequence (opt6) from DENV-3__FJ644564__SS-prME
acuucacuaugucuaaugaugauuuuacccgcugcauuggcauuucacuugacaagcagagacggggaaccacgaaugaucguaggcaaaaaugaaagggggaaaucauuguuauuuaaaacugcaucggguauuaacauguguacguuaauagcaauggacuugggagaaaugugugacgacacugugacguacaaauguccacacauuacagaaguagaaccagaagauauagauugcuggugcaauuugacaaguaccuggguaaccuacgguacuuguaaucaagcaggagaacacaggcgagauaaaagaagcguagcccuagcaccacauguaggaaugggucucgauacuagaacacaaacauggaugucggcugagggagcauggcggcaaguagaaaaaguugaaacaugggcauugagacacccaggauuuacaauacuugcacuauuuuuggcacacuauauuggaacaagucuaacgcaaaaaguaguuauauuuauacuucuaaugcugguuacuccgucaaugacgaugcguugcgugggugucgggaaucgagacuuuguugaaggauuaucuggagccacuugggucgaugucguacuugaacauggaggauguguaacaacaauggccaaaaauaaaccuacauuagauauagaacuucagaaaacagaagcgacgcaacuugcuacgcugcguaaauuaugcaucgaaggaaaaauaacuaauauuacuacugacucgcguuguccaacucaaggagaagcuguccuuccagaagaacaagaucaaaauuauguuugcaaacauacauauguagacaggggaugggguaauggcugcggccuuuuugggaaaggaucccuagucacaugugcaaaauuucaaugucuagaaccgauagaaggaaaagucguacaauaugaaaaccucaaauauacaguaauuauaacuguccauacaggggaccaacaccaaguaggcaacgagacgcaagggguaacagcagaaauaaccccacaagcgaguacgacugaagcgauuuuaccggaauacggaacccuugggcuagaaugcaguccucgaacgggauuagauuucaacgaaaugauccuccuaacgaugaaaaauaaagccuggaugguacaucgucaaugguuuuucgaucugccauuaccuuggacaagcggugcaacaaccgaaacgccaacguggaaucgcaaagaguuauuagugacguucaaaaaugcgcaugcgaagaaacaagaaguaguugugcuaggaucacaagaaggagcuaugcauaccgcguuaacgggagcaacagaaauccaaaacaguggagguacaaguaucuuugcuggucaucucaaaugcagauugaaaauggauaaacucgagcuuaaggguaugagcuaugccauguguacuaacacauucguuuuaaagaaagaaguaagugaaacacaacaugguaccauucuaaucaaaguagaauauaagggggaagaugcucccuguaaaauccccuuuucaacggaagacggccaaggaaaagcccauaaugggagacuaauuacagcuaauccgguggucacuaagaaagaagaaccggugaauaucgaagccgaaccaccauuuggcgaguccaauauaguaauugggauaggagauaacgcauuaaaaauuaacugguauaagaaaggaagcucaauagggaaaauguucgaggccacagcaaggggcgcaagacgaauggcuaucuuaggagauacagcaugggauuucgggucuguagggggaguacuaaacaguuugggaaagaugguacaucaaauauucgggucggcguacacggcgcuauuuucuggaguaucauggguuaugaaaauaggcauaggaguccuauugacuuggauaggcuugaauaguaaaaauaccaguaugucauuuuccugcauugcaauuggcauuauaacauuauaccucggagcgguugugcaagcagauaugggguguguuauaaacuggaaagguaaagaacugaaauguggaagugggauuuucguaacaaaugaagugcacacguggacggaacaauacaaguuucaagcagauucaccaaaacgacuagcaacagcgauagcaggagcaugggagaacggaguauguggaauaagaucaacaacacgcauggaaaacuuacuauggaaacaaaucgcgaaugagcucaauuauauauuaugggaaaauaacauuaaauuaacuguuguagugggugacacaauagguguacucgaacaaggaaaaaggacccuuacaccacaaccaauggaauugaaguauucguggaagacguggggaaaagcuaaaaucguaacagcugaaacacaaaauucaucauuuauaauagacgggccaaauacuccagagugcccgucugcaucaagggcuuggaauguaugggaaguagaagauuauggauucggaguauuuacaaccaacauauggcuuaaauugcgggagguauauacacagaugugugaccauagacucaugagugcagccguaaaggacgaaagggcugugcaugcagacaugggguacuggaucgaaucucagaagaaugggucauggaaacuugaaaaagcaucccuuauagaagucaaaacuugcacuuggccaaaaagucacacccucuggucuaaugguguauuggaaagugauaugauaaucccaaaaucacuugcaggaccuauaucacaacacaaucacaggccaggauaccacacccagacagccgggccauggcacuuagagaaucuagaacuugauuucacuuacugcgagggaacuacaguaguaauuacagagaauuguggcacucgggguccaucacuacguacgaccacgguaaguggaaaauuaauucacgaauggugcugucgaagcuguacacuaccaccucuaagauacaugggugaagaugguuguugguacggaauggaaauucguccaauuucagaaaaagaagaaaauauggugaagucacuuguuagugcugguagugguaaaguugauaacuuuacaaugggcaucuugugccuugcaauacucuucgaagaaguaaugcguggaaaauuugggaagaaacacaugauagccgggguguucuuuacuuuugucuuauuauugagcgggcaaauaacauggagagauauggcacauacauugauaaugauaggcagcaacgcgucagaucggauggguauggggguuacauaucucgcccuuauagccacauucaagauacaaccauuucucgcucuuggcuucuuucuccgaaaguuaacaucacgggaaaacuuacuacuaggaguagguuuagcaauggcaacuacucuccaauugcccgaagacauugaacaaauggcaaauggaauugcacuuggguuaauggcgcucaaauuaauaacacaauuugaaacguaccaauuauggacugcccugauaucauuaacauguucaaauacaauauuuacauugacaguagcauggagaacggcaacccuaauucucgcaggcguaucccuauuaccuguaugucagagcagcucaaugagaaaaaccgauugguugcccaugacaguagccgcuaugggggucccuccucuuccucuauucauauucucacuuaaggauacacugaaacgucgcucguggccgcucaaugaaggcgucauggcagucggccuugugucuauacuugcaagcucacuccuaaggaaugacgucccaauggcaggaccucuaguugcuggaggcuuacuuauagcuugcuacguaauaacugggacuucagcugaucucacagucgaaaaggcagccgauguaacuugggaggaagaagccgaacagacagguguuucccacaauuuaaugauaaccgucgacgaugaugguacaaugagaaucaaagacgaugaaacagaaaauaucuuaacgguauuguuaaaaaccgcccuacuaauuguaucgggaaucuucccauauuccauuccugcgacgcuauuaguauggcacacauggcaaaagcaaacgcaacgaagcgguguauuaugggacguaccauccccgccagaaacacaaaaggcagaacucgaagaaggaguauauagaaucaaacagcaaggaauuuuaggcaaaacgcaagucgggguugggguucaaaaggaaggggucuuucauacuauguggcauguaacuagaggagcuguacuaacucauaacggcaaacgucuagagccaaacugggcaucagucaagaaagaucuaauuucuuaugguggaggguggcgucuaucggcucaauggcaaaaaggagaggagguacaagucauagccguugagcccggcaaaaacccgaagaauuuccaaacuaugccaggaacauuucaaaccaccacaggugaaauaggggcaauagcgcuagauuucaagccaggaaccucugguucccccauuauuaaucgugaaggaaagguuguuggucuauauggaaacggcgugguaaccaaaaacggaggauacguaaguggaauagcucagaccaaugcugaacccgauggcccaacaccagaauuggaagaagagauguuuaagaaacgcaaucuuacaauuauggaccuacacccaggcuccggaaagacacguaaauaccuuccggcaauuguucgcgaagcaauuaaacguaggcucagaacgcuaaucuuagcgccaaccaggguuguugccgcagaaauggaggaggcuuuaaaaggacuacccauucgauaucaaaccacagcuacuaaaucugaacauaccggaagagaaauaguagauuugaugugucacgcuacguucacaaugcgacuucugucuccaguacgagugccuaauuauaaucuaauaaucauggaugaagcucacuuuacggauccagcaucaauugcagcuaggggauauauaucgacucgagugggaaugggagaggccgcugcaauauucaugagugccacaccuccggguacugcugaugcuuucccucaaaguaaugcaccuauacaagaugaggaacgcgauauaccugagagaucauggaacucuggaaacgaauggaucacagauuuugcagguaagacagucugguuuguaccuaguauuaaagcugguaacgacaucgcuaacuguuuacguaagaaugguaagaaaguaauacaacuaucaagaaaaaccuuugauacagaauaucagaaaacgaaacugaaugauugggauuuuguagucacuacagauauuagugaaaugggcgcuaauuucaaggcagaucgcguaauugauccuagacgcugucuuaaaccuguaauacuaacagaugguccagaaaggguaauauuagcggggccgaugccggucacagcagcgucagcagcucagagaaggggcaggguuggaagaaacccccagaaggaaaaugaucaauauaucuuuacuggucaaccacugaauaacgacgaggaccacgcucauuggacagaagccaaaaugcuacuagacaacauaaauacuccugaaggaauaauaccugccuuauuugaacccgaaagagagaaaagcgcugcaaucgauggugaauaccgacuuaagggagagucaagaaaaacguucguagaacucaugaggagaggagauuuacccguauggcuugcgcauaagguagcuucugaaggaaucaaguauacagauagaaaaugguguuuugauggacaacgcaauaaucaaauauuagaagaaaacauggacguagagaucuggacaaaagaaggugagaagaagaaauuacgaccccguuggcuugaugcgcgaacuuacucggauccucuggcacucaaagaauuuaaagacuuugcugcgggaaggaaaagcauagcgcuugaccucgucacugagauaggacguguaccgucucaucuagcacaccguacccgcaaugcauuggauaaccuagugauguugcauacaagugaacaugguggcagagcguacagacacgcgguugaagaguugccugaaacaauggaaacuuuacuguuacuuggcuuaaugauauuacuuacagguggagcuaugcuuuucuuaauuucagguaaagguaucgguaaaacgucgauaggauugauauguguaauagcgucuaguggcaugcuauggauggccgaaauaccucuccaauggaucgccucagcuauaguacuggaguucuuuaugaugguuuuguuaauaccagaaccagagaaacagcgaacaccacaagacaaucaguuggcauacgugguaauaggcauccuaacuuuggcggcaauuauagcggccaacgaaaugggacugcucgaaacuacgaaacgagacuuagguaugucaaaagaaccaggaguaguaucaccaaccaguuaccuagacguugauuuacauccagcaucggcuuggacgcuuuacgccguagcaacaacaguaaucacuccaaugcuucgucacacaaucgaaaauucuacggccaacguaagccuagcugcaaucgcaaaucaagcaguuguauuaauggggcuagauaaaggauggcccauaaguaaaauggaccuuggaguaccacucuuagcacucggauguuacucccaagucaacccgcugacauuaacggcagcgguucuguuacuuauaacgcacuaugcuauaauugguccuggacuacaagcaaaagccacaagggaagcacaaaaacgaacggcagcgggaauaaugaaaaaccccacgguagacggcauaauuacaauugauuuagaucccgucauuuaugacucaaaauucgagaaacaauuaggacaagugaugcuuuuaguauuaugcgcaguacaacuccuauugaugcgaacguccugggcacuuugugaggcuuuaacacuagcaacagggccaauuacuacacuuugggaagggucucccggcaaauucuggaacacuacgauugccguaucaauggcaaauauauuucggggaaguuaucuagccggagcagguuuagcauuuaguauaaugaagucaguaggaaccgguaaacgugggacaggaucccaaggagaaacgcugggugaaaaauggaagaagaaauugaaccagcuaucacguaaagaauuugauuuguauaagaaaagcgguauaacagaaguagauagaacagaggcaaaggaaggauugaaacguggagaaaccacccaucacgccguuagcagaggcucagcuaaauugcagugguuagucgaacgaaacaugguaauaccggaaggaaggguaauagaucuaggguguggccggggcggauggucauauuauugcgcggggcuaaagaaaguaacagaggucaggggauauaccaaaggaggucccgggcacgaggaacccguaccuaugucuaccuacggcuggaacaucgucaaauuaauguccggcaaagauguguucuaucugccgccagaaaaaugugacacccucuuaugcgauauaggcgaaaguaguccuaguccgacuguagaagagagcagaacaauuagaguauugaaaaugguugaacccuggcucaaaaauaaccaauuuuguauaaagguuuuaaacccuuacaugcccgcaguaaucgagcaccuggaaagacuccagaggaaacauggagguauguuaguaagaaacccauuaaguaggaacucuacucaugaaauguauuggauaucuaauggaacgggaaauauaguuaguagugugaauauggugucccgucuacuucuuaauagauucacaaugacgcauagaagaccuaccauagaaaaggauguagaucuuggagccggaacgcgacaugucaacgcagaaccugaaacaccuaacauggaugucaucggcgagagaauuaagcgaauuaaggaagaacauaacaguacuuggcacuacgacgaugagaauccuuacaagacaugggcuuaucacggcucauaugaagugaaagccacgggauccgccaguaguaugauuaauggaguaguaaaguuguuaacaaaaccaugggacguaguaccuauggugacucaaauggcaaugacagauaccacgccauuuggucaacaaaggguauuuaaggaaaaaguugacacuaggaccccgagacccaugccagggacgcgaaagguaauggaaauaacugccgagugguuguggcgaacauugggaaggaacaaaaggccgagacuaugcacaagggaagaauuuacgaagaaagucaggaccaacgcugcaaugggggccguuuucaccgaagaaaaucaaugggauucagcuaaagcggcagucgaagacgaagaauuuuggaaauuaguugacagggaacgagaauuacauaaacuagggaaaugugguaguuguguguauaauaugaugggcaagagagagaagaaacuaggagaauuugguaaagcgaaaggaagcagagccauuugguauaugugguuagguuccagauaucuagaauuugaagcguuaggcuuuuuaaaugaagaucauugguuuucacgcgagaauagcuauuccggaguugaaggagaaggucugcauaagcuggguuauauccugagagacauaucaaaaauaccgggaggagcaauguacgcagaugacacugcagguugggacacgcgaauuacagaagacgauuugcauaacgaagaaaagauaacccaacaaauggauccugaacaccggcuucuggccaaugccaucuucaaacuaacauaccaaaauaaaguugugaagguacagagaccgacgccgacagggacagucauggauauuauaagcaggaaagaucaacgcggaaguggucagguggguacuuauggucuaaacaccuuuacuaacauggaagcacaacuugugaggcaaauggaaggagaaggaguguuaucuaaggcugaucuagagaacccccaucugccugaaaagaaaauaacacaauggcuggaaacgaagggcgucgaacgucuaaaaaggauggcaauaaguggugaugacugcguaguuaaaccuauagacgacagauuugccaaugcacuauuagcucucaacgacaugggaaagguacggaaagauaucccccaauggcagccgaguaaagguuggcacgacuggcaacagguaccguucuguucucaccauuuucacgagcuuauaaugaaagaugggagaaaauugguuguccccugucgcccacaagacgaauugauaggcagagcuaggauuucacagggagcagguuggucccuccgagaaacugcuugcuuagguaaggcguaugcccaaauguggucucuaauguacuuccauagacgagauuuaagauuagcuaguaacgcuauuuguucagcgguuccaguacauuggguaccaacgucaaggacgacuuggaguauacaugcgcaucaucaauggaugacaacagaggauaugcucacagucuggaaucgaguauggauagaggacaacccguggauggaagauaaaacuccgguaacaacuugggaaaauguaccuuaucuagggaaacgggaggaucaauggugugguucccuaauaggccuuacuucaagagcaacaugggcccagaauauacccacagcaauacaacaagugagaucgcucauaggaaacgaggaguuucuugacuauaugccuagcaugaaacguuuuaggaaggaagaggaaagcgaaggagccauaugguag

SEQ ID NO: 23534 - RNA, 9873 nt, Artificial Sequence
  derived and/or modified CDS sequence (opt6) from DENV-3__HQ235027__SS-prME
acaucucuuugccucaugaugauauugccagcugcacucgcuuuucacuuaacuagcagagacggagaaccgagaaugauaguagguaaaaaugaaagagggaaauccuuauuauuuaaaacagcaagcggaauaaauauguguacucucauugcaauggaccuaggagaaaugugcgaugauacuguaacauacaaaugcccccauauuacagaaguugaacccgaagacaucgauuguuggugcaaccuaacaaguacaugggugacauauggaacuuguaaucaggcgggugaacacagacgagauaaacgcaguguggcauuggcgccacauguaggaauggguuuagauacaagaacacaaaccuggaugagugcugaaggcgcuuggaggcaaguugaaaaaguagaaacgugggcccucaggcaucccggauucacuauauuggcgcuuuucuuagcgcauuacauaggaacgucacucacucagaaaguuguaauuuucauacucuugaugcugguaacccccagcaugacgaugagaugugucgguguagguaaccgagauuuugucgaaggauugucuggagccacuugggucgacgugguacuagaacauggaggaugugucaccacgauggcuaaaaauaaaccaacauuagauaucgaauugcagaaaacagaagcaacacaauuggcuacguugcggaaauuauguauagaaggaaaaauaacgaauauuacuaccgauaguagaugcccaacucaaggagaagcaguucuuccagaagaacaagaucaaaacuauguaugcaaacauaccuacguagacagaggauggggaaacgguugugguuuauucgggaaaggaucucucgucacaugugccaaauuucaauguuuagaaccaauugaaggcaaagucgugcaguacgagaaccuaaaguacacugucauuauuaccguccacacaggagaccaacaccaaguagguaaugaaacgcaaggagucaccgccgaaauuacaccacaagccaguacuacggaggcaauacugccugaauacggaacccuaggguuagaaugcucaccacguacugggcuagauuuuaacgagaugauacuguuaacuaugaaaaacaaagcauggaugguacacaggcaaugguucuuugaccuaccacuuccuuggaccucuggugcuacaacagagaccccaaccuggaaucguaaagaacucuugguaacuuucaagaacgcacacgcuaaaaagcaagagguagugguacucggaucccaagaaggggcgaugcacacugcauugacuggagccauugagauacaaaacuccggaggcacaagcauauucgcuggucaccuaaagugccgucucaaaauggacaaacucgagcuuaaagguauguccuaugcaauguguacaaagacauucgucuugaagaaagaaguaucagaaacacaacauggcacuaucuuaauaaaaguagaauacaaaggggaagaugcgccgugcaaaauucccuuuucaacugaagacggucaagggaaggcuuauaacggcagacuaauaacagcaaauccaguagucaccaagaaagacgagcccgugaauaucgaagccgaaccaccuuuuggagaaucuaacaucguuauagguauaggggacaaugccuuaaagauaaauugguauaagaaagguaguucuaucggaaaaauguuugaagcgacggcacguggagcaagacgcauggccauucugggugauacggccugggauuucggaucuguuggugguguacugaacucguugggcaaaaugguacaccagauuuucggaagugcauacaccgcuuuauucucaggggucucuuggguaaugaaaaucgguaucggugugcuuuuaacauggaucggccuuaauucuaaaaauauuucaaugucauuuucguguauugcuauaggaauaauaacucuguacuuaggugcagugguucaagcagauauggguuguguaauaaacuggaaaggcaaagaacucaaaugcgguucaggaaucuucguaaccaaugaaguacacacauggacugaacaauauaaauuccaggcagacagucccaaaagauuggcuacagcuauagccggugcaugggagaacggagugugcggcauaagaaguacgacccguauggaaaacuuguuauggaagcaaauugcaaacgaguugaacuacauacuaugggaaaauaacaucaaacuaaccgugguagucggagacacaaucggggucuuagaacaagguaagcggaccuugacuccacaaccaauggagcugaaauacuccuggaagaccugggggaaggcaaagauugucacggcagaaacucaaaauucgucauucauuauagaugguccgaauacgccggagugcccaucagcuucuagagccuggaauguaugggaaguagaggauuauggcuucggcguauuuacuacaaauauuugguuaaaacugagagaagucuauacccaauuaugugaucacaggcuuaugucagcugcuguuaaagaugaacgggcgguccaugcggauaugggguacuggauagaaagucagaaaaauggaaguuggaaacuugaaaaggccucauuaauagagguaaaaacgugcacguggccuaaaagucauacgcuaugguccaacgggguacuggaaagugacaugauaauaccuaaaaguuuagcgggaccuauuucucaacauaaccauagaccagguuaccauacucaaacagcaggaccauggcaccuaggaaaauuagaauuggacuucaacuauugugagggaacaacagucgugaucacggaaaauugugguaccagagguccuucuuuacgcacgacaacaguaaguggaaaauuaauacaugaauggugcugcagaucgugcacauuaccuccguuaagguauaugggggaagacggcugcugguacgguauggaaauaagaccuauaagcgaaaaagaagaaaacaugguaaagagucugguuagugcaggaagcggaaaaguagacaacuuuacaauggguguguuaugcuuagcaauccuauuugaagaaguaaugcggggaaaauuugguaagaaacauaugauagcagggguuuucuuuacguucguacugcuguuaucgggucaaauuaccuggagagacauggcacacacccuaaucaugauaggcucaaacgcaagugaucgaaugggaaugggaguaacauaucuagcccuuauugcaacauuuaaaauacaaccauucuuggcauugggauuuuuccuacgaaaguuaacaucaagagaaaaucucuuguuagguguaggguuagccauggcuaccacgcuacagcucccugaggauauagagcaaauggcaaauggcauagccuuaggccuaauggcucugaaauuaauaacacaguucgaaacauaccaacuauggaccgcacucaucucucuaacaugcucuaauacaauguuuacacuuacgguugcguggcguacugccacacuaauucuagcaggaguuucuuugcugccaguuugucagucauccaguaugaggaaaacagauugguuaccaauggcaguggcagccaugggcguuccacccuuaccucuauuuauauuuagccuuaaagauacauugaagcgcaggucuuggcccuuaaaugaggguguuauggcaguaggccuaguaaguauccucgccagcucucuucucagaaaugacguaccaauggcugggccuuuaguagccgguggauuguuaauugcuugcuacgucaucacagguaccagcgcggauuugacaguagaaaaagcugccgauauuacaugggaagaagaagcagagcaaaccggagugucccauaauuuaaugauuaccguggaugacgacggcacuaugcguaucaaagaugaugaaacagaaaauauucucacaguucuacuuaaaacagcacugcucguagugucuggaguuuucccauauaguaucccagcaacacuauugguauggcacaccuggcaaaagcagacacaaagaucaggggugcuuugggaugugccuucgcccccugaaacacaaaaagcggagcucgaagaaggaguuuauaggauaaaacaacaaggaauuuuuggcaaaacccaaguagguguaggaguccaaaaagagggaguuuuucacaccauguggcacguuacccgaggcgcaguauuaacauacaauggaaagcguuuggagccgaacugggccuccgucaagaaagaccuaauuagcuaugguggugguuggagguuguccgcacaauggcaaaaaggggaagagguccagguaauagccguugaaccagguaaaaacccuaaaaauuuucaaacaaugcccgggacauuucagacaacgacaggagaaauuggagcaauagcccuagacuuuaaaccuggcacaaguggauccccaauaaucaaucgugaagguaaaguuguaggacuauacgguaaugggguuguaacuaaaaacggcggauacguuaguggaauagcacaaacaaacgcggaaccagaugguccaacuccggaacuagaagaggagauguucaagaaacgaaaucucacaauaauggaccuacauccaggcucaggcaagacgagaaaauacuugccggcaauugugagggaggcaauaaagagacgacuccggacgcugauccuagcaccaacaagagucguugccgcggaaauggaggaggcuuuaaagggccuuccuauacguuaucaaaccaccgcuacaaaaucggaacacacugguagagaaauaguagaccuaaugugccaugcaacauucaccaugcgcuuauuauccccugucagaguuccaaauuauaaucuaauaauaauggacgaagcgcauuucacggacccugccuccauagcagccagaggauauauuucaacaaggguagguaugggggaagcagcagcgauuuuuaugaccgcaaccccaccaggaacugcagacgcauuuccccaaaguaacgcaccaauucaagaugaggaacgcgacauuccagaaagaaguuggaauagcgggaaugaauggauaacagacuuugcaggaaagacagugugguuugugccaucgaucaaagcuggaaaugauauugcuaauugccugaggaaaaaugguaagaaaguaauacagcuuucgagaaaaacuuuugauaccgaauaucagaaaacuaaauugaacgacugggauuuugucguaaccacugauauuucugagaugggagcuaacuuuaaagcagauagagucauugauccacgucgcugccucaaacccguaauucuaacggauggaccagaacgugucauucucgcuggaccuaugccaguaacagcugccucagcggcacaacgcaggggacgcguugguagaaacccacaaaaagaaaaugaucaauacauuuuuacaggacagccguuaaauaacgacgaagaucacgcucauuggacagaggcaaaaaugcucuuggauaacauaaauacucccgaagguauaauaccugcauuauucgaaccagagagggaaaagucagccgcaauagauggcgaauaucgacugaaaggugagucaagaaaaacauucguagaauuaaugagaagaggagacuuacccguguggcuggcucauaaaguugcauccgaagguaucaaauacacagacagaaaauggugcuuugauggccaaagaaauaaccagaucuuggaagaaaauauggauguggaaauauggacaaaagaaggcgagaaaaagaaauuacggcccagaugguuggaugcacgaacauacuccgacccacuugcguuaaaagaauuuaaagacuucgcugcagggagaaagaguauugcauuagauuuggucacggaaauugggagaguaccgagucaccucgcacaucggacucgaaaugcacuagauaauuuaguuaugcuucauacaucugaacacggaggacgggcauauagacaugccguggaggaacuacccgaaacuauggaaacacuacuauuauuaggauuaaugauuuuauugacugguggagcgaugcuauucuuaauaucugguaaaggcaucggcaaaacaucuauaggguuaaucugugugauagcaagcaguggaauguuguggauggcggaaauaccuuuacaauggauagcuagugccauaguccuggaguucuuuaugaugguucuuuuaauacccgaaccagaaaagcaaagaacgccacaagacaaucagcuagcauauguuguaauuggaauccuuaccuuagcagcaauuauagcugcuaacgagaugggauugcuagaaacgacuaaaagagauuuagguaugucaaaggaaccggggguaguuucaccgacuuccuauuuagauguagaccuccacccagcuucggcauggacguuauacgcaguugcaaccacgguuauaacgccaaugcuaagacauacaauagaaaauucuacggcuaauguaucuuuggcagcgauugcaaaucaggccguaguacuaaugggacuugacaaagguuggccaauaaguaaaauggaucucgggguaccuuuacuagcacuugguuguuauagucagguaaacccccucacacucacugcagcgguccucuuauugauaacccacuaugcaaucauaggacccgguuuacaagcgaaagcaacuagagaagcgcaaaaacgcacugcagcagggauaaugaaaaauccgaccguugaugguauuaugaccauugaucuggaucccguaauauaugacucaaaauucgaaaaacaacugggccaaguaaugcuauuagucuuaugugccguccaacuucuuuuaaugcguacaucuugggcacugugugaagcucuaaccuuagcuacuggaccaauuacaacacugugggagggaaguccagguaaguucuggaacacuacaauugcaguauccauggcaaauauauuuagggguuccuaucuagcaggagcaggucuagccuucaguauaaugaaaaguguugguacggguaaaagaggcacgggcagucaaggcgaaacucucggcgaaaaguggaaaaagaaacuuaaucaguugagcagaaaagaguucgacagguacaaaaagucaggcauuacugaaguagacagaaccgaggccaaagaagggcuaaaaagaggggaaacuacacaccaugcagucucaagagggucagccaaauugcagugguucguugagagaaauauggucauaccugaaggcagagucauugauuuggguuguggacgaggcgguugguccuauuacugcgcuggccugaaaaagguaacggagguaagaggguacacaaaaggcgguccuggccaugaagaacccguaccgaugaguacauauggauggaauauaguaaagcuaaugucggggaaagacguauuuuacuugccaccugaaaaaugugauacuuuacuuugcgacauaggcgaaucuagcccuagcccgaccguagaggaaucucguacaauuagaguacucaagaugguugaaccauggcucaagaacaaucaauuuuguauuaaaauauuaaauccauauaugccuacugucauagaacaucuugaaagacuacagaggaaacacggagggauguuagucagaaauccccucucucgaaauucaacccaugaaauguacuggauauccaacgggaccggaaauauagucgccuccguaaauaugguuuccagacuucuauugaauagauucacuaugacccauaggcgccccaccauagaaaaggacgucgaucugggugcugguacucgucacguaaacgcagagccggaaaccccaaauauggacgugauaggugaacggauaaaaagaaucaaagaagaacacaauaguacuuggcauuaugaugaugagaauccuuauaaaacuugggcguaccacggcucuuaugaagugaaagcgacaggaucggcuucuucaaugauaaauggaguagugaaacuuuuaacuaagcccugggacguagucccaauggucacgcaaauggccaugacugacacuacaccguucggacaacaacgcgucuuuaaagaaaaagucgauacuaggacaccgcguucuaugccggguacuaggagaguuauggggauaaccgcugaaugguuauggagaacauuaggcaggaacaagaaaccacgauuauguacuagggaagaauuuaccaagaaaguaagaacaaacgccgcaaugggggcuguguucacagaggaaaaccaaugggauagugcaaaagcagcaguugaagacgaagauuucuggaaacuuguagauagagaacgugaauuacauaagcucggaaaaugcggcucguguguuuacaacaugaugggaaagcgcgaaaagaaguuaggcgaauuuggaaaggcuaagggaucgcgggcaauuugguauaugugguuaggagcuagauacuuagaguucgaagcgcuaggguuucuaaaugaagaccacugguucucaagggaaaacagcuacagugggguugaaggcgaaggccuacauaaauuaggauacauucuaagagauauauccaagauaccagggggcgcaauguaugcagacgacacugccggcugggauacaagaauuacugaggacgauuuacauaaugaagagaaaauaacccaacagauggaucccgaacauagacagcuugcaaacgcuauauuuaaauuaacauaccaaaauaaaguagugaaagugcaaagaccuacaccaacuggaacaguuauggacauaauaagccgaaaagaccaacguggaucuggacaaguaggcacauacgggcuuaacacguuuacuaacauggaagcacagcucauccgacagauggagggagaagggguacuaagcaaagccgauuuagaaaacccacaucuuccugagaagaaaauuacacaauggcuugaaacuaaaggagucgaaagguuaaaacgcauggcuaucucaggcgacgauuguguuguaaaaccaaucgaugauagauuugcgaacgcauuacuugcuuuaaaugauauggggaaaguccgcaaagauaucccacaauggcaaccaucuaaggguuggcacgauuggcaacagguucccuuuuguagucaucacuuucacgagcucaucaugaaggacggaagaaaguuagugguaccuugucguccacaagacgaacuaauaggacgagccagaauaagccaaggugcugguuggucacuaagagagacggcaugucuaggaaaagcauaugcgcaaauguggagucuaauguauuuucaccggagggacuuaagauuagcuagcaaugcaauaugcagcgcaguaccagugcauuggguucccacuucacguaccacuuggucgauucacgcucaccaccaauggaugacaaccgaagauauguuaacuguauggaaccgcguauggauugaagacaauccauggauggaagauaaaacgccggugaccacgugggaagaugucccauacuuaggaaaaagagaagaccaauggugcgguucauugauaggacuaacuagcagggcaacaugggcccagaacauaccuacggcaauacagcaaguaaggagcuugauaggaaacgaagaguucuuagauuacaugccaucuaugaaacgcuuucguaaagaagaagagucugaaggcgcaauuugguaa

SEQ ID NO: 23535 - RNA, 9873 nt, Artificial Sequence
  derived and/or modified CDS sequence (opt6) from DENV-3__JQ920476__SS-prME
acuucacuuugccugaugaugauguugccagcaacucuagcuuuucaucugacaucgagagauggagaaccgagaaugauuguagggaaaaaugaacgugguaaaagucuacuauucaaaacggcaaguggaauaaauaugugcacacuaauagcuauggaucugggagaaaugugugaugauacuguaacauauaaauguccacuuauuacugaagucgaaccagaggacauagauugcugguguaauuuaacgucaacuugggugaccuaugguaccugcaaccaagcaggggagcacaggcgagacaaaagaucuguugcuuuagcgccucacguaggaauggggcuagauacacggacccaaacuuggaugucggcagaaggagcauggcgccaaguggaaaaaguugaaacaugggcauuucgucauccagguuuuacuauauuggcauuauuucuagcucauuacauaggaacaucguugacacaaaaaguggugauauuuauucugcuaaugcuuguuacaccaagcaugacuaugagaugugucggagucgggaaccgcgacuuugucgaaggauuaucuggagcaaccugggucgaugucguuuuagagcaugguggauguguuaccacgauggcuaaaaauaaaccaacuuuagauauagaauuacagaaaacugaggcuacucaacuugcaacacuaaggaaacuauguaucgagggaaaaauuacuaauguuacaacagauucaaggugcccaacccaaggugaagcgauauugccugaagaacaagaucagaauuauguaugcaaacauacauauguugauagaggauggggaaacgguugcggacuauuugguaaaggaagccuaguuacaugcgcuaaguuucagugccuagagucgauugaaggcaaagcggugcaacaugaaaacuuaaaguacacugucauuauaacgguacacacuggagaucaacaccaaguaggaaacgaaacucagggcguaaccgcggaaauaacgccucaggcuucuaccguagaagcaauacuuccugaauacgggaccuuaggccuagaauguagcccgcgcacaggccuagauuuuaaugaaaugaucuuacuaaccaugaaaaacaaggcuuggaugguacaccgucagugguucuuugaucuuccuuuaccauggacaaguggugcaaccacagaaacacccacguggaacaagaaggaauuauuaguaacguuuaaaaacgcucacgcaaagaagcaggaaguuguugucuuaggcagucaggaaggggcgaugcauacagcucugacaggugcuacggagauucagacgucuggaggaacaagcauauuugcgggucacuuaaaauguagauuaaaaauggauaaauuggaacuaaaagguaugucguacgcuaugugucuaaaugcauucguuuuaaagaaagaaguuagugagacacaacacgggacgauacuuauaaagguagaauacaaaggagaagaugcuccauguaagauaccauucaguacagaagauggucaagggaaagcacauaauggaagacuaaucacagcaaaucccauaguaacuaagaaagaagaaccuguaaacauagaagcugaaccaccauucggagaaucaaacauaguaauuggaauaggagacaaagcacucaaaauuaauugguauaagaaagggucuucgauagguaaaauguuugaggcaaccgcgcguggagcucguagaauggcuauauuaggagauacagcuugggauuuuggaucuguaggaggaguacucaacucacugggaaaaaugguccaccaaauuuucggcucugcguauaccgcucuauuuucuggggucuccuggauaaugaaaauaggaaucggcguguuauugacguggauuggacuaaacagcaaaaacacaucaaugagcuuuucauguauagucaucggaauaauuacauuauauuugggcgcaguaguccaagcugauauggguugcguaauuaauuggaagggaaaggaguuaaaaugcgguucugguauuuucgugacuaacgaaguucacacguggacagaacaguacaaauuucaagcagauucaccuaaacguuuagcuacugcuaucgcuggcgcuugggaaaacggcgugugugguauaaggucaacuacaaggauggaaaaccugcuuuggaaacagaucgccaacgaacuuaauuauauacuaugggagaauaauauaaaauugacaaucgucguuggagauguuauuggaguacuagaacaaggaaaaaggacgcuuacaccacagccuauggaacugaaguacaguuggaaaacauggggcaaggcuaaaauaguaacggcugaaacccaaaacucauccuucauaaucgaugggccgaauacucccgaauguccaaaugcaaguagagcuuggaauguuugggaggucgaagauuacggauuuggugucuuuacaacgaacauuuggcucaaacuuagagagauguauacacaacucugcgaucaccgccuaaugagugcagccgugaaagacgaaagggcaguacacgcggacaugggcuauuggauagaaagccagaaaaaugggagcuggaagcucgagaaagcgagccucauagaaguuaaaaccugcacauggccaaaaucacacacccuguggaguaaugguguucuagaaagcgauaugauaauaccaaaaucauuagcaggaccgauuucacaacacaauuacagaccaggauaccauacacaaaccgcuggacccuggcaccucggcaaacuggaacuagacuucaauuacugcgaaggaacuacaguuguaauuacugaaaauugcggaacacggggcccaucuuuacgaacuacuaccgucagcggcaaacuaauacaugagugguguugccggaguugcacccuaccgccacuacgauauaugggugaagaugguugcugguacggaauggaaauucgaccaauuaaugaaaaagaagaaaacauggugaaaucucugguuucggcgggauccgggaaagcggacaauuuuacuaugggaguacuuugcuuagccauacuauucgaagaaguuaugcgaggaaaauuuggcaagaaacauaugaucgccggugcacuguucacauucguguuguuacucaguggucaaauuacauggcgagauauggcacauacucuaauaaugauaggcucaaaugcgucugaucguauggguaugggugugacauacuuagcucucaucgcaacuuucaaaauccaaccauuccuggcguuagguuucuuuuuacgaaaacuuacaagucgugaaaauuugcucuuagggguuggucuagcaauggcaacgacgcuucaacuaccagaagauauagaacaaauggcgaacggaauugcccuagggcuaauggcuuuaaaauuaaucacgcaguuugaaacauaccagcuuuggacagcacuugugagcuuaauguguaguaacaccauuuucacuuuaacgguggcguggcgaacagcgacauugauucuugccguuauaagucuauuaccggucugucagaguucaaguaugagaaaaacagauuggcucccaaugacaguagcagccaugggcgucccuccucuuccauuauuuaucuuuucuuuaaaagauacucuuaaaagaagaagcuggccauugaaugagggaguaauggcagugggauugguaucaauacuggcuucuagcuuuuugagaaaugauguaccuauggccggcccccuaguugcagggggauuacuuauugcguguuacguaauaacagggacaucugcugaccuuacgguggaaaaggcugccgacgucacuugggaagaagaggcagaacaaacaggaguaucucauaauuuaaugauaacaguagaugacgacggcacgaugcguauuaaagaugaugagaccgagaacauauugacaguauugcuuaaaacggcguuacuaauagucucaggaauauuuccuuauaguauuccggcgacuuuauugguuuggcauacauggcagaaacaaacacaacgcuccgggguucucugggauguaccaagucccccugaaacacaaaaagcagaacuagaggagggagucuauagaaucaaacaacaggguauuuucgggaagacccaaguagggguuggcguucagaaggagggaguuuuucacacuauguggcacgucacaagaggggcaguuuuaacccauaacggaaagagauuagagccaaauugggccaacguuaaaaaggaccuuauauccuacgguggcggauggaaguugagugcucaauggcaaaagggggaagaaguacaagugauagcaguagaaccuggcaaaaacccaaagaacuuccaaacgaugccaggaaucuuucagacuacuacaggugagauuggagcuauugcucuagacuucaagccaggaacaaguggaagcccuauuaucaauagagaggguaaagucguagggcuuuacggaaauggaguuguaaccaaaaauggugguuaugucucuggaauagcacagacgaaugcagaaccagacggcccaaccccugaacuagaagaagaaauguuuaagaaaaggaaucuuacgauuauggaccuacacccugggagcgguaaaacaagaaaauaccuccccgcuauagucagagaagcaauaaaacgaagacuacguacucuuauuuuagcucccacccgagugguggcggcagagauggaagaagcgcuuaagggauuaccgauccguuaccaaaccacagcuacaaaaucagaacauacgggacgggaaauuguagaucugaugugccaugcaacauucacuaugagguugcugaguccugucagagugccuaauuauaaccucauaguaauggaugaggcucauuuuacggauccugcgucaauugcagcaaggggauauauauccaccagagugggaaugggcgaagccgcagcgauuuuuaugacagccacuccgccaggaacugcugacgcauucccccagucaaaugcgcccauucaagaugaggaacgggauauaccagaacgcagcuggaauagcggcaaugaauggauuacggacuuugcugggaaaacgguaugguucgugccgaguauuaaagcaggaaacgauaucgcaaauuguuuacggaaaaauggcaagaaaguaauacaauugaguagaaagacauuugauacagaguaccagaaaacgaaacuuaacgauugggauuucgucguaacuacagauaucucagaaaugggugccaacuuuaaagcugauagaguaaucgauccuagacgauguuugaaaccaguaauccuuacagauggaccagaacgaguaauccuagcugguccgaugccaguuacaguugccucggcagcucaaagacgaggaagaguaggacgcaauccgcaaaaggaaaaugaccaauacauuuucacaggccaaccacuuaauaaugacgaagaccaugcacauuggacggaagcuaagaugcuauuagacaauauaaauacaccggaaggcaucauaccugcacuguucgaaccugagagggagaaaucugcggcaauagacggugaauacagacugaaaggagagagccgaaaaaccuucgucgaauuaaugcgaagaggagaucucccgguaugguuagcacacaaaguugcgucagaagguaucaaauauacagacaggaaaugguguuucgacggugagcguaacaaccagauacuggaagagaacauggacguagaaauauggacaaaagaaggugaaaagaagaaauuacgucccaggugguuagacgcgagaaccuacagcgacccacucgcacugaaagaguuuaaagacuuugccgcuggcaggaaauccauugcacuugaucuaguuacugaaauaggaagaguuccuucccaccuugcgcaccgcacgagaaaugcauuagauaaucucguaauguuacacacaagcgaacauggugguagagccuaucgccaugcuguagaagaacugccagaaacuauggaaaccuuacuuuuauuagguuuaaugauauuauuaacugguggugcaaugcuguuuuuaauaucuggaaaggguauaggaaaaacaaguauaggauuaauuuguguuguugcaucgaguggaaugcuauggauggcagacguaccccuacaauggauugcauccgcaauaguguuagaauuuuucaugauggucuuauugaucccugagccugaaaaacagaggacuccccaagacaaccaacuugcauacguuguuaucgguaucuuaacuuuagccgcaauaguugcggcgaaugaaaugggacuacuugaaacaacaaagcgugacuuaggcaugagcaaagaaaguggcguaguuucaccgacauccuauuuagacguagaucuacaucccgcgucagcguggacccuauaugcaguugcuacgacuguaauaacaccgauguugcgacauacaauagagaacucaacagccaaugugaguuuggcugcaauagcgaaccaagccguuguguuaaugggucuagacaaagguuggccaauaaguaaaauggaccuagggguaccacuccuugcauugggauguuauucucagguaaauccacuaacccuuaccgcagcggucuuauuguuaguaacacacuaugcgauuauugggcccggucugcaggcgaaagcaacucgugaggcccaaaagagaacggcagcaggcauaaugaagaacccuacagucgacggcauaaugacaauugaccuagaccccguaauuuacgacaguaaauuugaaaaacagcucggacaagucauguuacucguacuaugugcaguucaauugcuacuaaugagaaccaguugggcauuuugcgaagcauugacacucgccacagggccgauaacgacacuaugggaaggcucgcccgguaaauuuuggaacacuacaaucgcgguuucaauggcgaauauauuucgaggaagcuaucuagcgggcgcaggacuggcuuuuuccaucaugaaaaguguggggacuggaaaacguggaacaggaucacaaggagaaacacugggagaaaaguggaagaagaaacuuaaccaacuuucuagaaaagaauuugauuuauacaagaaaagcggaaucacggaaguggaucguacagaggccaaagaaggauuaaaaagaggagaaauaacucaucacgccguaucaaggggauccgcuaaacuucaaugguucguagaacguaauauggucauuccagaaggacggguuauugauuuaggaugcggaagaggagguuggucuuauuauugcgccggauuaaagaaaguuacggaaguacgcggauauacgaaaggugguccgggucaugaagaaccgguccccauguccacguaugguuggaauauaguaaaauuaaugucugggaaagauguauuuuaccuuccuccagaaaaaugugacacuuuauuaugcgacauaggagaaucauccccaucaccaacagucgaagaaucucguacaauacgaguuuuaaaaaugguagaaccuuggcucaaaaauaaccaguuuuguauaaaaguucuuaaucccuacaugccuacuguuauugagcaucuggaacgacuacagcgaaaacauggagguaugcuuguaaggaauccuuuaagccgaaauucgacacacgaaauguauuggauuaguaauggaaccggaaacauaguaucgucagucaacaugguuagcagauuauuauugaauagauuuacaaugacgcaccgaagaccaacaauugagaaagauguagaucugggagcggguaccagacauguuaacgcugaaccugagaccccuaacauggacguuauuggagaaagaaucagaagaauaaaagaagaacauucuagcacauggcauuaugaugaugaaaaucccuauaagaccugggccuaucauggaagcuaugagguuaaggcgacgggcagugcaucaaguaugauuaacgguguaguaaaacuucuaacaaaaccaugggacgugguuccgaugguuacacagauggcuaugacagacaccacaccuuuuggccaacaaagaguauuuaaagagaaagucgacacuagaacaccaagaccuaugccuggcacacggaaagugauggagauaacagcagaaugguuauggcgaacucucggcagaaauaaaaggccaagacuguguacccgagaagaguucaucaagaaagucagaaccaaugcagcaaugggagcaguuuucaccgaagaaaaucaaugggauucugcuagagcugcaguugaagaugaggaauuuuggaaacugguugaccgcgagcgagaauuacauaaauuaggaaaaugugggaguuguguauauaauaugaugggaaaacgagagaagaaauuaggagaauuuggcaaggcgaaaggaagccgggcgauaugguauauguggcuuggagcaagauaucuugaauuugaagcgcuaggcuucuugaaugaagaccauugguuuucacgggaaaauucacacucgggagucgaaggagaaggucuacauaaacuaggcuacauauuaagagacauaucgaaaauacccggcggggcaauguaugccgaugauacagcuggaugggauacuagaauuacagaagaugaucugcauaacgaggagaaaauuacacaacaaauggacccagagcauagacaacuugcaaacgcaaucuucaaacuuacguaucaaaauaaagugguaaagguacagcgaccuacaccaaaaggaacaguuauggauaucauaaguagaaaagaccaacgagguagcggccaagucgguacuuauggcuuaaacacauuuacaaauauggaagcucagcucauaaggcaaauggaaggcgagggaguuuuaucaaaagcugacuuagaaaacccgcaucuacuugaaaagaagguaacgcaaugguuagaaacuaaaggaguggagcgacuuaaacgaauggcgauaucaggggaugauugcguaguaaagccgauagacgaccguuucgccaaugcguuguuagcgcuaaaugauaugggaaagguacggaaggauauuccacaauggcaaccuagcaaaggauggcacgauuggcaacagguuccuuuuugcagucaucauuuucaugaacugauuaugaaagauggacguaagcucguggugccaugccgaccacaggaugagcucauaggcagagcucggauuucacaaggggcuggauggucucugcgagaaacagcaugcuuaggaaaagcguaugcacaaaugugggcacuaauguacuuucaucgccgagauuuaagacuagcaagcaacgccauauguagugcuguucccguacacuggguuccaaccagcagaaccacauggaguauucaugcacaccaucaauggaugacuaccgaagauauguuaaccguuuggaaccgaguguggauugaggacaaucccuggauggaagacaaaacuccaguuacaacaugggaagacgucccauauuugggaaaacgagaagaucagugguguggaucacuuaucgguuuaacuucaagggcaacaugggcacaaaauauacucacugcuauccaacagguaagguccuuaauaggaaacgaagaguuccucgacuacaugcccucaaugaaaagauuccgcaaagaagaagagagugaaggagcaaucugguag

SEQ ID NO: 23536 - RNA, 9873 nt, Artificial Sequence
  derived and/or modified CDS sequence (opt6) from DENV-3__JQ920477__SS-prME
acuucauuaugucuuaugaugauguuaccugcuacgcuugcguuucaucucacaucaagagauggggaacccagaaugauagucgguaaaaaugaaagaggaaagagcuuauuguucaaaacugcgagcggaauaaauaugugcacauuaauagcaauggauuuaggcgaaaugugugaugauacgguaacuuauaaaugcccccuaauaacggaaguagaacccgaagauauugauugcugguguaaccuuacuucuacaugggucacuuacggcacaugcaaccaagccggugaacauaggagggacaagcguucaguugcacucgcaccgcacguagguaugggcuuagacaccagaacacaaaccuggaugagcgcagaaggagccuggcgacaaguagagaaaguagaaacuugggccuuuaggcauccagguuucacaauauuagcuuuauuccuggcucauuauaucggaacuucccucacgcaaaaaguagugauauuuauucuucugaugcugguaacacccagcaugaccaugcguuguguaggagucgguaaccgcgacuuuguagaagguuugucuggagccacaugggucgaugucguuuuagaacacggaggaugcguaacuacuauggcuaaaaauaaaccaacgcuugauauagaacuccagaaaacagaagcaacacaacuugccacauugcgaaaauuaugcauagaggguaaaauuaccaaugucacaacagacagucgcuguccaacucaaggagaggcuauacugccagaggagcaggaucaaaacuacguauguaaacacaccuacguugaucgaggauggggcaauggguguggacuauucggaaaaggcaguuuagugacuugcgcaaaauuucaaugccuagagucaaucgaaggaaaagccguacaacaugaaaacuuaaaauacacaguuauaauuacaguacauacgggcgaucaacaccagguaggaaaugagacacaaggcguaacugccgaaaucacuccucaagcuaguaccguggaagcuauuuugccugaguacgguacuuuaggauuagaauguucgccucgaacuggucuagacuucaacgaaaugauacuauugaccaugaaaaauaaggcuuggaugguucaccgacaaugguucuuugaccuuccauugccauggacuucuggagcaaccaccgaaacuccgaccuggaacaagaaagaacuuuuaguaacuuuuaaaaaugcgcaugccaagaaacaggaaguuguaguacuugggucccaagaaggcgcaaugcauacagcucuaaccggagcuaccgagauucagacgaguggagggacuucuauauuugcaggccaccuaaaaugcagauuaaaaauggauaaauuagaacuuaaaggcaugucauaugcaaugugccucaaugcauuuguacuaaagaaagaaguaagugagacgcagcacggaacaaucuugauaaaaguagaguauaaaggggaagacgcuccauguaaaauuccguucucaacugaagauggucaagggaaagcacacaacggccgacuaauuacagcuaauccaauagugaccaagaaagaagaaccuguaaauauugaggcggagccuccauucggagaaucaaacauugugauagggauaggggauaaagcauuaaaaauaaauugguacaagaaagguagcuccauaggaaaaauguuugaggcaacugcaaggggagcuaggagaauggccauacuuggagauacugcaugggacuucgguucuguugguggaguacuaaauagcuugggaaaaaugguccaccaaauauucggaagugcauacacugcacuauuuucagguguaucguggauaaugaaaauaggaaucggcguucuccuuacuuggaucgggcucaacuccaaaaauaccucuaugaguuuuucauguauugucauagggauuauaacucuauaccuaggagcuguaguucaagcggacaugggauguguaaucaacuggaaagguaaagaauuaaaauguggcuccgguaucuucgucacaaaugaaguacacacauggaccgaacaguacaaauuucaagcagacagcccuaaacgacuagccacugcuauagcgggagcaugggaaaaugguguuuguggcauuagaaguacgaccagaauggaaaacuuacuauggaaacaaauagccaacgaacugaauuauauacuaugggagaauaauaucaaauuaacaauuguaguuggggaugugauagggguuuuggaacaagggaaacguacacuaacaccucaaccaauggaacugaaguacucuuggaagacguggggaaaagccaagauaguaacugcagagacacaaaauucuagcuuuauuauugacggcccgaacacucccgaauguccuucagcacugcgagcauggaaugugugggaaguagaagacuauggauuugggguuuucacaacuaacauaugguuaaaacugcgagaaaaauauacacaacuaugcgaucaucguuuaaugagcgcagcugugaaagaugaaagagcuguacacgcugauaugggguauuggauugaaucucaaaagaauggcucguggaaacuugaaaaggcuucucuuaucgaaguaaaaacauguacuuggccgaaaucgcauacauuauggucgaacgguguauuagaaagugauaugauaauacccaaaucccuugcuggccccauaucacaacacaacuaucgcccgggguaucauacacaaacagcaggaccguggcauuuagguaaauuagagcuugauuucaauuauugugaaggaacuaccguggucauaacagaaaauugugguacaaggggaccgagccuucgcacgacaacggucucaggaaagcugauacacgaauggugcuguagaagcugcacucuacccccauuaagauauaugggagaagauggaugcugguacggaauggagaucaggcccauuaaugaaaaggaagagaacaugguaaagucgcugguuagcgcagguagcggaaaaaccgauaacuucaccaugggaguuuuaugccuugccauacuauuugaggaaguaaugcgaggaaaauuugggaagaagcacaugauugcaggcgcccuuuucacuuucgucuuacuauuaucgggucaaaucacuuggcgagauauggcacauacguuaauaaugauagguaguaacgcuagugacaggauggguauggguguaacauauuuagcauuaauagcuacauuuaaaauccaaccuuucuuggcccuugguuucuucuuaagaaaacuaacgucuagagaaaaucuacuauuaggagugggauuggcgauggcgacaacuuuacaauuaccugaagacaucgaacaaauggcaaacggcauagcacuaggguuaauggcucuuaaacuaauaacacaauuugaaacauaucaguuguggacggcgcuggucucauugaugugcucuaauacgauauucacuuugaccguugcuuggcguacagccacauugauccuagcuguaauaagucucuuaccuguaugucaaucuaguucuaugcguaaaacagauuggcuaccaaugacuguagcagccaugggcgugccacccuugcccuuauucauauuuucacuuaaagacacauugaaaaggcgauccuggccguugaaugagggaguaauggcaguaggacugguuagcauccucgcaagcagcuuuuuacggaaugacgugccuauggcaggaccuuuaguugcuggggguuuacuaauugccuguuacguaauaacaggcacgagugccgaccuaacuguagagaaagcugcggacguaacaugggaagaagaagcagagcagacuggagucucucacaauuuaaugauaacuguagacgaugauggaacgaugagaauuaaagacgacgaaaccgagaauauacuaacaguuuuacucaaaacagcuuuacuuauaguuucgggcauuuucccauacucaauaccagcaaccuuauuaguguggcacacguggcaaaagcaaacgcagcggucuggaguucuuugggacguacccaguccgccugagacccaaaaagcagaauuagaagaagggguuuaccggauaaagcaacaaggaauuuuuggcaagacucaagucggaguagguguucagaaagaaggaguauuccacacuauguggcauguaacaagaggggcgguucuaacccauaauggaaagagacuugaaccuaauugggcaaaugugaagaaggaucuuauuucuuacggaggcggauggaaacuaagcgcucaauggcaaaaaggagaagaagugcagguuauagcagucgagcccggcaaaaaucccaagaacuuccagacaaugccaggaauuuuccaaacaacuacgggugagauaggggccauugcauuagacuuuaaaccuggcacuagcgguucaccgauuauaaaucgagaaggaaaaguagugggucucuacgggaauggaguaguaacaaagaauggaggauauguaucgggcauagcccaaacgaaugcagagccggacggucccacgccagaguuggaagaagaaauguucaagaaaaggaaccucacuauuauggacuugcauccagguagcgguaaaacccgaaaauauuuacccgcaauuguaagagaagcuaucaagcggagacuccgaacguuaauacucgcaccaacgcggguaguagccgcagaaauggaggaagcacuuaaaggguuaccaauucgauaccaaacaacagcaacaaaaucagagcacaccggucgugagauaguugauuuaaugugucacgcuacauucaccaugcgacuccucucaccuguucgaguucccaacuacaauuuaauaguuauggaugaagcacauuucacagauccggcgucaaucgcagcccgcggauauauauccacgagggucgggaugggggaagcagcagcuauaaguaugaccgcaacuccaccggguacagcagacgcguuuccacagagcaaugcuccgauacaagacgaagaacgagacauuccagaaagauccuggaacucaggaaacgaguggaucacagacuuugcaggaaaaacuguuugguucgucccuaguauuaaagcagguaacgauauugccaauuguuuaaggaaaaauggcaaaaagguuauccaacuaagccgcaagacauuugauacugaguaccagaagacuaaacuuaaugauugggacuuugucgucacgacagauauaucggagaugggugccaacuuuaaggccgaccgagugauugauccccguaggugccuaaagccaguaauucuuacugauggaccagaaagagucauucuggcuggaccgaugccuguaacagucgccagugcugcgcaaagacgaggaagaguuggacgaaauucacaaaaggaaaaugaccaauauaucuucacgggucagcccuuaaauaacgaugaagaucacgcgcauuggacugaagcuaaaauguuauuggacaauauuaacacuccagaaggaauaauacccgcguuauucgaaccagaaagagaaaagucugcagccauagacggggaauaucgacuaaaaggagagagccggaaaacauucguagaauuaaugcgcagaggcgaucucccaguaugguuagcccacaaaguagcuagugaaggaauaaaauacacagauagaaaauggugcuuugacggagagaggaauaaucaaauacuugaagaaaacauggauguggagaucuggacaaaagaaggagaaaagaagaaacuacgaccucgguggcuggaugcgagaacguacagugauccucuugcccugaaagaauuuaaagacuucgcagccggccgaaagucuauugcacuagaccuaguuaccgaaauaggaagaguaccuucgcaucuagcacacagaaccagaaaugcacuugacaauuuagugaugcuccauacaagcgaacauggagggagagcguaucgacacgcgguugaggagcuaccugagacuauggaaacauugcuacuacuuggauuaaugauucuuuuaacagguggagcaaugcuauucuugauuaguggaaaaggaauugguaaaacaucuauugguuugaucugcgucguggcuaguuccggcaugcucuggauggcagacguuccauuacaauggaucgccagugcuauagugcuugaauuuuucaugaugguuuugcugauaccagagccagagaaacaacggacuccucaggauaaucagcuagcuuacguagucauuggcauauugacacuagcugcuaucguugcugcaaaugaaauggguuuauuagaaacuaccaagagagauuuaggaaugucuaaagaaccuggcgugguuaguccaacauccuacuuagauguggaccuucauccugcuagcgcauggacucuauaugccguagcuacgacggucauaacgccaaugcuacgacauacaauagaaaacaguaccgcgaauguaucuuuagcugcgauagcaaaccaggcgguaguacuaaugggauuagauaaagguuggccuauuagcaaaauggaucuaggagugcccuuguuagcauuaggaugcuauagccaaguaaauccucucacuuuaacagcugcaguccuucucuuaguaacacauuaugcaauaauugggcccgguuuacaagcaaaagcaacgagagaagcacagaaaagaacagcagccgggaucaugaaaaaucccaccguagaugggauaaugacaaucgauuuagacccagugaucuaugauagcaaauuugaaaaacaguuaggccaagucauguuauuaguacugugugccguacaacuacuauuaaugagaacgaguugggcauucugugaggcgcucacuuuagcuaccggaccaauaacaacucuaugggaaggaucaccaggaaaauucuggaauacaacuauagcuguaucaauggcaaauauuuuccgaggcucauacuuggcgggggcgggauuggccuucaguauuaugaaaaguguugguaccgguaaacgcgguacagggagucaaggagagaccuuaggcgaaaaauggaaaaagaagcuaaaucaacugagccgcaaagaauuugauuuauacaagaaaagcggaauuacugagguagaucgcaccgaagcaaaagagggacuaaagcguggagaaauuacgcaucacgccguuucucgagggucagcaaaacuacagugguuugucgaaagaaauaugguaaucccagaaggucgcguaauugaucucggauguggacgcggcggaugguccuacuacugcgcuggcuuaaagaaaguaacagaaguacgaggcuauacgaaagguggcccuggacacgaagaaccuguaccaaugucgacuuauggguggaauauagugaagcuaaugucaggaaaggacguguucuacuuaccacccgagaaaugcgauacgcuauuaugugauaucggagagucaucgccgaguccuacuguugaggaaucucgaacaauaagggugcuaaaaauggucgaaccguggcugaaaaauaaccaauucugcauaaaaguauugaacccauacaugccaacggugauugaacauuuggaaaggcuccagcgcaaacacggcggaaugcuugugagaaauccguuaaguagaaacaguacacaugagauguacuggauuaguaauggaaccggaaacauuguuuccucuguuaauaugguaucacguuuguuauuaaauagauucacgaugacucacaggagacccaccauugaaaaagauguagacuuaggugccggaacacgacauguaaaugcagaacccgaaacuccaaauauggaugugauaggugaaaggauacgacgaauaaaggaagaacacucuagcacguggcacuaugacgaugagaacccguauaaaaccugggcguaucacggguccuacgaaguaaaggcaacaggaucagccaguucaaugauuaaugggguggugaaauuacuuaccaaaccaugggauguggugccuaugguuacccaaauggcuaugaccgauacuacgccuuuuggucaacagaggguuuucaaggagaagguagauacucguacuccacgccccaugccaggcacuaggaaaguaauggagauuacagcugaauggcuauggcgcacuuuaggcagaaauaagagaccgagauugugcaccagagaggaguucaucaagaaaguuaggacaaaugcagcaaugggggcuguguucacggaagaaaaucaaugggauagugccagagccgcaguugaagacgaagaauuuuggaagcucgucgaucgggaaagagagcuucauaaauuagggaaaugugguucauguguuuacaauaugaugggaaaacgagagaagaaacucggagaguucggcaaagcgaaaggauccagggccauuugguacaugugguuaggagcuagauaccuagaguucgaagcguuaggauuuuuaaacgaggaucacugguucagucgagaaaauucacauaguggcgucgaaggggaaggguuacacaaguuaggcuauauuuuaagagacauaagcaaaauaccagguggugcaauguaugcggaugauacagccgguugggauacacguauaacagaagaugaccuccauaaugaagagaaaauuacucaacagauggacccugaacauagacaacuggccaaugcgauauuuaaauugacauaucagaacaaggucguaaaaguucaacguccaacgccaaaagguacuguuauggacaucauuucccguaaagaucaacgugggucugggcaagucggcacauauggacuuaauacuuuuacuaacauggaagcacagcuaauacgacaaauggaaggcgaagggguuuuaucaaaagccgacuuagagaauccucauuugcucgagaagaaaguaacacaaugguuagaaaccaaaggaguagagcguuuaaagcguauggcaauaucgggggaugauuguguaguaaaaccaauagaugacagauuugcaaaugcacuacuagcuuuaaaugauauggguaaaguuaggaaagauauuccacaauggcaaccgaguaaaggguggcaugacuggcaacaaguaccauuuuguagccaucacuuucacgaguuaauaaugaaggauggccgaaaguuaguagugccgugccguccucaggaugagcuuauaggccgugcuaggauuucacaaggggcaggauggucucuucgugaaacagcauguuuggguaaggcuuacgcgcagaugugggcgcuuauguauuuucaccggagggacuuacgauuagcuucaaaugcuauauguagugcuguucccguacauuggguccccacgucucgaacaacauggagcauacaugcacaucaucaauggaugaccacagaagauauguuaacaguuuggaacagaguauggauagaggauaacccauggauggaagacaagacgccgguuaccacuugggaagacguaccguaucucgguaagcgagaggaccaauggugcggcagccuaauaggccuaacgucucgagcaacgugggcgcagaacaucuuaaccgcgauacaacaaguaaggucacuaauuggcaacgaagaguuuuuagacuauaugccuagcaugaagcgcuucagaaaagaagaagaaagugaaggggcaauaugguaa

SEQ ID NO: 23537 - RNA, 9873 nt, Artificial Sequence
  derived and/or modified CDS sequence (opt6) from DENV-3__JQ920478__SS-prME
acuucauuaugccuaaugaugaugcuuccagcaacucucgcauuccaccuaacuucuagggauggagaaccuaggaugaucguaggcaaaaaugaacgugguaaaagucuucuguuuaaaacugccaguggaauaaauauguguacauugauugcuauggaucuaggugaaaugugugaugauacuguaacauauaaauguccauugaucacugagguagaaccagaggacauagauuguuggugcaaucucacgucaacaugggucaccuauggcacuuguaaucaagccggagagcaucgcagagacaaaaggagcguggcucuggcaccacauguagguaugggacucgauacuagaacacaaacauggaugagugcagagggcgcuuggcgucaaguagaaaaaguugagacuugggcauuuagacaucccggcuuuacaaucuuagcacucuuuuuagcacauuacaucgggacaucauuaacccagaaaguagugauuuuuauacucuugauguugguaacgccgucuaugaccaugagauguguaggcgugggaaaccgggacuuuguagagggguugaguggcgcuaccuggguagauguagugcucgaacauggugguugcguaaccacuauggcgaaaaacaaaccgacacuggauauagaguuacagaaaacugaagcaacacaguuagcuacucuaagaaaauuaugcauugaaggaaaaauaacaaauguuacuacagacagcagaugcccaacacaaggugaagcuauccuaccagaagaacaagaucagaacuacguuuguaaacacacauacgucgauagaggaugggguaacggauguggcuuauuugguaaaggaaguuugguuacaugcgcuaaauuccaauguuuggaaucuauagaaggcaaagcaguucaacaugagaaucuuaaauacacuguaauuauuacuguacacacuggagaucagcaucaaguggguaaugaaacgcaaggggucacugcugagauaaccccucaggcaucgaccguagaagcaauacuaccugaauacgguaccuuggggcuugagugcaguccuaggacuggucuugauuuuaaugaaaugauccuacugacgaugaaaaacaaagcguggaugguacauaggcaaugguuuuucgaccucccguuaccauggacguccggugcgacaacugagacuccaacauggaauaagaaagaguuauuaguaacauuuaaaaacgcucacgccaagaaacaggaagugguaguccucgguucccaagaaggagcaaugcacacggcgcuaacuggagcaaccgaaauucaaacgagcagaggaacuucaauuuuugcgggccauuuaaaaugccgacuaaaaauggacaaauuagaauugaaaggaaugaguuacgcaaugugccuaaaugccuucguacuuaagaaagaaguaagugaaacucaacauggaacaauauuaauuaaaguagaauacaaaggagaggacgccccuugcaaaaucccguuuucuacagaagacggccagggaaaagcccacaacggaaggcucauuacagcaaacccaaucguuacaaagaaagaagaaccggugaauauugaagcugaaccgccguuuggagaaaguaauauuguuauuggaauuggggacaaggcauuaaagauuaacugguacaagaaaggaagcucgauugguaaaauguuugaagcuaccgcuaggggcgcgagaaggauggccauauugggggauacagcuugggacuuuggaaguguaggugguguacucaacagccugggaaaaauggugcaccagauuuuugguagcgcuuacaccgcucucuuuucggguguaucuuggaucaugaagauuggaauaggcguguuacucacguggauuggccuuaauaguaaaaauacaucgaugagcuuuucuugcauuguuauaggaauaaucacuuuauaucucggcgcuguaguucaggccgauaugggcugcguuauaaacuggaaaggcaaggaauugaagugcggcagcggaauauucguuacaaaugaggugcacacuuggacggaacaauauaaguuccaagcugacucuccaaaaagacuagcaacggcuauagcuggugcgugggaaaaugggguauguggaauaagaucaacaaccaggauggaaaauuugcucuggaaacagauagcaaaugaauugaauuacauacucugggaaaauaauauuaaguuaacaauuguuguaggggauguaauaggaguacuagaacaaggcaagcgaacgcuaaccccacaaccaauggaauuaaaauacuccuggaaaaccugggggaaagcaaaaauagugacugcugagacucaaaauucuaguuuuaucauagacgggccuaauacgccagagugcccaagugcgcuacgugcauggaacguuugggaaguagaagauuauggauucggagucuuuacaacgaauauauggcucaaauuacgagaaaaauauacacaacuaugugaccacagacuaaugucggcggccgucaaagaugagagggcgguacacgcugacauggguuauuggauagagagucagaaaaauggaucguggaaacuugagaaagcaucacuaaucgaaguuaaaaccugcacauggccaaaaagucauacauuauggaguaacgggguacuagaaucagacaugauaauaccgaaaaguuuagccgggccgauaagucaacauaauuaucgcccgggauaucauacacaaacugccggcccauggcacuugggaaaacuugaguuagauuuuaauuacugcgaagguacaacaguugugaucaccgaaaacugugggacacgugguccuucacuaagaacaacgacuguuagugguaaauuaauacaugaaugguguuguagaucaugcacacuaccuccccucagguacaugggagaggaugggugcugguaugguauggaaauacgacccaucaaugaaaaagaggaaaacaugguaaagagucuugucagugcggggucaggcaaaacagacaacuucacgaugggagucuuaugccuugcuauacuauuugaagaaguuaugcgcgguaaauuugguaagaaacauaugauagccggugcuuuauuuacguucguguuguuguuauccggacagauaaccuggagagacauggcacacacucucauuaugauaggaucgaaugcaucggaucguaugggaaugggagugacauaccuagccuugauagccacauucaaaauccaaccauuucuagcguuaggguucuuucuuagaaaauuaacuucacgugaaaauuuauuauuaggaguuggacucgcgauggcaacuacacuccaacuaccagaggauauugaacaaauggcaaauggcauagcucuuggucuaauggcccuaaaacuuauaacucaauucgagacauaucaacucuggacagcauugauuagucuuauguguucuaacacgauauucacucucacgguagcauggagaaccgcuacacuaauauuagcuguuauuaguuuacuuccaguuugucaaaguaguucaaugcguaaaacugauuggcuaccaaugaccgucgcagcgaugggaguaccuccguuaccacuauucauauuuuccuuaaaagauacacuaaaacguagaucguggccuuuaaacgaggggguaauggcagugggauuaguuuccauuuuagcgaguuccuuuuuacguaaugacgucccuauggcaggcccccuaguagcgggagguuuacuaauugcuuguuacguuauaacaggcacaagugcugaccuaacaguagaaaaagccgcagaugucacaugggaagaagaagcugaacaaacaggugucucccacaaucuaaugauaacaguagacgaugaugguacaaugaggauuaaggacgacgagacagaaaacauuuuaacgguucuauuaaaaacggcucuccuuauugucuccggaauuuucccauacucaauuccugccacucucuuagucuggcacacguggcaaaaacaaacccaaagaaguggcguauugugggauguuccuucgccaccugaaacgcagaaggccgaauuagaagaagguguauacagaauaaaacaacagggaauauucgggaagacacaaguugguguaggaguccaaaaagaaggcguuuuccacacaauguggcacgugacuagaggagcagugcuaacucacaauggaaaacgacuugagcccaacugggcaaacgucaagaaagacuuaauuuccuauggagguggcuggaaauuaagcgcccaguggcaaaaaggugaggagguacaaguaaucgcuguagaacccggaaagaaucccaaaaauuuucaaacaaugccaggaauauuccagaccacuacuggugagaucggagcuauagcuuuagauuucaaacccgggacaagcggaucaccuauaauuaauagagaaggaaaaguaguuggguuauauggcaauggagugguaacuaaaaauggaggauacguaucagggaucgcccagacuaaugcagaaccagaugggccgacaccggaguuggaagaagaaauguuuaagaaacggaauuuaacuauaauggauuugcacccaggaucaggaaaaacccgaaaauacuugccugcaaucgugcgagaggcaauaaaacgucgguuacgaacauuaauccuagccccuacaaggguaguggcugccgagauggaagaagcguuaaaaggacuaccaauacguuaucagacaacggcaacuaaaucagaacauacuggacgggaaauaguagauuuaaugugccacgcaacauucaccaugcgauuacuaucuccaguacgcgucccuaauuacaauuuaauuguaauggacgaagcucauuuuacugauccagcaucuauugcugcuagagguuauauaaguacccgcguagggaugggugaggcugcugcaaucuucaugacggcaacuccaccaggaacugcugacgcauuuccccaaaguaacgcuccgauccaagacgaagaacgugauauaccagaaagaaguuggaacaguggaaacgaguggauaacagauuuugcuggcaagaccguuugguuuguaccaaguauaaaagcaggcaacgauauugcuaauugucugaggaaaaacgggaagaaagucauacaacugucgagaaaaacuuuugacacagaauaucagaaaacgaaauuaaaugacugggauuucguaguuaccacagauauaucagaaaugggugccaacuucaaagcugauagaguuauagauccccgucgauguuugaaaccgguaauauuaaccgauggcccugaacgagugauauuagcugggcccaugcccguaacagucgccucagcagcacagcgcagaggaagaguagguagaaauucacaaaaagagaaugaccaauacauauuuacaggacaaccacucaauaaugacgaagaccaugcacacuggacagaggcaaagaugcuuuuggacaauaucaauacgccagagggaauuauacccgcguuauuugaaccugaaagagaaaagagugcagcuauagauggugaauaucgucuaaagggagaaucuaggaagaccuucguugagcuuaugagaagaggugauuuaccagugugguuagcacacaagguggcgagcgaaggaauaaaauacacggauagaaaaugguguuuugacggugaacguaauaaucagauuuuagaagaaaauauggacgucgagauauggacgaaagaaggagagaagaagaaacuaaggccacggugguuagaugccagaaccuauucagaucccuuggcucuaaaggaauuuaaggauuucgcugcaggucggaaaaguauugcccuagacuuagugacugagauaggaagaguaccuucacaccuugcucaucgaacgagaaacgcauuagauaaucuagugauguugcauacaagugaacauggaggaagggcauaccgacaugcaguggaagaacuaccagagacaauggaaaccuuauuacuauugggacucaugauauuacucaccggaggcgcaaugcuauuccuuauaagugguaaaggcaucgguaaaacaagcauuggauuaaucugcguugucgccuccucuggaauguuguggauggccgauguaccucuccaauggauagcuucagcaaucguacuagaguucuuuaugaugguguuguuaauaccggaaccggaaaaacagagaacuccacaagauaaucaauuggcauacguaguaauuggaauauuaacacuagcagcuauugucgcagcgaacgaaaugggucuacuggaaaccacaaaacgagaccuuggaaugucaaaagaacccggaguuguaucacccacauccuaccuagauguugaccuacauccggccuccgcauggacauuauaugccguugcaacgacagugauuacgccuaugcuuaggcauacaauugaaaauaguacugcaaauguuucauuagcugcgauugcuaaucaagcaguuguauuaaugggauuagacaaaggauggcccauauccaaaauggaccuugguguuccucuucuggcccucggguguuacucccaaguuaauccacugacacuaacggccgcaguauuauuacuugugacacacuaugcaaucauaggcccuggcuuacaggcaaaagcuacaagggaagcccaaaagagaaccgccgcugguaucaugaaaaacccaacagucgacggcauaaugacgauagacuuagaccccguuauuuaugauucaaaauuugaaaaacaauuagggcaaguuauguuacugguauuaugugcgguucaguuacuacuuaugcggacaaguugggcauucugcgaggcuuuaacauuggccaccgguccuauaacgacauuaugggaaggaucuccaggaaaguucuggaacaccacaauugcugugucuauggcaaacaucuucagagguucauaucuugcuggagcuggauuagcauucucaauaaugaagucgguaggaaccggaaaacguggaacggggucucaaggggaaacuuugggggagaaauggaagaaaaagcucaaucagcugucaagaaaagaauuugaccuauacaagaaaucuggcauaacagaagucgaccgaacugaagcuaaagagggauuaaagagaggagaaauuacucaucaugcagugaguagaggaucggcaaaacuccaaugguucgucgaacgaaacauggugauaccggaaggcagaguuauugaccuaggaugcggacgagguggauggagcuacuacugugcuggacucaagaaagugacugaaguaagagguuauacuaaaggagguccaggccaugaagaaccuguaccuaugucaacuuacggauggaauauugugaaauuaaugucagguaaggacguauuuuaucuuccgccugaaaagugugacacacuauuaugugauaucggagaaucgucgccaagcccaacuguagaagaaagucguacuauuagaguccuuaaaaugguggaaccaugguuaaagaacaaucaguuuuguauaaaaguacuuaaccccuauaugccuaccgucauagagcacuuagaaagacuucaacgaaaacacggcgguauguuagugagaaauccuuuaagucgcaauaguacucaugaaauguauuggauauccaauggaaccggaaacauaguaaguagcgucaacauggugucacggcuuuuacugaacagauucaccaugacccaucgucgaccuacuauagaaaaagauguagacuuaggagcagggacgagacacguaaaugccgagccagaaacaccuaauauggacgugaucggagaacggauaagaagaauuaaggaggagcauucaucaacauggcauuaugacgaugaaaauccauacaaaaccugggcuuaucauggaucuuaugaagucaaagccacgggaucagcuaguagcaugauaaauggaguugucaaacuucugacaaaaccgugggacuuaguuccaauggugacccaaauggcaaugacagauacaacaccauuugggcaacaaagaguuuucaaagaaaaaguagauacccggacaccucgaccaaugccugguacucgaaaaguuauggaaauaacagcagaaugguuguggagaacauugggacguaauaaaagaccuagacuuugcacgcgcgaagaauuuaucaagaaaguuagaacaaaugcggcaaugggggccguauucacagaagaaaaccaaugggauucugcaagagcagccguggaggacgaagaguucuggaagcugguagaccgagagagagaacuacacaaacucgggaaaugcggcucauguguuuauaacaugaugggaaaaagagagaagaaauuaggagaauuuggaaaagcaaaagguucuagggcaauuugguacauguggcugggggcaagauaucucgaguuugaagcacuaggauucuugaaugaagaccauugguuuucaagggaaaauucacauucgggaguagaaggugaagguuugcacaagcuagguuauauacucagagauauauccaagauucccggcggagcaauguacgccgaugauacagcuggcugggauacaagaauaacugaagacgaucuacauaaugaggagaaaauaacucagcaaauggacccugaacauaggcaacucgcaaaugcgaucuucaaacuuacguaccagaacaagguugugaaaguacaaagaccaacgccuaaagguacagugauggauaucauaucuagaaaagaccaaagaggauccggucaagugggaacauauggucugaauacuuucacuaauauggaagcccaacuuauccgacagauggaaggggaaggcguuuuaagcaaagcugaucuagaaaauccacauuugcuagaaaagaaaguuacucagugguuggaaaccaaggggguggaaagauuaaaacgaauggcuauuaguggagaugauugcguggucaaaccgauugaugaccgcuuugcaaacgcuuuauuggcucuaaaugauaugggaaagguacgcaaggacauaccucaauggcagccgucuaagggauggcacgauuggcagcaagucccguucuguucgcaccacuuccacgaguuaauaaugaaggacggcagaaaacucgugguuccuuguaggccacaagaugaacuuauaggcagagcaagaauuagucagggagccggguggagucuacgggagacagcgugucuugguaaagcauacgcgcaaaugugggcacuaauguauuuccacagaagagaccugagacuagcgagcaaugcuauuuguagcgcaguccccguucauuggguaccgacaucgagaacuaccugguccauucaugcucaucaccaauggaugacgacagaggauauguugacaguauggaacagagucuggauugaggacaacccuuggauggaggacaaaacuccagucacuaccugggaagauguaccauauuuaggcaaaagagaagaccaauggugcgguagcuuaauugguuugacaaguagagcuacgugggcucaaaauauacuuacugcuauucaacaaguuaggucucuuauaggaaaugaggaguuucuugacuauaugccaagcaugaaacguuucagaaaggaggaagaaucagaaggggcaauaugguaa

SEQ ID NO: 23538 - RNA, 9873 nt, Artificial Sequence
  derived and/or modified CDS sequence (opt6) from DENV-3__JQ920480__SS-prME
acgucacuaugccucaugaugauguuaccugcaacucuugcauuucaccuaacaucuagagauggggaaccacgaaugauuguaggcaaaaaugaacgagggaaaagucuacuuuucaaaacugccaguggaauaaauauguguacccuaauagcgauggauuuaggggaaaugugugacgacaccgugacauacaaaugcccguuaauuacagaagucgaaccugaagauauagauugcuggugcaaucuaacuucgacuugggugacauaugguaccuguaaccaagcaggggaacaucgacgagacaaacgaaguguggcacuugcaccucauguugguaugggccuugauacuagaacgcaaacauggaugucugccgaaggagccuggcgucaaguugaaaaaguugaaacaugggccuuuagacacccgggguuuacgauccucgcauuauuucuugcacacuauauuggcacaucguuaacgcaaaaaguugucauauuuauccuacuuauguugguaaccccuucaaugacaaugcgaugugucggcguaggaaaccgcgauuucguugagggucuaaguggcgccacaugggucgauguuguccuggagcauggugggugcguaaccacaauggccaaaaacaaaccuacucucgauauagaacuccagaaaacagaagcaacacaauuagcaacccuacgcaaacuauguauagaagggaaaauaacgaaugugacaaccgauucuagaugcccaacgcaaggggaagcaauucuuccagaagaacaagaucaaaauuauguuuguaaacauacauaugucgauaggggguggggaaauggcugcggacucuuugggaaaggaucuuuagugacaugugcaaaauuucaaugucucgaaaguauagaaggaaaagcggugcaacaugaaaaucuaaaauauacaguuauaauaaccguacacaccggcgaccaacaccaagucgguaacgaaacgcaaggugugaccgcagagauaacgccucaagcgucaacuguagaggcaaucuuaccagacuauggaacauuaggacuugaaugcucuccaagaacuggauuggauuucaaugaaaugaucuuauuaacaaugaaaaauaaggcuuggaugguucaucgacaaugguuucuagaucuaccauuaccuuggaccagcggggcuacuacugaaacucccacauggaauaagaaagagcuauuagugacauucaaaaaugcucaugcuaagaaacaggagguaguuguacuagguagccaagaaggagcgaugcacaccgcucucacaggagcaacagaaauacaaacuuccggaggaacaagcauauuugccggucaccucaaaugcagacuaaaaauggauaagcucgaauuaaaagguaugucuuaugcaaugugucuaaaugcguucguuuuaaagaaagaaguuucugagacgcagcauggaacaauauugaucaaaguggaauacaaaggagaggacgcaccauguaaaauuccauucuccacagaagacggacaagguaaggcgcauaacgggaggcuuauaacagcaaaucccauaguuaccaagaaagaagaaccgguaaacaucgaagccgaaccuccauucggggaaaguaauauugugauaggaauaggagacaaggcacuuaaaauuaauugguauaagaaaggaucaaguaucggcaaaauguucgaagcaacugcuagaggcgcacggaggauggccauuuuaggugauacagcuugggauuuuggcucaguaggaggagucuugaacucgcuggggaaaaugguacaucagauuuuuggaucagcguauaccgcguuauuuagcggcguaucauggauaaugaaaauuggaauagggguacuauuaacauggauaggacucaauucgaaaaauacuucaaugucuuucucuugcaucguaauugguauuauaacacuguaccuaggggccgucguucaagcugauauggguugugugauaaauuggaagggcaaagaacuaaaaugugguucaggcauuuuugugacuaaugaaguucacacauggacugaacaguacaaauuccaggcugauucuccgaagagacuagcaacagcgauugccggagcaugggaaaaugguguguguggaauccguagcaccacacgaauggaaaaucugcuauggaaacagauagcuaacgaauugaauuauauacuaugggaaaauaacaucaaauuaacaauaguaguaggggaugucauaggaguauuagagcaaggcaagagaacauuaacaccccaaccaauggaacucaaauauucuuggaaaacuugggggaaggcgaaaauagucacggcagagacgcaaaauaguaguuucauaaucgacggaccaaauacaccugaauguccgucagcguuacgagccuggaacguuugggagguagaggacuacggauuuggaguauuuacgacgaacauauggcuaaaacucagggaaaaguacacacaauuaugugaucaccgccuuaugagugcugcagugaaggacgaacgggccgugcacgcagauauggguuacuggauagaaagccagaaaaacgaaucuuggaaacuagagaaagccucauuaauagaagucaaaacauguaccuggccuaagucgcauacacuuuggucaaauggcguauuggagucagacaugauuauacccaagaguuuggcuggcccaauuagccaacauaacuaccgcccaggcuaccauacacagacggccgguccauggcaccuagggaaacucgaacuggauuucaacuauugugagggcacaacaguaguuaucacggaaaacuguggaacaaggggacccagcuuacguaccacgacaguuucagguaaauugauacacgaaugguguuguagaucauguacguuacccccauuaagguauaugggagaagaugguuguugguauggaauggagaucagacccaucaacgaaaaagaagagaauauggucaaaucucuugugucagcagguucggggaaaacggacaacuucacuauggggguacuaugcuuggcaauacucuuugaggaagugaugcguggaaaguucgguaagaaacauaugaucgcaggagcucuauuuauguucguccuauugcuaucuggucaaauaacauggcgcgacaugguacacaccuuaauuaugauugggaguaacgcuagcgaccguaugggcauggggguaacauaucuggcucugauagcaacguucaaaauacaaccuuuccuugcacucggguucuuucuuagaaaacuuacgucccgagagaauuugcuccuuggagugggucuagccauggcaacaacacuacaacugccggaagacauugaacaaauggcuaacggaauagcauuaggauuaauggcguuaaaguuaauuacacaguuugagacguaucaauuauggacggcacugauaaguuuaauguguaguaacaccauauucacucugacaguggcuuggcggaccgccacauuaauacuugcaguaauaagucucuugcccguaugucaaaguaguucaaugaggaaaacggacuggcuaccaaugaccguugcggcgauggggguaccuccucuuccccuguuuauauuuucgcuaaaggauacauuaaaaagaagaucauggccucuuaaugaggguguuauggcaguaggauuggugucaauacuagccagcuccuuucuccgaaaugaugugccgauggcagguccacucguagcuggaggguuauuaauagcuugcuacguuauuacaggcacaagcgcagacuuaaccguugaaaaagcagcugauguuaccugggaagaggaggccgaacaaaccgggguaagccauaaucuaaugauuacaguugacgacgaugguacuaugcgcauaaaagaugaugaaacagaaaacaucuugacaguuuuacucaagacagcauuacugaucgucucaggaauuuuuccuuauagcauaccagcaacuuuauuggucuggcauacguggcaaaaacaaacacaaagaagcggggugcuaugggacgugccgaguccacccgagacccagaaggcagaguuggaagaggguguguaucgcaucaaacaacagggaauauuugguaagacgcaagugggggugggaguacaaaaagaaggcguuuuccacacgauguggcaugugacccggggagcaguacugacacacaacggcaaacguuuggaaccaaauugggcaaauguuaaaaaggaucugaucuccuauggaggaggcuggaaacuuucugcgcaguggcaaaaaggagaagaaguacaggugaucgcuguagaaccugguaagaacccuaagaauuuccaaacuaugccagggauauuccaaacgacaacgggcgaaauaggagcaaucgcauuagacuuuaaaccugggacaagcgguucaccaauaauaaaccgggaaggcaaagugguaggacuauacgggaauggugugguaacuaaaaacggggguuacguuagcgguaucgcccagacaaaugccgagccggauggaccuacgccugagcuagaggaagagauguuuaagaaacguaauuugaccauaauggacuuacauccggguucaggaaagacccgaaaauaucuaccggcaauaguuagggaagcgauaaaaagaagacuuagaacucugauucuagcacccacacgaguuguagcagcagaaauggaggaggcguuaaaaggccucccuaucagguaucaaacaaccgcuacaaaaagcgaacacacgggaagagaaauaguagaccuuaugugccacgcuacauuuacaaugcgauuacuuucaccgguucgcguaccuaacuauaauuuaauagucauggaugaagcgcacuuuacagauccagcgucaauagcagcaagaggauacauaaguaccagaguugguaugggagaggcagcagccauuuuuaugacugcaacuccgccaggaacggccgaugcuuuuccucaaucgaaugcgccuauacaagaugaggaaagggacauuccagagaggucauggaacucggguaaugaguggauaacugauuucgcgggaaaaacgguuugguucgucccauccauuaaagcagggaaugacauagcgaauugucuucgcaaaaauggcaagaaaguaauccagcuaagucguaaaacuuucgauacugaauaucagaaaacgaaacuaaacgauugggauuucguaguuacgacggauauaagugaaaugggugcaaauuucaaagcagauaggguuauugaucccagaagaugccuaaaaccuguaauccuaaccgacggaccagaacgugucauauuagcagguccuaugccggucacgguugcuagcgcugcccaaagaagaggucgaguaggaaggaacucacaaaaagagaaugaucaauacauauuuacuggacagccucucaauaaugaugaagaccacgcacauuggacagaagcaaagaugcucuuagacaauauuaacacaccagaaggcauaauaccagcccuauucgagccugaacgugaaaaaucugcggcaauagacggugaguaccgacuaaaaggagagucaagaaaaacauuuguagaauuaaugagacgaggagaucugccagucuggcuagcucauaagguagccagugaaggcauaaaauacacagauagaaaauggugcuuugauggagaaagaaauaaccagauacuugaagaaaauauggauguugaaauauggacaaaagaaggcgagaagaagaaacuacgacccagauggcuagaugcccguacuuauagcgacccacuagcucuaaaggaauuuaaagacuuugcagcaggaagaaaaagcauagcgcuugaucuagucaccgagaucggacguguaccuagucaccucgcgcaucgcacaagaaaugccuuggauaacuuagugaugcuucacacguccgagcaugguggucgagcauauaggcaugcaguagaggagcuaccagaaacaauggaaacauuacuucugcuaggcuugaugauacuacucacaggaggggccaugcuauuucuaauuagugggaaggguaucggaaagacaagcauuggucuuauauguguaguagcuucgucagguaugcuguggauggcagauguaccguuacaguggauugcaucugcaauuguucuggaauuuuucaugaugguucucuuaauuccagaaccagaaaaacaacgaaccccacaggacaaucagcuagcuuacgugguaaucggcauucuuacccuugcagcaauaguugcagcgaaugaaaugggcuuacuugaaacaacgaaacgagaccuuggcaugaguaaagagcccggcguggucucccccacgagcuaccucgacguugauuugcaccccgcaucagccuggacuuuauacgcaguagcaaccacaguaauaaccccaaugcuucgucacacaauugaaaauagcacagcuaacguaucauuagcugcgaucgccaaucaagcugugguccucaugggucuagacaaaggguggcccaucaguaaaauggaucucggaguaccucuucuugcucucggaugcuauagucaggucaauccauuaacacugaccgccgccguacucuuauuaguuacccauuaugcuauuauugguccaggauuacaggcgaaagcaacccgagaggcucagaaaagaaccgcugccgggauuaugaaaaaucccacaguagacggcauuaugacaaucgaucuagauccuguaauauaugacaguaaauuugagaaacaguuaggacaagucaugcuauuaguccugugcgccgugcaacuacuuuuaaugagaacaucgugggcuuucugcgaagcucuaacacuagcaacaggaccaauaacuacacuaugggagggcucucccgggaaauuuuggaacaccacaauugcgguaaguauggccaacauauucagggguaguuacuuagcaggcgcaggccuugcauuuucgauaaugaaauccguaggcacgggaaaaagaggaaccggaagccaaggagaaacguugggagaaaaauggaagaagaaauuaaaccaacuaucaagaaaagaauuugacuuauauaagaaaucagguauaacggaaguugacagaacagaagcaaaggagggauuaaaaagaggagagauaacacaucaugccguaagccgugguagcgccaagcuccaaugguuuguugaaagaaacauggucauuccagaaggcagaguaauagaccucggauguggucguggaggauggaguuauuacugcgccggacuaaagaaaguaacagaaguacgaggguacaccaagggugguccgggacaugaagaaccgguaccuaugaguacauacggauggaauauugucaaacuuauguccgguaaagauguauuuuaccuacccccugaaaaaugugauacacuuuuaugugacauaggagagucgucuccuaguccaaccguugaagaaucucgaaccauccgaguauuaaaaaugguugaaccuuggcuuaaaaacaaucaauucuguauaaagguacuaaauccauauaugccgacaguuauagaacauuuagagcgacuacaacguaaacauggugggaugcugguacguaauccacuaucacguaacucuacucacgaaauguauuggauaucaaacggaacaggcaauauaguaucaucagucaauaugguaagccgcuuauuauugaauagguuuacaaugacccaucgacgaccuacuauugagaaagauguagaccuaggagcagguacaaggcauguaaacgcagaaccagaaacucccaacauggauguaaucggagaaagaauccgaaggauuaaagaagaacauagcagcacauggcacuaugaugacgaaaacccuuacaagaccugggcuuaccacgguucuuacgaaguaaaagcuacugggucagcuagcucaaugauaaaugggguuguaaaacuucugacaaaacccugggauguuguuccgaugguuacccaaauggcgaugacagauacaacuccauucggacaacaaaggguauuuaaagagaaagucgacacaaggacuccaagacccaugccaggaacaagaaaaguaauggaaauaaccgcugaauggcucuggagaaccuuaggaagaaauaaaagacccagauuauguacgcgugaggaguuuauuaaaaagguacgaacaaaugcugcuaugggagccguauucacggaagagaaucaaugggauagcgcaagagcugccguugaagacgaagaauuuuggaaguuaguggauagagagcgggaacuucacaaacuugguaagugcgggucaugugucuauaacaugaugggaaaaagagagaagaaauuaggugaguucgguaaagcuaaaggaucacgugccauaugguauaugugguuaggagcaagauaccuagaauuugaagcucuaggcuuuuuaaaugaggaccauugguuuucccgagagaacagucacuccggggucgaaggcgaaggucugcacaaauuaggguauauccugcgagauauuucgaaaauaccagggggagcuauguaugcagaugauacagcgggaugggacacccguaucaccgaagaugaccugcacaaugaagagaaaaucacucagcagauggauccagaacaccgccagcucgccaaugccauauucaaacuuacguaucagaacaaaguaguuaaaguacaaagaccgacaccaaagggcaccgucauggauauaauaucacggaaagaccaaaggggaucaggacagguugguacauauggacucaauacuuucacgaauauggaagcacaauugauccggcaaauggaaggcgaaggaguucucuccaaagcagaucuggaaaauccgcauuuguuagagaagaaaguaacacaauggcuggaaacaaaagguguggaaaggcucaaaagaauggcgauaucaggagaugauugcgugguaaaacccauugacgacagguuugcuaaugcacuucuagcacuuaacgacaugggcaaagucagaaaagauauaccccaauggcaaccaaguaaaggauggcaugacuggcaacaaguaccauucugcagucaucacuuucacgaauuaauaaugaaagacggucgaaaauuaguuguccccuguagaccccaagaugaacuaauaggacgagcacgaauaucacaaggagcgggauggucacuuagagaaacagcaugccuaggcaaggcuuacgcacaaaugugggcacuaauguauuuccacaggcgagauuuaagauuagcauccaacgcaauuuguuccgcuguaccaguucacuggguacccacuagccgcacuacuuggucuauacaugcgcaucaccaauggaugacaacugaggacauguugacaguuuggaauagaguauggauagaggauaauccauggauggaagacaaaacgccggugacaacgugggaagacguaccauaucuaggcaaaagagaagaucaaugguguggaucuuugauaggccugacgucaagggcuacuugggcccagaacauucugacagcaauucaacaaguaaggucauugauagggaaugaagaauuucuagauuacaugccuagcaugaaacgguuuagaaaagaggaagagucagaaggggccaucugguaa

SEQ ID NO: 23539 - RNA, 9873 nt, Artificial Sequence
  derived and/or modified CDS sequence (opt6) from DENV-3__JQ920479__SS-prME
acuucauuauguuuaaugaugauguuaccagcaacuuuggcauuucacuuaacaagucgcgacggagaaccucguaugauuguugguaaaaaugaaagaggaaaaaguuuacuauuuaaaacugcauccgggauuaauaugugcacguuaaucgcaauggaccuaggugaaaugugugaugauacgguuacauauaaauguccacuuauuacugaaguugaaccagaagauauagacuguuggugcaaucuaacaagcacauggguuacauacggaaccuguaaccaagcuggagaacaucgucgagauaaaagaagugucgcucuagcaccacauguagguaugggauuagacacgagaacacaaaccuggaugucugcagaaggagcguggaggcaaguggaaaagguggaaacaugggcauucagacauccuggauucaccauccuagcucuauuuuuggcccauuauaucggaacgucguuaacacaaaaaguggucauauucauuuuauuaaugcucgucacaccuagcaugacaaugaggugugucggggucggaaauagagacuuuguugaaggguugaguggagccacauggguugacgucguucuugaacauggagggugcguuacgacaauggcaaagaauaaaccaacgcuagacaucgaacuccagaaaacggaagcgacccaacucgcaacucuaagaaaacuuuguauagaagggaagaucaccaacguaacaacagauucacgcugucccacacaaggagaagcuauucugccggaagaacaagaucaaaacuauguguguaaacacacuuauguugauagaggguggggaaacgggugcggauuauuugguaagggaucucuaguuacaugugcaaaauuucagugucuagaaucuauugaaggcaaagcaguccaacacgaaaaccuaaaauauacuguaauaauuacaguacauacaggagaucaacaucaagucgggaacgaaacacaggggguuacagcagaaauaaccccacaagcgagcaccguagaagcgauacucccugaauaugggacccucggacuugaauguucgccaagaacuggauuggauuucaaugagaugauacuuuugacuaugaagaacaaggcuuggaugguacacagacaaugguuucuagauuugccauugccguggacgucuggugcaacaacggaaacaccgacauggaauaagaaggaauuacuuguaacauucaaaaacgcacaugcgaagaaacaggaaguuguaguguuagguucucaggaaggcgcuaugcauacugccuuaacuggagcaaccgaaauacaaacaaguggcggcacguccaucuucgcggggcauuugaaauguagguuaaaaauggacaaacuagagcuaaaaggaauguccuaugccaugugccuaaacgcuuucguuuuaaagaaagaagugagugaaacucagcacggcaccaucuuaauaaaaguugaguacaaaggagaggacgcacccuguaaaaucccuuuuuccacagaagacggacaagggaaagcacauaaugguagauuaauuacagcuaauccaauugucacaaagaaagaagaaccuguuaauauugaagcagaaccaccauuuggagaaucuaacauaguaauaggaaucggugacaaggcucugaaaauaaauugguauaaaaaggguaguucuauuggaaaaauguucgaagccacagcccguggggcaagaaggauggcaauucugggugacacagcuugggauuucggaucaguggguggcguguuaaauagucuuggaaagaugguccaccaaaucuuuggcagugcauauacagcuuuguucucaggcguaucuuggauaaugaaaauuggcauagguguauuacuuacauggauaggccugaacagcaaaaacaccagcaugaguuucucuugcaucguaaucgguauaauaacacucuacuuaggagcugucgugcaagcagacauggggugugugaucaacuggaaaggaaaagaauuaaaaugugguagcggaauuuuugucacuaaugaggugcauacuuggaccgaacaauauaaauuucaagcugauucaccaaaaagauuagcaaccgccaucgcaggagccugggaaaauggggugugugguauucgcagcacaacuagaauggaaaaucucuuauggaaacagaucgcaaaugaacuuaacuacauauugugggaaaauaauauaaaauuaacgauuguaguuggggauguaauaggaguuuuggaacagggaaaacggacacuuaccccucaaccgauggaacucaaguauaguuggaagacuuggggcaaagccaagaucguaacugcugaaacccaaaauaguucauuuauuauugauggaccgaauaccccagaaugccccagcgcccuacgagcuuggaauguaugggaaguagaggacuacggcuuuggagucuucacgacaaauauauggcuaaaacugagagagaaguauacacaauuaugugaucauagacugaugucugcggcaguaaaggacgaacgggcuguacaugcugacauggguuauuggauagaaucacaaaagaacgaauccuggaaacuugaaaaagcaagucuaauugaagucaaaacaugcacguggccaaaaagccauacauuauggucaaacggaguauuggagagugacaugaucaucccuaaaaguuuagcugguccgauaagucagcacaacuauagaccgggcuaccauacucagacugcugggcccuggcauuuaggcaaauuagaacucgacuucaauuauugcgaaggcacgacaguuguuauuacugaaaauuguggcauccgaggaccaucgcucaggacgaccaccguuagcggcaaguuaauacacgagugguguuguagaucgugcacccuuccaccacucagauauaugggcgaggacggcuguugguacggaauggaaauaaggccaauuaaugaaaaggaagaaaacaugguaaaaagccucgugucagcuggcagcggaaaaacagauaacuucaccaugggaguacuaugucuugcaauucucuucgaagagguuaugcgaggcaaauuugguaagaaacauaugauugccggugcuuuauucauguuuguauugcuauuaucaggacagauaaccuggcgugauaugguacauacauuaaucaugauagguucgaacgcuagcgaucguaugggcauggggguuaccuauuuagcccuaauagcaaccuuuaaaauacagcccuucuuagccuuaggauucuuucuacgaaaguugacuuccagggagaacuuauuguuaggaguuggccuagcuauggcgacaacuuuacaauuaccugaagacauagaacaaauggcuaacgggauagcuuugggacuaauggcacucaaauugauuacucaauucgaaacguaucaacuauggacagcccuaauaucacuaaugugcaguaacacaaucuuuacucucacaguagcuuggagaacagccacccuaauucuagcaguaaucucauuacugccuguaugccaaucuagcaguaugaggaaaaccgacugguugccaaugacuguagcggcaaugggaguaccaccuuuaccauuguucauauucucucugaaggauacccuaaaacgcagaucuuggccauuaaacgaggggguaauggcggugggauuggugucuauccuugcaagcucauuucugagaaacgacguaccgauggcuggaccacucgucgcaggaggucuuuugauagcauguuauguuauuacugguacaagugcagaucuuacuguagaaaaagcugcggaugugacuugggaagaagaagccgagcagacagguguuucgcauaaccucaugauaaccguagaugaugacggaacaaugagaauaaaggaugaugaaacagaaaauauacugacaguucuauuaaaaacugccuuacugauaguuaguggaaucuucccuuauaguaucccggcuacuuuacucguuuggcauacuuggcagaagcaaacucagcguagcgggguuuuaugggacgucccgucaccaccagagacccaaaaagcagagcuugaggaaggcguauauagaauaaaacaacaagguauuuuuggaaaaacccaagugggcguugguguucaaaaagaagguguguuucacacaauguggcauguaacgagaggggcggugcuaacucauaauggcaagagguuggaaccaaauugggcgaacguaaagaaagaucuuauuagcuauggaggaggcuggaaacuuagcgcccaguggcaaaaaggagaagaagugcaaguuauugcuguggaacccgggaagaacccgaaaaacuuccaaacaaugccgggaauauuucagacgacuacgggagaaauuggagccauagcccuagauuucaaaccagguacgucugguucgcccauuauuaauagagaagguaaaguaguugguuuguacggaaaugggguagugacuaaaaacggagguuauguauccggaauagcgcagacuaacgccgaaccugauggaccuaccccugagcuugaagaagaaauguuuaagaaacgcaacuuaacuauaauggauuuacacccugggucgggaaaaacaaggaaauauuuaccugcaauugugcgagaagcgauuaaaagaagauuacgcacuuugauauuggcacccacaaggguuguugcagccgagauggaagaagcauuaaaaggacucccuaucagauaucaaacaacagcuacuaaaagcgaacacacugggcgagaaaucgucgacuuaaugugucaugcgacauuuaccaugcgguuacuguccccuguuagaguacccaauuauaaccucauaguaauggaugaagcacauuuuacagauccagccucaaucgcugcaagggguuauauaaguacaaggguaggaaugggagaagcagccgcuauauuuaugacagcaacuccuccugguacagcagacgccuuuccacaaucuaaugccccaauccaagaugaagagagggacauuccagaaaggucuuggaacucuggaaacgaauggaucaccgauuuugccggaaaaacaguaugguucguucccaguauuaaggccggaaacgauauugcgaauugucucaggaaaaaugguaagaaaguaauccaacuuucaaggaaaacguuugauacugaauaucagaaaacuaaacuuaacgauugggauuuuguugucacuaccgauauuagugaaaugggcgcuaauuuuaaagcagaucggguaaucgauccuagacgauguuuaaaaccuguaauucucaccgauggucccgagaggguaauucucgcugggccgaugccaguuacaguggcgagugcagcccaacguagggguagaguuggaagaaauucucaaaaagagaaugaucaauacauauuuacaggccaaccccuuaacaaugacgaggaucaugcacauuggaccgaagcaaaaauguuguuagauaauauuaauacacccgaaggaauaaucccagcauuauucgagccagaacgagagaaaagugcagcgauugauggcgaauaccgacuaaaaggagaaucaaggaagacauucgucgaacucaugcgccgaggagaucucccaguuugguuagcacacaaaguagcgucggaagguauaaaauacacagaucguaagugguguuuugauggugagagaaauaaucaaauuuuagaagagaauauggauguagagauauggacgaaagaaggugagaaaaagaaacugcgaccaagguggcuagaugcacgaacauacucugacccccuagcuuuaaaagaauuuaaagacuuugcagcgggucgaaaaagcauugcacuagauuuagucacugaaauuggacgaguaccuagucauuuagcccauagaacaaggaacgcuuuagacaaccucgugauguuacacacaagugaacacggugggcgagcauauagacaugcaguggaagaacuaccggaaacuauggagaccuuacuuuuacuagguuuaaugauacuuuugacaggaggagcaauguuauuucuuauauccgggaaaggaaucggaaagacaucaaucgggcucauauguguggucgcuagcaguggaauguuauggauggcagaugugccgcugcaguggauagcaagugccaucguauuagaguucuuuaugaugguacuacuaauaccggaaccagagaaacagcgcaccccucaagauaaucaacuagcuuauguaguaaucggcauauuaacuuuggcagcaauuguugcugcaaacgagaugggcuuauuggaaacaacuaaacgagaccuugguauguccaaggaaccaggcgugguuagcccaacgaguuacuuggauguagacuuacauccagcaucugcguggacucuuuacgcaguugcaaccacuguaaucacccccauguuaagacauacgauugaaaacagcacugcuaacguaucacucgcugcgauugcuaaccaagcggucguacugaugggcuuagauaagggguggccaauaucuaaaauggauuuaggaguuccacuacuugcgcucgguuguuauucacaggucaauccauuaacccuuacggcagcagugcuauuauuagugacacauuacgcaauaaucgguccaggacuacaggcaaaggcuacucgugaagcucaaaaacgcacagcugcuggaauaaugaaaaauccuacggucgacggaauaaugacgauugaucuugacccuguuauuuaugauucaaaguuugagaaacaauuaggccaaguuauguuauuaguauugugcgcaguacaauuacuacuaaugcggaccaguugggcauuuugugaagcacucacacucgcuacaggaccuauaacaacacugugggaaggaaguccggguaaauuuuggaauacuacaauagccguaucgauggccaauauuuuucgagguucauaucuugccggagcaggacuagcuuuuuccauaaugaaaucugucgguaccggaaaaagaggaacugguucccaaggcgaaacauuaggagaaaaauggaagaagaaauuaaaucaacuaucuagaaaggaauuugacuuauauaaaaagucggguauaacggaaguagacaggacagaagcuaaggaaggauuaaaaagaggagaaauaacacaucaugcgguaucaagaggauccgccaaacuacaaugguuugucgagcguaacaugguaauuccagaggggagagugauugauuuagggugcggucggggcggcuggucauauuauagcgcaggacucaagaaaguuacugaaguuagaggauauaccaaagguggaccgggccaugaagaaccaguuccaaugucaacauauggauggaacauagugaaacuuaugucuggaaaagauguauuuuaucuuccgccggaaaaaugugacacacuuuugugugacauuggagaaucaucacccucaccuacaguugaagaaaguagaacaauacggguuuuaaaaaugguggaaccaugguugaaaaauaaucaauuuuguauuaagguacuaaaucccuacaugcccacagugauagaacaccuagaacggcugcagcgaaaacauggagggaugcuagucaggaauccccuuuccagaaacaguacacaugaaauguacuggauuucgaacgguaccgguaauauuguaucaucaguaaauauggugucaagacuacuauuaaauagguuuacuaugacacaucgccgccccacaauagaaaaggacguagaucugggagcagggacaaggcaugucaaugcugaaccagagacaccaaauauggacguaaucggugagagaauaagacguauaaaggaagaacacucuaguacuuggcauuacgaugaugaaaauccauacaagacuugggccuaucacgggucguaugaaguuaaagcgacgggcagcgcaagcagcaugauaaacgggguugugaaacugcuuacuaaaccaugggauguaguacccaugguuacucaaauggccaugacagacacuacaccauuuggccaacaaagaguguuuaaggaaaaaguagacacuagaacaccacgaccaaugccagguacaagaaagguuauggaaauaaccgcugaaugguuauggcggacacuaggccgcaauaaaagaccaagacuuugcacacgagaagaauuuaucaagaaagucagaacaaacgcagcaaugggugcaguauucacagaagaaaaccagugggauagugcuagagcagcgguugaggaugaagaguucuggaaauuaguagaccgugaaagagagcuucacaaguuagguaaaugugggaguugugucuauaauaugauggguaaaagggagaagaaauuaggggaguucggaaaagcaaaggguucgagagccauuugguauaugugguugggugcgcgauacuuagaguucgaggccuuaggguucuugaaugaggaccacugguuuagccgugaaaauucucauucaggaguugaaggagaagguuugcacaaacuuggguauauauuacgugauauuucuaaaauaccgggaggggcaauguaugcggacgauacagcugggugggauacacgaaucaccgaagacgaucuacacaacgaagagaaaauaacccaacaaauggacccagaacacagacaauuagcaaaugcaauuuucaagcugacguaucaaaauaaagucguaaagguccagaggccuacuccuaaaggcacuguaauggauauuaucucuagaaaggaucaaagagguucaggucaaguagguacauacggacuaaacacauuuaccaauauggaagcgcaauuaauaaggcaaauggaaggggaaggaguacuuuccaaggcugaccuagaaaauccgcaucugcuggagaagaaagucacacagugguuagaaacuaaaggaguagaacgauuaaaacgaauggcaauuucgggagacgauuguguaguaaaaccgauagaugaucguuucgcgaaugcacuuuuagcacuuaaugauaugggaaaggugcgaaaagauauaccucaguggcagccgagcaaggguuggcacgacuggcagcaggucccuuucugcucucaucauuuucaugaauuaauuaugaaagauggaagaaaacucgucguuccuugucgaccacaagaugaguuaaucggacgggcgaggauuucccaaggcgccgguuggucgcugcgcgaaaccgcaugcuugggaaaagccuaugcacaaaugugggcguugauguacuuucacagaagagacuuaagacuggcaucaaaugcgauuugcagugcuguuccaguacauuggguaccaacgucacguacaacauggucgauucaugcccaucaucaauggaugacuaccgaagacauguugacgguguggaaccguguuuggauagaagauaacccguggauggaggacaaaacuccuguaacgacuugggaggacguaccuuaucuuggaaagagggaagaucaauggugugguucuuugauaggauuaacuucaagagccacaugggcgcaaaauauauuaacggcaauucaacagguacgaucacucauaggaaaugaagaguuccuagacuacaugccaaguaugaaacgcuuuagaaaagaagaggagucagaaggagcaauuugguga

SEQ ID NO: 23540 - RNA, 9873 nt, Artificial Sequence
  derived and/or modified CDS sequence (opt6) from DENV-3__KU216208__SS-prME
acuucacuaugcuugaugaugauucuaccugcagcccuugcauuccaccuaacaucgagggauggggaaccaaggaugaucguuggcaaaaacgaacgagguaaaucucuacuauuuaaaaccgcuucugguauaaauaugugcacauuaauagcuauggacuugggugaaaugugugaugauacaguuacauauaaauguccccacauaacugaagucgaaccagaagauauagauugcuggugcaacuuaacgucaaccuggguaacguauggcacgugcaaccaagcuggagaacacagacgagacaaaaggucaguugcacuugcaccacauguuggaaugggguuagauacacguacccaaacauggaugucugcugaaggugcuuggaggcaaguggaaaaaguggaaaccugggcccuacgucacccaggauuuaccauacuugccuuauuucuagcacauuauauaggaacgucacuaacacagaaaguaguuauauuuauccuguuaaugcuggucacacccuccaugacgaugagauguguaggugucggaaaccgagauuuuguagaaggccuuagcggggcgacuuggaucgacguaguauuggaacacggcggauguguaacgacaauggccaaaaacaaacccacccuugacaucgaauuacagaaaacagaagcaacacaacuagcaacacuaaggaaacuuugcauugaaggcaaaauuacaaauaucaccacagacucucgguguccaacccaaggagaagcuguccuaccugaagaacaagaccaaaauuauguauguaaacaugcauacguggaccgcggauggggaaacggaugcgguuuguuuggaaaaggaucauugguaacaugcgcgaaauuucaaugccuagaaccaauagaaggaaaaguaguccaauacgaaaaucuaaaauacaccguuauuaucacuguucacacaggugaccaacaccaaguaggaaacgaaacucaaggaguaacagccgagauaacaccacaagcgagcaccacagaagcaauucuaccagaauacggcacccugggguuagaauguaguccaagaaccggguuagauuuuaaugagaugauauuauuaaccaugaaaaacaaagcauggaugguacaccgccaaugguucuuugacuuaccuuuaccauggacaaguggagcaacgacugagaccccaaccuggaaucguaaagaacugcucguaacguucaaaaaugcucaugcuaagaaacaagaagucguuguacuagguagucaggaaggagcaaugcauaccgcacuuacaggagcaacggagauacaaaauucuggcggcacaucuauauucgcaggacaccuaaaaugucgacugaaaauggacaaacucgagcuaaaagggaugucauaugcaaugugcaccaacacuuucguacugaagaaagagguaucugaaacgcagcacggcacaauauuaauaaaaguagaauauaaaggugaagaugcaccuuguaaaauaccguucucaaccgaggacggccaagggaaagcacacaacggaagguuaauaacagcaaaccccguugugacgaagaaagaggaaccugugaacauagaagcugagcccccuuucggagaaaguaacauagucauugggauaggagacaacgcccuaaaaauaaacugguauaagaaaggaucaucuaucgggaagauguucgaagcaacagcgcgcggagcuagacguauggcaauccuaggagauacugcuugggauuuugggucaguugguggaguuuuaaauucauuagguaagaugguucaucaaauuuuuggaagugccuacacggcccuauucucuggugucucguggguuaugaagauugguaucggagucuugcugacauggauagggcuaaauagcaaaaacaccuccaugucuuucagcuguauugcgauugguaucauaacuuuguauuuaggggcgguaguacaagcagauauggguuguguaguaaacuggaaagggaaggaacuuaaauguggcucuggaaucuucguaacaaaugaaguucauacauggacggaacaguauaaauuucaggcggauagccccaaaagauuagcaacagcaauagcuggagcgugggaaaaugguguauguggcaucagaucgacuacgagaauggagaaccucuuauggaagcaaaucgcuaaugagcuaaacuauauacucugggagaauaauauaaaacucaccguagugguaggagacacgaucggaguauuagaacagggaaaacggacacuaaccccucaaccaauggaauuaaaguacagcuggaagacuugggguaaagcuaaaauaguuaccgcugagacucaaaauagcucauucauaauagaugguccgaacacaccugaaugcccauccgccucgcgggcauggaacguaugggaaguagaagacuacggauucggaguauuuacgacaaauaucuggcugaaguuacgagaaguuuauacacagaugugugaucauagauuaaugucagcagcaguaaaagacgagcgggccgugcacgccgauauggguuauuggauugaaagucagaaaaauggcucauggaaacuugaaaaagcgagucuuaucgaagucaaaacuuguacauggccaaaaucucauacucuguggagcaacggcguauuagagucagauaugauaauuccaaaaucauuagccggcccaauuucccagcauaauuaucgaccgggcuaccacacacagacagcaggaccguggcacuuagguaaacucgaauuagacuucaauuacugugaaggcacuaccgugguaaucaccgagaauuguggaacacgaggcccgagcuuaagaacaacuaccguaaguggaaaacuuauccaugaguggugcugcaggucguguacacuaccaccauugcgcuacaugggagaagacgguuguugguauggaauggaaauuaggcccauuagugaaaaagaagagaauauggugaaaagccuaguaucugcaggcucugguaagguugacaauuucacaaugggcguauuaugccuugcuauauuauucgaagaagugaugagaggaaaauucgggaagaaacauaugaucgcuggcguauucuuuacguuuguauuauuauuaucaggacaaauaacauggcgagauauggcucauacccuuaucaugauaggcucuaacgcgucugacaggauggggaugggcguaacuuaccuagcacuaauagccacguuuaaaauacaaccuuuucuagcucuuggauucuuucucagaaaauuaacuucgagggaaaaccuccuguuaggaguuggccuugcaauggcgaccacauuacaauugccagaagauauugagcaaauggcaaacgggauagcacuagguuugauggcuuuaaaguuaaucacucaauuugagacguaucaauuguggacggccuuaauaucccuaaccuguagcaauacaauuuuuacuuugacaguugcauggagaacugcaacauuaauucuggcaggggugaguuuauuacccguuugucaauccaguuccaugagaaagaccgauuggcuacccaugacaguugccgccauggguguaccaccucucccgcuauuuauauuuagccuaaaagacacucuaaaaagaagaucauggccacuuaaugaaggcgucauggcuguggggcucgucucgauacuagccagcucacugcuccgaaacgaugucccuauggcagggccucuuguagcggguggccuccuaauagcuuguuauguaauuacagggacuucggcggauuuaacuguagaaaaggcagcugauguaacuugggaggaagaggcagaacagacggggguaagccauaaccugaugauaacaguagaugaugauggaaccaugaggauuaaggaugaugaaacagaaaacaucuuaacuguacugcuaaaaacggcacuuuuaauuguuucuggaauauucccuuacagcauuccugcaaccuuauuaguguggcacacuuggcaaaaacaaacccaaagguccggugugcuaugggaugucccauccccgcccgaaacucaaaaagccgaacuugaagaagguguauaucgaaucaaacaacaagguauacuuggaaaaacacaaguaggaguagggguacaaaaagaagggguauuucacacgauguggcacgugacuagaggggcuguacuuacacacaaugguaaaagacuagaacccaauugggcgucagugaagaaggaccuaaucagcuacggaggaggauggcgacuuagcgcacaauggcagaaaggggaggaaguacaagugauugcagucgaaccaggcaaaaauccaaagaauuuucaaacgaugccagguacauuccaaacuacuacuggugaaauuggugcuauagcuuuggacuucaaacccggaaccagugggucacccaucaucaaucgugaagggaaaguaguaggucuuuacgguaauggcguuguaacuaaaaauggaggcuacguaucaggaauugcacagaccaaugcagaaccugauggcccuacacccgaguuagaagaagagauguuuaagaaaagaaaucugacaaucauggauuugcaucccgguucaggaaaaacgagaaaauaucuuccagcaaucguaagagaagcaauuaagcgucguuuacggacacuuauccucgccccgacaagaguagucgccgccgagauggaagaggcuuuaaagggacugccuauaagauaucaaacgacagccacaaaaucugaacacacgggacgcgagauaguagaucugaugugucacgcaacauucacaaugcgucuacucaguccgguccgaguacccaauuauaacuuaauaauuauggacgaagcgcauuuuacagauccugccagcauagcagccagggguuauauuucaacucguguuggcaugggugaagcagcugcgauuuuuaugaccgcuacaccgccuggcacagcagacgcauucccacaaaguaacgcaccaauccaagaugaggaaagagauauaccagaacguagcuggaacucaggaaacgaauggauaacggacuuugcagguaaaacaguaugguucgugccaucuaucaaggcuggaaacgauauugcgaacugccuccggaagaacgguaagaaagugauucaauuaucgaggaagacguucgagaccgaguaccagaaaacuaaacucaacgauugggauuuuguagucaccaccgacauuagcgaaaugggggcuaacuucaaggcagaucgagugauugacccacgaaggugccuaaaaccuguaauacucacggacgguccggaaaggguaauccuggccggcccuaugccgguaacagcagccagcgcagcccaaagaaggggccgaguagggagaaauccacaaaaagaaaaugaucaauacauuuuuaccggacaaccucuuaauaaugaugaggaucacgcacacuggaccgaagcaaaaauguuacucgauaauauuaauacaccagaagguauaaucccugcacuauuugaacccgaaagagaaaagucugcugcaauagacggcgaauacagacuaaagggugagucuagaaaaaccuuuguagaauugaugaggagaggagacuuaccagugugguuagcuuauaaaguagcuucggaaggaauaaaauauaccgaccgaaaaugguguuuugacggacaaagaaauaaccaaauauuagaagaaaacauggauguagaaauuuggacaaaagaaggggagaaaaagaaauugcguccaagauggcuugaugcaaggacuuacucggauccuuuagcguuaaaagaguuuaaagauuucgccgcaggaagaaagagcaucgcuuuggauuuggucaccgaaaucggaagggugccaagucaucuugcacauagaacacgaaacgcguuagacaaucugguuaugcuucauacgucggaacacggaggacgggcuuaucgucaugcgguggaagaguuaccugaaacaauggaaacucuucuguuauuaggucuaaugauuuuacuuacagguggcgcaaugcuguuccucauaaguggaaaagguauagguaagacaaguauaggccuaauuugcgucaucgccucgagcgguauguuauggauggcugaaauuccuuuacaauggauugcuuccgcuauaguauuagaauuuuucaugaugguucuauuaauucccgaaccggagaaacaacguaccccucaagauaaucaacuugcguauguaguuauugguauacucacccuagcugcaauaauugccgcuaaugaaaugggacuauuagaaaccaccaaaagagacuuaggaaugucaaaagaaccaggaguaguaagucccacgaguuauuuagacguagaucuucauccggcgucugcauggaccuuguacgcaguagcaacuacugugaucaccccgaugcucagacauacuauugaaaacuccacggcaaacguaucccuugcagcuauugcgaaucaagcgguaguacuaaugggacuugacaaagguuggccgauaucaaagauggaccugggaguaccuuuacuugccuuaggaugcuauucacagguuaauccguugacauuaacagcagcaguauuauuauuaaucacucauuaugcaauaauugguccaggauuacaggcuaaggcuacgcgggaagcacagaaaaggacagccgcgggcauaaugaaaaauccaacaguggacggaauaauuaccauugaucuagauccuguuauauacgauucaaaauucgaaaagcagcucggacaaguuaugcuccugguuuuaugugcaguacaacuguugcuaaugagaacaucuugggcccucugcgaagcauuaacucuugcaacggguccaauuacaacacuuugggaaggcucgccuggaaaauuuuggaacacuaccaucgcgguuucaauggcuaacauauuuagaggaagcuaucuagcgggggcuggauuggcguucaguaucaugaaaaguguaggaacaggaaagagaggaacuggcucgcaaggggaaacuuuaggagagaaauggaaaaagaaacugaaccaacucucaagaaaggaguuugaucuauauaagaaaucgggcauuacagaaguagauagaacugaagcuaaggaaggauuaaagcguggagaaacaacacaccacgcaguaagcagaggaucggcaaaguugcaaugguuuguagaaaggaauaugguaauaccggagggcagaguuauagacuuaggaugugggcgcggcgguuggagcuauuauugugcuggacucaagaaaguaacagagguuagaggauauaccaaaggaggaccagggcaugaagaaccuguccccauggcaacauacgguuggaacauagucaaacuuaugucaggcaaagacguauuuuauuuaccgccugagaagugugauacgcuacugugcgauaucggagaaucuucaccgucaccaacaguugaagaaucuagaaccauuagaguacuaaaaaugguggagcccugguugaaaaacaaucaguuuuguauaaagguacuaaacccuuacaugccagcaguuauugaacaucuagagagauuacaaagaaaacacggaggcauguuagucaggaacccucucagcagaaacucuacgcaugaaauguacuggaucucaaauggaacaggcaacauaguaucgaguguuaauaugguuucgcgauuacuccuaaauagauuuacaaugacucauagaagaccaacuaucgaaaaagaugucgaccuaggggccggaacacgucauguaaaugcagagccugagacuccgaauauggauguaauaggugaacgaauaaaacguauaaaagaggaacauaacaguaccuggcacuaugaugacgagaacccauauaaaacaugggcauaccacggaucuuacgaaguaaaggcaacggguagugcaucuucgaugauuaauggaguaguaaaacuauuaacgaaaccaugggacgucgugccgaugguaacucagauggcgaugacugacacgacaccauucgggcaacagcgaguuuuuaaagagaaaguugauacucgaacaccucgaccuaugccaggcacaagaaaggucauggaaauuacggcagaaugguuauggaggacauuaggcagaaacaaacguccucgccuauguacaagagaagaauuuacgaagaaaguuagaaccaacgcugcaaugggcgcuguauuuacagaagagaaucaaugggacucugcgaaagcagcgguugaagacgaagaguucuggaaauuaguggaucgcgaacgagagcuccauaaacuaggaaaauguggaucaugcguauauaacaugaugggaaaaagggagaagaaauuaggagaauuuggcaaagcaaaaggaagcagagccauaugguauaugugguuaggcgcgcgcuauuuagaguucgaggcguuaggcuuccuaaacgaagaucauugguucucuagagaaaauuccuacucaggcguggaaggugaaggauuacauaaacuugguuauauacuucgagauauaaguaaaauaccuggcggagcuauguacgcugacgacacagccggaugggauaccagaaucacagaagacgauuuacauaaugaagagaaaauuacacaacaaauggaucccgaacaucgccuacuagcgaaugcaauuuucaaguuaacuuaucaaaacaaaguagugaaaguucaacggccaacuccuacaggaaccguuauggauauaaucucgcgaaaagaucaaagaggaagugggcagguaggaaccuacggacucaauacauucacaaauauggaagcucaauuaguacgacaaauggaaggagaaggagugcugucaaaagccgauuuagagaauccgcauuuaccugagaaaaagauaacccaauggcuggaaacuaagggcgucgaacgucuaaagcgaauggccauaaguggagaugauugcguuguaaaaccgauugacgacagauuugcuaaugcuuugcuagcacucaacgacaugggaaaaguuagaaaggauauaccucaauggcaaccaagcaaaggauggcacgauuggcaacagguuccguucugcucacaccauuuucaugaauuaauuaugaaagacgggaggaagcuaguuguuccauguagaccucaagacgaacuaaucggcagagcgagaauaagccaaggugcuggguggaguuugagggaaaccgccugucuugggaaagccuacgcccaaauguggucauuaauguacuuccaccgacgugaccuacgguuagcuagcaaugcuauaugcagcgcuguacccguucacuggguuccgacaucacguacuacauggucaauacaugcgcaccaucaauggaugacaacugaagauaugcuaacaguauggaauagaguuuggauugaagauaauccauggauggaggauaagacaccaguuacaacgugggaaaauguaccuuaucuaggcaaacgggaagaccaauggugcgguagucucauaggccuuacauccagagcuacuugggcacaaaauauaccaaccgcuauacaacaagugaggucucuuauaggaaaugaagaguuccuugacuauaugccgucaaugaagcgauuucggaaggaagaagaaucagaaggcgcuauuugguga

SEQ ID NO: 23541 - RNA, 9873 nt, Artificial Sequence
  derived and/or modified CDS sequence (opt6) from DENV-3__GU370053__SS-prME
acaucauuaugucucaugaugauucuaccagcagcauuagcguuccauuugacaagccgggauggagaaccaagaaugaucguaggcaaaaaugaaagaggaaaaucgcuacuuuuuaaaacagcuagcggaauaaauauguguacuuugauagcaauggacuugggagaaaugugugaugauacaguuacuuauaaauguccacacauuacagaaguggaaccagaagacaucgauuguugguguaacuuaacuuccacuuggguaacauauggaacauguaaccaagcaggggaacaucgacgcgacaaacgaucaguugcuuuagcaccccacguugguaugggacuagauacgagaacgcaaacauggauguccgcugaaggagcauggcgucagguggagaaagucgaaacaugggcgcuuagacacccgggauucacuauuuuggcauuauuucuagcacauuacauagggacaagucuaacacagaaagucguaauauuuauuuuauuaauguuaguaacuccaagcaugaccaugcgaugugugggaguagguaaccgcgacuuuguagaaggauugucuggugcaacauggguagauguuguuuuggaacacggaggaugcguaacgaccauggcuaaaaauaaaccgacguuggacaucgaacuccagaaaacagaagcgacucaacuagcgacacuaagaaaacuguguauagaagggaaaauaacgaauauaacaaccgauaguaggugucccacucagggugaggccguccuccccgaggaacaagaccagaauuacguauguaaacacacauauguugaucgagguuggggaaacggguguggauuguuuggaaaaggaucuuuaguaacgugugcgaaauuccagugucuagaaccuauagagggaaaagucguacaauaugagaauuuaaaauauacugucaucauaacaguccauacaggagaccaacaucaagucggaaaugaaacacaagguguuacagcggaaauaaccccucaagcgucuacaacugaggcuaucuugccagaauaugguacauuaggauuagaauguuccccuagaacugggcucgauuuuaaugaaaugauauuacugacaaugaaaaauaaggcuuggaugguucauagacagugguucuuugaucuuccauugccaugggcgucgggugcuacuaccgagacuccaaccuggaaccguaaagaauuacucgucacuuuuaaaaaugcacacgcgaagaaacaagaaguaguaguauuaggaagucaggaaggugcgaugcauacugcgcuuacuggcgccacagagauccaaaacuccggggguaccucaauauuugccggccauuuaaaauguagacucaaaauggauaaacuagagcugaaaggcaugucauaugcuaugugcacaaacaccuuuguauuaaagaaagagguauccgaaacccagcacgggacuauucugauaaaaguagaguauaaaggagaagaugcgccauguaaaauuccauuuaguaccgaagauggacaaggcaaagcacauaacggacgacuaaucacugccaacccgguaguaacaaagaaagaggaaccugucaacauugaagccgaaccaccuuuuggagagucuaacauuguuauagguauaggagacaaugccuugaaaauaaauugguauaagaaagguucaagcauaggaaaaauguuugaggcuacggccaggggugcgagacgaauggcaauuuuaggugauacggccugggauuucggaucugugggagguguauuaaauucacucggaaaaaugguucaccaaauauuugggagugcauacacggcacuauuuucugguguuaguugggugaugaaaauuggcaucgguguauuguuaacauggaucggucuuaauucgaaaaauacaaguaugucauucucaugcauagcgauaggaauuauaacacuauaucuaggugcaguaguucaagcagauauggguuguguaauaaauuggaaaggaaaagaacugaaaugugguuccggaaucuucguaacuaacgaaguucauacauggacagagcaauauaaauuccaagcagacagcccgaaaagauuagcuacugcuauugcaggagcuugggaaaacggaguuugcggaauuagaucuacaacgagaauggaaaauuuacuuuggaaacaaauugcuaaugaacugaacuauauucugugggaaaauaacauaaaacuuaccguaguaguuggagacacaauaggagugcucgaacagggaaaacgaacuuuaacgccccaaccuauggaauuaaaauacagcuggaaaaccuggggaaaagcgaaaaucgugacugcggaaauacaaaauagcagcuuuauaauugauggcccaaauacaccugagugcccuucagccucaagagcauggaauguaugggaagucgaggacuauggauuuggaguauuuacaaccaauauauggcucaaacuacgugagguauacacucagcugugugaccauagauugaugucagcagccguaaaagaugaacgagcaguacaugcagacaugggauauuggauagaaagucagaaaaacggaucuuggaaauuagaaaaagccucacuuauugaagugaaaacguguacauggcccaagagucauacauuauggucuaauggaguacuagaauccgauaugauaauuccaaaaucucuagcaggcccaaucucucaacacaauuacagaccuggauaucauacucaaaccgcuggaccauggcacuuaggcaagcuagaacuugauuuuaauuauugcgaggguacgacggucgugaucaccgagucuugugggacgagaggaccuagucuucgcacuaccacagucagugguaaguuaauccaugagugguguugucgcaguugcacuuuaccaccucuuagguauaugggagaagauggaugcugguaugguauggaaauacgaccuauaagcgaaaaagaagaaaauaugguaaaaucccuggugagugcuggcucugguaaaguugacaauuuuacgaugggcguacugugccuugcgauccuguaugaagagguaaugagagguaaguuugggaagaaacacaugauagccgguguauucuucacauuuguucugcuucuuucuggucaaauuacauggagagacauggcacauacauugauuaugauagguucuaaugcuagcgauagaaugggaauggggguuaccuauuuagcccuuaucgccacuuucaaaauucagccguuucuagcccuaggauucuuucuaagaaaacuuaccucucgagaaaaucuucuauuagggguaggauuagcaauggccacuacacuccaauuaccggaagauauagaacagauggcgaauggcauugcauuaggucuaauggcuuugaaacuaauuacacaguucgaaaccuaucaacuuuggacugcucuggucagcuugacuuguagcaacacaauauuuacucuaacaguagcguggagaacagccacccuaauacuggcgggaguuagucuauuaccaguaugccaaaguucaucgaugcggaaaacagacuggcuacccauggcaguagcugcuaugggaguacccccacucccccuuuuuauauucucauuaaaggacacauuaaaaagaagaucguggccuuuaaaugaaggaguaauggcaguugggcucgugucaaucuuagccucguccuuacuacguaaugacgucccuauggcuggccccuuaguagccgguggacuucugauagcuuguuauguuauaacagguacuagcgcggacuuaacaguugagaaagcggcagauguuaccugggaagaagaagcagaacaaacaggagugagucacaauuuaaugauuacuguagaugacgacgguacaaugagaauaaaagaugaugaaacggaaaacauauuaacuguuuuacucaaaacagcucuacuaaucguuucuggcauauuuccauacucuauccccgcgaccuuauuaguguggcauacauggcaaaagcagacucaacgaaguggcguccugugggacguaccaaguccuccugaaacucaaaaagcagagcuagaggaaggaguauauaggauaaaacaacaagguauauucgguaagacacaaguuggggucggugugcaaaaagaagguguauuucacacgauguggcauguuacccggggcgccguucuuacacauaaugguaaacguuuagaaccgaauugggcuucugucaagaaagacuuaauuaguuauggugguggauggagacucagcgcccaauggcaaaaaggagaagaagugcagguuauagccguggaaccaggcaaaaacccaaagaauuuucaaaccaugccuggaacauuucaaacgacaacaggugaaauuggcgcaauagcccucgauuucaagccugguacgaguggaaguccaaucauaaauagagaaggcaaaguaguuggccuguacggaaaugguguagucaccaaaaacgguggauauguaagcggcauugcacaaacaaaugcagaacccgacggaccaacgccugaacucgaagaagaaauguuuaagaaaagaaaucuuacaauaauggauuugcauccaggaucagggaagacaaggaaguacuugccugcuauagugcgcgaagccauuaaaagaagauuaaggacucuuaucuuggcaccuaccaggguugucgcagcagaaauggaagaagcucuaaaaggucuaccgauaagauaccaaacuaccgcaacaaaaagugagcacacaggaagggagauuguagaccugaugugucaugccacguuuacgaugcgucuuuuaucaccaguaagggugcccaacuacaacuugauaguuauggacgaggcucacuucaccgacccagcaaguauagcagcgcggggauauauaaguacaaggguaggaaugggugaagcugcagcaauuuuuaugacagcaaccccaccuggaacugcagacgccuucccgcaaucuaaugcaccuauacaagacgaggaacgugacauacccgaaagaucauggaauaguggaaaugaauggaucacagacuucgcuggaaaaacuguaugguuugugcccuccaucaaggcugguaacgauauugcaaacugccugaggaagaauggcaagaaagugauucagcuauccagaaagacuuucgauacagaauaucaaaagacaaaguuaaacgauugggacuucguaguuacaaccgacauuucagaaaugggcgccaacuucaaggcagauagagugauagacccccguaggugccuaaaaccgguaauccuaaccgacggcccugaacgaguaauauuagcuggaccuaugccaguaacggcagccuccgcagcacagaggcgaggaagggugggucgaaauccacaaaaagaaaaugaucaauauauauucacaggucaaccguugaauaaugaugaggaucaugcacacuggacugaagcgaagaugcuacuagauaauauaaacacaccagaagguauuauaccagcacuauuugaaccugagagagaaaagagcgcggccauagauggagaguacagacuaaaaggagaaucaagaaaaacuuucgucgaauugaugagaagaggggaccuuccuguuuggcucgcucauaaggucgcaucagaaggcauaaaauauacagaccgcaaaugguguuuugauggacaacgaaauaaucagauccuagaggagaauauggacguugaaaucuggacgaaagaaggagagaagaagaaacugagaccgagauggcuggacgcacguacauacagugauccccucgcacuaaaagaauuuaaagacuucgcagccggccguaaaucuaucgcauuagauuuggucacugagauaggacgugugcccucucaucuagcacaccgaacuagaaaugcauuagacaaucuaguaauguuacauacaucggaacaugggggucgcgccuauagacaugcuguggaggaacuacccgaaaccauggaaacccuuuuacuacuaggucuuaugaucuuauugacugguggagcgaugcuauuuuuaauaagcggaaagggcauuggaaaaaccucaauuggacuaaucuguguaauagcauccucugguauguuauggauggcagaaguuccacuacaguggauagcaagcgcuauaguauuagaguucuuuaugauggucuuguugauuccagaaccagaaaagcaaaggacuccccaagauaaucagcuggcauaugugguuaucggaauccucacgcuggcugccauuaucgcugcaaaugaaaugggccuuuuagaaacaacuaaacgggauuuagguaugucgaaagaacccggagugguauccccaacgagcuaucuggacguagaucuacaucccgcaagugcauggacguuauaugcuguagcuaccacagucauuacuccuauguugagacacacaaucgaaaauucuacugccaaugucucauuagcagccauagccaaucaagcagugguucuuaugggccuggauaaaggcuggcccaucaguaagauggaucuaggagucccccuuuuagcacuagguuguuauagucagguuaacccuuuaacccuaacagcagcgguacuucuccuaauaacacauuacgcuauuaucggaccaggcuugcaagccaaggcaacaagagaagcacaaaagcguaccgccgccgguauaaugaaaaacccaacaguggacggaauaaugacaaucgacuuagauccuguuauuuacgauucuaaguuugaaaaacaacugggacagguuaugcuauuaguucuuugcgccgugcaauuauuguuaaugcgcacgagcugggcauugugcgaagcccugaccuuggcaacaggucccauaacaacucuuugggaggguagcccgggaaaauucuggaauacaacuaucgcggugucuauggccaauauauuuaggggaaguuaucuggccggugcggggcuagcauucucaauaaugaaaaguguaggaacaggaaaacggggaacaggaucgcaaggugagacucuaggcgaaaaauggaagaagaaauugaaucaacucucacggaaagaauuugacuuauauaagaaaucaggaauaacggaaguagaucggacggaggcgaaagaaggauuaaagagaggcgagacaacucaucaugccguuucuagggggucggcaaaacuucaaugguuuguggagagaaacaugguugucccugaagggagaguuauagaucuuggcugugguagaggugguuggaguuauuauugcgccggacugaagaaaguuacugaaguaagaggauauacaaaagggggaccgggacaugaggagccggucccuaugucgacauacggauggaauauaguuaaauuaaugucugguaaggauguauuuuauuuaccacccgaaaaaugcgauacguuguuaugugauauuggagaaucaucaccgucaccgacaguagaagaaagccguacuauucgaguccuaaaaaugguagaaccauggcuuaagaacaaucaauuuuguaucaaaguauugaauccuuauaugccuacuguuaucgaacaccuagaaaggcuacaacgcaaacacgguggcauguuaguaaggaauccucuaucaagaaauucaacacaugaaauguauuggaucucaaacgguacuggaaacauagucuccucaguuaauaugguaucaaggcuacuucuuaaccgguuuaccaugacucauagaagaccgacuauagaaaaagauguggaccuaggugcagggacaaggcauguuaaugccgagcccgaaacgccuaauauggacguuauaggcgaaagaaucaaacgaauaaaagaggaacacaauaguacauggcacuaugacgacgaaaauccauacaaaacaugggccuaucauggcucuuaugaggucaaagcuacggguagcgcuagcuccaugauaaauggaguaguaaaacuguuaacuaaaccgugggaugugguaccaaugguuacacaaauggccaugacugacacaaccccuuuuggacaacaaagaguauucaaggaaaagguugauacacguacaccacguccaaugccuggcacuaggaaagucauggagauuaccgccgaguggcuauggcgaacacugggcagaaacaaacgaccgaggcucugcacacgagaggaguuuaccaagaaggucagaacaaaugcagcuaugggugcuguauuuaccgaagaaaaccaaugggauagcgcgaaagcugcuguggaagacgaagaauuuuggaagcuagucgaccgagaaagagaacuccauaaacugggaaaauguggaucauguguauacaacaugaugggcaaaagagagaagaaauugggagaguucgggaaggcaaaaggcucaagggcaauaugguauaugugguugggggcacgauaucuugaauuugaggcacucggguucuuaaacgaagaccauugguuuagccgugaaaauucauauucaggcgucgaaggggaaggacuccauaaguuaggauauauauuacgggauaucaguaagauuccugguggggcaauguacgcagacgauacagcagguugggauacuagaauaacugaagaugaucugcacaacgaagagaagauaauacaacaaauggaucccgaacauaggcaacucgcuaaugccauauuuaaacuaaccuaucaaaauaaaguaguuaaaguacaacgaccaacacccacaggaacugucauggacauaaucucaagaaaagaucaaaggggaucgggacaagucgggacuuauggacuuaauacauuuacaaacauggaagcccagcugguaagacagauggaaggggaggggguccucacaaaagcugaucuggaaaauccccacuuacccgaaaagaagauaacacaauggcuugaaacaaaaggcguggaaagguugaaaagaauggcaauuagcggugaugauugcguaguaaagccaauugacgauagauucgcaaacgcuuuacuggcucuaaaugacaugggaaagguucguaaagacaucccacaauggcaaccuagcaggggauggcacgauuggcaacaggugccauucugcagccaucacuuucacgaacugauuaugaaagauggacgcaaacucguaguuccuugucggccucaggacgaguuaauaggcagagcuagaauaagccagggggcaggauggucccuacgagagacagcgugccucgguaaggcuuaugcucaaauguggagucuaauguauuuccauagacgggauuuacgcuuagcaucgaacgccaucuguucggccguucccguacauugggucccaacuucuagaaccacauggaguauacacgcacaccaccaauggaugacuacugaggacaugcugaccguauggaaucgcgucuggauagaagaaaauccauggauggaggauaaaacuccaguaacuaccugggaaaauguuccguauuuaggcaagcgagaagaucaguggugcggaucacuuaucggccugacuucuagagcaacuugggcacaaaacauuuuaacagcaauacaacaggugcgaucauuaauaggcaacgaggaauuuuuggacuauaugccaucgaugaaacgauuuagaaaagaagaagaaucagagggggccauuugguaa

SEQ ID NO: 23542 - RNA, 9873 nt, Artificial Sequence
  derived and/or modified CDS sequence (opt6) from DENV-3__JQ411814__SS-prME
acgagucuuuguuuaaugaugauucucccggcagcauuagcauuucaccugacgucucgugacggggaaccccgaaugauaguagguaaaaacgaacgcggcaaaucucuacuguuuaaaacugcaaguggcaucaauauguguacuuuaauagcaauggaucucggcgaaaugugcgaugacaccguaacuuacaaauguccgcacaucacagaaguagaaccggaagauauagauugcugguguaauuuaacuagcacaugggugaccuaugggacgugcaaucaagcuggugaacaucgccgggacaaaagauccguagcgcuugcaccucacgucggcaugggacuagauacacgaacccaaacauggaugagcgcugaaggggccuggagacaaguagaaaaaguggaaacuugggcacucaggcacccugguuuuacaauacuagcccucuuucucgcucauuauauagggacaucuuuaacacaaaaaguagucaucuucauccuacuuaugcuaguaacaccuuccaugacuaugagaugcguugguauugggaaccgagacuuugucgaaggauuaucuggagcaacauggguagacgucguauuggaacacggcggguguguaacgacaauggccaaaaacaaacccacuuuagauauugaacuacagaaaacugaagcaacccaacuagccacauuaaggaaauuauguaucgaaggaaaaauaacuaauaucacuacagacagcagauguccaacacaaggagaagcggucuuacccgaagaacaagaucaaaacuacguaugcaaacacacauacguagauagaggguggggcaacggaugcggacucuucggaaaaggaaguuugguuacaugcgcaaaauuucaaugucucgaaccgauagaagggaaaguuguacaauaugagaaccuaaaauauacuguuaucauuaccguucacacuggagaucaacaucaaguggguaacgaaacccaaggaguaacugcagagaucacuccccaagcgaguacaacugaagccauucuaccagaauacgggacccuaggcuuagaauguucaccacguacagguuuggacuucaacgaaaugauauuacuuaccaugaaaaauaaagccuggaugguccaucgucaaugguucuuugaucugccacugccguggacaaguggggcuacaacggaaacuccaaccuggaaccguaaagaacugcugguuacguuuaaaaaugcucacgccaagaaacaagaaguagugguguugggcucucaagaaggcgcgaugcacaccgcucuaacgggcgcuacagagauacagaacucagguggaacaagcauuuuugcaggacaucugaaaugcagacuaaaaauggauaaauuagaacuaaaagguaugaguuaugcaaugugcaccaacacauucgucuugaagaaagagguaucagaaacgcaacacggaacaauacuaauaaaaguagaauauaaaggagaagacgccccguguaaaauaccauuuucaacugaagacggucaaggaaaagcacauaauggaagauugauuacagcgaauccuguuguaacaaagaaagaagaaccaguuaauauagaagcagagccuccguucggugagucuaauaucgucauaggaauuggggauaaugcuuuaaaaauuaacugguauaagaaaggauccucaauaggaaaaauguucgaagcaacugcucgcggagcgaggaggauggcgauucuaggagauacagcaugggauuuuggaaguguagguggcguguuaaacagucuugguaaaaugguccaucagauauucggauccgcuuauacggcauuguuuagcggaguaagcuggguuaugaaaauuggaauagguguacuuuuaacauggaucggacuuaauaguaaaaauacgucaaugucguuuucaugcauagcaauaggcauaauaacccuuuauuuaggugcaguaguucaagcugauaugggguguguaaucaauuggaaagguaaagaauuaaaauguggaaguggaaucuucguaacaaaugaaguacauacauggaccgaacaguauaaguuucaagcugacagcccuaaaaggcucgcaacagcgaucgcuggggcaugggaaaacggaguaugugguauuagaaguacaacccguauggagaaccuucuauggaaacaaaucgcaaaugaauuaaacuacauauuaugggaaaacaacauaaaacuaacuguuguuguaggagauacuauaggugugcuggaacaaggaaaaagaacuuugacgccccaacccauggaacuaaaauauucguggaaaacguggggaaaagcuaaaauagugacagcagaaacacaaaauaguuccuuuauaauugauggaccaaacacuccggagugcccgucggcuaguagagccuggaauguuugggaaguagaagacuauggauuuggugucuuuacgacuaacauaugguuaaaacuacgagauguuuacacacaacucugugaccaccgucuaaugucagccgcuguaaaagaugaaagagcgguucaugcugauaugggcuacuggauugagucacagaaaaacggauccuggaaacuugaaaaagcuagccuaauugaaguaaaaacauguacguggccaaaaagucacacacuguggucaaaugggguccuggaaucugauaugaucauaccgaaaaguuuagcggguccgauaucacagcacaauuaccguccaggauaucauacucaaacagcagggcccuggcacuuaggaaaauuagaguuagauuucaacuauugcgagggcacgacgguuguaauaacggaaaauuguggcacucgaggaccuuccuugagaacaacuacaguaucugggaaacucauacacgaaugguguugccgguccugcaccuuaccaccguuaagauacaugggagaggauggaugcugguauggaauggaaauuagaccaauuucggaaaaagaagaaaacauggucaaauccuuagucucagcagggagcggaaagguagacaacuucacaauggggguucugugucuggcaauacuauuugaagaaguuaugagggguaaauuuggaaagaaacacaugauagccgguguauuauucacuuuuguucuacuguuaaguggccaaauaacauggagagacauggcacauacacuaaucaugauagguucaaacgcgucugauagaaugggcaugggagucacauauuuggccuuaauagcuacuuuuaaaauccaacccuuccucgcgcucgguuucuucuuaagaaaauuaacauccagagaaaacuuacuuuuaggaguaggacuagcaauggcaacuacccugcaguugccggaagauauugaacaaauggcuaauggaauagcuuuaggucuuauggcucugaaguuaauaacucaguuugaaacauaccaacuauggacugcacuuguaucacuuacauguucuaacacaauccuuaccuuaacuguagcuuggcgaacagcaacucuaauucuagcaggaguaucacuacuuccuguuugucagucguccaguaugaggaaaaccgauugguugcccaugaccguagcagcgaugggcguuccaccccuaccuuuauuuauauuuaguuugaaagacacccuaaaaagaagaucauggccucugaacgaagguguaauggccguaggccuaguaucuauauuagcgucgucucugcugcgaaaugauguaccaauggcaggcccacuugucgcaggagguuuauuaauagcuugcuacgugaucacagguacaucggccgacuuaacgguggagaaagcagcagauguaacaugggaagaagaggcagaacaaacgggaguuucccauaacuugaugauaaccguagacgacgaugguacaaugaggaucaaagaugacgaaacagaaaauauucugacagucuuacuaaagacggcguuacuaauuguuagugguauuuuuccauauucuauaccugcgaccuuauuagucuggcauacauggcaaaaacagacacagcguaguggaguccucugggauguuccuucgccuccggaaacucaaaaagcagaacucgaagaaggaguguaucguauaaagcaacaggguaucuuagggaaaacucaagugggcguugguguucaaaaagaggguguuuuccauacaauguggcaugugacucgaggggccguacuaacgcacaauggcaaacguuuagaaccgaauugggccucugucaagaaagaccucauuaguuauggugguggauggagacuuagugcccaauggcagaagggggaagagguacaagucauugcuguagaacccggcaaaaauccuaaaaacuuucaaacaaugccagguacguuucagacaacaaccggagaaauuggugcuauagcauuagauuucaaacccggcacaagugguucaccuauuauaaaucgagaaggaaaagugguuggacucuauggaaauggaguaguuacuaaaaacggugguuacguaagcggaauagcucaaaccaaugccgagccagauggaccgacuccagaacuagaagaagaaauguucaagaaaaggaaucuuacuauaauggaccuacacccgggaucugguaaaacuagaaaauacuuaccggcaauuguuagggaagccaucaaaagacgucuacgaacguuaauacuagccccuacaagaguuguggcagcggagauggaagaagccuugaaggguuuaccaauuagauaccaaacaacugcaacgaaaucagaacauacgggacgagaaauugucgacuuaaugugccacgcgacauucacuaugcggcucuuauccccuguccgcgucccaaauuauaaucucauaauuauggaugaagcacacuucaccgauccagcuaguauugcggcuagaggguauauuaguaccagggucggcaugggagaagcggcugcaauauucaugacggcuacaccacccggaacagcggaugcauuuccgcaaagcaacgcaccgauccaggaugaggaaagagauaucccagaaaggucauggaauagugguaacgaauggauuacugauuuugcuggaaaaacuguuugguuuguaccgaguauaaaagcagguaaugauauagccaacuguuugaggaaaaacggcaagaaagugauacaacuaagucgcaagacauucgauacagaauaucagaaaacuaaauuaaaugauugggacuuuguaguuacaaccgacaucucagaaaugggggcaaauuuuaaagcagacagagucauagauccacgacgaugccuaaaaccugugauccuuacugauggcccagaaagaguaauauuagcagguccgaugcccguuacagcagccucagcagcacaaaggcguggaaggguaggaagaaacccacagaaggaaaacgaccaauacauauuuacaggucaaccacuuaauaacgaugaagaucacgcacauuggaccgaagcgaaaaugcuccuagauaacauaaacacacccgaaggaauaauacccgcuuuauucgaaccagaaagagaaaaaucagcagcuauugauggugaauacagacuuaaaggcgagucucggaaaacauuuguggaacuuaugaggcgcggggauuuaccaguuugguuagcucauaaaguggcuucugaagggauuaaguauacagacagaaaaugguguuuugacggacagcggaauaaucagauuuuagaagagaauauggaugucgaaauauggaccaaggagggugagaagaagaaacuaaggccucgcuggcuagacgcgagaacauauucagaucccuuggcguuaaaggaauuuaaagacuuugccgcaggcagaaaaucaauagcguuggauuuagucacugaaauagguagagugccgucucaucuugcgcauaggacccgaaaugcucuagauaaucuuguaauguugcacacaagcgaacacgggggccgagcguauaggcacgcuguugaagaacuaccagagacgauggagaccuuacuccugcuugguuuaaugauuuuguugacagggggagcaaugcuauuuuuaauaaguggaaaaggaauaggcaagacuucaauuggccugauuuguguaauugcgucgucuggcauguuguggauggcggaaauuccauuacaguggauagccagugcaauuguccuagaauuuuucaugaugguauuguuaauuccagaaccugagaaacaacgaacaccccaggacaaccagcuggcauacgugguuauagguauuuuaaccuuggcugcuauuauugcagcaaaugaaaugggccuacuagaaacgacaaaacgggacuuaggaaugucuaaagagccaggaguaguaucaccuacaagcuaccuagauguugaucuucauccggcgucagcauggacucuguacgcaguggccacaaccguuauuacaccuauguuaagacacacgauagaaaacucuacugcaaacguaagucuagcagcaauugcaaaccaagcaguuguauuaaugggacuagauaaggguuggccgauuaguaagauggaccuagguguacccuuauuagcacuaggauguuacucccaaguuaauccacuaacucuaacugcagccguauuacuacugaucacacauuacgcuauuaucggcccgggccuccaggcaaaagcaacaagagaagcucagaaaagaacagccgcuggcaucaugaagaacccaacaguagaugguauuaugacaauugaucuagacccugucauauacgauucuaaauuugaaaagcaacucggucaagugauguuacuuguuuuaugugcgguacaacuacuucugaugagaacgagcugggcacuuugcgaagcccugacgcucgccacagguccaauaacuacguuaugggaaggaucucccgggaaauuuuggaacaccacaauagcaguaagcauggcuaacaucuuuaggggaaguuaccuagcaggagcagggcuagccuuuaguauuaugaagucggucgggaccggcaaacgcggaacggggagccaaggugagacacucggagaaaaauggaaaaagaaacugaaccaacuaagccgcaaagaguucgaccuauauaagaaaagcggaauuacagaaguagacaggacagaggccaaagaagguuuaaagaggggagaaauuacacaccaugcuguuucccgaggauccgcaaaauugcaaugguuuguagaaagaaauaugguaaucccagaagguagaguaauagaucuggguugcggaagaggagggugguccuauuacugugcuggauugaagaaaguaacagaaguaagggguuauacaaaaggcggaccuggucaugaggaaccagugcccauguccaccuacggauggaauauugucaaauuaaugagcggaaaagacguauucuauuugccaccagaaaaaugcgauacucucuugugcgauauuggggaaucuagucccuccccuacaguugaagaauccagaaccauacggguuuuaaaaaugguagaaccguggcugaaaaacaaucaguuuuguaucaaagugcucaauccauauaugccuacagucauagaacaucuugaacggcuucagcggaaacauggcgguaugcuugucaggaauccauuaaguaggaauagcacccaugaaauguauuggauaaguaaugggacagguaacauaguuucuagcguuaauaugguuucgcggcuuuuguuaaacagauuuacaaugacccaucgcagaccaaccaucgaaaaagacgucgaucuuggggcagguacgaggcauguaaaugccgaaccagagacgcccaacauggaugucaucggggaaaggauaaaacggauaaaagaagaacauaauaguacuuggcauuacgacgacgaaaauccauacaagacaugggcuuaccauggaaguuaugaaguuaaggcaacagggucggcuucuuccaugauaaacggcguaguaaaacuacuaacaaaaccaugggaugugguucccaugguaacucaaauggcaaugaccgauacuacaccauuuggacaacagagagucuuuaaagagaaaguggauacaaggacgccuaggccuaugccagguacuaggaagguaauggggauaaccgccgaauggcuguggcgcacgcucgguaggaauaaacgcccuagacuauguacuagggaagaauuuacuaagaaaguaagaacuaaugcagcuaugggagccguuuucacugaggaaaaccaaugggacagcgcuaaagcggccguagaagacgaggaguucuggaagcucguugacagagaaagggagcuccauaaacuaggaaaauguggcuccugugucuauaauaugaugggaaaaagggagaagaaacuaggagaauuuggaaaagcaaaagguucgcgagcaauaugguauaugugguuaggugcgagauaccucgaguuugaagcacucggcuuucuaaaugaggaucauugguucucucgugacaacucguacuccggaguagaaggagaggguuugcacaaacuuggguacauuuuacgcgauauuucaaaaauaccaggcggcgcaauguaugcugaugauacagccggcugggacacuagaauaacugaagaugacuuacacaacgaagagaaaauuacacaacaaauggauccugaacauagacaauuggcaaaugcaaucuuuaaguuaaccuaccagaauaaaguagucaaagugcaacgacccacaccaacagguaccguuauggauauaauaucaagaaaagaccaacgaggauccggacaaguagggacuuacggucuuaauacguucacaaacauggaaguccaacucguacgacaaauggaaggagaaggcguauuaagcaaggcugacuuagaaaauccgcauuuaccagagaagaaaaucacucagugguuagaaacgaaggguguagaacguuuaaagagaauggcgauaucaggcgaugacugcguaguaaagcccauagaugaucgcuuugcaaaugcauuacuagcuuuaaaugauaugggaaaaguaaggaaggauauaccucaauggcaacccucuaaggguuggcaugauuggcagcagguccccuuuuguucgcaucacuuccaugaguuaauuaugaaagauggaaggaagcuaguaguuccaugucggccacaagaugaacucauuggcagagcuagaauuagccaaggcgcaggauggagccuacgagagacggcgugccuaggaaaagcauacgcgcaaauguggucacuaauguauuuccaucggagagacuuacgauuagcuaguaaugccauauguucagcaguaccuguacauuggguaccuacuucacguacaacauggucaauccaugcucaucaucaguggaugacaacagaggacaugcuuaccguguggaaucggguuuggaucgaagauaaccccuggauggaagauaaaacgccaguaacaacuugggagaauguaccuuacuuagguaagcgugaggaccaguggugugggaguuuaauuggauugacgaguagagcaacgugggcacaaaauauuccuaccgccauucagcaaguuagauccuuaauaggaaacgaagaguuccuggauuacaugccgucaaugaagcguuucagaaaagaggaagaaagugaaggggcaauaugguga

SEQ ID NO: 23543 - RNA, 9873 nt, Artificial Sequence
  derived and/or modified CDS sequence (opt6) from DENV-3__KM190937__SS-prME
acaagucuuugucuaaugaugaugcuaccagcaaccuuggcauuccaccuaacuucucgcgacggggaaccaagaaugauaguggguaaaaaugaaagggggaaaucccuauuauuuaaaacggcgucagguauaaauauguguacauuaauagcuauggauuuaggagaaaugugugaugauaccgucacguacaaaugcccacacauuacagaaguagaaccugaagauauugauugcugguguaaucuuacuucaacguggguaacuuaugggacuuguaaucaagcuggcgaacaucgccgggauaaacgaucaguugcaauagcaccacaugugggaauggggcuugauacgagaacgcaaacauggaugucagcggaaggagcauggagacaaguagaaaaaguugaaacuugggcacuuagacacccaggauuuacaauucuugcacuuuucuuggcacauuacauagggacaagucucacccaaaaaguugucauuuucauucugcucauguugguuaccccuucaaugacaaugcguugcguagggguagguaaccgggacuuuguagaaggguugagcggcgcuacauggguagacguggucuuggaacaugguggauguguaaccacuauggccaaaaauaaaccuacccucgacauugaauugcagaaaacugaagcgacgcaacuagcuacauuaaggaaauuauguaucgaaggaaaaauuacgaacauuacuacggacucucgcuguccuacucaaggugaggcaauauugccugaagaacaagaucaaaauuacguauguaaacauaccuacguggacagagguuggggcaaugguugcggcuuauucgggaaaggauccuuaguaacaugcgcuaaauuccaaugucuugaaucgauugaagguaaaguaguccaacaugaaaaucuuaaauauacgguaaucauaacuguacauacaggagaccaacaccaaguagguaaugagaugcaggguguaacagcagaaauuaccccgcaggcaaguaccgccgaggucaucuuaccggaguauggcacacuaggacucgaauguaguccgcguacgggccuugacuuuaaugaaaugauaagucugacuaugaaaaacaaagcauggaugguacauagacaaugguuuuucgauuuaccacuaccguggacgucaggggcuacugcagagacaccgacuuggaacagaaaagaacuauuggucacauuuaaaaaugcgcaugccaagaaacaagaagugguuguccucggcagucaagaaggugcuaugcauacugcccugacaggugcaaccgaaauacagacaucaggcggaacgaguauuuucgcaggucacuuaaaaugcagacucaaaauggauaaacuugaacuaaaaggaaugaguuaugcaaugugccuauccucauuuguacugaagaaagaaguuagcgagacacaacacggaacaauucuaaucaaaguagaguauaaaggugaagaugccccauguaaaauaccuuuuuccacugaagauggacaaggcaaagcucauaacggcagacucauaacagccaacccaguaguaaccaagaaagaagaaccugucaauauagaagccgaaccuccauuuggagagagcaacauaguaauaggcaucggggacaaggcuuuaaaaauaaauugguacaagaaagguucuuccauaggaaaaauguuugaggcuaccgcacgcggagcuagaagaauggcuauucuaggugacacagcuugggacuucggaaguguugggggaguacuaaauucgcuaggaaaaaugguacaucaaauauucggcagcgcauauacugcacucuuugguggagugaguuggaugaugaaaaucgguauagggguauuacuaacuuggaucggccugaacucuaaaaauacaucaauguccuuuagcugcauagcuauugguauaauuacauuguauuuaggugccguaguacaagcagacaugggcugcguuauuaauuggaaagguaaagaauugaaaugugguucuggcauauuugucacaaaugaaguucauacuuggacagaacaauacaaauuucaggcugauucuccaaaaagacucgcaacagcuauugccggugcaugggagaacgguguauguggaauccgaucaacuacaaggauggaaaaccuacuguggaaacaaaucgcaaacgaauugaauuauauucuaugggaaaauaauaucaaauugaccguuguaguuggggauauuacuggaguacuagagcagggcaaaaggacuuuaaccccgcaaccaauggaguuaaaauauucauggaaaaccuggggaaaagcuaaaaucguaacagcggaaacacaaaauuccucguucauuauugauggucccagcacgccagaauguccaucagccagccgagcuuggaauguaugggaaguggaggauuacggcuuugguguuuuuacgacgaauauuugguuaaaauuaagagaaguguacacacaauuaugugaucaucgucuuaugagcgcggcaguuaaagaugaacgcgcuguacacgcugacauggguuacuggauagaaucccagaaaaauggaucauggaaauuagaaaaagccucguucauugaggucaaaacauguacauggccuaaaucacacacguuguggucgaauggaguacuugaaagugacaugauaauuccuaaaagccuagcaggacccaucucucaacauaaucauaggccugguuaccacacacaaacagcuggaccuuggcauuuaggaaaauuggagcucgacuuuaacuauugcgaaggaacgacuguaguuauauccgagaauugugguacacgugguccuuccuuaagaacaacuacaguuucagguaaacuuauccacgaauggugcugccgaaguugcacccugccaccucuucgcuauaugggagaagacggaugcugguauggaauggaaauaagacccauaaacgaaaaagaagaaaacaugguaaaauccuuagcauccgcggggagugggaaaguagauaauuucacaaugggaguucuuugccuagcuauacuuuuugaagaagugaugcgggguaaauuuggaaaaauccacaugauugcuggaguacuauucacuuucguuuuacuccuaagcggacagauaacauggcgugauauggcacauacauuaauuaugauugggaguaacgccucagaccggauggguaugggcgucacauaccuagcguuaauagcuacauuuaaaauucaaccauuucuagcuuuagguuucuuucuucgaaaacucacaagccgugaaaaucuucuacuaggagucggucuagcaauggcugcuaccuugaggcugcccgaggauaucgaacaaauggcgaacggaauugcauuaggauugauggcacuaaaauuaauaacacaauuugaaacauaccaacuuuggaccgccuuaguaagccugacguguaguaacaccauauucacauuaacaguugcauggaggacagcuacguugauauuagcaggaauaucauuacugccgguaugccaauccagcucaaugcguaaaacugacuggcuacccaugacugucgcagcaaugggagcacaaccacuccccuuauuuaucuucucauugaaagacacacuaaaaagaagaagcuggccccuaaacgaagggguaauggcggugggcuugguuagcauucuggcuucgucuuuauuaagaaaugauguaccgauggcaggaccucugguggcaggaggucuuuuaauugccuguuacgugauuacagggacaagugccgaucuuacuguggagaaagcugcggacguaacuugggaagaagaagccgaacaaacuggcgucucccauaaccuuaugguuaccgucgaugacgacgguacaaugagaaucaaagacgaugaaacugagaauauacucacgguauuacucaaaacagccuuacugauagugagcgguauauuuccauauucuauucccgcaacacuuuuaguauggcacacauggcagaagcaaacccaaagaagcggcguuuugugggacguaccaaguccaccggagacacaaaaagcggaguuggaagaaggcguauacaggaucaaacaacaggguauauucgggaaaacacaaguugggguugguguucaaaaagaaggaguguuucauaccauguggcauguuacucguggagcuguauuaacccacaaugguaaaagacuggagcccaauugggcuaguguuaagaaagaucuuaucaguuacgguggaggguggagauugucugcgcaauggcaaaaaggggaagaaguacaagugauugcagucgagccgggaaagaauccuaaaaacuuucaaacgaugccugggauauuucagacuacaaccggugaaauuggugcaauagcgcuagauuuuaaaccaggaacuucaggcagucccauaauaaauagagaggguaaaguagucggcuuauacggaaauggagugguaacgaaaaauggugguuacgucucugggauugcacaaacuaaugccgaaccugauggaccgacucccgaguuagaagaggaaauguuuaagaaaaggaauuuaacaaucauggaucuacacccugggucaggaaagacccggaaauaccuaccagcuauaguucgggaagcuauuaaaagacgucuacgaacauugauauuggcuccgacaagaguaguagcggcagaaauggaagaggcuuugaaaggacugccaauacgauaccaaacgacagcuacuaagucggaacacacgggacgugaaauaguagacuuaaugugucaugcaacauuuacaaugagacuacuaucaccaguaagaguaccuaauuacaaccuaauaauaauggacgaagcacauuuuacagauccagccucuaucgccgcacggggauacaucucaaccagggucggcaugggcgaagcggcugccauauuuaugacagcaacaccacccgguacagcugaugccuucccacaaaguaacgcuccaauacaggacgaagaaagagacauuccagaaagauccuggaacucagguaaugaguggauuacggauuuuguaggaaaaaccguaugguucguacccaguauuaaggccgguaacgauaucgcaaacugccuacgaaagaaugggaagaaaguuauccaacuaaguagaaagacauuugauacugaguaucagaaaacgaagcuaaacgauugggacuuuguaguuaccacggacauauccgaaaugggagccaauuucaaagccgaccgaguaauagacccgaggcgaugucuuaaacccguaauauuaacugaugguccugaacgggugaucuuggcuggaccuaugccaguuaccguagcauccgcggcccaaagacgaggaagaguaggaaggaacccacagaaagaaaacgaccaauacauuuuuaugggccaaccauuaaauaaugaugaagaccacgcucauuggaccgaagcaaaaaugcuucuugauaauauaaauaccccagaaggcauuauaccugcauuguucgaacccgaacgugagaaaagugcugcaauugacggugaauaccgccuaaaaggugagucaagaaaaacauucguugaacuuaugcguagaggcgauuugccgguauggcuagcucauaaaguggcaagcgaagggauuaaauauacggacaggaaaugguguuucgauggagaaaggaauaaucaaauccuugaagagaacauggacguugaaauauggacgaaagaaggggagaagaagaaauuacgaccuagauggcuggacgcuagaacuuauuccgacccucuugcuuuaaaagaguucaaagauuuugcggcuggaagaaaaaguauagcauuagacuugguuacagaaauuggcagagugcccucacauuuagcucaccgcacacgaaacgcuuuagacaauuugguaaugcuacauacaagugaacaugguggucgagcauacaggcaugcgguagaagaacuuccggagacaauggaaacucuguugcucuugggucugaugauauuauuaacgggaggagcuauguuauuccuaaucagcggcaagggaauuggcaaaaccucaaucggauugauauguguuauagcaucaucugguaugcuuuggauggcagacguaccguugcaauggauugccuccgccaucgugcuggaguucuuuaugaugguuuuacuaauuccggagcccgaaaagcaaaggacuccacaagauaaccaauuggcauaugucguuauuggaaucuuaacacuggcagcaauaguagccgccaaugaaaugggucuacuagagacuaccaaacgagaucucgguaugaguaaagagccgggaguugucucgccgacuucuuacuuagacgucgauuugcacccggcaucagcauggacauuguacgcaguagcuacaaccgugauuaccccaaugcuccgacauacaauagaaaauuccacagcaaauguaucacuagcugcaauagcgaaucaggccgugguguuaaugggucuggauaaaggauggccgauaucuaaaauggacuuaggaguuccgcugcucgccuuagggugcuauucucaaguuaauccccuaacguuagccgcggccguucuucuauuaguaacacauuaugcaauaaucgguccuggucuccaagcuaaagcaacaagagaagcacagaaaagaacggcagcaggcaucaugaaaaaccccacaguugacggaauaaugacaauagaccuagacccgguaaucuacgauucgaaauucgagaaacagcuaggccaaguaaugcuccugguacuuugcgcgguucaacuacuacuaaugaggacuucuugggcauuaugugagguacuuacccuagcaacugggccaauuacaacgcugugggaaggcucaccugggaaauuuuggaauacuacaauugcugugucgauggcaaauaucuuccgaggaucguauuuggcuggagcaggacuagcauuuucuauuaugaagaguguaggaacaggaaagcguggaacuggaucacaaggagaaacucucggugaaaaauggaagaagaaauugaaucaauuaucuaggaaggaguucgaccuauacaagaaaucaggaaucacagagguagauagaacugaggcaaaagaaggucuuaaacgaggggaaauaacacaucaugccguauccagagguuccgcaaaacuccaaugguuuguggaacgaaacaugguaauuccagaaggacgaguuauagacuuaggaugugggagagguggauggucguacuacugcgccggcuugaaaaaggucacagaaguuaggggauauacgaaaggagguccaggacaugaggaacccgucccaaugucuaccuauggauggaacauaguuaaauuaaugucggguaaagaugucuucuauuugccaccagaaaaaugugauacguuacuaugugacauuggugaaucgucuccaucgccgacaguggaggaaucgaggacaauacgaguacuaaaaaugguugaaccuuggcucaagaauaaccaauucuguauuaagguacuuaauccauauaugccaacagugaucgaacaccuggagagacuacaaagaaagcacggcggaaugcuaguaaggaaccccuuaagucgaaacucgacucacgaaauguacuggauaagcaaugggacagggaacauuguuucaagcguuaacaugguuucacguuuauuauuaaaucgauuuacaaugacacaucguagaccaacaauagaaaaagacguugaucuaggugccggaacacgccacgugaacgcugagcccgaaacaccgaacauggauguuauuggagaaaggauuaagagaauaaaagaggaacacucuaguaccuggcauuaugacgaugaaaacccauauaaaacaugggcauaucauggcucuuaugaaguuaaagcuacaggaucggcuuccaguaugauaaacggagucguuaaacugcucacaaaaccgugggauguuguaccaaugguaacccaaauggcaaugaccgacacaacuccuuucggucaacagcguguuuuuaaagagaagguagauacucgaaccccacguccaaugccaggaacacguaagguuauggaaauaacggcggaaugguuguggagaacuuuggguaggaauaaaaggccgaggcuguguacgcgggaagaauuuacaaagaaaguuagaaccaaugccgcaaugggugcagucuuuacagaagaaaaucaaugggacagcgcgcgugcggcaguagaagacgaagaguucuggaaacucgucgaucgggagagagaacugcacaaauuaggcaaauguggaaguugugucuacaauaugauggguaaaagagaaaagaaauuaggugaguucggcaaggcuaaggguucgagagcgauaugguauauguggcuuggagcacgauacuuggaauuugaagcguuaggauuccugaaugaggaucacugguucucuagggaaaacucauacuccgggguugaaggagaaggccuacauaaacuaggcuauauacucagagauauauccaaaauaccuggaggagcuauguaugcagaugacacagcugguugggacacgaggaucacagaagaugaucugcauaaugaagagaaaauuacgcaacaaauggaucccgaacaccgucaacuagcaaacgcaauuuucaagcuaacguaucaaaacaaaguuguuaaaguccaacgcccuacuccuaaagguacaguaauggacaucauaucacggaaagaucaacgagggucaggucagguugguaccuacggcuuaaauacauucaccaauauggaggcacaauugauacgucagauggaaggugaagguguauugucaaaggccgaucuagaaaacccucaucccuuagagaagaaaauaacacaaugguuagaaacgaaagguguagaacgauuaaaacguauggcaauuucuggagaugauugcguggugaaaccaaucgacgacagauucgcuaacgcucuauuagcauugaacgauauggggaaaguuagaaaagacauaccgcaauggcaaccuucgaaaggcuggcacgacuggcagcaaguacccuucuguucacaccauuuucaugaacuaaucaugaaagacgguagaaaauuagucguaccaugucgcccacaggaugaauuaauagggcgugcgaggauuucgcagggcgcuggcugguccuuacgcgagacagccugucugggaaaggcuuaugcacaaaugugggccuuaauguacuuucacagaagagacuuaagguuagcgucaaacgcuauauguagugcagugccuguucauuggguuccaaccagccgcaccacauggucuauacacgcacaccaccaguggaugacgaccgaagauauguuaacaguguggaauagaguuuggauugaggauaauccuuggauggaagacaaaacaccgguuaccacgugggaagauguaccauaccucggaaaacgagaagaucaguggugugguucuuuaauaggcuugacaucaagagcuacuugggcgcagaauauacuaacagccauacagcaaguuaggagcuugauaggaaacgaagaguuccuggauuauaugccuucaaugaaacgauuuagaaaagaagaagaaagugaaggcgcuauaugguaa

SEQ ID NO: 23544 - RNA, 9873 nt, Artificial Sequence
  derived and/or modified CDS sequence (opt6) from DENV-3__JQ920487__SS-prME
acgucuuuauguuugaugaugaugcuaccagcaacacuagcuuuucacuuaacaucacgagacggagaaccaaggaugauaguagguaaaaacgaaaggggcaaaucacuauuguuuaaaacagcgucagggaucaauauguguacccuuauugcuauggaucugggggaaaugugugacgauaccguuacauacaaaugcccacuaauaacggaaguugaaccagaagauaucgauugcugguguaaccugacgagcacaugggugacguauggcacauguaaccaggcaggagaacauagaagggacaaaagaagcguugccuuagcuccacauguugggaugggacuagacaccagaacgcagacuuggaugagugcagagggugcuuggcgucaaguggaaaaaguagaaaccugggcuuuuaggcauccaggauuuacaauuuuagcauuauuucuagcucauuacauagguacgucguuaacacaaaaaguagugauuuucauauuauuaaugcuagugacccccagcaugacuaugcgauguguuggcguuggaaauagggauuuuguugagggucuaaguggagccacauggguggauguaguuuuggaacacggagguugugucacaacuauggcgaaaaacaaaccaacacucgauauagaacuacagaaaaccgaagcaacucaauuggcaacauuaagaaaacugugcauugagggaaaaauaacuaauguuacaacagauucucgcuguccaacccaaggagaagccauucuucccgaagaacaagaucaaaacuacguuugcaaacacacuuauguagaucgaggauggggaaauggcuguggacucuuugggaaaggcagcuuagucacaugugcuaaauuucaaugcuuggaaucgauagaagggaaagcaguacagcaugaaaaccuaaaauauaccguaaucauaacagugcauacgggagaucaacaccaaguugggaaugaaacccaaggugugacagcggagauaacgccucaggccaguaccguggaagccauuuugccggaauacgguacgcuuggacuagaguguucaccaagaacgggucucgauuucaacgaaaugauacuccuuacaaugaaaaacaaagcauggaugguccacaggcagugguucuuugaccuucccuugccuuggacuucaggagcuacuacagaaacgcccacguggaauaagaaagaauuauuagucacauucaaaaaugcacaugccaagaaacaagagguaguaguauugggaagucaggaaggagcuaugcacaccgcucuaacaggagcaacugaaauacaaaccagugguggaacgucaauauuugccgggcauuuaaaaugcagacuuaaaauggauaaacuggagcuaaaagggaugucuuacgcaauguguuugaaugccuuugugcucaagaaagagguaucagagacgcaacauggaacgauacuaauaaaagucgaauacaaaggugaagacgcacccuguaaaauuccuuuuucaacugaggacggacaaggaaaagcgcacaauggacgauugauuacagcaaacccuauaguaacuaaaaaggaagaaccaguaaauauagaggcagaaccuccuuuuggagagucgaauauugucauaggaauaggggauaaagcguuaaaaaucaauugguauaaaaagggcagcaguauagggaagauguucgaagcaacugcuaggggcgcuagacguauggccauacuaggugacacagccugggauuuugggaguguugguggcgugcucaacuccuugggaaaaauggugcaucaaauuuuuggaucggcauauacagcacucuuuuccggaguuaguuggaucaugaagaucgguauuggaguauuacuaaccuggauaggacuaaauagcaaaaacacgucaaugaguuucucaugcauagugauugguauaauaaccuuauaccuaggagcuguuguacaagcugauaugggcuguguaauaaauuggaaagggaaagaauuaaaaugcgguucugggaucuuuguuacaaacgagguacacacauggacugaacaauauaaauuccaagcggauucgcccaaaagacuagcaacagccauugcuggggcaugggagaauggggugugcggcauuaggucuacaacgaggauggaaaauuuauuauggaaacaaauugccaaugaauuaaacuauauucuuugggaaaauaauauaaaauuaacugucguuguaggggauguuauaggcguacucgagcaaggcaaaagaacacuaacaccacaacccauggaacuaaaauauuccuggaaaacuuggggaaaagcaaaaauaguuaccgcugagacucaaaauucuucauuuauuaucgauggaccuaauacaccagaauguccgucagcgucccgggcguggaauguaugggaagucgaggauuacggguuuggaguauuuacgaccaauauauggcuaaaauugagagaaauguauacccaguuaugcgaucauagauuaaugucugcagccguaaaagaugaaagagccgugcaugcagacauggguuauuggauugaaagccagaaaaauggaucauggaaacuagaaaaggcuucccuaauagagguaaaaacaugcaccuggcccaaaucccacacauuguggagcaacggcguauuagaaagugacaugauaauucccaagagucucgcaggacccauaagccaacacaauuaccgaccgggauaccacacgcaaaccgcggggccuuggcaccugggaaaacuugaauuagauuuuaauuacugcgaagguacgacaguugucaucacugaaaacugugguacaagggggccaagucucagaacgacuacgguuucaggaaaguuaauccaugagugguguugcaggaguugcacauuaccaccguugcguuauaugggagaggacgguugcugguauggcauggagauuagaccgauuaacgaaaaggaagagaauaugguuaaaucauuagucucagcaggcucagguaaagcggacaauuuuacuauggggguguuauguuuggcuaucuuauuugaagaaguuaugagaggcaaauucgguaagaaacauaugauugcgggagcauuauucacguuuguacuacuccuguccggucaaaucacguggcgagauauggcacacacccuaauaaugauugguucuaacgccucagauaggauggguauggguguaacauaccuggcgcugauagcaacuuucaagauccaaccguucuuagcacuuggcuucuuucugaggaaacuaacaagccgagaaaaccuauuacuaggcguaggacuagcaauggcuacuacguuacaacuaccggaagacauagagcagauggccaacgguaucgcccuaggauugauggcccuuaaguuaauaacgcaauuugaaacuuaucaauuauggacagcucucgucagccuaauguguucgaacacuaucuuuacacuaacagucgccuggagaacugcaacuuuaauauuggcgguaauauccuuacucccaguaugucaauccucgagcaugagaaagacugacuggcucccgaugacaguggcagcuaugggagucccacccuugccauuguuuauauuuucguuaaaagauacucucaagcggaggaguuggccucuuaacgagggaguuauggcaguuggcuuaguauccauuuuggcaagcucguucuuacguaaugaugucccuauggccggcccuuugguugccggaggacuacuuaucgcaugcuauguuauaaccgguaccucugcugacuuaacaguagaaaaagcagcggacguaacaugggaagaagaggcggaacaaaccggagucagucacaacuuaaugauaacgguagacgacgauggaacgaugcgaauaaaggacgacgagacagaaaauauacucacgguacuuuuaaaaacugcacuguuaauuguaaguggaauauuuccauauagcauaccggcuacucuacucguuuggcacacauggcaaaaacaaacccaaaggucaggcguucuuugggaugugccaagcccgccagaaacgcagaaggccgagcuggaggaaggaguuuaucgaauuaaacaacaaggaauuuucggaaaaacacagguuggagucgguguucaaaaagaaggaguauuccacacaauguggcauguaacgcggggugccguacuuacucauaaugguaaaagacuagaaccuaauugggccaaugucaagaaagaccugauaaguuaugggggaggauggaaauuguccgcacaguggcaaaaaggagaagaaguacaaguaauagcaguagagccuggcaaaaacccgaagaacuuccaaacaaugccaggaauauuucaaacaaccacaggugaaauuggcgcaaucgcacuagauuucaaaccagguacaucagggucacccauaauaaacagagaaggcaagguaguagguuuauauggaaacgguguagugacuaaaaacgggggauauguaaguggaauagcacagacaaaugcagaaccagauggaccaaccccagaauuagaagaagagauguucaagaaaagaaaucucacuauaauggacuuacacccugguucagguaaaacucgaaaguaucugccugcuauaguaagagaagccauaaaacgcagacugcguacacuuauacuagcaccgacacgaguagucgcggcugaaauggaagaagcguuaaaaggauugccuaucagauaucagacuacagccacaaagagugagcacacaggaagagagauuguagauuugaugugucacgcaacauucacaaugaggcuccuaucuccaguccguguaccaaauuacaaucuaaucgugauggacgaggcacauuuuacagacccggcaagcauagcagcucgaggauacauuucuaccagaguaggcaugggugaagcagcagcuauauucaugacagcaacgccaccggguacagcggaugccuuuccccagagcaaugcacccauccaagaugaagagagagacauaccagaaagaucauggaacagcgguaacgaauggauaacagauuucgcgggcaaaaccgucugguuuguaccgucaauaaaggcaggcaaugacauagcaaauugcuugcggaaaaaugguaagaaagugauccagcuuagccgaaaaacauucgauacggaauaucagaaaacgaaauugaacgauugggauuuuguugugacaaccgauaucagugaaaugggcgccaacuucaaagcggacagaguaaucgacccacgccgaugucuuaagccaguaauucuaacggauggaccagagagagucauacuggccggaccaaugccaguaaccguagcaagugcggcucaacgaagaggacgaguagguagaaauccucaaaaagaaaaugaucaauacauuuucacuggacagccucuuaauaacgaugaagaucaugcacauuggacagaagcgaaaaugcuguuagauaacauuaauacacccgaaggaauuauuccagcguuauuugaaccagaaagagagaaaagugccgcuauagacggagaauaucgguuaaaaggagaaagucggaaaacguuuguugaacuuaugagaaggggcgaucuucccguauggcuugcacauaaggucgcuagugaaggaauaaaguacacagaucgaaagugguguuucgacggugaaagaaauaaucaaauauuagaggaaaauauggauguagaaaucuggacgaaagagggcgagaaaaagaaacuccgucccagauggcuagacgcucguacuuauagugaucccuuggccuuaaaagaauuuaaagacuucgccgcaggucgaaaaucaauagcccuugacuuaguaacagaaauagguagagugccuagucaucuugcgcaucggacgaggaacgcccucgacaaccuaguuauguugcauaccagugagcaugggggcagggccuaccggcacgcugucgaggaacuccccgaaacaauggaaacauuacuacugcuaggauugaugauuuuauuaaccggaggagcaauguuguuucuuauuaguggaaagggaaucggaaaaacgucaauuggacugauauguguaguagcuucaucggguaugcuauggauggcagaugugccauuacaauggaucgcuagcgcaaucguacuggaguucuuuaugaugguacuuuuaauaccagaaccggaaaagcaacgaaccccacaagauaaucagcuagcuuauguaguaauagguauauugacucuagcagcuauugucgcagcuaacgaaaugggucuacucgagacaacuaaaagagaucucggaauguccaaggaaccaggaguaguuucaccgaccucauauuuagauguugaccuacauccggcuucugcuuggacacuguacgccguagcuacaacaguaauaacucccauguuaaggcauacaauugaaaacucaacugcgaauguaaguuuagccgcaauagcaaaucaggcaguaguacucaugggauuagacaagggcuggccgauaagcaagauggacuuggguguaccccuacuagcacugggaugcuacucacaaguuaauccgcuuacauuaacugccgccguauuauugcuaguaacccauuacgcaaucauaggucccggucuacaagcaaaggccacccgagaagcucagaagagaacugcagcugguauaaugaagaacccaacuguagaugggauaaugacuaucgauuuggauccggugauauaugauuccaaguucgaaaaacaauuaggacaagucauguuacucguccugugugcaguacaauuauuauugaugcggaccucaugggcauuuugugaagcccuuacauuagcaacugggccaaucacaacacuaugggaaggcaguccagguaaauucuggaauacuacuaucgccguuaguauggcaaacauuuucagaggcagcuaucuggcaggagcaggucuugcauuuucgauuaugaaaagcguuggaaccggcaagcgugggacagggagucaaggugagacucuaggugaaaaguggaagaagaaacuuaaucaacugucaagaaaagaauuugaucuguacaagaaaaguggcauaacugaaguagaccgcacagaagcaaaggaaggacuaaagcggggugaaauaacccaucaugccgugagcagggguagugccaagcuacaaugguuuguggaacggaacaugguaauaccagagggaaggguaauagaucucggaugugggagaggcggauggucauauuauugugcuggacucaagaaagucacagaagucagaggauacacuaaagguggucccggacaugaagaaccaguuccuaugucaaccuaugguuggaauauuguaaaauuaaugucaggaaaggacgucuuuuacuugccaccugaaaaaugcgauacacuauuaugugauaucggagagucaagucccucaccaacgguggaagaaagccggacuauuagaguacugaaaaugguugaaccauggcucaagaacaaucaauuuugcauaaaaguauugaacccauacaugccgacuguuauagaacaucuugaaagauuacaaagaaagcauggcggcauguuagucagaaauccguugucaaggaauaguacgcacgaaauguacuggauaaguaacggcaccggaaauauaguguccaguguuaacaugguuucucgauuacuacucaauagauucaccaugacacauagaaggccaacaauugagaaggacguagaccucggagcugguacuaggcauguuaaugcugaaccagaaacacccaauauggacgucaucggugaacguauccgccgaauaaaagaggaacauaguucaacauggcacuaugaugacgaaaauccauauaaaaccugggcauaccaugguucauaugaggugaaggcgacaggaucggcaucaucaaugauaaacgggguagucaaauugcucacaaaacccugggacguugucccgauggucacacaaauggcaaugacagauacaacgccuuucggacaacagcgaguauuuaaggaaaaaguugacaccaggacgccgcguccgaugccuggaacaagaaaaguuauggaaauuacggcagaaugguuauggagaacauugggaagaaauaagagacccagauuauguacccgagaagaauuuauaaagaaagugcgaaccaacgcggcaaugggcgcgguguuuacagaagaaaaccaaugggacagugcucgugcugcagucgaagaugaagaauuuuggaaauuaguggauagggaacgugaacuacauaaauuaggaaaaugugggaguugugucuauaauaugaugggcaagcgagaaaagaaacuaggagaguucggcaaagcaaaaggaaguagagcaauaugguauauguggcucggagcuagauacuuagaguucgaggcacucggauuuuuaaacgaggaucauugguucucaagggagaacagccacuccgguguugagggggaggggcuacacaaauuggguuauauauuacgcgauauaaguaaaauacccggaggugcuauguacgcagacgauaccgcggguugggacaccagaauaacagaagaugaucuacauaacgaagagaaaauuacgcaacaaauggacccugaacaucgacagcuagcaaacgcaaucuuuaaguuaacauaucaaaacaagguuguaaaaguacaacgaccuacgccaaaaggcacggugauggacauaauaucacgaaaagaccaaagaggaagcggacaagucgguacauaugggcuaaauacauucaccaauauggaagcacagcuaauacgacaaauggaaggagaaggggucuuaucuaaagcagaccuagagaauccacauuuacucgagaagaagguuacacaauggcucgaaacaaaaggaguagaacgucuaaaaagaauggcgauuucuggagaugacuguguaguuaaacccauugaugauagauuugcaaaugcacuguuagcucuuaaugacauggguaaaguaaggaaagacauuccccaauggcaaccguccaaaggauggcaugauuggcaacaaguaccguucugcagucaccauuuucacgaacuuauaaugaaagaugggaggaagcuagugguuccauguagaccucaagacgaauuaauaggaagggcaaggauaucccagggagcaggauggucucuaagagaaacagcuuguuugggaaaggcuuacgcacaaaugugggcacugauguacuuucauaggagagaucugcgacuggccucaaacgcuaucuguucagccguaccaguacauuggguuccuacaagucggacaacauggaguauacaugcacaucaccaguggaugaccaccgaagacaugcuuacuguauggaacagagucuggaucgaggauaacccuuggauggaagauaaaaccccaguaacuaccugggaagauguaccauaucuagguaaacgugaagaucaaugguguggaucucugauuggccugacuucuagagcaacgugggcccaaaauaucuugacggcuauucagcaaguaagaagucugauagguaacgaggaauuuuuagauuauaugccaaguaugaagcgguuuaggaaagaagaggaaagcgaaggagcaauuugguga

SEQ ID NO: 23545 - RNA, 9873 nt, Artificial Sequence
  derived and/or modified CDS sequence (opt6) from DENV-3__JQ920488__SS-prME
accucauugugucuaaugaugaugcugccagcuacucuagccuuucaucuaacaucacgugacggagaaccacgaaugauaguaggcaaaaaugaaagagguaaaaguuuauuauuuaaaacagcaucaggaauuaauaugugcacauuaaucgcaauggaccucggagaaaugugcgacgacacaguaacuuauaaaugcccacuaauaacggaagucgaaccagaagacauagauugcugguguaacuuaacgucaacguggguuacauauggaacaugcaaucaagcuggagaacauagacgagauaaacgaucaguagcacuugcaccucauguggguaugggacucgacacaagaacacaaacuuggaugucagcagaaggagcuuggcgccaaguugaaaaaguugaaacgugggccuuuagacaucccggauuuacuauuuuagcuuuauuccuggcucacuauauugguacaucacugacccaaaaagugguuauauucauucuccugaugcuaguaacaccgucaaugacaaugcgauguguagguguggguaaccgcgacuuugucgaagguuugaguggagccaccuggguagauguaguucucgaacauggaggaugcguaacuacaauggcgaaaaacaaacccacacuagacauagaauuacagaaaacagaagcuacacaacuagcaacauuaagaaaacuuugcauagagggaaaaaucacgaauguaaccacggauucucguugcccaacacaaggggaggcaaucuuaccugaagaacaagaucaaaacuacguguguaaacauacguacguagaucggggauggggaaacggcugcggucucuucgguaaagguucuuuaguaacaugcgcaaaauuucaaugccuggaaucuauugaaggaaaagcuguacaacacgaaaaucuaaaauacacuguaauuaucacuguacauacaggugaucaacaucaaguagguaacgagacacaaggcguaacugcugagauuacuccgcaagcaucaacaguagaagccauacuaccugaauacggaacacugggcuuggaaugcagcccacgaaccggacuagauuuuaacgaaaugauucugcucaccaugaaaaacaaagccuggaugguacaccggcaaugguucuuugaucuacccuuacccuggacaaguggcgccacgacagaaacgccaacuuggaauaagaaagaacuauuaguuacauucaaaaaugcucacgcaaagaaacaggaagucguaguauuggggagccaagaaggugcaaugcacacugcacuuacgggcgccacagaaauacagaccucuggaggcacuucuauuuuugcuggucacuuaaaaugccgguuaaaaauggacaaacuugaacuaaaagguauguccuaugccaugugccuuaaugcguucguacuuaagaaagaaguaagugaaacccagcauggaaccauucuaaucaaaguagaauacaaaggagaagaugcccccugcaaaaucccauuuaguacagaggacggacaaggaaaagcucauaauggaagauuaauaacagccaauccaauuguaacuaagaaagaagaaccagucaacaucgaggccgaaccaccauucggugaaaguaacauugucauaggaauaggggacaaagcccuaaaaauuaauugguauaagaaaggaucaucaaucgguaaaauguuugaggccacagcgcggggugcaagacgaauggcaauauuaggugauacugcaugggauuuuggauccguaggcgggguauuaaacagccuaggcaaaaugguccaucaaauuuucggaagugccuacacagcccuuuuuaguggggucucauggauuaugaaaauuggcauagguguuuuacuaaccuggaucggguuaaauagcaaaaacacaagcaugaguuuuuccuguaucguaaucggcauaauuaccuuguaucucggugcaguaguucaagcagacaugggauguguaaucaacuggaaagggaaagagcuuaaaugugguagugguauuuuugucacaaacgagguacauacuuggacagaacaauauaaauuucaagcugacucaccaaaacgauuagcuaccgccauagcaggggccugggaaaauggaguaugcggaauaagaagcacaacacguauggagaaccuguuauggaaacagauagcuaaugaauugaauuauauacugugggagaauaacauuaaacucaccauaguggugggugacguaauuggaguccuggaacaagguaaaagaacauuaacuccucaaccgauggaacuuaaauauucauggaagacuugggguaaagcaaaaauaguaacggcugaaacacaaaacaguaguuucauaauagaugggcccaacacgccugagugcccaucagcacuacgcgcauggaacguuugggaaguugaagauuacgguuuuggaguuuuuacuacaaauauuugguuaaaguugcgugagaaguacacucaauuaugugaccaccgcuuaaugucggcagcugugaaggacgagcgcgccguccacgcagacaugggauauuggauagaaucucagaaaaacgaaaguuggaaacuagaaaaagccucacuaaucgaagucaaaacaugcaccuggccaaagagucacacacuguggaguaacgguguacuugaaagugacaugauaauaccaaagucacucgcagggccuauaucacaacacaacuacagaccuggauaccacacucaaacagccggaccauggcaccuagggaaauuggaauuggauuuuaacuacugugaagguacaacaguaguuauuacagagaacugugguauccguggcccaucacuacgcacgacaacaguaucgggaaaacuuauccaugaaugguguugccgaaguugcacgcuuccgccauuacgcuauaugggagaggauggaugcugguauggaauggaaauccgaccaaucaacgagaaggaagaaaacaugguuaaaucauuagugagugcaggaagugguaaaacagacaauuuuacuauggguguacuuugucuagcaauacuauucgaagaaguaaugcgagguaaauuugguaagaaacauaugaucgccggcgcuuuguuuacauucgucuuacuacuaagcggccaaauaacguggagagauauggcacacaccuuaauuaugauagggucaaaugccucagaucgcauggguaugggagugacauaccuggcacuaauugccacauucaaaauacaacccuucuuagcccuaggcuucuuuuugagaaaacuaaccucuagagaaaauuugcuacuaggaguugguuuagcgauggcgaccaccuugcaacuuccagaagauauagaacaaauggccaaugguauugccuuaggacuaauggcauugaaauuaauaacccaauuugagacauaccaguuauggacugcucucauaucgcuuauguguucgaauacuauauuuacccuaacaguugcauggagaacagcuacguuaauuuuagcgguaaucucgcuauugccagucugucaaaguuccucgaugcggaaaacugacuggcucccuaugaccguggcagcaauggggguuccuccucuaccacuuuucauauucucacuaaaagacacguuaaaaagacggucauggccgcuaaaugaaggggucauggcgguagggcucguguccauuuuggcuucuucguuucuuagaaacgacgugccgauggcgggcccauuaguugcuggugggcucuuaauugcuuguuaugucauaacaggaacuucagcagaucuuacaguugaaaaagccgcugacgugacaugggaagaagaagcagagcaaacagggguuagucacaaucucaugauaacaguagacgacgacgguacaaugcgaauuaaggacgaugaaacugaaaacauuuugacaguacuccuaaaaaccgcguuauuaauugucagugguauauucccuuauuccauuccugcgacauuacuggucuggcauacguggcaaaaacaaacccaaagauccggugugcuaugggacgugccuagcccuccugaaacgcaaaaggcagaauuagaagaaggcguguaucguauaaaacagcaagggauuuucggaaaaacgcaaguagguguuggggugcagaaagaagguguuuuccauacaauguggcauguaacaagaggcgccguauugacgcacaauggaaaacgucuggaaccaaauugggcaaacguuaagaaagaucuaauuucauacggaggggguuggaaacucggggcccaauggcaaaaaggagaagaagugcaaguuauagccgucgagccaggcaaaaauccgaaaaacuuucaaaccaugccggguauauuucaaacuaccacuggugaaaucggcgcaauugcuuuagauuuuaaaccaggaacaagcgguaguccuauuauaaacagggaaggcaagguuguugguuuauaugggaacggcguugucacuaaaaacgggggcuaugucucuggaaucgcacagacuaaugccgagcccgacgggccaacuccggaguuggaagaggagauguucaaaaagcggaacuugacaauaauggacuuacacccagggucagggaaaacgagaaaauaccuuccagcuaucguuagagaagcgauuaaacgacgacucaggacacuaauuuuggcgcccacacgagucguagcagcagaaauggaagaagcccuaaaaggacuaccuauacgcuaucagacaacugcgacuaagucagaacauacgggcagagaaauaguagacuuaaugugccaugccacguuuacuaugagacuguugaguccaguuaggguacccaauuacaacuuaauagugauggaugaagcucacuucacugacccugccuccauugcagccagagguuauauaagcacaaggguugguaugggagaggcugcugcaauuuucaugacggcgaccccuccugguacugcugaugcauucccccaaagcaaugccccgauacaagaugaagaacgugacauaccagaacgaucguggaacuccgguaaugaauggauaacugauuuugcugggaagaccgugugguucguuccgucaaucaaagcugguaaugauauugcaaacugccucaggaaaaacggcaagaaaguaauucaacucucaagaaagacuuucgauaccgaauaccagaaaacaaaguuaaaugacugggauuuugucguuacaacggauauaagugaaaugggagcuaauuucaaagcggacaggguuauagauccuagaagguguuuaaagccaguaauauuaacagauggccccgaacgcgucauauuagcuggaccuaugccugucacaguagcaucggcugcccaaagaagaggaagagucgguagaaacagccagaaagaaaaugaucaauauauauuuaccggucagccucuuaauaaugaugaagaucacgcacauuggacagaagcuaaaauguuacuugauaacauaaauacgccugaggguauaaucccagcccucuucgaacccgaacgagagaaaagugccgccauagauggggaauauagacugaagggugaaagccguaagacuuuuguagaacuuaugcgccgaggagacuugccgguguggcucgcacauaaaguugcuagugaagguauuaaauauacugaccguaagugguguuucgauggagaaagaaacaaccaaauuuuggaagaaaacauggauguugagauuuggacuaaagaaggcgagaagaagaaauuacguccaagauggcuagaugcuagaacauauagugacccacuggcucuuaaagaauuuaaagacuucgcugcaggcaggaaaucuaucgcgcuugaucucguuacagagauaggaagaguacccucacaucuugcccaucgaacuagaaaugcucuagauaauuuaguaaugcuacauacaucugaacacgggggcagagcauaucgacaugcaguugaagaacugccagagacgauggaaacauuacuucuauuagggcucaugauacuauuaacaggaggggcgaugcuauuuuuaauaucaggaaaaggaauagguaagacaucuauaggauuaauuugcguaguggcaagcucagggaugcucuggauggcagauguuccccuacaauggauugcaagugcuauagucuuagaguuuuucaugaugguucuccuuaucccugagccugaaaaacagcggacaccucaagauaaccaacuugcuuaugucgugauaggcauauuaacccuagcggcaauaguagccgcaaacgaaaugggguuacuggaaaccacaaaacgugaucugggaauguccaaagaaccuggagucguaucuccaaccaguuauuuagauguagaccuacacccagcauccgcauggacauuauaugcgguagcaacuacagugauuacuccaaugcugagacacacaauagaaaauagcacagcuaaugugucauuagcugcaaucgcaaaucaagcuguaguguuaaugggguuagacaaagguuggccaauuaguaaaauggaccucgguguaccuuuguuggcuuuagguugcuauagucaggucaacccguuaacacuaacugcugcaguccucuugcuaguuacccauuacgcuauaauagguccugguuuacaagcuaaggcgacaagagaagcacagaaacgcaccgccgcaggaaucaugaagaauccaacuguggauggaauaaugacgauugaccuagauccaguaauuuacgauagcaaauuugaaaaacaguugggucaaguuauguuauugguuuugugcgcgguccagcuacuuuuaaugcgcacaaguugggcuuucugugaggcuuuaacuuuagcgacaggaccaauuacuacacuuugggagggcucgccgggaaaauuuuggaacacuaccauugccgucucaauggcaaauauauuuagaggaucuuaccuggcaggagcagggcuggcauucucaauuaugaaaucuguugggacaggcaaacguggcacagguucucaaggagaaacguuaggcgagaaguggaagaagaaauugaaucaacuaucucgaaaggaguucgacuuauacaagaaguccgggauaacugaaguagaccgcacagaagcaaaagaagguuugaaaagaggcgaaauuacacaucaugcaguaagccgaggguccgcgaaacuucaaugguucgucgagcgaaauaugguuauccccgaaggaagaguaaucgaucuggguuguggcagaggaggcuggucauauuauugcgcuggacucaagaaaguaacagaggucagaggcuauaccaaaggagggccgggucaugaagaaccuguccccaugucgaccuauggcuggaauaucguuaaauugaugagugggaaagaugucuuuuauuuaccgccggagaaaugugacaccuuauugugugauauaggugagagcucuccaaguccaaccguugaagaaaguaggacgauaagaguauuaaaaaugguagaacccugguuaaagaacaaccaguuuuguauuaaagugcuuaacccuuauaugcccacgguuauagaacaccuggagcggcuucagcguaagcacggugggaugcuuguuagaaauccauuguccagaaacucuacgcaugagauguauuggaucagcaacggaacugguaauauagucuccaguguuaacaugguaucacgauuacuguuaaauagguuuacaaugacacauagaagaccaacgauagagaaggacguugaccuuggagccggaacacgacacguuaaugccgagccagagacaccuaacauggauguaauaggugaaagaauuagacguauaaaagaagaacauucuagcacauggcacuacgaugaugaaaacccuuauaagacaugggcauaccacggaaguuaugagguaaaggcgaccgguucagcuucauccaugauaaacgguguaguuaaguuacuuacaaaacccugggacguaguacccaugguaacucaaauggcaaugacagauacaacgccauuuggucagcaacgaguguuuaaagaaaaagucgacacaaggacaccuagaccuaugccuggaacgagaaaaguuauggaaauuacagcagaaugguuguggcgaacuuuaggacguaauaagcgacccagacuguguaccagggaagaguucauuaaaaagguuagaacuaaugcggcaaugggugcuguuuucacggaagagaaucagugggauucagcucgagcagcuguugaggacgaagaauuuuggaagcuaguggaccgcgaaagagaauuacacaaauuagguaagugcgguucaugcguuuacaacaugaugggaaaaagggagaagaaacuaggagaauuugguaaggcgaaagguucacgcgcuauuugguauaugugguuaggagcaagauaucucgaauuugaggcacuagguuuucugaaugaagaccacugguucagucgagaaaauagccauuccgggguugaaggagaaggguuacacaaacugggguacauacuuagggauauuucuaaaauaccagguggagccauguaugcagaugacacagcuggcugggacacaaggaucacugaagaugacuuacauaaugaagagaaaauaacucagcaaauggacccggaacacagacaacuugcaaacgcaauauuuaaacuaacguaccagaauaaaguagucaaggugcaaaggccgacaccuaaaggcaccguuauggacauaauaagcagaaaagaccagagggguucaggacaaguagguacguauggucuuaauacguuuacaaauauggaagcccaacuaauacgacaaauggagggugaagggguccucaguaaggcagaccuagaaaauccgcaccuacuagagaagaaagucacccaaugguuggaaacaaaaggcguagagagguuaaagcguauggcaauaaguggcgaugauuguguuguaaaacccaucgaugacagauucgcuaaugcauuauuggccuuaaacgauauggggaagguacgaaaagauauuccccaauggcaacccucaaaaggguggcacgauuggcaacaaguacccuucugcucucaccauuuccacgaauugauuaugaaagacggacgaaaauuggugguaccguguaggccacaagaugaauuaauaggaagggcuaggauuucucaaggggccgguuggucacugagagaaacugcaugccuuggaaaggccuacgcucaaaugugggcucuaauguacuuccaccggagagauuuaagacuugccucuaacgcaauuuguagcgcaguaccaguucacuggguaccaacaucaagaacgacuuggaguauacaugcccaccaucaauggaugacaacugaagacaugcucacuguuuggaauagaguuuggaucgaagacaacccuuggauggaagacaaaacaccggugacaacaugggaagacgucccauacuugggaaagcgggaggaucaauggugcggcucauugauuggauuaacuagcagagcaacgugggcacaaaacauccuaacagccauccaacagguacggaguuuaauaggcaaugaagaauuuuuagacuauaugccguccaugaaaagauuuagaaaagaagaagaguccgaaggagcuauaugguaa

SEQ ID NO: 23546 - RNA, 9873 nt, Artificial Sequence
  derived and/or modified CDS sequence (opt6) from DENV-3__JQ920489__SS-prME
acuucucugugcuuaaugaugaugcucccagcaacauuagcauuccauuuaacaagccgagauggggaaccgcgaaugauuguagguaaaaacgaacgcgguaaaagucuauuauuuaaaacagcaucagggauuaauaugugcacuuugauugccauggauuuaggagaaaugugcgacgauacgguaacguauaaaugccccuuaaucacggaaguugaaccagaagauauugauuguugguguaaccuuacgucaacauggguaaccuacgggacguguaaucaagcuggugaacaucgaagagauaaaagaucuguugcacuagcaccucauguagguaugggacuugauaccagaacacaaacauggaugagugcagaaggagcauggagacaaguagaaaaaguagaaacuugggcuuuuagacacccaggauuuacaauauuggcguuguuccuugcucacuauauuggaaccagucuaacucaaaaagucgucauauucaucuugcucaugcugguuacacccagcaugacaaugagauguguaggaguggguaaucgcgauuuugucgaagguuugucgggagcuacauggguagaugucguuuuagaacacggagggugugucaccacuauggccaaaaacaaaccaacuuuagacauagaacugcagaaaacagaagccacgcaauuagcuacucuacgaaaacuauguauagaaggcaaaauuacaaacauuacuaccgacucccgaugcccaacacaaggagaagcuauccuaccugaagaacaagaccaaaauuaugugugcaaacacacauacguagaucgggguuggggaaauggaugugggcuuuucggaaaaggaucgcuugucacgugugcuaaauuucaaugccuagaaaguauagaagggaaagcaguacaacacgaaaacuugaaauauacaguaauuauaacagugcauacaggcgaucaacaccaaguaggcaaugaaacgcaagguguuacagccgaaauaacaccacaagcaucgacugucgaagcgauuuuaccugaauacggaaccuuaggauuagaauguucuccacguacgggauuagauuuuaaugaaaugauacuucuuacuaugaaaaacaaagcauggaugguccauaggcaaugguucuuugaucucccauugccauggacaagcggagcgacaacagaaacaccgacuuggaacaagaaagaacuguuagugacauuuaaaaaugcucacgccaagaaacaagagguaguggucuuaggcagccaggaaggugcaaugcacacagcgcuuacuggugcaaccgagauacaaacuucuggaggaacaucaauauucgcaggacauuugaaaugccggcuuaaaauggacaaacuugaacuaaaaggaaugaguuacgcgauguguuuaaaugccuuuguacucaagaaagagguuucagaaacacaacacggaacaauacuaauaaaaguagaguauaaaggggaagaugccccguguaaaaucccuuucaguaccgaagauggccaggguaaagcacacaacgggcguuuaauaacggcaaacccuauaguaaccaagaaagaggagccuguaaauauagaggccgaaccuccauuuggcgaaucuaauauugugauaggaauaggagauaaagcauuaaaaauaaauugguacaagaaggguaguucaauaggaaagauguuugaagcgacugcuagaggcgcacguaggauggcgauucuaggugacaccgcaugggacuucgggucaguaggaggaguuuuaaacucacuagguaaaaugguucaccaaauauucggaucagcauacacagcucucuuuucuggugugucguggauuaugaaaauugguauuggcgugcuucuaaccuggauuggucuaaauucgaaaaauaccucaaugaguuucucgugcauaguuauagggauaauuacacuauaucuaggugcgguggugcaagcagauauggggugugucauaaauuggaaagggaaagaacuuaaauguggaucugggauauuuguaaccaacgaagugcauaccuggacagaacaauauaaauuccaagcagacagucccaagcgacuagcgaccgcaauugcuggugcuugggaaaauggaguuugcgguauacgcagcacaacccgcauggaaaaucuucuuuggaaacagauagcaaaugaacuaaauuacauacuaugggagaacaauauaaaauuaacaaucguaguuggagacguaauagguguucuggaacaaggcaaaagaacucucaccccacaaccaauggaacuaaaauacucauggaaaacuuggggaaaagcaaaaaucguaacagcagaaacacaaaauuccucguuuauaauagacgggccaaauacaccagaaugucccucggcaucaagagcauggaauguuugggaaguagaagauuacgguuuugguguuuucaccacuaauauauggcuuaaauugagagagaaguacacucaauuaugugaucauagauuaaugagugcugccgucaaggacgaaagggccgugcacgcagauaugggauauuggauagaaucucagaaaaacgguucuuggaaauuagaaaaggccucauuaauagaagugaagacuuguacguggccgaaaagccacacacucuggaguaaugguguucuugagucagauaugauaauaccaaaaucauuagcagguccaauaucgcagcauaauuauagaccuggauaccauacacaaacagccgggccauggcaucuaggaaaguuagaauuagauuuuaauuauugugaagggacuacaguagucauuacggaaaauugugggaucagaggcccaucguuacggacgacaacaguaagcggcaaacuaauacacgagugguguugucgaaguugcacauuaccaccccuucgguacaugggagaggaugguugcugguaugggauggagauccggccaauuaacgaaaaagaggaaaauaugguaaaaucauugguaagcgcagggucagggaaaacugacaauuuuaccaugggaguuuugugucuggcaauucuguuugaagaggugaugcggggaaaauucgguaagaaacauaugauagcaggagcauuauucaccuuuguauuauuacucagcggacaaauaacauggcgcgauauggcccacacucuaauaaugauuggauccaacgcaucagaucggauggguaugggggugacauacuuagcacuaauugcuacuuuuaaaauucaaccguucuuggcucuaggguucuucuuacggaaacucacaucgagagaaaaucucuugcuaggagugggucuggcaauggcaacaacgcuucaacuaccggaggacaucgaacagauggcuaacgggaucgcauuagggcucauggcguuaaaauuaauuacacaguucgaaaccuaucaguuauggacugcccucauuagucuaaugugcucaaacacaauuuuuaccuuaacagucgcguggcggacagcgacacugauucuagcuguuaucagcuugcugcccgugugucaaagcucaucaaugaggaaaacagacuggcuaccaaugacuguagcugcgaugggaguuccgccauuaccauuguuuaucuucagucuaaaagacacgcugaaacgccgaaguuggccauuaaacgaaggcgucauggccgucgguuuagugagcauacuagcuucuuccuuuuugaggaaugacguaccaauggcggggccacugguugcgggcggucuacucauugccuguuauguuaucacaggaaccucggcagaucuaacuguagaaaaagccgccgacgugacaugggaagaagaagcugagcaaacuggugugucucacaaucuuaugauaacaguagacgacgauggaacuaugagaauuaaagacgaugaaacggaaaacauacuaacaguucuacucaaaacagcauuguuaauaguaagugguauuuucccauauaguauuccagcaacacuuuugguuuggcauacguggcaaaagcagacacaaaggagcgggguacuaugggauguaccuaguccgccagagacacaaaaggcagaauuggaagaaggcguguaucgcauuaaacaacaggguaucuuugggaaaacacagguggguguaggcguccaaaaggaaggugucuuccauacgauguggcacgucacgagaggggcuguacuuacacauaacgguaaacggcuagaaccuaacugggcuaaugucaagaaagauuuaaucaguuauggcgguggauggaaauugagcgcccaauggcaaaaaggagaagagguacaagugauagcaguggaaccggggaaaaaucccaaaaauuuucaaacuaugccaggaauauuucaaacuacaaccggugaaauaggagccauugcauuagauuucaagccuggaacauccggaucaccaauuauaaauagagaaggaaaaguaguaggauuguauggaaauggaguagucacaaagaacgguggauacguuucaggcauugcgcaaacaaaugcugagcccgauggaccaacucccgagcuagaagaagaaauguuuaaaaagagaaauuuaacaauaauggaucuacauccaggaagcgguaaaacuagaaaauaucuuccagcgaucgugagggaggccauuaaacgccgguuacgaacucucauuuuggcacccacaagaguagucgccgcugagauggaagaagcgcuaaagggacuuccgauacgguaccaaacgacugcaacaaaaagcgaacacacugggagagaaauaguggacuugaugugucacgcaacguucacaaugaggcuuuuaucaccaguucguguaccaaacuauaaccuuauaguaauggaugaagcucacuucacagacccagccuccauagccgcuaggggauauauauccacgagaguaggcaugggagaagccgcagcaauauuuaugacagcgacuccaccugguacugcagacgcuuuuccacagaguaacgcaccaauucaagacgaagaacgggauauacccgaacggucauggaauaguggaaaugaauggauaacagauuucgcaggaaagacugugugguuuguacccuccauaaaagcgggaaaugauaucgcaaauugcuuacguaaaaacgguaagaaagugauccagcuaagucgaaaaacauucgacacggaauaucaaaagacaaaauuaaacgacugggacuuuguaguaaccacggacauuagugaaaugggcgcuaacuucaaagccgauaggguaauugaucccagaagaugucucaagccugugauauugacggauggaccagaaagaguaauauuagcaggccccaugccagugacuguagcgagugccgcgcaaagaagaggacgugugggacgcaauucacaaaaagagaaugaccaauauauauucacgggacaaccccucaauaacgaugaggaucaugcacacuggacugaagccaaaaugcuacucgauaauauuaacacacccgaaggaauuaucccagcuuuauuugaaccggaacgugagaaaagugcagcaauagauggcgaauauagacuuaaaggugaaucuaggaaaaccuucguagaacucaugagaaggggagauuuaccaguauggcucgcacauaaaguggcaucggaagguauaaaguacacugaccgaaaauggugcuuugauggugaacgaaauaaccaaauuuuagaagagaauauggacguagaaauauggacgagagaaggagagaagaagaaacuacgacccagauggcucgacgcuagaacauauagugacccucuagcuuuaaaagaauuuaaagauuuugcagcuggaagaaaaucaaucgcauuagaucuugucacugaaauuggccgaguuccuucacauuuagcacaccgcacgaggaaugcauuggauaacuuaguaaugcugcacacaucggaacacggcggacgagcuuauagacaugcuguggaggaauuacccgaaacgauggaaaccuuacuauuguugggguuaaugaucuuacuaacagguggagcaauguuauucuugauaaguggaaaagguauuggaaaaacuucaauaggacugauuugcguuguugcuagcaguggaaugcuauggauggcugaugucccgcuacaauggauagcuucagcaauaguccuugaguucuucaugaugguauuacuuauuccagaacccgaaaaacagaggacaccacaagauaaucaacucgcauaugucguaauaggcauucuaacauuagcugcaaucguagcagcaaaugagaugggauuauuagagaccacaaaaagagaucuugguaugaguaaagaaccaggaguuguaagcccuacaucguauuuagauguugaccuacacccagcaagugccuggacccuuuaugcgguagcaacuacaguuauaacgcccaugcuuagacauaccauugagaauaguacggcaaacgucagccucgcagcaauagcuaaucaagcagugguuuuaauggggcuugacaagggguggcccauuuccaaaauggaccuagggguaccacucuuggcucuuggauguuauucacagguaaauccacuuacccuaacggcggccguauuauuauuagucacccauuacgcuauaauaggacccgggcuucaagcgaaagcaacuagggaagcccagaaaaggacagcagccggcauuaugaaaaauccaaccguagauggaauuaugacaauagaccuagauccggucauauacgauaguaaauuugaaaaacaacuaggucaaguaaugcuucuuguacuaugugcaguacaauuacuacugaugaggacuucgugggcuuucugugaagcguuaacccuugcuacaggaccaauaacaaccuuaugggagggaucaccaggaaaauuuuggaauacaacuauagcagugucuauggcuaacauauuccgugguaguuacuuggcgggagccggucuugcuuucuccauaaugaagagugucggcacugguaaaagggguaccgguucucaaggagagacauugggcgaaaaauggaagaagaaacuuaaccagcugagucgaaaagaguucgauuuauacaagaaaagcgggauaacagaaguagaccggauugaggcaaaagagggauuaaaaagaggagaaauaacccaucaugcugucucuagaggcucagccaagcugcaaugguucguugagcguaauaugguaauuccugaaggaagaguaaucgaccugggaugcggacguggaggguggucauacuauugcgcaggccugaagaagguuacagaaguucgcggcuauacaaaaggugggccagggcacgaagaaccuguuccuaugucgacauacggauggaacaucguaaaacucaugucugguaaggauguuuucuaucucccuccugaaaaaugugacacacuauuaugugauauuggugaaagcaguccaucgccuacgguggaagaaucuagaacgauaaggguacuaaaaaugguggaaccauggcucaaaaacaaucaguuuugcauaaagguuuuaaauccauauaugccuacaguaaucgagcaucuagagcggcuccaaagaaaacacgguggcaugcuuguaagaaauccgcuaucuagaaauagcacacacgaaauguacuggauaucuaauggcacaggcaacaucgucucuucaguuaauaugguaucucggcuauuacuaaacagauuuacaaugacucauagacguccgacaauagagaaagauguagacuuaggugcugguacacggcaugugaaugccgagccagaaacaccaaacaugaacgugaucggcgaaagaauuagacgaaucaaagaggaacauagcagcaccuggcacuacgaugacgaaaaccccuauaaaacaugggccuaucauggauccuacgaagucaaagccacugguucagccucuucaaugauaaaugguguuguuaaacuacuaacuaagccaugggacgucgugccuaugguaacgcaaauggcaaugaccgacacuacaccauuuggacaacagagaguauuuaaagaaaaaguagauacacgaaccccgcgaccgaugccugguacacgaaaaguaauggaaauaacggcugagugguuguggagaacauuggggcggaauaagcggccaagacuuuguacgcgggaagaguuuauaaagaaaguccggacaaaugcugcaaugggggcaguauuuaccgaagaaaaccaaugggacucggcaagagcagccguugaggacgaggaguuuuggaaauugguagaccgagaacgagaacuucauaaauugggaaaaugugguucuugcgucuacaauaugaugggaaaaagggagaagaaauuaggagaauuuggaaaagcaaaaggaaguagagcuauaugguauaugugguugggagcacguuaccucgaguuugaggcuuuggguuuccuaaaugaagaccauugguuuaguagagaaaauucacacagcggggucgaaggagaaggauugcacaaguuaggguauauccuuagagacaucagcaaaauaccaggcggcgcaauguaugcugaugauacugcuggcugggauacacgaaucaccgaagaugaucuucauaacgaggagaaaauaacacagcaaauggacccugagcauagacaauuagcuaacgcuauuuucaaauuaacuuaccaaaauaaagucguaaaagugcagagaccaaccccuaagggcaccguuauggauauaaucucgcggaaagaucaaagggguaguggacaaguaggaacauauggauugaauaccuuuacuaacauggaagcccagcuaauuagacagauggaaggugaagguguacucucaaaggcugauuuagaaaacccgcauuuacuagagaagaaagugacgcagugguuggaaacaaaaggaguugaaagguuaaaacgcauggcgauaucgggugaugauugugugguuaaaccgauagaugaccguuucgcaaacgcuuuacuagcauuaaacgauauggguaaagugagaaaagauauaccacaauggcaacccuccaagggauggcaugacuggcagcaaguaccuuucugcucucaucacuuucacgaacuaauaaugaaagacgguagaaaauugguagucccuugucgaccacaggacgaacucauagguagagcuaggauaagccaaggugcggguuggucccuacgggaaacugccugucuagguaaagcguacgcucagaugugggcauugauguacuuccaucgacgugaucuuaggcuugcuucaaaugccauuugcagugcggugccgguccacuggguuccgacaagucgcacuacguggucgauccaugcccaucaccaauggaugacaacugaagauaugcuaacaguguggaacagaguauggaucgaagacaauccuuggauggaagacaagacacccguaacgacuugggaggauguucccuacuuagggaaaagggaagaccaaugguguggaaguuuaauaggucugacaagucgugcgacuugggcacagaauaucuuaacugccauucaacaaguuagaucacuuauuggcaacgaagaguuccuagauuacaugccgagcaugaagagauuuagaaaagaagaagaaucggaaggagcuaucugguaa

SEQ ID NO: 23547 - RNA, 9873 nt, Artificial Sequence
  derived and/or modified CDS sequence (opt6) from DENV-3__KF824902__SS-prME
acaucccuauguuuaaugaugaugcuaccugcaacauuagcuuuccacuugaccagcagggauggagaaccacguaugauaguuggcaaaaaugaacgaggaaaaaguuuacuauuuaaaacugcaucuggaauuaacaugugcacauuaauugcaauggacuuaggggaaaugugugaugauaccguuacauauaaauguccacuaauagcagaaguugaacccgaagauaucgacuguugguguaauuugacgagcacuugggucacguauggaacaugcaaucaagcgggugaacaccgaagagacaaacgaucuguggcguuagcgccucauguuggcaugggauuagacacgcgaacgcaaacguggauguccgcagaaggggcauggagacagguagaaaaaguugaaaccugggcauuacgucacccugguuuuacuauauuagcucuauuucuagcgcacuauauuggcacaucauuaacacaaaaagugguaauuuuuauauuauuaaugcugguaacaccuaguauggcuaugcguugugucgggguaggaaacagagauuucguggaaggacuaaguggcgcaaccuggguagacgugguacuagaacacggaggcugcguaacuaccauggcuaaaaacaaacccacccuagacauagaacuccagaaaaccgaggcaacacaauuagcaacguugcggaaacuauguauagagggcaaaauaacuaauauaaccaccgauagcagauguccaacucagggagaagcuauuuugccagaggaacaagaucaaaauuaugucugcaaacauacuuauguagaucgcggcuggggcaaugguuguggucuauuuggaaaaggaucacucguaacaugugccaaauuucaaugccuagagucaauugaagguaaaguaguacaacacgaaaauuuaaaauauacggugacaauaacaguacacacaggagaccagcaucaagugggcaacgacacccaagguguuaccgcagaaauuacuccucaggccaguacaguagaagcuauacugccggaauaugguacacuuggacuagaaugcucuccgagaacuggauuagauuucaacgaaaugauauuguuaacaaugaaaaauaaagccuggaugguucaucggcaaugguucuuugauuuaccccucccguggaccucuggugcgacuacagagacgccuaccuggaauagaaaagaguuacuuguaacauuuaaaaacgcucaugccaagaaacaagaagugguugugcuaggaucucaggagggggccaugcauacagcccucacgggagcuacagaaauccaaaacuccggaggcacguccauauuugcuggacaccuaaaaugcaggcuaaaaauggauaaauuagaguuaaaaggaaugagcuaugcaauguguuugaauacguuuguacuaaagaaagaagucucagagacucagcacggaacaauauuaauaaaaguugaauacaaaggagaagacgcgccaugcaaaauuccguucucuacugaagaugggcaagguaaagcucauaauggccggcuuaucacagcaaacccagucgugacuaagaaagaggaaccggucaacauagaagccgagcccccuuuuggagaauccaauauagucauaggaauaggugauaaagcacuaaaaaucaauugguacaagaaagguaguucaauaggaaaaauguuugaagcgaccgcaagaggugcccgcagaauggccauauuaggugauacugcuugggauuuuggcuccguagggggaguauuaaacuccuuaggaaaaaugguucaucaaauauuuggcucggcauauacugcccucuuugguggcguaagcuggauaaugaagauuggaaucggagucuuguuaaccuggaucggacuaaauuccaaaaauacauccaugucguucagcuguauaguuauugguauuauaacuuuguaucucggcacugugguucaagccgauaugggaugugugauaaacuggaaagguaaagaacuaaaaugcggaucaggaauuuuugugacuaaugaaguccauacauggacagaacaauacaaguuccaggcugacagucccaaaagacuugcaacagcaauagcuggcgcuugggagaauggaguaugcggaauacggucuacaacccgaauggaaaaccugcuuuggaaacagauagcaaaugaauugaauuauauacuaugggaaaauaauauaaaauuaacgguaguaguaggggauauuauugguguacuggaacaagguaaacgggccuuaaccccucaaccaauggaguuaaaauauucuuggaaaacauggggaaaagcuaaaauuguuacagccgaaauacaaaauagcuccuucauuauugauggaccgaauaccccagagugcccuucagccucacgagcuuggaacguaugggaaguagaagauuauggauuugguguuuucacuaccaacauauggcuuaaacuuagggaaguauauacucaaaccugcgaccaucgacugaugagcgcugcgauaaaggaugagcgagcaguucaugccgauaugggauacuggauagaaucucagaaaaauggaagcuggaaauuggaaaaagccucguuuauugagguaaaaaccugcaccuggccuaaaacgcacacacuaugguccaauggaguacuugaaucagacaugaucauacccaaaucacucgccggaccuauuagucaacauaaucacagaccaggcuaucauacucaaacagccggcccuuggcauuuaggaaaauuggaauuagacuuuaauuauugcgaagguacuacaguuguaaucacugaaaauuguggcaccagaggaccuagccuuaggacaacaacugugucaggaaaacugauacaugaauggugcugcagaucauguacacuaccaccacuaagauauaugggugaggacggcuguugguacggcauggagauucguccuauaaaugagaaagaagaaaauaugguaaaaucacuuguauccgcugguucagguaagguugauaauuuuacaaugggagucuuaugucuagcaauauuauuugaagaaguaaugcgagggaaauucgguaagaaacacaugauagcgggggugcucuuuacuuucaugcuacuccuuaguggucaaauaacuuggagagacauggcacauacuuuaaucaugauuggaucgaacgccucugaucgaaugggaaugggcguaacuuaucuagcucuaaucgcaacuuucaaaauccaacccuucuuagcauuaggauucuuucuuagaaaauugacuucuagagaaaauuugcuuuuaggugugggcuuagcaauggccacuacucuucaacuucccgaagacauugaacagauggcgaauggcauugcgcuuggacucauggcacuaaagcuaaucacacaauucgagacauaccaacuuuggaccgcauuaguuucccuaaccugcaguaacacaauauucacuuuaacugucgcauggcgaacggcuacccuuauauuagcuggaguuucgcucuugccaguaugccaaagcucaaguaugagaaaaacugacugguuaccuguagccguugcagccaugggugugccuccauuaccccuuuuuaucuuuagcuugaaggacacauugaaacgacgaagcuggccauuaaaugaaggcguaauggcaguaggcuuaguaucuauacucgccucaucacuccuaaggaaugauguaccaauggcaggaccguuaguugcugguggcuugcuuaucgcuuguuacgucauuaccgguaccucggcggauuugaccgucgaaaaggcugccgauguaacaugggaggaagaagcugaacaaacaggaguuucccacaaccuuaugauuacuguagacgacgauggaacaaugcgaauaaaggacgacgagacagaaaacauccuaacaguauugcuuaaaacggccuuacugauaguaagugggaucuuuccauacagcauaccagcgacucucuuaguauggcauacauggcaaaaacaaacacaaagaagugguguucucugggaugucccaagucccccggaaacccaaaaggcagaacuugaagaaggaguuuauagaauaaagcagcaaggaauuuucggcaaaacacaagucgguguaggaguacagaaagagggcguuuuccauacaauguggcacguaacgagaggugcgguacuaacacauaacggaaaaagacuugaaccuaauugggcaagcguuaagaaggaucuuauuucauacggaggaggcuggcgucuaucagcucaauggcaaaagggcgaagaagugcaaguaauagcaguugaaccaggaagaaauccuaagaauuuucagacuaugccaggaauauuccaaaccacaacaggugaaauaggugccauagcccucgacuuuaaaccuggaacaaguggcucgccaauaauuaauagagaaggaaaggugguaggauuguauggaaauggcguuguaaccaaaaauggcggguauguauccggaauagcccaagcaaacgcagaaccagaagggccaacaccugaauuagaagaagagauguucaagaaaaggaauuuaacaauuauggauuuacacccagguucuggcaaaacgcgaaaauacuugccugcaaucguccgugaagcgaucaaaagacgucugcgcacauugauauuagcacccacaagggucgucgcugcugagauggaagaagcacuaaaaggauugccaauccguuaucaaacaacagccacaaaaucagaacauaccgggcgugaaauaguaguucuuaugugucacgccacuuucacaaugagacuacucucgccgguaagggugccuaauuauaaccugauaauaauggacgaagcacauuuuacggauccggccagcauagcagcaagaggauauauaucuacucguguuggaaugggagaagcugcggcgauauuuaugacagccacuccgccgggaacugcagaggcauuuccacaauccaaugcccccauccaggacgaagaaagagauauaccugaacgcaguuggaauaguggcaacgaauggauuacagacuucgucggcaaaacaguaugguucguacccucaauaaaggcugggaacgauauugcgaacuguuugaggaaaaacgguaagaaaguuauccaguuaucaagaaaaaccuucgacacagaauaccaaaagacuaaacuaaaugauugggauuucguugugacaacagacauuucagagaugggugccaacuuuaaagcugauaggguaauagauccgcgaagguguuuaaaacccgugauacuuacggaugguccagaaagaguaauacuagccggaccaaugccuguuacagcagcguccgcagcacaaaggaggggccgaguaggcagaaauccucaaaaagagaacgaucaauauauuuucaugggucagccauugaauaaugaugaggaucaugcacauuggaccgaagccaagaugcuauuagacaauauaaacacucccgagggaauuauaccugcguuauuugagccugaaagagaaaaaucugcagcuauagauggagaauaccguuuaaaaggagagucaagaaagacauuuguagaguuaaugcgaagaggggaccuaccgguguggcuagcccauaaaguagcuuccgaaggaaucaaauauacugauaggaaguggugcuuugauggggaaagaaacaaccagauauuagaagaaaauauggauguagagaucuggacaaaagaaggcgaacgaaagaaacuacguccaagauggcucgacgcuagaacauauagcgacccauuagcguugaaagaguuuaaagacuuugccgcugggcggaaaucaauagcauuagaccuaguaaccgaaauaggcagagugccaagccauuuagcucaucgaacacguaaugcgcuagauaacuuaguaaugcuccauaccucggaacacgggggcagagcuuaccgacacgcaguugaagaauuacccgaaacuauggagaccuuguuauuacuuggguuaaugauccuauugacaggaggugcaaugcuuuuccuaaucucaggaaaaggcaucggaaagacgagcaucgggcuuauuuguguuauaguuaguucuggaauguuguggauggcugaugucccauugcaauggaucgcuagugcaauaguauuagaguuuuucaugaugguucuauuaauuccagagcccgaaaaacaaaggacgccacaagacaaccaacuagcguauguuguaauagguauauuaacacuagcagcaauugucgcagcaaaugaaaugggguugcuugaaacaacgaaacgcgaucuaggcauguccaaagaacccgguguggucagccccacaaguuaucucgaugucgaccuacacccagcuagcgcauggacguuauacgcgguugcaacuacagugauaacuccaaugcuacgucauaccauugaaaauucgacugcaaaugucaguuuagcagccauagcuaaucaggcgguaguguuaaugggauuagacaagggauggcccauaucuaaaauggacuuaggaguaccucuauuagcacuaggcugcuauucccaagucaauccucuaacacuuacagccgcaguguuacuguugguaacccauuacgcaauuaucggaccugguuuacaggcgaaggccacgagagaagcacagaaaagaaccgcggcggguauaaugaaaaaccccacaguagauggcauaaugacaauugaucuagacccagugaucuaugauaguaaauuugaaaaacagcuaggucaaguuauguuacuuguucuaugugcuguacaguuacuauugaugcgcacuagcugggccuuaugcgaagcucucacacuagcuacggguccaauaacaacucuuugggaaggaagucccggcaaauuuuggaacacaacaauugcaguuagcauggcuaacauuuuccgcgggaguuauuuggcaggagcuggauuggccuuuaguauuaugaaaaguguagguacaggaaaaagggggacuggcucacaaggugagacacuuggcgaaaaauggaagaagaaacugaaucagcuaucgcggagagaguucgaauuguacaaaaagagcgggaucaccgagguggaucggacggaggcaaaagaaggacuuaagcgaggagaaaccacacaucaugcuguaucaagaggaucagcaaaacuacagugguuuguagaacguaauauggucauaccggagggacgcguaauagacuuaggcugcgguagaggagguuggucauacuauugcgccggcuuaaagaaagucacagaagugagagguuacacaaaagguggcccaggucaugaagaaccagucccaauguccacguacggguggaauacaguaaagcuaaugagcggaaaagauguguucuaucugccgccagaaaaaugugauacacuauuaugcgauauaggugaaucguccccuucaccaacugucgaggagucaagaacuauacgagugcuuaaaauggucgagcccuggcucaaaaacaaucaauucuguauuaagguguugaauccauauaugccaacaguaaucgagcauuuggaaagacuacaacgaaaacacggagguauguuaguuagaaauccacuauccagaaacucaacacaugagauguauuggauuaguaauggaacuggcaauauaguaucaucgguuaacaugguuucaagacuucuucuaaaccguuucacaaugacacaccgccggccaacgaucgaaaaagacguggaccucggagcugguacaagacacgugaacgcugaaccagagacaccgaauauggauguaauuggggagagaauuaaacggauuaaagaagaacauagcucaacauggcauuaugaugaugagaaccccuacaagacgugggccuaucacggaagcuaugaagucaaagcgacgggaagcgcaagcucuaugauuaacggaguuguaaaacuauugacuaagccaugggauguaguaccuauggucacacaaauggcaaugacugacacaacuccguucgggcagcaaagaguguuuaaggagaaaguugauacaaggaccccuagaccaaugccuggaacacguaaagucauggagauaacagcagaauggcuuuggagaacacuaggucgaaauaagagaccucgucuauguacuagagaagaguuuaccaaaaaggucaggacaaaugcagcaaugggcgccgucuuuaccgaagaaaaucaaugggaauccgcgagggccgcgguagaagacgaggaauuuuggaaguuggucgggcgagaacgagaauuacauaagcucgguaagugugguucuugcguauacaauaugaugggaaaacgggagaagaaauugggggaauuuggaaaagcuaaaggaucgagagccauuugguauauguggcuaggugcgcgguaccuagaauuugaagcacuaggauuuuuaaaugaagaccacugguucucacgggaaaauucauauucugguguagaaggagaagguuugcacaaauugggguacauuuugagagauauaucaaaaauucccgguggagcaauguaugcagacgacacugccgguugggauacaagaauaacagaggacgaucuacauaaugaggagaaaauuacgcaacaaauggauccggaacaucgacaauuagcaaaugcgauuuuuaaacuaacauaucaaaauaaaguugugaaaguccaaaggccgacuccaaaaggaacaguuauggacauuauaucgagaaaggaucaacguggaucaggccaaguaggaacguauggcuuaaacaccuucaccaauauggaagcacaacucauaagacaaauggaaggggaagggguuuuguccaaagcagauuuggagaauccucaccuucuagagaagaaaauaacacaguggcuugaaacuaaagggguggaacgucuuaaaaggauggcaaucagcggggacgauugugucgucaaaccuauagaugauagauucgcgaacgcucuguuagcacucaaugauauggguaaaguccgaaaggauauaccacaauggcaaccuagcaaaggcuggcaugauuggcaacagguuccuuuuuguagucaucacuuccaugaacucauuaugaaagauggccgaaaguuaguaguaccuugcaggccucaagacgaacugauugguagggcacgaaucagucaaggagcaggcuggucauuaaaagaaacugcuugucucggcaaggcauacgcccagauguggucauuaauguauuuucauagaagagaucugcgacuggcaucaaaugcgauauguuccgcaguaccggugcauuggguaccaacuucaaggacaacauggaguauacaugcccaucaccaguggaugacuacagaagacauguuaacaguguggaauaggguuuggauagaagacaauccauggauggaagacaagacaccaguaaccacaugggaagacguuccauaucuaggaaagcgugaggaccaauggugcgguaguuuaaucggguugacaagucgcgcuacuugggcgcagaauauucucaccgcaauucaacaaguucgaaguuugauaggcgacgaagaguuccuagauuauaugcccucuaugaaaagauuucgcaaagaagaagaaucugaaggggcgauuugguag

SEQ ID NO: 23548 - RNA, 9873 nt, Artificial Sequence
  derived and/or modified CDS sequence (opt6) from DENV-3__KF824903__SS-prME
accaguuuaugcuuaaugaugaugcuaccagcuacucuagcguuccaccuaacaagucgagauggagaaccacgcaugaucguugguaaaaaugaacgagggaaaucucuauuauuuaaaacagcuuccggcauuaacaugugcacccuuauugcuauggacuugggggaaaugugugacgacaccguuacauacaaaugucccuuaauagcagaaguagaacccgaagauauagauugcugguguaaucuaacuucuacauggguuacguaugguacaugcaaccaagcaggggaacaucgaagggacaaaagaucugucgcacuagcuccacacguagguauggguuuagauacaaggacacagacauggauguccgcggaaggagcuuggagacaaguagaaaaaguagaaacuugggcacuaagacauccugguuuuacuauauuagcuuuguuucuugcucauuauauuggaacuucucuaacacaaaaaguagucaucuucauauuauuaaugcuaguaacaccaucuauggcgaugcgaugcgucggagucggaaauagagacuuugucgaaggcuuaucaggagcaaccuggguagaugugguuuuagaacacgggggcugugucacgaccauggccaaaaauaaaccaacuuuagauauagaacuucagaaaacagaagcuacucaacuagcaaccuugcgcaaacuaugcaucgagggaaaaauuacgaauauuacuacagauucgaggugcccgacacaaggcgaagcuauauugccagaagaacaagaccaaaacuauguuugcaaacauacguauguugauagggguuggggcaacggguguggguuauucggcaaaggaaguuuagugacaugugcaaaauuucaaugucuugaaagcauagagggaaaagugguccagcaugagaaucuaaaauauacuguuacaaucacaguacacacgggugaccaacaucaaguagguaaugauacgcaaggcguuacggcggagauaaccccacaggcaaguaccguagaagcuauauugccagaauaugguacacuuggucuggaguguucuccucguacuggucuagacuucaacgaaaugauucuucuaacaaugaaaaacaaagcauggaugguacaucgacaaugguuuuucgaucuaccguugccauggaccuccggcgcaaccaccgagacacccacauggaacaggaaagaacugcuagucacauucaaaaacgcgcacgccaagaaacaagagguaguuguacuuggaucucaagaaggcgccaugcauacugcacuuaccggagcaacugaaauccagaacucaggagguacaucuauuuucgccggacacuuaaaauguagacugaaaauggauaaauuggaauuaaaagggaugagcuaugcaaugugccuaaacaccuucgugcucaagaaagaaguuucagaaacacaacacggaacgauauugauuaaagucgaauacaaaggagaggacgcuccuuguaagauuccguucucgacagaagacggucaaggaaaagcccauaaugguaggcucauaacugcaaacccaguuguaacuaagaaagaagaacccgugaacauugaagccgaacccccauuuggagaaaguaauaucgucaucggaaucggugauaaagcacuuaaaaucaauugguacaagaaagguaguucaauaggcaaaauguuugaggcgacagcgcguggggcacgacggauggcuauauuaggugacacggccugggauuuuggaagcguaggggguguacuaaauucguugggcaaaaugguccaucaaauauucggaagugcauacacggcacuuuuuggaggagucucauggauuaugaaaauaggaauaggcguacuucuuacauggaucggacuuaacaguaaaaacacgaguaugaguuuuuccuguaucguuaucggaauuaucacauuauacuuaggaacggucguccaggccgacauggguuguguaauaaauuggaaagguaaagagcuaaaauguggcagugggauauucgugacaaaugaaguucauacuuggacagaacaauauaaauuccaggcagacucucccaaacgauuagccacagcuauagcaggcgcuugggagaauggcguuugugguauaagaaguacuacaagaauggaaaacuuauuauggaaacaaauagcaaacgagcugaacuacauucucugggaaaacaauauaaagcuaacuguuguaguaggagauaucauaggaguuuuggaacaagggaaaagagcucuaacaccucaaccaauggaguugaaguacaguuggaagacauggggcaaagcgaagauaguaacugcagagauacagaacucaucauuuauaauugaugggccaaacacuccagaaugcccaagugcuucucgagcauggaacguaugggaaguggaagauuacgguuucgguguguucaccacaaauauuuggcuuaaauuaagggaaguguacacacaaacaugcgaccauagguuaaugagugcagcgauaaaagaugaaagagcuguacaugcagauaugggauauuggauagaaucacaaaagaacggaucauggaaacuggaaaaagcgagcuuuauugaagucaagacuuguacuuggccuaaaucacauacauuauggagcaacggaguucuagaaagugacaugaucaucccaaaaucgcucgcagguccaauuucacaacacaaccaccguccaggauaucauacccaaacagcuggucccuggcauuuagguaaacuagagcuugauuuuaacuacugcgaaggaacaaccguugugaucacugaaaauuguggaacuagggggccaaguuuacgaaccacuacaguaucugguaaauugauacaugaauggugcugucggaguugcacuuugccaccauuacgcuauaugggagaagauggauguugguacggaauggaaauacgcccaauuaacgaaaaagaagaaaacauggugaaaucgcuugucagcgcaggcagcgguaagguagauaauuuuacgaugggcguacuaugcuuagcgauucuauuugaagaaguuaugaggggaaaauuugggaaaaagcauaugauugccgguguacucuucacuuuuaugcugcuacuuagcggacaaaucacguggcgggauauggcacacacacuuaucaugauugggucaaacgcgucggaucgaaugggaaugggcgucacguaccuugcauuaauagcaacuuuuaaaauacaaccuuuucuggcacuuggguucuuccuacgcaaacuuacaucacgcgaaaaucuccuguugggaguaggauuagccauggcaacaacguuacaauuaccagaagacaucgagcaaauggcaaaugguauagcacuggguuugauggcauuaaaauuaauuacucaauuugagacuuaucaguuauggacugcauuggugagcuuaacguguaguaauacaaucuuuacacuaacuguagcuuggagaacagcgacacucauccuggcaggaguaucauuacuuccugugugucaauccucgucaaugcgaaaaacugacuggcugccaguagcugucgcggcgaugggaguaccaccacucccauuauuuauuuucucgcuuaaagauacauuaaaacggcgcaguuggccacugaaugagggugucauggcaguaggcuuggucagcauacuagcuucaucacucuuacguaacgauguccccauggcuggaccguuaguagcgggagguuuguuaauagcuuguuacguaauaacggggacguccgcagauuuaacgguagaaaaggcagcagauguaacaugggaagaggaggccgaacagacugggguuucacacaaucuaaugauaacgguagacgaugauggcacaaugcgaauaaaagaugacgaaacggaaaauauauugaccguguuacuuaagacagcauuacuaaucgugagugguauauucccuuacucaaucccggcaacccuccuagucuggcauacauggcagaaacagacccaacgaaguggaguuuugugggacguaccaucaccuccagaaacacaaaaagcugaauuagaagaaggaguuuauagaauuaagcagcaaggaauauucgguaagacacaaguaggcguaggcguucaaaaagaaggggucuuucacaccauguggcaugugacacgaggagcaguguugacgcauaauggaaaaagacucgagccgaacugggccagugucaagaaagaucuaauuucauacggaggaggcuggagacugagugcacaauggcaaaagggugaagaaguacaagugauugcaguagaaccggggaggaauccgaaaaauuuccagacgaugccagguauauuucaaacaacaacgggugaaauaggggcaauugcucuggauuuuaaaccuggaacguccggaaguccaauaauaaaccgggaaggcaagguagucgguuuauacggaaauggugugguaacaaagaaugggggcuaugucagcggaauugcacaggcaaaugcagaaccagaaggcccaacgccagagcuugaggaagagauguuuaagaaaagaaaucuaacaauuauggaccuacacccgggaagcggcaaaacgcggaaauauuuacccgcaaucguaagagaggccauaaaacgaagguuacguacuuuaauucuugcaccaacaagaguuguagcugcagaaauggaagaagccuuaaaaggauuaccaauuagauaccagacaaccgcuacuaaaucagagcauacugggagggaaauuguagagugcaugugucaugcgaccuucacaaugagacuacuaucaccuguaaggguaccuaauuacaaucugaucauaauggaugaggcacauuucacugacccggcaucaauagcagcacgaggcuauauuaguacacgagucgggaugggagaagcggcagcaauuuucaugacagcaacgccaccaggaacagcagaggcuuuuccucaaaguaaugcaccuauucaagaugaagaacgggauauaccggagcgguccuggaacucuggaaacgaauggauaacagauuuuguaggcaaaaccgucugguuuguuccaagcaucaaagcgggcaaugauauagcuaacugucuacgcaaaaaugggaaaaaggugauacagcucaguagaaagacuuuugauacugaauaccaaaagacuaaauugaacgauugggacuuugucguuacaacagacauaagugaaaugggugcuaacuucaaagcugacaggguuaucgacccgagacgaugcuuaaagccaguaaucuuaacugauggucccgaacgagucauuuuagcaggaccuaugccaguaacugcugcgagcgcagcucaacgaagggguagaguagguagaaauccacaaaaagaaaaugaucaauacaucuuuacaggucaaccccuuaauaacgaugaggaucaugcacauuggacggaagcuaaaaugcucuuagacaauauaaauacuccagagggaaucauuccugcccuauuugagccagaaagagaaaaauccgcagcaaucgacggagaauaucgauuaaaaggagaaucaagaaaaacauuugucgaauuaaugagaagaggcgaucuacccguauggcuugcacacaaaguggcuagcgaaggaaucaaauacaccgacagaaaauggugcuuugauggagaaagaaauaaucagaucuuggaagaaaauauggauguagagauuuggacaaaagaaggagaaagaaagaaauuaaggcccagaugguuagacgcuaggacauacagugauccguuggcacugaaagaguucaaagacuucgcagcgggucgaaaaucaauugcucuugauuuggucacugaaauaggacgaguucccucgcauuuggcccaccgcacacgaaacgcauuagacaaccuuguuaugcuacauacaucugagcacgggggaagggcauauagacacgccgucgaagaauuacccgagaccauggaaacucuccuucugcuuggacuaaugauucuauuaaccggaggcgcaauguuauuuuuaauuucagggaagggaaucggaaaaacaucuauaggccuuauauguguuauaguaucauccggcauguuauggauggcugauguuccucuacaauggauugcaucagccaucgucuuagaauuuuucaugaugguauugcuaauucccgagccugaaaaacaaagaacuccgcaagauaaucagcuagcauauguaguaauagguauucucacgcuagcugcgauuguagcagcaaaugaaaugggcuuacuggaaacaacaaagagagacuuagggaugagcaaagaacccggaguugugaguccuacuucauacuuagaugucgaccugcauccagcaagcgcauggacucuauacgcuguagccacuaccguaauaacucccauguuacgccauacaauugaaaauagcacugcgaaugucucuuuagcugcgauagcgaaucaagcugucguucuuaugggacuugacaaaggauggccaauaucgaaaauggaucuuggaguacccuuauuagccuuaggauguuauagucaaguuaacccgcuaacgcucacggccgcuguacugcuauuagucacucauuaugcaauaauaggcccaggauuacaagcuaaagccacucgggaagcccaaaaacgcacagcugcuggaauaaugaaaaacccaacaguugacggaaucaugaccauagaccuugauccuguaaucuaugacagcaaauucgaaaagcagcuagggcaagucauguuacugguacuuugcgccgugcaacuacuacuuaugcgaaccuccugggcauuaugcgaagcauugacccucgcaacugguccuaucacgacccucugggagggaucgccagggaaauuuuggaauacaacuauugcaguuagcauggcgaacauuuuucggggaaguuauuuagcuggugcaggacuagcauuuucaauaaugaaaucuguugguacaggaaaacgcggcacaggaucacagggugaaacccuaggggaaaaauggaaaaagaaacuaaaucagcuuuccagaagagaauuugagcuuuauaagaaaagcgguauuacagaaguagaucgaacagaggcaaaagaaggucuaaagagaggugaaacaacacaccaugcgguaucucgagggagugcaaaauuacagugguucgucgagcgaaauauggucauaccggaaggcagagugauugaucuagguugcgguaggggagguuggucuuacuacugcgcaggucucaagaaagucacagaagugagagguuauacaaagggagguccgggacaugaggaaccaguaccuaugagcaccuaugguuggaacaccguaaaacugaugucgggcaaggacguauuuuaucugccgccugagaaaugcgauacacugcugugcgacauuggugaaucaaguccgagcccaacagucgaagagagucguacuauccggguauugaaaauggucgaacccuggcuuaagaauaaucaauuuugcauaaaagugcugaauccuuauaugccuacagugauagaacaccuggagcgauuacaaagaaagcauggagggaugcugguuagaaauccucuaucuaggaauagcacacacgaaauguauuggauaagcaacgggacaggaaacauagugagcuccguaaacaugguaagccgacuacuucuuaacagauucacgaugacucauaggcgaccuacaaucgaaaaagauguagauuugggagcugggacaagacacguuaacgcggagccggaaacaccaaauauggaugugaucggagagcguaucaaacgaauaaaagaagaacauaguaguacuuggcauuacgacgacgagaauccauacaaaacuugggccuaccaugguucauacgaggucaaggcgacggggagugcuucaucgaugauaaaugggguaguaaagcuguugacuaaaccuugggauguggucccuauggugacgcaaauggccaugaccgacaccacccccuuugggcagcaaagaguauuuaaagagaaaguagacacgagaacuccacguccaaugcccggaacccgcaaaguuauggagauaacggcagaauggcuguggagaacucuuggacguaacaaaaggccucggcucugcacgagggaggaguucacuaagaaaguaagaacaaaugcggccaugggggccgucuucaccgaggaaaaccaaugggaaucagcaagagcggcuguugaagaugaagaauuuuggaagcugguaggcagagagcgagaacuacauaagcucgguaaauguggauccugugucuauaacaugaugggcaaacgagagaagaaauuaggugaguuugguaaagccaaagggucuagagcuauaugguacauguggcugggagcuagauaccuggaguuugaagcauuaggauucuugaaugaagaccauugguuuagccgagaaaacaguuacucgggaguugaaggugaaggauugcacaaauuagguuauauauuacgggacauuucuaaaauuccaggaggagccauguaugccgacgauacagccggaugggauaccagaauuacagaggacgaucuccauaacgaagagaaaaucacacagcaaauggaccccgaacacagacaacuugccaaugcaauuuuuaaacugacuuaucagaauaaaguuguaaagguacaaagaccaacucccaaggguacugucauggacauaauaagcagaaaagaccaaagggggaguggacaagugggcacauacgguuuaaauacauucaccaacauggaagcucagcugauccgucaaauggaaggagaagggguccugucuaaggcagauuuggaaaacccacaucuuuuagagaagaaaauaacccaguggcuagaaacgaaaggaguugaacggcuuaaaagaauggcaauuaguggggacgacugugucguuaaaccaauagaugauagauuugccaaugcauuauuagcgcuaaaugauaugggcaaagucagaaaagauauaccgcaauggcaaccaaguaaaggcuggcacgauuggcaacaaguuccuuuuuguucacaucauuuucaugaauuaauaaugaaagauggacgaaagcuaguuguaccgugucgaccacaggacgaauuaauugggcgagccagaaucucacaaggagcaggauggucucucaaagaaacagcaugcuuagggaaggcauacgcacaaauguggucucucauguacuuucacagaagagaucuucgauuggcaucgaaugcuauauguucggcaguaccuguacauuggguccccacaucucgaacaacaugguccauucacgcgcaccaucaguggaugaccaccgaagauaugcuuacaguauggaaucguguguggauagaggauaaccccuggauggaagacaaaacaccaguaacaacuugggaagaugugccauacuuggguaagagagaagaccaaugguguggaucucugauagggcucacaucccgagcgacgugggcccaaaacauucuaacggcaauucaacaaguccguagcuuaauaggagaugaagaauuuuuggauuauaugccuucgaugaaaagauuuagaaaagaggaagaaucggaaggugcuauaugguag

SEQ ID NO: 23549 - RNA, 9873 nt, Artificial Sequence
  derived and/or modified CDS sequence (opt6) from DENV-3__JF504679__SS-prME
acuucuuuauguuuaaugaugaucuuacccgcugcacuagcauuccacuuaacuucacgagauggugagccacgcaugauaguagguaaaaaugaaagaggaaaaucacuuuuguucaaaacagccucuggaaucaauauguguacauuaauagccauggaccuaggcgaaaugugugaugauacaguuaccuauaaauguccacauauaacugaaguugaaccggaagacauagacugcuggugcaacuuaacuagcaccuggguuacuuacggaaccuguaaccaagcaggggaacacagacgggauaaacgaaguguugcauuagcgccccacgugggaaugggacuggacacaagaacucagacauggaugucugcagaaggagcauggaggcaaguugaaaaaguagaaacaugggcauuacgacauccaggauuuacuauauuagcauuauuuuuagcgcauuacauaggaacaagucuaacacaaaaaguaguaauauuuauccucuuaaugcucguaacaccgucuaugacaaugcgaugcguagguguuggaaauagagauuucguagaaggucuauccggugcaaccuggguugauguaguauuggaacauggagguugcgugacaacaauggcgaaaaauaaaccaacucuagauauugagcugcagaaaacggaagcuacccaacuugcuacacucagaaaacuuuguauagagggaaaaauaaccaacaucacuaccgacaguagaugucccacgcaaggggaagcgguacuaccugaagaacaagaccaaaauuauguguguaaacauacauauguggauagagguugggggaacgguuguggguuauuuggaaaaggaagccugguuacgugugccaaauuccagugucucgaaccaauugaaggaaaaguaguucaauacgaaaaccuaaaauacacaguuauuauuacaguacauacaggcgaucagcaucaagugggcaaugagacucaaggaguaacggcugaaauaacgccucaggcgucaacaacagaagcgauuuugccagaauacggaacuuuagggcuagaauguucaccacgaacuggguuagacuucaacgaaaugauuuuguuaacuaugaaaaauaaggcuuggauggugcauagacaaugguucuuugauuugccacucccauggacaucuggggccacaacugaaaccccaacuuggaauaggaaagaacuuuuaguaacauucaaaaacgcacacgcaaagaaacaagaagugguaguacuagggucacaagaaggagcgaugcauaccgcguuaacuggcgcaacagaaauacaaaacucugguggcaccaguauauuugcugggcauuuaaaaugcagauuaaaaauggauaaacuugaauuaaaaggaaugagcuaugcaaugugcacuaacacuuuuguuuugaagaaagaaguaagcgaaacgcaacacggaacaauacuuauuaaagucgaguauaaaggagaagaugcaccuuguaaaauaccguucaguacugaggacgggcaagggaaagcacauaauggacgauuaaucacagcaaauccugucgucacuaagaaagaggaaccaguaaauauugaggcagaaccuccauucggggaaucaaauauugucaucggcauaggagacaaugcuuuaaaaauaaauugguauaagaaagguaguucaauugggaaaauguuugaagcaacggcucguggagcacgccggauggcaauccugggagauacugcaugggauuucggaagcguuggugguguacuaaacagccugggaaaaaugguacaccaaauauuugggucagcauacaccgcgcuguucucggguguuaguuggguuaugaaaauagggaucggaguuuuauuaacauggauaggcuuaaauagcaaaaauacaucuaugaguuuuaguugcauagcuaucgggauaauuacccucuauuuaggcgcuguaguacaggcugacaugggaugcgugaucaacuggaaaggcaaagagcuuaaaugcggaucaggaauauuuguuacaaaugaaguacacaccuggaccgaacaauauaaauuccaagcugacagccccaaacgauuagcaacaguaauugccggugcaugggagaacggugucugugggauacgaucuaccacacgaauggaaaaucuucuauggaaacagauugcgaaugaauugaauuauauacuaugggaaaacaauauuaaacuaacagucguuguuggagauacaauuggaguguuagaacaaggcaaacgcaccuuaacaccgcaaccuauggagcuaaaauacucguggaaaaccugggguaaagcaaaaauagugacagcugaaacacagaacucaucauuuauaauugacggucccaauaccccagaaugcccguccgcaaguagggcauggaauguuugggaaguagaagacuacgguuuuggugucuuuacaacaaauauuugguuaaaacucagggaaguuuauacacaaaugugugaucaucgauuaaugucagcagcagugaaagacgaaagagcaguacaugcggauaugggcuauuggauagaaucccagaaaaacggaucuuggaaacuagagaaagccucacuuauugaagucaaaacauguacuuggccuaaaagccacacacuuuggucaaacggagugcucgaaagugauaugauuauaccgaaaagucuagcugggccgguaucacaacacaauuaccguccaggauaccacacgcaaaccgcuggucccuggcaccuugguaaacuugagcuugacuuuaauuacugugaggggaccacgguagugauuacagaaaauugugguacucgaggaccaucucugcggacaacaacaguuucugggaaacuuauacaugagugguguugcaggucuugcacuuuacccccuuuaagauauaugggagaggauggaugcugguacggaauggaaaucagaccgauuucggaaagggaagagaauaugguaaagucuuuaguaucggccggcagcgguaagguagacaauuucaccauggguguucucugccuugcaauucuuuuugaagaggucaugcguggaaaauucgguaagaaacacaugauagcaggcguauucuucacauuuaugcuacuacuguccggucaaauuacauggagagauauggcacacacgcuaauaaugauaggcagcaaugccucggacagaauggguaugggaguaacauacuuggcacuaauagcaacauucaaaauucagccguuccucgcacuagguuucuuccuaagaaaauuaacuucuagagaaaaccuacuuuuaggaguaggucucgcaauggcuacuacuauucagcuuccagaagauauagaacagauggcaaacgguauagcccuaggucugauggcgcugaaauuaauaacacaauuugaaacuuaccaauuauggacagcuuuaaucucguugacuuguaguaauaccaucuucacccucacaguagcuuggagaaccgcgacauugauucucgcuggcguuucccuacuccccgugugucaaucaagcaguaugagaaaaacugauugguugccuaugacaguggccgcuaugggagucccaccucuaccacuuuuuauauuuucgcuaaaagacacccucaaaagaagaaguuggccauuaaaugaagguguaauggcuguugguuuagucaguaucuuggcuaguuccuuacuucggaacgauguacccauggcggguccuuuaguugccgggggcuuguuaauagcguguuacguuauuacaggcacuucugcugacuugaccguagaaaaggccgcugauguuacaugggaggaagaggccgaacaaacagggguuucacauaauuuaaugauaacaguggaugaugacggaacgaugagaaucaaagacgaugaaacggagaauauauuaacagugcucuuaaagacagcucuauugauagucagugggauauucccuuauuccaucccagccacccuauuaguauggcauacauggcagaaacaaacccaaagaagugggguacuaugggacgugcccagcccgcccgaaacacaaaaagcugagcucgaggaaggagucuacagaauuaaacaacaaggaaucuuaggcaaaacucaaguagguguaggaguacaaaaagaagguguuuuucauacaauguggcaugucacuaggggagcuguccuaacacacaacggaaaacgcuuagaaccuaauugggcguccgucaagaaagauuugauaucauacggagguggcuggagauuaucugcucaauggcaaaagggagaggaaguacaaguuauugccgucgaaccaggaaagaacccgaaaaauuuucaaacuaugccagguacauuucaaacgacaacaggagaaauaggagccauagcuuuggacuuuaaaccugguacuucaggcagcccuauuauaaaucgugaaggcaaaguaguagggcuauauggaaacgggguaguuacuaaaaacgguggauacguaagugguaucgcccaaacuaacgcagagccggauggaccaacacccgaauuagaagaagaaauguuuaaaaagagaaauuuaacaaucauggaccuccauccgggcucuggaaaaacaaggaaguauuuacccgcuauuguucgagaggcaauaaaaagaagguuaagaacacuaauucuagcaccaacucgcguuguggcagccgagauggaagaagccuuaaaaggguuaccuauccgcuaucaaacaacagccaccaagagugaacauacugggcgcgaaaucguggaccucaugugccacgccacauuuacaaugcgcuuacuaaguccuguucgugugccaaacuauaauuuaauaauaauggaugaagcucacuuuacagacccagccucuaucgccgcaagaggauauauuucgacucguguuggaaugggugaagccgcagccaucuuuaugaccgccacucccccgggcacugcugaugccuuuccccaaagcaacgcaccaauucaagacgaagaaagagauauaccagaaaggucuuggaacucuggaaaugaauggaucacugauuuugcaggaaaaacaguaugguucguuccaaguaucaaggcggguaacgacaucgcaaauugucucaggaaaaauggcaagaaagugauacaacuaagcagaaaaacuuuugauacagaauaccaaaagacuaaauugaacgauugggauuuuguuguaaccacugauauuagugaaaugggcgcgaacuuuaaagcagaucgagucauagacccaagacguugucuaaaacccguaauucuaacagacggucccgaacggguaauucucgcaggcccuaugcccguaacaguggcuagugcugcgcaacgaagaggcaggguuggucgaaacccacaaaaagagaaugaucaauauauauuuacuggucaaccacuaaacaacgaugaggaucaugcccacuggacggaggcgaaaaugcuauuagacaauaucaauacgccagaagguaucauaccagcauuguucgaaccagaaagagagaaaagugcggcaauugacggagaauaucgauuaaaaggcgaaaguagaaaaacauuuguagaacuaaugaggagaggagaucugccaguuuggcuagcgcacaaaguagcgagugaaggcauaaaauacacugacaggaaauggugcuuugauggacagagaaauaaccaaauauuagaagaaaacauggacguagaaauauggaccaaggaaggcgagaagaagaaacuacgaccccgaugguuagaugcaagaacuuauuccgacccucuugcauuaaaagaauuuaaagauuuugccgcgggcagaaaaucuauugcuuuagaucuaguuacugagaucgguagaguuccaucccaccuugcccacaggacccgaaaugcacuggauaacuuaguaaugcuacauacaucagaacauggagggagagcauauagacacgcaguagaagaacucccagaaacuauggaaacacugcuccuauugggguuaaugaucuuacuuacaggaggugccaugcuuuuucuuauuucugguaagggcaucgguaaaacaucuauaggacugaucuguguuauagcgucaucgggaauguuauggauggcagagaucccucuacaauggauugcgucugcgauuguuuuagaguucuuuaugaugguuuuauuaauuccagaaccagaaaaacaacgaaccccacaagacaaucaguuggcuuaugucgugauaggcaucuugacacuggccgcaauaauagcggcaaaugaaaugggcuugcuagagacaacgaaaagagaucuuggaaugucuaaagaaccuggaguaguuucaccaacuagcuaccuugauguagaccuacauccggcaucagccuggacguuauaugcaguggcgacaacuguaauaacuccuaugcuccgacauacgaucgaaaauucaacagcaaauguuucguuagccgcaauagcgaaccaagcuguugugcuaaugggguuagacaagggauggccgauuaguaaaauggaccucgguguaccauuauuagcacuggguuguuauucucaagucaauccccugacccucacugcagccguucuucuucuaguaacacauuaugcuauaauagguccaggccugcaggccaaagccacacgcgaagcucagaaacgaacugcggccgguauaaugaagaauccuacuguugauggaauuauuacgaucgauuuagauccagucauuuaugauaguaaauucgaaaaacaauuaggacaggugaugcuauuaguuuuaugcgccguacaacuacuucuuaugaggacaagcugggcacuaugugaagcauugacacuagcaacaggccccauaacaacacuaugggaaggcaguccugguaaguuuuggaauacaacuauagcagugucaauggcaaauauauuccggggcaguuaccucgcuggggcaggucuagcauuuaguauuaugaaaagcguaggcacgggaaaacgaggcacaggaagucaaggugaaacccuaggugaaaaguggaaaaagaaguugaaucaguugagucgaaaagaguuugaucuauacaagaaaagugggauaacagaagucgauagaacugaagcgaaagaagguuuaaagagaggugaaacuacucaucaugcgguuagucgcggcagcgcuaaguugcagugguuuguagaacguaauaugguuauuccggaaggacgcgucauagauuuaggcugcggacgugguggauggaguuacuauugugccgggcugaagaaagucacagaaguuagggguuauacaaaaggagggcccggucaugaagaaccaguuccaaugagcacguauggcuggaauauugugaaauugaugucagggaaagauguauuuuaccuacccccggagaagugugacaccuuguuaugcgacauaggggagaguucuccuagcccuacugucgaagagagucgaacaauaagagucuuaaaaaugguggagcccuggcugaaaaauaaucaauuuuguauaaaggugcuaaauccguauaugccggcugucauagaacaccuagaacgucugcaaagaaagcauggaggcauguuaguccguaacccgcugagccgaaauucaacucaugaaauguacuggauuagcaaugguacagggaauauaguaagcagcgugaacauggugagccgguuauugcugaacagauuuacaaugacacauagaagaccuacaauagagaaagacguagauuuaggagcggggacaagacauguuaaugccgagccugaaacaccuaauauggaugugaucggagaaagaaucagaagaauuaaggaggaacauaacucaacuuggcauuaugaugacgagaacccuuacaaaaccugggcuuaccacgguuccuaugagguuaaagcaacaggaagcgcuucuaguaugauaaaugguguuguaaaacuguuaaccaagcccugggaugucguuccaauggucacacaaauggcuaugaccgauaccacaccauucggucaacaaagaguauuuaaggaaaaaguugauacacgaacgccucgaccaaugccgggcacacggaaggucauggaaaucacagcugagugguuauggaggacucuaggaagaaauaaaagacccagacuuugcacgagagaagaauuuacuaagaaaguuagaacaaacgcggcuaugggggcgguauuuacagaagaaaaccagugggacucggccaaagcagccgucgaggaugaagaguucuggaaguuaguugacagagaaagggaguuacauaaacuaggaaaaugugguucaugcguuuacaauaugaugggaaagcgugagaagaaauugggggaguucggaaaagcuaaaggaagucgagcaauaugguauauguggcuaggagcgcgauaucuagaauuugaggcauuagguuuccuaaaugaagaucauugguucucacgagaaaauucauauuccggaguagagggagagggacugcauaaacucgguuacauucuucgagacauaagcaaaauuccaggcggcgcaauguaugcggacgauacagcagguugggacacgcgcauaacagaagaugaucuucacaacgaagagaaaaucacacaacagaugaaucccgaacacaggcucuuagcgaacgcaauauucaaauuaaccuaccagaacaaaguaguaaaaguucaaagacccacuccgacggguacaguaauggauauuauuucaagaaaggaccaacgagggucuggacagguagggacauauggcuuaaauacauucacgaauauggaagcccagcugguaagacaaauggaaggagaaggaguccuaucaaaagcagaucuugagaauccucacuuacccgagaagaaaaucacucaaugguuagagacaaaaggcguagagcgccucaaacgaauggcaauuuccggggacgacuguguaguaaaaccgauagacgaucgauuugcaaaugcguuacuagcuuugaaugauauggggaaaguaaggaaggauauaccacaguggcagccaaguaagggcuggcaugacuggcagcagguaccuuucuguucacaccacuuccaugaauuaauaaugaaagacggaagaaaguuagucguaccauguaggccucaagaugaguuaauuggacgagcuagaauuagucaaggcgcaggauggagucugcgugaaacagccugccuagguaaggccuacgcucaaauguggucgcuuauguacuuccacagacgagacuuacgucuggcaucaaacgcuauauguagugcuguuccuguacauuggguacccacgucuagaacaacguggaguauucacgcacaucaccaauggaugacgacggaagauaugcuaacggucuggaaccgcguauggauagaagauaauccuuggauggaagacaaaacaccugucacuacuugggaaaauguaccuuauuuggggaaaagagaagaucaauggugcgguucgcuaauagguuuaacaucacgcgcaacaugggcccaaaacauuccaacagcaauacaacaaguaagaucauugaucggcaaugaagaauuuuuagauuacaugccgagcaugaaaagauuccguaaagaagaagagagcgaaggagcaauuugguaa

SEQ ID NO: 23550 - RNA, 9873 nt, Artificial Sequence
  derived and/or modified CDS sequence (opt6) from DENV-3__KC425219__SS-prME
accucauuauguuugaugaugauacugccugcagcacucgcuuuucaucucaccucgcgagauggagaaccaagaaugauaguagggaaaaacgaaagaggaaaaucauuacuuuuuaaaacugcaagcggaauaaauauguguacauuaauagcgauggauuuaggagaaaugugcgaugacacuguaacauauaaaugcccucacauaacugaaguagaaccugaagauauugacuguugguguaaucuuacgucaaccuggguaacauauggaacauguaaucaagcaggggagagacgaagggauaaaaggucgguagcauuagcgccacacguaggaaugggacuggacacacguacacaaacauggaugucggcagaaggggccuggaggcaaguugagaaaguagaaaccugggcgcucaggcauccagguuucacgauuuuagcguuguuucucgcucauuacauaggcacaagucuaacucaaaaaguagugauauuuauauuacugaugcucguuacaccuucaaugacgaugagauguguaggcguaggaaacagagauuuuguugaagguuuaucaggagcaacuuggguagauguaguucuugaacauggagguugugugacaacaauggcuaaaaacaaaccaacgcuugauaucgaauugcagaaaacugaggcgacacaacuugcgacucuaaggaaacuauguauagaagguaaaaucacaaauauaacuacagacaguagaugcccaacucaaggugaagcaguauuaccagaagaacaagaucaaaauuacguauguaaacauacuuacguggaccggggcugggggaauggguguggccuuuuugggaaaggauccuuagucacaugugcaaaauuucaaugucuugagccgauugaagguaaaguaguucaauacgaaaaucugaaauacaccguaauaauuaccgugcacacaggagaccaacaccaaguaggcaaugaaacacaaggggugacggccgagauuaccccacaagcaucgaccacggaagcaauacuaccagaguaugguacccuuggacucgaaugcaguccaagaacaggucuagauuucaaugaaaugauauuacuaacgaugaaaaauaaagcauggaugguacaucggcaaugguucuuugacuugccacucccuuggacgagcggugcaacaacugaaacgccuacauggaacagaaaagaacuacuggugacauuuaaaaaugcgcaugcuaagaaacaagaaguuguaguauuagguagucaagaaggcgccaugcauacggcuuugaccggagcgacagaaauacaaaacagcggcggcacgucgauauuugccggacacuuaaaaugucggcuaaaaauggauaaacuagagcuaaaagguauguccuacgccaugugcacaaauacuuuuguucuaaagaaagagguaagugaaacgcaacaugguaccauauuaauaaaaguugaauauagaggcgaggacgcaccauguaaaauuccauucucuacagaagauggacaaggaaaagcacacaacggaagauuaauaacugcuaauccaguaguaacuaagaaagaggaaccggugaauauagaggccgaaccgcccuucggcgaaucaaauauaguuauaggaaucggggauaaugcacucaaaauaaacugguauaagaaaggaagcucgauaggaaaaauguuugaagcuacugcuagaggagcaagaagaauggcuauacuuggcgacaccgccugggauuucggcaguguaggcggagucuuaaacucucuugggaaaaugguacaucaaauuuucggaucggccuauacagcacuauuuucaggaguaucauggguaaugaaaauuggcauaggaguacuauuaacguggaucggacucaauccgaaaaacacuucgaugucguuuuccugcauagcaauagguauuauuaccuuauaucuaggugcagugguucaggcugacaugggaugugugauuaauuggaaaggcaaagaacucaaauguggcuccggcauauuugucacaaaugaagugcacacauggaccgaacaguauaaauuucaggcagauucuccaaaaagacuagcuacagcaauagcaggggcgugggaaaaugggguauguggaauuagaaguacaacaaggauggaaaaucuacuguggaaacaaauugcaaaugaauugaacuauauccuaugggagaacaauauuaaauuaacgguuguaguuggugauauaauaggcguauuagaacaagguaaacgaacauuaacuccccagccaauggaacuuaaauacaguuggaaaacauggggaaaagccaaaauagucaccgcggagacacaaaacaguaguuucauaauagacggaccaaacacaccagaguguccguccgcaagucgugcauggaacgucugggaaguugaagacuauggguuuggcgucuuuaccaccaacauauggcuuaaauuacgagagguuuauacccagcucugugaccauagauugaugagcgcagcaguaaaagacgaaagggcuguacacgcugauauggguuauuggauagaaagucagaaaaauggaucauggaaacuagaaaaagccagccuuauagaagucaaaacauguacuuggccaaaaucacauaccuuauggaguaaugguguacuggaaagugacaugauaauaccuaaaucacucgcaggacccaucucacaacauaaucaucgcccuggauaucauacacaaacagcugguccuuggcaucucgggaaauuagaauuagauuuuaauuauugcgaaggaacgacuguaguuauuacagaaaauuguggaaccaggggucccagcuuaagaacaacaaccguuagugggaaauugauacacgaaugguguugccggagcugcacguuaccaccauuacgauauaugggggaagauggcuguugguacgguauggagaucagacccauaagugaaaaagaagaaaauaugguaaaaagucugguaucagccggaagcggcaaaguggauaauuucacgaugggaguauuauguuuagccauacucuucgaagagguaaugagaggaaaauuuggcaagaaacacaugauagccgguguguucuuuaccuucguuuuacuacuaagugggcaaauuacuuggagagauauggcacauacuuuaaucaugauuggguccaaugcauccgaucggaugggaaugggcgugaccuauuuagcuuuaauugcuacguucaaaauacaaccauuucuagcacuaggcuucuuucucagaaaacugacaucuagagagaacuuacuacucggagugggauuagcaauggcaacaacuuuacaauugcccgaagauauagaacaaauggcaaauggcauugcucuaggucuuauggcccuaaaauuaauaacacaauucgaaacuuaucaacuuuggacugcuuugaucagcuugacuuguagcaauacgauguuuacgcuaacgguugcuuggagaacugcaacucuuauauuagcaggcgugagucuccugccggucugucaaucuucuuccaugagaaaaacagauuggcuacccauggcagucgcagcuauggggguuccuccacuaccauuauuuauauuuagucucaaagauaccuugaaacgacguucguggccccuaaaugaggggguaauggcgguaggauugguaagcauacuagccagcagccuacucagaaacgauguaccaauggcgggaccuuuaguugcugggggacuguuaauagcguguuacgugauaacaggcacaucagcggaucuaacuguagagaaagcugccgacauaacaugggaggaagaagcagagcagacagguguaucucacaauuuaaugaucacuguagaugacgacggaacgaugagaauuaaagaugacgagacggagaauauucuaacuguacuccucaaaacagcgcuccuaauaguuagcggugucuuucccuauucgauuccugcgacuuugcuaguauggcauacguggcaaaaacaaacccaaagaucgggaguucucugggaugugccaagcccuccagaaacacagaaagcggaguuagaagaaggaguauacagaauuaagcagcaagguaucuucgguaagacucaggucggagugggcguucaaaaggaagguguauuccauacuauguggcaugugacaagaggcgcaguacucacauauaacgguaaacgauuagagccuaacugggcaucgguuaagaaggauuugauaaguuacggcggaggauggagauugagugcucaauggcagaagggagaagaaguacaaguaaucgcuguagaaccaggcaaaaacccgaagaauuuucaaaccaugccgggaacuuuucagacuacgacuggagaaaucggagcaauugcacuagauuuuaaaccagguacauccggaucaccaauaauaaauagggagggaaagguaguuggguuguauggcaauggagugguuacuaaaaaugguggguauguuagcggaauagcgcagacgaaugcugagccagaugguccuacaccugagcuggaagaagaaauguuuaagaaacgcaacuuaacaaucauggacuuacauccaggaagcggaaaaacucgaaaauaccucccggcgaucguacgugaagcaauuaaacgaaggcuccgcaccuuaauauuagcaccaacacguguugucgcagcggaaauggaagaggccuuaaaaggccuaccuaucagguaucaaacuacagccacuaaaucagaacauacggggcgggaaauuguagaccucaugugccacgcgacuuuuacgaugcgauuacuaucgccaguaagagugccaaauuauaauuugauaauuauggaugaagcacacuuuacagaccccgccucuaucgcagcaagagguuauauaaguacgcgaguagggaugggagaagcagccgcuauuuucaugacagcaacaccaccagguacugcugaugcauuuccgcagucuaacgcgcccauucaagaugaagaaagagacaucccggaacgaagcuggaacagcgggaaugaguggauuacugacuuugcuggaaagacgguaugguuugugccaucgauuaaggcaggaaacgauauugcaaauugucuuaggaaaaauggcaagaaaguaauucaacuaaguagaaaaacauuugauacagaauaucagaaaaccaaguuaaacgauugggacuuuguaguaacaacagacauuuccgaaaugggggccaauuucaaggcggauagaguuauugauccgaggaggugccucaaacccgucauuuuaacagaugguccugaaagagugauacuggccggcccaaugccuguuacugccgcuucagccgcucaaaggcgugggcgaguggguagaaauccucaaaaagaaaaugaccaauacaucuucacggggcaaccauuaaauaaugacgaggaucaugcucauuggaccgaagcaaagaugcuucuagacaauauuaacacaccagaaggaauuauucccgcacuuuuugagccagagcgagagaaaagcgcagcgauugacggugaguauagacuaaagggagagucaagaaaaacauuuguagaauuaaugaggcggggcgauuuaccagugugguuagcccacaaaguugcuagugaaggaauuaaauacacggauagaaaaugguguuuugacggacaaagaaauaaucaaauacuagaagaaaauauggacguagaaauauggacaaaagaaggcgagaagaagaaauuaagaccuagauggcuagaugcccguaccuauagugauccucuagccuuaaaagaauuuaaagauuuugccgcugggcguaagagcauagcgcuugauuuaguaacugaaauagggagaguaccaucacaucucgcccaccgaacacgaaacgcuuuggacaaucuagugauguuacacaccucagaacauggagggcgggcauaccgacaugcuguugaggaguugccagaaaccauggagacguuauugcuauuagguuugaugauccuacuuacagguggagcuaugcuauuucugauauccggaaaaggaauaggaaagaccuccaucggacuaauaugcguaauugcaucuagcggaaugcuauggauggcagaaauaccucuccaguggauugcaagcgccauaguauuggaguucuuuaugaugguacuuuuaauuccagaaccagagaaacaaaggacaccacaggacaaucaacuggcauacgucguuauaggaaucuuaacacucgcagcaauaauagcagcgaacgagaugggucuacuggaaacaacgaagagagaucucgguauguccaaagaaccuggcguuguuucuccaacgucauauuuagacgucgaccuucaucccgcuucugcauggacguuguacgccguagcaacuacaguuauaacuccgaugcugcgacacacuauugaaaacaguacggccaauguuagccuagcggcuauugcaaaucaagccguaguuuuaaugggcuuagauaaaggauggccaauaucaaaaauggauuuaggaguuccauuacucgccuuaggaugcuauucgcaaguuaauccucucacacuaacggcagcuguccucuuguugauuacccauuaugcaauaauaggaccagggcuccaagccaaagcuacucgcgaagcucagaaaagaacagcagcaggaauaaugaagaaucccacaguugauggaauaaugacgauagaucuggauccugucauauacgacucaaaauucgagaagcaacuugggcaagugaugcucuuaguucuuugugccguucaguuauuguuaaugcggacaaguugggcccuaugcgaggcauuaacguuagcaacaggaccaauuacuacgcuaugggagggcucaccagguaaauuuuggaauacuacaauagcuguuucgauggccaauauuuuuagggggucauauuuagcaggagcuggguuagcauuuagcauuaugaaaagcguaggaaccgguaaacgagguacugggagccaaggagagaccuugggggaaaaauggaagaagaaacuaaaucagcuaucucguaaggaauuugauuuguacaagaagucaggaauaacugaaguagaucgaacagaagccaaagagggcuuaaaaagaggggaaauaacgcaccaugccgucagccguggaucggcaaaauugcaaugguucguagaacggaacaugguaauaccagaagguagagucauugauuuggguugcggcaggggaggcuggaguuauuauugcgcugguuugaagaaaguuacugaagugcguggauauacuaaggguggacccggccaugaagaaccgguuccuaugucaacguauggauggaacauaguuaaacuuaugucagguaaagacguauuuuaccuacccccggaaaagugugacacauugcuaugcgacauaggugaaucauccccgaguccuacuguggaggaaagucgaacuauuagaguauuaaaaaugguagagccauggcuaaagaacaaucaguuuugcauuaaaguguuaaaccccuauaugccuaccgugauagagcauuuagagcgauuacaaagaaaacacggugggaugcucguacgcaauccacucagcaggaacaguacucacgagauguacuggaucuccaaugguacgggcaacauuguagcguccguaaacauggucucccgucuuuuacuuaaucguuuuacgaugacucaccgccgcccuacgauagagaaagacguagaucuaggagcaggcacaagacauguaaaugccgaaccggaaacaccaaacauggauguuauaggagaacgaaucaagaggauaaaggaggaacacaauucgacuuggcauuaugaugaugagaacccuuauaagaccugggcuuaucauggcucuuacgaagucaaagcuacaggcuccgcuaguaguaugauaaaugggguuguuaaacuuuuaaccaaaccuugggauguagucccuauggucacccaaauggcaaugacggacacaaccccauucggacaacaaaggguuuuuaaggaaaaaguagauacuaggacacccaggucgaugccugguacgcgaagaguaaugggcaucacagcggaauggcuuuggagaacauuagggagaaauaagaagccgcgccuauguaccagagaggaauuuaccaagaaaguuaggacaaacgcagcaaugggugccguauuuacugaggaaaaccaaugggacucugcaaaagcugcaguugaggacgaggauuuuuggaagcucguagaccgagaacgggaauugcauaaauuaggaaaauguggcagcuguguauauaauaugaugggaaagagagaaaagaaacuuggugaguucggcaaagccaaggguagucgggccauuugguauaugugguuaggagcacgguaccuugaguucgaagcacucggauucuugaaugaagaccauugguucagcagagaaaacucuuacagugggguagagggagagggccuucauaaacuaggauauauacuacgagauauaaguaaaauaccuggaggagccauguacgcagaugauacugcugggugggacacacgaauuacagaagaugaucuucauaacgaagagaaaauaacccaacaaauggauccugaacacagacaacuggcuaaugcaauauuuaaacuaacauaucaaaauaaagucgucaagguacagagaccaacgccaacaggaacaguuauggacauaauaucacgaaaagaucagagggguucaggacaaguugguacauacggauugaacaccuuuacaaauauggaggcgcaacuuauuagacaaauggaaggcgaaggcguuuuaucaaaagcagaucuggaaaacccgcauuugcccgagaagaaaauaacacaauggcuagagacuaagggaguugaacgacugaaacguauggcaaucuccggagacgauuguguaguaaagccaauagaugauagauuugcaaaugcucuccuagcacucaacgauaugggaaaggucagaaaggauauaccacaauggcaacccaguaaagguuggcaugauuggcaacaagucccauuuugcucacaucauuuucaugaacucauaaugaaagauggacgaaaauuaguaguuccauguagaccccaagaugaacuaauaggacgggcucgaauaagucaaggagccggguggucauugcgcgaaacggccugccuugguaaggcuuaugcccaaauguggagucuuauguacuuucauaggcgagauuuaagauuggccucuaacgccaucuguagugcagucccugugcauuggguaccaaccagccgaacgacuuggaguauucaugcgcaccaccaauggaugacaacagaagauauguugacaguguggaaucgcguauggaucgaggacaacccuuggauggaagacaaaacaccagugacuacuugggaaaaugugcccuauuuaggaaaacgcgaagaucaaugguguggaucucuuaucggauugacgucaagggcuacaugggcacaaaacauaccaacagccauacaacagguaaggaguuuaauagguaacgaagaauuucuugacuauaugccauccaugaaacgauucagaaaagaagaagaaucagagggggcaauuugguag

SEQ ID NO: 23551 - RNA, 9873 nt, Artificial Sequence
  derived and/or modified CDS sequence (opt6) from DENV-3__AY858037__SS-prME
acuagcuuaugcuuaaugaugauguuaccaguaacauuggcuuuccauuuaacaagcagagauggugaaccaagaaugauaguugguaaaaaugaacgaggaaaaucacugcuuuucaaaacagcaaguggaauuaacauguguacacuaaucgcaauggauuugggugaaaugugugacgauacaguaacauauaaaugcccucugauaacggaaguagaaccagaagauauagauuguugguguaaucugacaaguacguggguaacauauggaacguguaaucaagccggagagcacagacgggauaaacguucuguagcgcuggcaccccauguaggaaugggccuggacacaagagcucaaacauggaugagcgccgaaggagcguggcgucaaguagaaaaagucgaaacaugggcauuucgucauccagguuuuacaauucuugcucuuuuccuagcgcauuauaucggcacgucauuaacucaaaaaguaguuauuuuuauacuauuaaugcuggugacaccuuccaugacuaugagaugcguaggaguagguaauagggauuuuguugaaggauuaucgggugcaacauggguagacguagucuuagaacaugggggauguguaacuaccauggccaaaaauaaaccuacuuuggacauagaauugcagaaaacugaggcaacacaacuugcuacacuaagaaaauuauguauagaaggcaaaauaacaaacgucacaacugacucacguugcccaacacaaggagaggcaaucuuacccgaggagcaagaccagaauuauguauguaaacauacuuauguagacagggguuggggaaauggaugcgguuuauucgguaaagggucguuaguaacaugugcaaaauuccaaugcuuagaaucaaucgaagggaaagucguacaacaugaaaaucugaaauacacuguuauaaucacaguacacacuggagaccagcaucaaguaggaaacgaaacacaagggguaacggcggaaaucacgccacaggcuucaacaguggaggcaauuuugccggaauauggaacacuaggucuagaguguucaccccguacuggacuagauuucaacgaaaugauuuuacucacgaugaaaaauaaagccuggaugguucauagacagugguucuucgauuuaccacuuccauggacaucaggggcuacaacugaaacgccgaccuggaauaagaaagaacuccucguuacauucaaaaaugcucaugcuaagaaacaagaaguaguaguuuuagggucacaagagggggcaaugcacacagcuuuaacaggagcaacagaaauacagacaagcggaggaaccaguauauuugcaggccaucucaaauguagguuaaaaauggacaaacuggaacuaaaaggcaugucauaugcuauguguucgaaugcauucgucuuaaagaaagaagucagugaaacacagcacggaacgauacuaaucaaaguugaauauaaaggagaagaugccccuugcaaaaucccuuuuucaacugaggacgggcaaggaaaagcucauaaugggaggcucauaaccgccaauccaguaguaacgaagaaagaagaaccugucaauauagaagcugagccaccguuuggugaaaguaacaucauuauagguauaggggaucgugcguugaaaauuaacugguauaagaaaggguccaguauaggaaaaauguucgaagcuaccgcaagaggggcuagaagaauggcaauacuuggggauacggcaugggauuucggaaguguugggggagugcuuaauagcuuagggaaaaugguacaccagauauuuggcagcgcguauacugccuuauucagcgguguuucauggaucaugaaaauagggaucggagucuuguuaacuuggauugguuugaacucuaaaaacaccucuaugucauuuaguugcauaguaauaggcaucauaacacuauaucugggagcugugguacaggcagacauggguuguguaauaaauuggaaaggaaaagaacuuaaaugcgguucgggaauuuucguaacuaaugaaguucacacauggacagaacaauauaaauuccaagccgacucccccaaacgauuagccaccgcaauugcaggagcuugggagaaugggguaugcggaauuagaucaacuacgagaauggagaaccuacuauggaaacaaauagcuaaugaguuaaauuacaucuuaugggaaaauaauaucaaacuaacaguagucgugggugauauaauaggaguguuggaacaaggaaaaagaacgcucacaccacaaccgauggaauugaaauacucguggaaaacgugggggaaagccaaaauagucacagcggaaacccagaacuccucauuuauaauagauggccccaauacuccagagugccccaacgcaucuagggcauggaauguaugggaaguagaagauuacggauuugguguauucacgacaaauauauggcucaaacuccgcgaaauguauacccaacucugugaucaucgguugauguccgccgccgugaaagaugagagggcgguacaugcagauauggguuauuggauugaaagucagaaaaacgguucguggaaguuagaaaaagcgucacucauugagguaaaaaccuguacauggccaaaaucacacacacuauggaguaaugggguuuuggaaagugauaugauuaucccuaagagcuuagcagguccuauuucacaacauaauuauagaccgggguaucacacccagaccgcaggaccuuggcaucuagguaaguuagaacuggauuuuaacuauugugaagggacuaccguaguuauaacugaaaauugugguacacggggaccuucuuuacggacaaccaccgucucuggaaaauuaauacaugaauggugcugucguuccuguacucuuccuccuuuaagauauaugggcgaagacggaugcugguacggaauggaaauaagaccaauaaaugagaaggaagaaaacauggugaaaucauuaguaagugcugguaguggaaaaguagauaauuuuacuaugggcguacuuugucuggcaauuuuauuugaagaaguuaugagagguaaauucggcaagaaacacaugauagcgggugugcuguuuaccuuuguuuuauuacucaguggucaaauuacauggcgugauauggcgcguacuuugauaaugauugguucaaaugccuccgacaggauggggauggguguaacuuaccuugcgcuaauugcaacauuuaaaauacagcccuuucucgcacugggauucuuuuuacggaaauugacaaguagggaaaaucuacuacuaggaguaggguuagcaauggcuacuacgcuucaacuaccggaagauaucgaacaaauggccaacggaaucgcccuuggauuaauggcuuuaaaauugauaacgcaguucgagacuuaccaacuauggacugcccucguaucucuaauguguucuaauaccauauuuacuuuaaccguggcauggaggaccgcuacauuaauacuagccggcaucaguuuguucccagucugccaauccuccaguaugcgaaaaacugauuggcuaccaaugacugucgcagcgauggguguuccaccauuacccuuauuuauauuuucauuaaaggacacacuuaaaagaaggucauggccacuaaaugaaggcgugauggcuguaggccuaguaaguauucuugcgucuucucuauugcguaacgauguaccuauggccggucccuuggucgcuggaggauuauuaauagcaugcuauguuauuacggguacaagugccgaccuuacgguggaaaaagcagcagacguaacaugggaagaagaggcugaacaaacgggggugucacauaaccuuaugaucaccguugacgaugacgggaccaugagaauaaaagaugaugaaacagaaaauauuuugacgguacuauuaaaaacggcacuucuaaucgugagcggcauauucccguacaguauuccagcaaccuugcuaguguggcauacuuggcagaaacaaacacaacguucuggaguauuaugggacguaccaagcccgccagaaacucaaaaagcugagcuugaggaaggaguuuaucguaucaagcaacaaggaaucuuuggaaaaacccaggucggaguagguguacaaaaagaagguguguuucacacuauguggcaugucacaagaggcgcugugcugaccuacaaugggaagcgucuagagccaaacugggcaagugucaagaaagauuuaaucucauauggcgguggguggcgacuuagcgcucaguggcagaaaggagaagaaguacaaguaaucgcaguagaaccaggcaagaacccuaaaaauuuccaaacuaugcccggaauauuccaaacaacgaccggagaaauaggggccauagcacuagauuuuaaaccagguacgucaggauccccuauuauuaauagagagggcaaaguagucggcuuauacgggaauggcguugugaccaaaaauggagguuauguuucaggcauugcacaaacaaaugcagaaccagauggacccacgccugaacuggaagaagagauguucaagaaacgaaaucuaaccaucauggaucuacaccccgggucuggaaaaacucgaaaauaccucccggcaaucguccgagaggcgauaaaaaggagauuaagaacauuaauacuugccccaaccagaguaguagcugcugaaauggaagaggccuugaaaggucuuccgauccgcuaucaaaccacagcaacgaaaagcgaacacacugguaaagaaauagucgaucugaugugccacgcuacauucacaaugagauuauugagucccguccggguuccuaauuacaaccuaauuauuauggaugaggcacauuucacggaucccgcaucuaucgcugcaaggggcuauauaaguacgagaguuggaaugggagaagcagcagcaauauucaugacugcaacuccaccaggaacagcugaugcauuuccucaaaguaaugcuccaauccaggaugaagaaagagauauacccgaacgcaguuggaacucaggcaacgauuggauuacagacuuugccggcaagacagucugguucgugcccuccauuaaagcagguaacgauauagcuaauuguuuacgaaagaacggcaagaaaguuauacaacugagccgcaagacuuuugacacugaauaucagaaaacuaaacucaaugauugggacuuuguuguaacgacagacauaagugaaaugggugcaaacuuuaaggcagacagaguaauagacccacgaagaugcuugaaaccugugauacuuacugacggaccagagcgcguuauacucgcuggucccaugccaguuacgguugcaucagcagcacaacgaagaggcaggguaggucgcaauccacaaaaagaaaaugaucaauacauuuuuacuggacaaccacugaacaacgaugaggaccacgcucauuggacagaggccaaaauguuauuagacaacauuaacaccccggaagguauaauaccggcacuuuuugaaccugagagggagaaaucagcugcaauagauggagaauauagacuaaaaggagaaucaagaaaaacauuuguagaacuaaugcgucgcggagacuuaccggucuggcucgcgcauaaaguagccucggagggaauaaaauauacagauagaaaaugguguuuugacggugaaagaaacaaucaaauucuagaagaaaacauggauguagaaauuuggacaaaggaaggagagaagaagaaacuacgaccaaggugguuggaugcaagaacauacuccgacccauuggcauuaaaagaguuuaaagauuuugcagcagguagaaaaaguauugcacuagauuugguaacugagauagggcgaguuccaucgcaccuagcacauagaacuaggaacgcacuugacaaccuaguaaugcuacauaccagcgaacaugggggcagagccuacagacacgcuguagaagaauuaccagaaaccauggaaacacuucuauugcuuggauugaugauacuucuuaccgguggagcuaugcucuuucucauaagugggaaaggaguugguaaaacuagcauuggucuaauuuguguaguggcaucuagcggaauguuauggauggcagauaucccauuacaauggauagcuucggccauaguguuagaauuuuucaugaugguacuuuuaauaccggaaccagaaaagcaacgcacaccgcaagauaaucaguuagcguacguuguaauaggaaucuuaacuuuagcagcaauugucgcugcaaacgaaaugggacuucuagaaaccacuaaacgcgauuuaggaaugagcaaagagccgggggucguaucuccgacaucguauuuagauguagacuuacaucccgcuuccgcuuggacucuauacgcaguagcgacaacagugauuacucccauguuacgacauacaauagaaaauagcacagcuaauguaaguuuagcugcuauagcgaaccaagcugucguacuaaugggauuagauaaagguuggccaauaucgaaaauggaccugggggugccgcuccuagcguuaggcuguuauucgcaagucaauccuuugacauuaacagcagcaguacuucuguuggugacacacuaugccauaauugguccagggcuacaagcaaaagcgacacgagaagcacagaaaagaacugcagcggguauaaugaagaacccgacaguggacgggauaaugaccauagaucuggauccgguaauauacgauaguaaguuugaaaaacaacuaggacaaguaaugcuccuaguacuaugugccguucaauuacuauuaaugcgcacaaguugggcuuuuugugaagcccuaacuuuagcaacagggccgauaacaacauuaugggagggaucaccgggcaaguuuuggaauacgaccauugcgguaagcauggcaaauaucuuuagaggcaguuacuuagccggagcugguuuagcuuucaguauuaugaagaguguuggaaccgguaagcguggaacuggaucgcagggugaaacccugggagaaaaguggaagaagaaacuuaaccaacugucccgaaaagaauuugacuuauacaagaaaucugguauaacugaaguugacagaacugaagcgaaagaaggacugaaaagaggagaaaucacacaccaugcugucagccguggcuccgcuaaacuucagugguuuguugagaggaauauggucauuccagagggaagagugauagaccuggguugugggagaggagguuggucuuacuauugugccggccucaagaaagucacggaaguuagggguuacaccaagggagguccgggacaugaagaaccaguuccgaugaguacguauggauggaauauuguuaaacuuaugucagguaaggauguguucuaucugccaccagaaaagugugacacuuugcuuugugauaucggagaaaguaguccaagucccacaguagaagagucgaggacuauaaggguguuaaagauggucgagccauggcuuaaaaauaaccaauucuguaucaaggugcuaaacccauacaugccuacuguaauagaacaccuagagagacugcaaagaaaacacggagguaugcuaguuaggaacccacucaguagaaacucaacucaugaaauguauuggauuuccaacgggacuggcaacauaguuucgucgguuaauaugguaucaaggcuacuacucaauagguuuacgaugacguauagaagaccaacaauagaaaaagauguugaucuaggugcagggacaagacauguaaaugccgaaccugagacacccaauauggaugucauaggagagagaauaagacgaauaaaggaagaacauucuuccacauggcauuaugaugaugaaaauccuuacaaaacaugggcauaucacgggagcuacgaggucaaagcuacaggaucggcaagcaguaugauuaauggaguaguaaaacuauuaacaaaaccaugggauguaguaccuaccguaacucaaauggcuaugacagacacuacaccguuuggccagcaacguguauucaaagaaaaaguggacacucguacaccgaaaccgaugccuggaacaagaaaaguuauggaaauuacggcggaaugguuauggagaacacuuggaagaaacaaaagaccucgacuaugcacuagagaagaauuuaccaagaaagugcgcaccaacgcggcuaugggagccguauuuacagaggaaaaucagugggauucugcgcgagccgcaguggaagacgaggaauuuuggaaacugguagauagagaacgggaauuacacaagcuaggaaaaugugggucauguguuuauaacaugaugggcaaacgagagaagaaauuaggggaguucggaaaggcaaaaggaucacgagcaauaugguauaugugguugggggcaagauaucuggaauuugaagcauugggauuccuaaacgaagaucacugguuuaguagagaaaacagcuacuccgguguagaaggugagggauugcacaaauuaggauauauucucagagacauuaguaaaauucccggcggggcaauguacgcugaugauaccgcaggaugggacacuagaauuacagaagaugaccuccacaaugaggagaaaauuacgcagcaaauggaucccgagcaccggcaacucgccaaugcaauauuuaaacuaacguaucaaaacaaaguagucaaaguccagcgaccuacaccuaagggaacuguaauggauauaaucucccguaaggaucagcgugggucgggccaggucggcacuuacgguuugaauaccuuuacaaauauggaagcccaauuaauaagacaaauggaaggugaagggguuuuaucaaagacagaccuagaaaauccacauuuguuagagaagaaaauaacccaaugguuggagacuaaggggguagagagauuaaaacguauggcaauaagcggagaugacugcguugucaagccgauugaugauagauuugcaaaugcccuacucgcacugaaugacaugggaaaaguaagaaaagacaucccgcaauggcaaccguccaagggguggcaugauuggcaacaaguacccuuuugcucgcaucacuuucaugaguuaauaaugaaggacgguagaaaauuaguaguaccuugucgaccacaagacgaacucaucggccgagcuagaauaucccaaggugcaggcuggaguuuaaaagagacagcuugcuuaggcaaggcuuacgcucaaaugugggcacuuauguauuuccaccgaagggaucugagauuagcgaguaacgcaauaugcagugcggugccaguccacuggguaccaacaucgcgcacaacauggucuauccacgcacaccaucaauggaugacaaccgaggauaugcuaacagucuggaaccggguuuggauagaggacaauccuuggauggaggauaagacaccaguaacgacaugggaagacguaccguaccuagguaaacgggaagaucaauggugugggaguuuaauaggacuuaccaguagagcgacaugggcacagaacauacuuacggcaauccaacaggucagauccuuaauaggaaaugaagaauuuuuggauuauaugccaagcaugaagcgauuuagaaaagaggaagagucggaaggcgcuauaugguga

SEQ ID NO: 23552 - RNA, 9873 nt, Artificial Sequence
  derived and/or modified CDS sequence (opt6) from DENV-3__KJ737429__SS-prME
acaucucugugccuaaugaugauguuaccugcuacacuagcauuucaccugacaagucgugauggcgaacccagaaugauaguggggaaaaaugaaaggggcaaaagucuacuauuuaaaacagcauccgguauaaacauguguacccucauagcuauggaucuuggugaaaugugugaugauacuguaacuuacaaaugcccacuuauugcugaaguagaaccagaagauauagauugcugguguaaccuuacaagcacauggguaaccuacggaacauguaaucaagcuggagaacacagaagggauaaaagauccguggcccuggcaccacauguaggaauggguuuagauacaagaacgcaaacuuggaugucagcggaaggugcauggagacaaguagaaaaagucgaaaccugggcuuuaagacaccccggauuuacaauucuagcauuauuccuggcgcauuauauuggaacaagucuaacacaaaaaguuguuauuuuuauauuauuaauguuaguuacucccaguaugacuaugagaugugucggaguugguaauagggauuucguagaaggauuaucuggagcuaccuggguugacguuguguuggaacauggugguugcguaaccacgauggcgaaaaauaaaccuacguuagauauagaauugcagaaaacagaagcaacacaacuagcuacccugcgaaaauugugcaucgaaggaaaaaucaccaacauuaccacugauucacgauguccgacacagggugaagcuauccuucccgaagaacaagaccaaaauuauguuuguaaacacacguauguagaccgcggaugggguaaugguuguggacuuuuuggcaaagggagccuagugacgugugccaaauuucagugucuagagccaauagaaggcaaaguaguacaauaugaaaaccucaaauacaccguaaucauaacagugcacacaggcgaucaacaucaaguaggaaacgauacacaggggguaacaguagaaauaacaccucaagcaaguacagucgaggcaguucuacccgaauacggaacuuuagggcucgaaugcucgccacgcacuggucuagacuucaacgagaugauucuacucacaaugaaaaacaaagccuggauggugcauagacagugguucuuugauuugccucuaccauggacaagcggagcuaccacagaaacaccuacuuggaaucgaaaagaacuuuuaguaacauucaaaaacgcacacgcuaagaaacaagaaguagugguacuagguagucaagaaggugcuaugcacacagcucuaacuggagccacugagauacaaaacaguggaggaacgucaauauuugcggggcaucuuaaauguaggcugaaaauggauaaacuagaauugaaaggaaugagcuacgcuaugugccuaaacacuuuuguucuaaagaaagagguuucggaaacgcaacaugggacaauacuuauaaaaguggaauacaaaggcgaagaugcgccauguaaaauaccuuuuucaacggaagacggacaaggaaaggcccauaauggacgauugauaacagcuaaucccguaguuacgaagaaagaggagcccguaaauauugaagcugagccaccuuuuggcgaaaguaauaucguaauugguauaggagauaaggcauugaaaauaaauugguauaagaaaggcagcuccaucggaaaaauguuugaagcuacagcaagaggagccagacgaauggcgauucuaggagauacggcaugggacuuuggaucaguuggaggaguauuaaacucuuuaggaaaaauggugcaucaaauuuucggaagugcuuauaccgcguuauuuaguggaguaagcuggauaaugaaaauagguauuggcguuuuacuaacauggauuggacuuaauuccaagaauaccaguauguccuuuaguugcauaguaauagguauaaucacacuuuaccugggcgcaguuguacaggcugauauggguugcguaauuaacuggaaaggaaaggaacuuaagugcggaucaggaauauucguaacuaacgagguacauaccuggacugaacaauauaaauuccaagcggacagcccgaaaagguuagccacagcaauagccggagcuugggaaaauggaguuugcgguauucgcagcacaacaagaauggaaaacuuauuauggaaacagauagcaaacgaacugaauuauauucuuugggaaaauaauauaaaauuaaccguagucguuggagauauaauagguguauuagaacaggguaaacguacacuuacaccacagccaauggaauugaaauauucauggaagaccugggguaaagcaaaaauugugaccgcugagacucagaacaguucauuuauuaucgacgguccuaacaccccagaaugcccguccgcuagccgcgcuuggaaugugugggaaguggaagauuacgguuuuggaguuuucaccacgaacaucuggcuaaaacucagagaaguguacacucagagcugcgaucaucgauugaugucagcagcaaucaaggacgaaagagcuguacaugcggacaugggguacuggaucgaaagccaaaagaaugguagcuggaaauuggagaaagcaucauuuauagaaguaaaaacauguacuuggcccaagucccauacccuuuggagcaauggaguauuagaaucggacaugaucauuccgaagucauuagcaggccccauaucucagcacaaccaucgucccggcuaucauacacaaaccgcugguccuuggcaucuuggcaaacuggaauuggauuuuaauuauugcgaaggcacaacuguagucauaaccgaaaacugcggaacccgaggacccucuuuaagaacaacaacaguuucugguaaguuaauacaugaaugguguuguaggaguuguacucuaccaccuuuaagauauaugggcgaagacggauguugguacgggauggagaucagaccaauuaacgaaaaggaggagaacaugguuaagucccucguuucggcuggcucagggaaaguagauaacuuuacgaugggaguauuaugucuagccauacuauuugaagaaguuaugcgugggaaauuugguaagaaacacaugauagcaggcgucuuguuuacauucguuuuguuacuaucuggacaaauuacuuggagggauauggcacauacacugauuaugauuggaucaaaugcuucugaucgaauggguaugggaguaacuuaccuagcuuuaaucgcuaccuucaaaauacaaccauuccuggccuugggauucuuuuuaaggaaauuaacgagucgagaaaaucuuuugcuaggaguaggguuggcuauggcuacuacgcugcaauuacccgaggacauagagcaaauggcuaaugggauagcacucgguuugaugacacuaaaauugaucacacaauucgaaacuuaccaauuauggacagcuuugguuucucuaacuugcaguaacacaauauucacgcuaacagucgcguggcgaacagcaacuuuaauauuggcuggugucucgcuccuaccauuaugucaaucaagcaguaugcgaaaaacagauuggcuuccaaugacgguagcggcaauggguguaccaccgcuaccccuauuuauauucagcuuaaaagauacgccaaaaagaaggucauggccacuuaaugaaggcguuauggcgguuggacuuguuucaauucuagcuucaucccuucuaagaaacgauguaccuauggcaggaccucucguagcgggaggauuacuaaucgcuuguuaugugauaacaggaacaagugccgaucuaacgguagaaaaagccgcagauguaacaugggaagaagaggccgaacaaacagggguuucccacaaucuaaugaucacaguggacgaugaugguacuaugagaauaaaagaugaugaaacugaaaacauacuuacuguacuacucaaaacagcacuguuaauaguguccggaaucuucccauauucuaucccugcgacacugcugguauggcacacuuggcaaaaacaaacacaacgaagcggcgucuugugggacguacccucaccaccagaaacucaaaaggcagaacuggaggaaggggucuauagaauuaaacaacaagguaucuuugguaaaacucaaguuggggucggaguacaaaaagagggaguguuccauacgauguggcauguaacacgaggagcuguuuuaacacauaaugguaaaagacuugaaccuaauugggccucaguuaagaaggaccuuauuucguacgggggcggcuggagacuaagugcacaauggcaaaaaggagaagaaguucaagucaucgcagucgaaccagguaagaacccuaaaaauuuccaaacuaugccagguaucuuucaaacaacuacuggggaaauaggagcuauagcgcuagauuuuaaaccuggaacaucuggaagcccgaucauuaaccgcgaagguaaaguaguagggcuauacggaaauggcgugguaacuaaaaacggaggauacgugaguggaauagcacaaacuaacgccgaaccggacgggcccaccccagaauuggaagaagaaauguucaaaaagagaaaccucaccauaauggaccuccauccgggaaguggaaagaccaggaaauacuuaccagcgauuguaagagaggcaauuaagcgccgcuuacgaacgcucauauuagccccuacacguguaguggcggcugaaauggaagaagccuuaaaaggacuaccaauacgauaucaaacgacagccacuaagucagaacacaccggccgggagauaguagaucucaugugucaugcaacguuuacaaugagauuacuaucaccagugcgaguaccaaauuacaauuuaauaaucauggaugaggcccacuuuacugaucccgcuaguauugcugcaagaggauacauaucaacccgagugggaaugggugaagcagcagcgauauucaugacagccacuccuccuggcacugcagaggcuuuuccucaguccaaugcgccuauacaggaugaagagagggacauacccgaaagaaguuggaacucuggaaaugaauggauuacagauuuugucggaaaaacgguuugguuugugcccucuauuaaggcagguaaugacauagcuaauugcuugagaaagaauggaaagaaagugauccagcucucaagaaaaaccuucgauaccgaguaccagaaaacaagacuaaaugacugggauuuuguuguaacaacagacaucagugagaugggugcgaacuucaaagccgacagggugauagacccacggagaugccuaaaaccugugauucuuacagauggaccggagcgcgugauauuagcagggccuaugcccguuacagcagcauccgcagcacaacgaagaggcaggguaggaagaaauccacaaaaagaaaacgaucaguauauauucacaggacagccuuugaauaacgaugaggaucaugcucacuggacagaagcuaaaauguuauuagacaauauaaacaccccagagggaauuauaccggcacuuuucgaacccgaacgggagaagagugcggcuaucgauggagaauacagacugaagggugaaagucgaaagacuuucgucgaacuuaugaggcggggcgauuugccaguuugguuagcacauaagguggcuucagaggggauuaaauauacugauagaaagugguguuuugacggagaacguaauaaucagaucuuagaggaaaauauggacguggagauauggaccaaagaaggagagcguaagaaauuaagaccccguuggcuagacgcaaggacuuacagcgauccuuuggcacugaaagaguuuaaggacuuugcggcuggucguaaaucgauugcuuuggauuuagucacagaaauuggccgcgugccaucacaccuagcacauagaacuaggaacgcacuagacaacuuaguuauguugcauaccucagaacacggcggacgugcuuauagacacgcaguagaggaauuaccggaaacgauggagacacuuuuacuacucgggcucaugauuuuacuaacugggggugcuaugcuauuucucaucucuggaaaagguauagggaagacaaguauuggacuaauaugcgugauaguaaguucuggaauguuauggauggccgaugucccccuacaauggauagcuuccgcuauuguguuagaauuuuucaugaugguauugcugaucccagaaccugagaagcaaaggacgccacaggauaaucaacuggcauacgucguaauaggaauauuaacauuagcugcaauagucgcugcaaacgagaugggacuucuagagacaaccaagagagaccuaggcaugucaaaagaaccggggguagucucgccaacgagcuauuuggauguagaucugcauccugcuuccgcauggacucuauaugcaguagcaacaacagucaucacgccaauguugcggcauacaauagaaaauaguacagcuaauguuucgcuugcagcaauagcaaaccaggcgguuguacucaugggauuggauaagggauggcccauaagcaagauggacuugggagugccucuacuugcauuaggguguuauucacaaguaaauccucugacccuuacagccgcagugcuauuacucgugacucauuacgcaauuauagggccagguuuacaggcaaaagcuacacgggaagcucaaaaacgaacugccgcgggaauuaugaagaacccuaccguggauggaauuaugacaauugauuuggauccaguuauauaugauaguaaauuugaaaagcagcucggacaagugaugcugcuaguacugugugcaguacaacuucuccucaugcgcacuuccugggcacucugugaagcgcucacauuagccacagggcccauuacgacucucugggaagguagcccagguaaguuuuggaacaccacaauagccguaucgauggcaaauauauucagagguucauaucuagcuggagcagguuuggcauucaguauaaugaaaucgguggggacugggaggagagguacaggaagucaaggggaaacucugggugaaaaauggaagaagaaacuaaaccagcugucgcguaaagaguuugaucuauauaagaagucuggaauaaccgaaguagaucggaccgaagcaaaggaaggauugaagagaggagaaacaacacaucaugcgguuucucgagguagcgcgaaguuacaaugguuuguagaaagaaauaugguaauacccgagggacgcguuauugacuuagguugcggaagaggcggcuggucuuacuacugcgcgggguugaagaaaguaacagaggucagaggguauacaaaaggcgggccuggucaugaagaaccagucccuaugucgacauauggcuggaacauugucaagcucaugucugguaaagaugucuuuuaccuaccacccgaaaaaugugauacccuauuaugugauauaggcgaaaguuccccaucuccaacaguugaagagaguaggacaauaagagugcuaaaaauggucgaacccuggcuuaaaaauaaccaauuuugcauuaagguacuaaauccauacaugccaacggugauagagcaccuagaaagacuucaacgcaaauaugguggcaugcuuguucggaacccauuaagcagaaacaguacucaugaaauguacuggauauccaauggcacggggaauaucgucucuaguguaaacaugguauccagauuacuauuaaacagauuuacaaugacucauagaagaccaacgauugaaaaggacguggacuuaggagcuggcacuagacacguaaaugcagagccggagacaccgaauauggauguaauuggugaaagaauuaaacggauuaaagaagaacacagcucuacguggcauuaugaugaugaaaauccauauaaaacuugggcguaucaugggucuuaugaggugaaagcuacaggcuccgcgucaaguaugaucaauggaguaguuaaguuguuaacuaaaccaugggauguaguccccaugguuacacaaauggcgaugacggacacuacgcccuucggucaacaacgaguauuuaaagaaaagguugacaccaggacgccaaggccaaugccuggcacgcguaagguuauggaaauaaccgcagaauggcucuggcgaacuuuaggacgaaacaagaaaccaagacuauguaccagggaagaguucaccaagaaaguuagaacgaaugcggcuaugggggcgguuuucacggaggaaaaccaaugggauagcgcacgcgcagcaguggaagacgaggaauuuuggaaguuagucgauagggaaagagaauugcacaaacuagguaaaugcgggucaugugucuauaacaugaugggcaaaagagaaaagaaacuuggggaauuuggaaaagcgaaagggaguagagcaaucugguacaugugguugggcgcacgguaccucgaguuugaagcucucgguuuccuaaaugaagaccauugguucagucgagaaaacuccuauucugguguagagggcgaaggauuacauaaacuggguuacauccuaagggacauuagcaagauacccgguggagcuauguaugcagaugauacugcagguugggauaccaggauaacugaagaugauuuacacaaugaagagaaaaucacucaacagauggacccugaacauagacaguuagccaacgcuauauucaaacuaaccuaccaaaauaaaguggugaaaguccaaaggccaacaccaaagggaacugugauggacauaauaagucgaaaagaucaaagaggcucaggacaaguagggacauaugguuuaaauacauucacaaacauggaagcacaacugguuaggcaaauggaaggagagggagugcuuagcaaagccgaucucgagaauccccauuuacucgaaaagaaaaucacucaauggcuagagacaaagggaguggaaagauugaaaagaauggcuaucucuggagaugauugcguaguaaaaccuauugaugauagauucgcaaaugcucucuuagcccuaaacgacaugggcaaaguucgaaaagacauaccucaauggcagccuucgaaaggauggcacgauuggcagcaaguaccauuuugcucccaucauuuucaugaauugauuaugaaagauggaagaaaguuaguuguaccauguagaccacaagaugaacuaauuggaagggcacgaauuucucaaggugcuggauggagccuuaaggaaaccgcguguuuagggaaggcuuaugcacaaauguggagccucauguacuuucacagaagagaucucagauuagcauccaacgcaauauguucggccguaccaguacacugggugccgaccagcagaaccacguggucuauccaugcucaucaccaauggaugaccacggaagacaugcuuacaguuuggaauagagucuggauagaggacaauccguggauggaagauaaaaccccaguuacaaccugggaagaugucccguacuuaggaaagcgagaagaucaauggugugguucauuaauaggucugacaucucgagcuacaugggcgcaaaacauucuaacagcaauucagcaggucagaucacuaauaggugaugaagaauuucuggacuacaugccuaguaugaaacgauuucguaaagaagaagaaucagaaggagccauuugguaa

SEQ ID NO: 23553 - RNA, 9873 nt, Artificial Sequence
  derived and/or modified CDS sequence (opt6) from DENV-3__DQ863638__SS-prME
acgucguuauguuuaaugaugauguuaccagcaacacuugcauuucauuuaacuagcagagacggggagccccgaaugauuguagguaaaaaugaacguggaaaaucauuacucuucaaaacugcguccggaaucaauauguguacauuaaucgcuauggaucugggcgaaaugugcgaugacacagugacauauaaaugcccccacauagcggaagucgaaccggaagauauagacugcuggugcaaucuaacuucaacguggguuacauaugguaccuguaaccaagcaggggagcaucgaagagauaaacguucaguagcuuuggcuccacaugucggaaugggauuagacaccagaacgcaaacauggauguccgccgaaggcgcuuggaggcaaguagaaaaaguagagacaugggcuuugagacacccggguuucacaauuuuggcauuauuccuagcgcauuacaucggaacgagucuaacacaaaaagucguuauauucauauuguugauauuaguaacaccaucaauggccaugcgguguguaggcgucgguaauagggauuuuguagaagguuuauccggugcaacauggguagauguuguauuagaacaugguggauguguuacaacaauggccaaaaacaaaccaacauuagacauagaauugcagaaaacagaagcaacucaacuugcaacacuuagaaaauuauguauagaagguaaaaucacaaacauaacuacagauucuagaugucccacucaaggggaagcaauccucccagaagaacaagaucaaaauuaugucuguaaacauacguauguggacagaggauggggaaacgguuguggguuguucggcaaaggcucgcugguaacuugugcaaaauuucaaugccuagaaagcauagaaggaaaaguaguucaacacgaaaauuuaaaauacacaguuauaauaacaguccacaccggggaucaacaucaagugggaaacgagacacaaggaguaacugcagaaauaacgccccaggcuucgaccguggaagcaauauuaccugaguauggaaccuuggguuuggaguguaguccacggacaggucuagacuuuaacgaaaugauccuacuaaccaugaaaaacaaagcauggauggugcaucgccagugguucuuugauuuaccuuuaccguggacaucuggagcgacgacugaaaccccuacauggaauaggaaagaauugcucgucacguuuaaaaacgcccacgccaagaaacaggaagucguuguccuaggaagucaagaaggugcaaugcauacagcgcucacuggugcgacagaaauccagaauaguggaggaacuagcauauuugccggacauuuaaaaugucggcugaaaauggacaaauuagaauuaaaagguaugaguuacgcuauguguuuaaacacguucgucuugaaaaaggagguuucugaaacacaacacggaaccauuuuaauuaagguagaauauaagggagaggaugcuccuugcaaaauuccuuuuucuacagaagauggacaaggcaaagcucacaauggacgacuuauaacugcuaaucccguuguuaccaagaaagaagaaccgguuaauauagaagcggaaccgccguuuggugaaucaaauaucguaauaggcaucggugauaaggcacuaaaaaucaauugguauaagaaagguucaaguaucggaaaaauguucgaggcaaccgcaagaggugcuagaagaauggcuauacuuggagauacagcaugggacuucgguucaguagggggugugcuuaauaguuuaggaaagaugguacaucaaaucuuuggaagcgcuuacacugcccuguuuucgggggucagcuggauaaugaaaauaggaauuggggugcugcuaacauggaucgguuuaaacuccaaaaauacaagcaugagcuuuaguugcauagcgaucgggauaauuacguuauaccuaggagccguugugcaagcggacauggggugcguaauaaacuggaaaggaaaagaauuaaaauguggaucgggaauauucguuacgaaugagguacauacauggacugaacaguauaaguuucaagccgacaguccaaaaaggcuggcaacggcuauagcgggggcaugggaaaacggaguauguggaauaagaucaacaaccagaauggagaaucuauuauggaaacaaauugcaaaugagcucaauuauauauugugggagaacaacauuaaacuuaccguaguaguaggagacauuauaggaguuuuagaacaggggaaacguacuuuaaccccucagccuauggaacugaaguauucauggaaaacuuggggcaaagcaaaaauaguaacugcagagacucaaaauucuaguuuuauaauagacggaccucacacuccugaauguccaagagcuagcagagcauggaauguaugggaaguugaggacuauggauuugguguguucaccacaaacauuuggcuaaaauugcgagaagaauauacgcaguugugugaccaucgcuuaaugagugcggcagugaaagacgaacgugcaguccacgccgauauggguuauuggaucgaaucucagaaaaauggcucuuggaaauuagaaaaagcaagucuuauugaaguaaaaacguguacuuggccuaaaagucauacuuuauggucuaacgguguguuggaaagcgacaugauaauuccaaaaagucuggcuggaccgauuagccaacauaaccauagaccaggguaccauacccaaacagcugguccauggcaccuaggaaaacuugaguuagacuucaacuauugugaggguacgacgguaguaauaacugaaaauuguggcacaagagguccaucguuaagaacaacgacugugucuggaaaauugauacacgaguggugcugucgaaguugcacuuuaccaccuuugagguauaugggcgaagauggauguugguauggaauggagauaagaccaauaaaugaaaaagaagagaacaugguuaagucgcuagcaucggccggaagcgggaagguagauaauuuuaccaugggauuucuauguuuagccauucuauuugaagaagucaugagggggaaauuugguaagaaacauaugauugcaggaguuuuucucacauuuuugcucuuauuaucgggucaaaucacauggagagacauggcacacacauuaaucaugauaggaucuaaugccagcgacagaauggguauggguguuacauauuuagcauuaauugccacguuuaagauacaaccuuuucuagcguuaggcuucuuuuugagaaagcuaaccagcagggaaaacuuuuuacuuggaguggguuuagcuauggccacuaccuuacaacuaccugaagauauugaacaaauggcaaauggcaucgcauugggguuaauggcgcuaaagcuaauaacucaauuugaaacauaucaauuguggacagcacucgugucguuaacguguucaaauacaauauuuacuuugaccgucgcauggagaacggcaacguugauuuuggccggcgucucucuacugcccguaugccaaaguuccuccaugagaaaaacggacugguuaccgauggcgguggcugcgauggguguaccuccgcuuccucuguuuauauucagccuuaaggacacuuuaaaacggagaucuuggccucuaaaugaggguguaauggcgguuggcuuagugaguaucuuagcaucgucauuauuaaggaacgauguaccaauggcugggcccuugguggcaggaggauuacuaauagcauguuacgugauaacaggaacaucugcagacuuaacaguagaaaaagcggcggaugucacuugggaggaagaagcggaacaaacuggugugucccauaaucuaaugaucacaguugaugaugacggaacuaugcguauaaaggacgaugagacugaaaauauauuaacgguacuguuaaagacugcacuacucauaguaagugggauauuuccuuauucgauuccugcaacgcuuuuaguauggcauacauggcaaaaacaaacccaaaggagcggagucuugugggauguaccaucaccacccgaaacgcaaaaagcugaguuggaagaaggagucuacagaauaaaacaacaaggcauauuuggaaaaacccaaguuggaguugggguucaaaaagaggguguauuucacacgauguggcaugugaccaggggugcaguacuaacgcacaacggaaaaagacuggagccgaacugggcuaguguuaagaaagaucucauaucuuacggagguggguggcgacugucggcacaguggcaaaaaggagaagaagugcaagucauugccgucgaaccggguaaaaaccccaaaaauuuucagacaaugccaggaauuuuucaaacaaccaccggagaaauuggugccauugcacucgacuuuaaacccgggacaaguggaucuccaauaauuaaccgugaaggaaaggugguaggacuauauggaaauggaguaguaacuaaaaacggaggauauguaucugguauagcacaaacuaacgcagagccagauggaccaacaccagaauuagaggaagaaauguucaagaaacgcaaucuuaccauaauggaucuucacccagguuccggaaaaacucgaaaguaccuaccugcaauuguuagggaggcaauuaagagacguuuacgaacucugauccuugcaccaacgcggguaguagcugcagaaauggaagaagcccuaaaagguuuaccuauucgcuaucaaacaaccgcuacuaaaucagaacauacaggcagagagauaguagaccuuaugugucaugccacauucacuaugcgacuacuuucaccggucagaguaccaaacuauaauuugauuauuauggacgaagcacacuucacugauccugcaucuauagcagcacguggauauauuucgaccagaguugguaugggagaagcugcagcaauuuucaugacagccacaccaccaggaacugccgacgccuuuccucaaaguaacgcaccuauucaagaugaagaacgagauauacccgaacgaucuuggaacagugguaacgaauggauaacugauuuugugggaaaaacugugugguuuguuccauccauaaaagcagguaaugauauagccaacugucuuaggaaaaauggaaagaaggugauacaauuaucuagaaaaacauuugauacugaguaucaaaagacaaagcuaaacgacugggacuuuguaguaacuacagacauuagcgaaaugggggcuaauuuuaaagcggaccgaguuauagauccccgccgaugcuuaaaacccguaauauuaacagauggacccgagcgcgucauacuggcaggaccuaugccgguaaccgcagcgucugcagcccagagaagaggacgugugggaaggaauccccaaaaggagaacgaucaguacauauuuagaggccaaccauuaaacaacgaugaagaucacgcucacuggacagaggcgaagauguuacuagauaauauuaauacgcccgaaggcauuauuccagccuuauuugaaccugaaagagagaaaagugcugcuauagacggagaauauagacuaaaaggagagucgaggaaaacuuuugucgaauuaaugcgaagaggagaucugccagucuggcucgcccacaaaguagccucggagggaaucaaguacacagaucguaaauggugcuucgauggugaacggaauaaucagauauuagaagaaaauauggauguugagauuuggacaaaagaaggagaaaagaagaaauuaagaccaagguggcuagaugcgcgaacauauucagauccucuagcacuuaaagaguuuaaagauuuugcagcagguagaaaaagcauugcauuggacuuggugacagaaauaggacgggugccaucgcaccuagcacauaggacaagaaaugcccuagauaaucuggucauguuacauaccuccgaacacggugguagggcauaucgacaugcaguagaggaacugccagaaacuauggaaacgcuacuuuuguuaggacuaaugauauugcucacaggaggugccauguuauucuuaauaagugguaaaggaauagguaagacauccaucggauuaauuugugugauagcaucguccggaauguuauggauggccgaugucccguuacaauggauagcuuccgcaaucguguuagaguucuuuaugaugguauuauugauuccugaaccagaaaaacaaagaacuccucaagauaaucaacuagcauauguugucauaggaauuuuaacgcuagcugcaaucguagcugcaaaugaaaugggccuauuggaaacgacaaagagagaccuagggaugucaaaagagccuggaguaguaucaccgacaagcuauuuagaugucgaucugcacccugcuagcgcauggacacuauaugcuguagccacaacggugauaacaccaauguugcggcauacuauugaaaauucgacagcaaauguuucacucgccgcuauugcaaaccaagccguaguuuuaauggggcuagacaaaggguggcccaucucaaaaauggacuugggagucccauuauuagcucuugguuguuauagucaagucaacccacuaacccuuacugccgccguauugcuccuagccacacacuaugccaucauagguccggguuuacaggcgaaggcuacucgagaagcucaaaagagaacagcagcgggcauaacaaagaaccccaccguugauggcauaaugacaauagaucucgauccuguaauauaugacaguaaguuugaaaaacaauuaggacaggucauguuauuaguguugugcgcggugcaacuucucuuaaugagaacgucaugggcauuaugcgaggcauuaacacuugccacgggccccauuacgacauuaugggagggaagcccugggaaauuuuggaauacgacgauagcaguaagcauggcgaacauauuucgcgguagcuauuuggcaggcgcugguuuagcauuuucaauuaugaaaagcguaggcacaggcaaaaggggaaccgguucacaaggugaaacucuaggugaaaaauggaagaagaaacucaaccaacuuaguagaaaggaguuugacuuauacaagaaaucaggcauaaccgaggucgauagaacagaggccaaagaaggccuaaaacguggugaaauaacacgacaugcgguaucaagggguagcgcaaaacuacaaugguucguugaaaggaacaugguuauaccagaaggucgagugaucgauuuaggcuguggaaggggagguuggucauauuacugcgcaggacucaaaaaggucacugaagugagaggauauacaaaaggagggccuggccaugaagaaccggugccaaugaguacauaugguuggaauauagugaaauuaaugucaggcaaagacguauucuauuuaccucccgaaaagugugauacgcucuuaugugauaucggcgaaucaucgcccucaccaacaguagaagagucgcguacaauaagaguccuuaaaaugguagaaccauggcuaaagaacaaccaauucugcauaaaaguguuaaacccuuacaugccaacaguuaucgaacaucucgaaaggcuacaacgaaaacaugguggaaugcucguaagaaauccucuaagucguaauuccacucaugaaauguacuggauaaguaacgguacgggaaauauuguguccagcguaaacaugguaaguagacuauuguugaacagguuuacaaugacacaucgaagacccaccauagaaaaagacguagauuuaggagcuggcacgagacauguuaacgcugagccagaaaccccaaauauggacgucauaggugaacguauaaaacggaucaaagaagaacacaauucaacauggcauuaugacgacgaaaacccauacaagacaugggcguaccaugggucauaugaaguuaaggccacaggcucugcuagcagcaugaucaauggaguuguaaaauuauuaacaaaaccuugggauguuguaccuaugguaauucaaauggcaaugacagauacgacacccuuuggacagcaaagaguauucaaagagaaaguagauacuagaacuccccguccuaugccuggaacuagaaaagucauggagauaacugccgaguggcuauggcggaccuuagguagaaacaagcggccacguuuauguacacgugaagaguuuaccaagaaaguacggacgaaugcagcaaugggagcggucuuuaccgaagaaaaucagugggauucugccagggcugcaguugaagaugaagaauuuuggaagcuaguggauagagagagggagcugcauaaguuagguaagugcggauccuguguauauaacaugaugggaaagagggagaagaaauuaggcgaauuuggaaaggcgaaaggaaguagggcgaucugguacaugugguuaggagcuagguaucuagaauuugaagcacuaggguucuuuaaugaagaucauugguuuucuagggaaaacuccuauaguggaguagaaggggaaggacuucacaaauuagguuauauauuacgugacauaagcaaaauuccagguggugcaauguacgcagaugacacugcagggugggauacgcggauuaccgaggacgauuuacacaacgaagagaaaaucacacaacagauggauccugaacauagacaauuggcuaaugcaauauuuaaacugacuuaucaaaauaaaguuguaaaaguccagagaccuaccccuaaaggcacuguaauggauauuauuucucgaaaagaucaaagaggaagcggucaaguggguacguacggauuaaacacguuuaccaauauggaagcccagcucguacgucagauggagggagaaggagucuuaucaaaagcggaccuugagaauccacaccucuuggagaagaaaauaacacaguggcuagaaacgaaagguguagaaagauugaaacgcauggcaauuagcggcgacgauugugugguaaagccaauagacgacagauuugccaacgcauuacuggcacuaaaugauaugggaaaagucagaaaggauaucccccaauggcaaccaucuaagggauggcacgacuggcagcagguucccuucugcucacaccauuuccaugaacuaauaaugaaagauggaagaaaacuuguugucccaugucgaccacaagacgagcugauaggacgagcgcgaauuuccagaggugcugguuggucacugaaggaaacagcaugccuaggaaaggcauacgcgcaaauguggucacucauguauuuccaccgacgcgaccuacgauuagcaagcaaugccauaugcuccgcaguaccaguacacuggguuccaacaucuagaacaacguggaguauucacgcacaucaucaauggaugacaacugaggauauguuaacaguuuggaauaggguauggaucgaggauaauccauggauggaagauaaaacucccgugacaacuugggaagauguaccauacuuagguaaaagggaagaucaauggugcggcagucuaauaggguugacaagccgugcuacuugggcacaaaauaucuuaacagcuauacaacagguaaggucccucauagggaaugaagaauuuuuagacuauaugccaucaaugaaacgguuuaagaaagaagaagaaagugagggagccauuugguag

SEQ ID NO: 23554 - RNA, 9873 nt, Artificial Sequence
  derived and/or modified CDS sequence (opt6) from DENV-3__KJ737430__SS-prME
acaagucuuugucuuaugaugauguuaccagcgacuuuagcauuucacuuaacgagucgagacggugagccccguaugauaguaggcaaaaaugaaagggguaaauccuugcuuuucaaaacggcaaguggaauaaauauguguacacugauagcuauggaccuaggugaaaugugcgaugauacaguuacuuacaaaugcccuuugauugcagaggucgaaccagaagacauagauuguugguguaauuuaacuucuaccugggucacauauggaaccuguaaccaagcaggagaacacagacgcgauaaaagaucaguugcacuagcaccgcaugugggaaugggacuagauacgaggacucaaaccuggaugagugcagaaggugcauggaggcaaguugagaaagucgaaacaugggccuuaagacauccuggcuuuacaauacuagcacuguuucuagcgcacuacauuggaaccagucucacucaaaaaguuguaauuuuuauccuacuaaugcuaguaacaccgagcauggccaugagauguguaggagucgguaacagggacuucguagaagguuuaaguggagcuacuuggguugacguaguucuagaacaugggggauguguuacaacuauggccaaaaauaaaccaacgcuggauaucgaguuacagaaaaccgaagcuacgcaacuagcaacucuaagaaaacuauguauugaagggaaaauaacaaauauaacgacagauucucgcugucccacacaaggggaagcgauacuaccagaagaacaagaucaaaauuauguauguaaacauacauacguagaccgagguugggguaauggguguggauuauuuggcaaagguaguuuagugacuugugcaaaauuccaaugccuugagagcauagaagguaaagucgugcagcaugagaacuuaaaauacaccguaauaauaacaguucauacaggugaucagcaucaaguaggaaacgauacgcaaggaguaacgguggaaaucacaccccaggccucaacgguugaggccauacuuccagaauauggcacauuaggcuuagaaugcagcccaagaacuggauuagauuucaaugaaaugauccuauuaaccaugaaaaauaaggcuuggaugguucaccgacaaugguuuuucgaucuuccacuuccauggacgucuggugcaacaacagaaacuccgacuuggaacagaaaagaguuacucgugacguuuaaaaacgcucaugccaagaaacaagagguaguggugcuaggaagucaagagggggcgaugcacacagccuugaccggugccacagaaauccaaaauagcggcgggacaaguauauuugccggccauuuaaaaugcagauuaaaaauggacaaauuagaacucaaagguaugucauaugcgaugugcuugaacacguucguacuuaagaaagaagucucagaaacacaacaugguacuaucuuaauaaaaguugaauauaaaggagaagacgccccgugcaaaaucccuuucagcacggaggauggucaagguaaagcucauaacggaagacugaucacugccaauccaguaguuaccaagaaagaagaaccaguuaauaucgaagcagaaccaccauucggugaaucgaauauaguaaucggcauaggugauaaagcucucaaaauaaauugguauaagaaagggucuucaauaggaaaaauguuugaagcaacagcacgaggagcucgccguauggccauucuaggugauaccgcaugggauuucggcucaguagguggcguuuuaaauagucuugguaaaaugguacaucaaauauuuggaucggcauauacagcacucuuuucuggggugucguggauaaugaaaauaggaaucgguguuuuauugaccuggauaggccuuaauucuaaaaauacaucaaugucauuuucauguaucgcuaucgggauaauuacacuauaucucggugcaguuguacaggcggacaugggcuguguaauaaauuggaaagggaaagagcucaaauguggaagugguauuuuugugacaaaugaaguucacacauggacagaacaauauaaauuucaggcggauucuccuaaacgccuugccacugcaauugcuggagcaugggaaaauggaguuugcgggauacgaucuacuacgaggauggaaaaccuacucuggaaacagauugcgaacgaacugaauuauauacucugggaaaacaauauaaaauuaacuguaguuguaggagauauaaucggaguccuggaacaaggaaaaagaaccuuaacuccucagccuauggaauuaaaauauaguuggaagaccugggguaaagcgaaaaucguaacagcagaaacccaaaacaguucauucauaauagacgguccuaauaccccagaaugcccuagcgccagcagagcguggaauguaugggaagucgaagacuacggguucgguguauuuacgacuaacauauggcucaaacugagggagguuuacacacaaucaugugaccacagacuaaugucugccgcuaucaaagaugaacgagcaguacaugcagauaugggcuauuggauagagucacagaaaaauggcagcuggaaacuugagaaagccucguuuauagaagucaaaacauguacauggccaaaaagccacacacuuuggucaaauggcguguuagaauccgacaugauuauccccaagagcuuggcgggcccaauaucacaacauaaucacagacccggcuaucauacucaaacggcagggcccuggcauuuagggaaacuagaauuagauuuuaacuacugcgagggcaccacugucguaauuaccgaaaauugugggacacgaggucccagcuuaagaacuacaacgguaagcgggaaauuaauacaugagugguguugccgcucguguacguugccaccauuacgguauaugggcgaggauggaugcugguauggcauggaaauaaggccgaucaaugagaaagaggaaaauaugguuaagagcuuagugucagcaggcucagggaaaguagauaacuuuacuauggguguucuauguuuagcuauccucuuugaagaagugaugcgggguaaauuuggaaagaaacacaugauagcaggcguacuauuuaccuuuguccuacuacuaaguggucaaauaacauggcgagauauggcccauacacuaauuaugauuggaucaaacgcaagcgaucguaugggaauggggguaacauauuuagcgcucauagcgacauucaaaauccaaccuuucuuagcuuuaggauucuuucuccgaaaacuaacaucuagagagaacuugcuacucgggguuggauuggcaauggcaacaacccuacagcuacccgaagacauagagcagauggcuaauggaauagcguugggguugauggcacucaaacugauaacucaguuugaaacauaccaacuauggaccgccuuaguaucacuuacaugcaguaauacgaucuucacucugacaguggcuuggaggacugcuacuuugauauuagcaggaguuucgcuguugccugucugucaaucuuccucuaugcgcaaaacugauugguugccgauggcuguugcagcaaugggaguaccaccauuaccucuauuuauauucucacuaaaagacacccuaaaacggcguaguuggccccuaaaugaggggguuauggccguugguuuaguaucuauacuagcaucaucgcuguuaagaaaugauguaccgauggcuggcccauuaguugcgggaggacugcuaauagcauguuacgugaucacaggaacaagugcagaccugacgguggaaaaagcagcugacguuacaugggaagaagaagcagaacaaacagggguaagccauaaucuaaugauuaccgucgacgacgaugguacgaugagaauaaaagaugaugaaaccgaaaacauucuuacaguuuuacugaaaacugccuuacuuauaguaagcggaauauucccguauuccaucccagccacacuauuaguauggcauacauggcaaaaacagacacaaagaaguggagucuugugggaugugccgaguccuccggagacccaaaaggcagaauuggaggaagguguguaucguauuaaacagcagggaauuuuuggcaaaacacaaguaggaguaggaguacaaaaagaagggguauuccauacuauguggcacgugacgagaggggccguccuaacgcacaaugguaaaagacuugaaccuaauugggcaucugugaagaaagauuuaauuucuuauggcgguggcuggagauuaagugcacaauggcaaaagggagaagaaguucaagucauugcgguugaaccaggcaaaaauccuaagaacuuucagaccaugccggguauauuucaaacuacaacuggugaaauuggggccaucgcgcuagauuuuaaaccagguacauccggaagccccauuaucaaucgugaaggaaaaguaguaggguuauacgguaacggaguugugacuaagaauggaggguacguaagcgggauugcucaaaccaacgcugagccugacggacccaccccagagcucgaggaagagauguuuaagaaaagaaauuuaacaauaauggaucuccaucccggaucaggcaaaacacgaaaguaccuuccagcuaucguuagagaggcuaucaaaagacguuugcggacgcuuauacucgcuccaacaagaguaguggccgcugaaauggaggaagcauuaaaaggguuaccuauaagauaucaaaccacggcaacgaaaagugaacauacaggacgagaaaucguagaucuaaugugccaugcuacuuuuacaaugcgacuucuuagcccaguacgagucccuaacuauaauuuaauuauaauggaugaagcacacuuuaccgaucccgcuucuauagcagcacggggauauauaucaacucgcguuggaaugggugaagcagcagccauuuucaugacggcgacuccaccugggacagcggaggcauucccacaaucaaacgccccaauacaagaugaagaaagagacaucccagaacgaagcuggaacuccgggaaugaguggauaacagauuuuguaggcaagacaguuugguucguaccuaguaucaaagcuggaaaugacauagccaauugucucaggaaaaaugggaagaaaguaauacagcuaagccgcaaaacauuugauacugaguaucaaaagacaaaacuuaacgauugggauuuuguuguaacaaccgauauaucagaaaugggggcgaauuuuaaggcagaucgaguuaucgauccccgacgauguuuaaaaccaguuauccuuacugacggaccagaacgaguaauauuagcaggcccuaugccagugaccgcagcaucggcagcacaaagaagaggccggguugguagaaauccucaaaaagaaaacgaucaauacaucuucacaggacaaccacuaaauaaugaugaggaccaugcucauuggacagaagccaaaaugcuacuagauaacauaaauacgccagaaggcauaauccccgcucuguucgagcccgaaagagaaaaaucggcagcaauagauggagaauauagacuaaaaggagaaucgaggaaaaccuuuguagaauugaugcggcggggagaucucccugucugguuggcucacaaaguugcaagcgaaggaauaaaauauacugauagaaagugguguuuugacggagagaggaauaaucaaauuuuagaagagaauauggacguagaaauauggacuaaagaaggagaaaggaagaaauuacggccacgcugguuggaugcgcgaacuuacuccgauccucuagccuuaaaggaauuuaaagacuucgcggcgggaagaaaaucgauugcacucgaccuagucacagaaauuggacggguaccuagucaucuagcacaccggacuagaaaugccuuggauaauuuaguaauguuacauacaucggaacauggagguagagcguaccgacaugcuguugaagaauuacccgagacgauggaaacgcuucugcugcuaggguuaaugauucuauugacagguggagccauguuauucuuaauuaguggcaaaggcauaggaaaaacaucuaucggacugauuugcgugauuguaagcucuggaauguuauggauggcugauguuccuuuacaauggauagcaucugcuauuguauuagaguucuuuaugauggugcuauugauaccggaaccagaaaaacaaagaacgccgcaagauaaucaauuagcguaugucguuauagggauacugacccuugcagcaauaguugcagcuaaugagaugggacuguuagaaacaacaaaaagagaucugggaaugagcaaggaaccaggaguaguaucaccuacaaguuaucuagaugucgaccuccauccugcuucugcauggacauuguacgcaguagcuacgacaguaauaacaccaauguuacgacauacaauugaaaauagcacggccaacguaagucuagcggcaauagcaaaucaggcuguagucuuaaugggauuagacaaaggcuggccaauuuccaaaauggauuuaggugucccauuacuugcucucgguuguuacucacaagugaauccccuuacacuaacugcagcaguacuuuuacuuguuacacacuaugcaauuaucggaccaggauuacaggcgaaagcuacucgugaagcacagaaaaggacggcggcggguaucaugaaaaauccaaccguggauggaauaaugacaauagaucuagacccuguuauauacgauaguaaguuugagaagcaauuaggccaagucaugcuccuaguccuaugugccguccaguuacuccuuaugcguacaucaugggcccuaugugaagcucugacgcucgcaacgggcccaauaacaacuuuaugggaaggaagcccgggaaaauucuggaacacaacgauugcagucuccauggcgaauaucuuucgaggaagcuaccucgcuggagccggauuagcauuuaguauuaugaagucaguagguaccggaaaaagagguacgggcucucagggugagacacuuggugaaaaauggaagaagaaauuaaaucagcugucaagaaaagaauuugaucuauauaagaaaucggggaucacggaggucgaccggacugaagcgaaagagggccucaaaagaggggaaacaacacaccaugcaguaaguagagguagcgcaaaguuacaaugguucguagaaaggaauauggugaucccagaaggacguguuauugauuugggaugcggaaggggaggcugguccuauuauugugcggguuugaagaaggugacugaaguacgaggauauacuaagggcggacccggacaugaggaaccuguuccaaugaguacauauggauggaauauaguaaaauuaaugaguggaaaagaugucuucuaucugccuccugagaaaugcgauacgcuacuaugcgacaucggggaaucaaguccuagcccaaccguugaagaaagcagaaccaucaggguccuaaaaaugguggaacccuggcucaaaaauaaccaauucugcauaaaaguccuaaacccauauaugccaacuguaauagaacacuuggaaagacuccaaagaaaauauggggguauguugguaagaaauccguuaucaaggaauaguacucaugaaauguauuggauaucaaauggaacaggaaacaucgugagcuccguaaauaugguuagucgcuuauuacucaauagauuuaccaugacucacaggcgaccuacaauagaaaaggauguagacuuaggcgcuggaacgagacaugugaacgcugaacccgaaacuccaaauauggauguuaucggagaaagaauaaaacgaauuaaagaagaacauucuaguacauggcauuacgaugaugaaaacccauauaaaaccugggcguaucacggcucuuacgaaguuaaagcuacaggcucggccucuucaaugauuaauggagucguaaaacuucuaacgaagccuugggacguaguuccuaugguuauacaaauggcgaugacugacacaacaccauuuggucaacaaagaguauuuaaagaaaagguagacacacgaacaccucguccgaugccuggaacuaggaaggugauggaaauaacugcagaauggcucuggagaacacuuggucgaaauaagcgaccacgacuaugcacaagagaagaauuuacgaagaaaguacguacaaacgcagcgaugggugcaguauucacugaagaaaaccaaugggacuccgcgcgugccgcuguagaagacgaagaguuuuggaaacuuguggaucgggaaagagaauugcauaaauuagggaaaugugguucuugcguuuacaacaugauggggaaaagggagaagaaauuaggagaauuuggaaaggcaaaaggcucacgcgcaauuugguauauguggcucggagcuagauaucuugaauuugaagcauuggguuuucuaaacgaagaccauugguucuccagagaaaacucauauucggggguagagggcgaaggucuucauaaacuaggauacauauuacgugauauauccaaaauaccugguggagcaauguacgcagacgauacagcugguugggacacuagaauaacggaggaugaucuccacaaugaagagaaaaucacacaacaaauggauccggaacauagacaauuggcaaaugcgauauuuaaauuaaccuaccaaaauaaggucgucaaagugcagcgccccacucccaaagguaccguuauggauaucaucucacggaaagaccagcgaggcagcggacagguugggacuuacggacucaauacuuucacaaacauggaggcacagcuaguccgccaaauggagggcgagggcguacucagcaaagcugauuuagaaaauccgcaucuacuagagaagaaaauuacacaauggcuugaaacaaaagguguagaacgccuuaagcgcauggcaauauccggcgaugacuguguaguaaaaccaauagaugaucgauucgcuaacgcacuccuagcacuaaaugacauggguaaaguucguaaagauauaccacaauggcaaccgucuaaagguuggcaugauuggcaacaaguacccuucuguagccaccauuuucaugaauugauuaugaaggaugggaggaaauuaguuguaccguguagaccucaagaugaacuaauugguagagcuaggauaagccaaggugcagguuggucguuaaaagaaacugcuugcuuggguaaggcguaugcacaaauguggaguuugauguauuuccauaggcgggaucuuagacuagccucgaaugcuaucuguucagcuguaccuguucauugggucccgacaucaagaacaacuuggaguauacaugcgcaccaucaauggaugacaaccgaggacauguuaacgguuuggaacaggguauggauugaggacaacccauggauggaggacaaaacgccaguuaccacuugggaggaugucccguaucuaggaaaaagagaagaccaauggugugguagcuuaauuggauuaacaaguagagcuacaugggcacaaaauauauugacagcuauacagcaagucagauccuugaucggugaugaggaguucuuagacuauaugccgaguaugaaaagauuucgaaaagaagaagaaagcgaaggugccaucugguag

SEQ ID NO: 23555 - RNA, 9873 nt, Artificial Sequence
  derived and/or modified CDS sequence (opt6) from DENV-3__AY858040__SS-prME
accucacuaugccuaaugaugauguuaccggcuacccuugcguuucaccuuacaucgagagacggggaacccagaaugaucguagggaaaaacgaacgaggcaaaagucugcuguuuaaaacagcaucagguaucaauauguguacccuaauagcgauggauuuaggagaaaugugugaugacacugugacuuauaaauguccccuaauaacagaaguggaacccgaagauauagauuguugguguaaucuaaccaguacuugggugacauacgguacuuguaaccaagcuggggaacaucgaagagacaaaagaucgguggcuuuagcgccucacgucggaaugggucuagauacacgugcacaaacauggaugucagcagaaggagcguggcggcaaguagaaaaagucgaaaccugggccuuucgacacccuggguucacaauacuagcacuauucuuggcucauuauaucgguacaucccuaacccaaaaaguugugauauucauauuauugaugcuugugacgccgaguaugacaaugcgcugugucggaguuggaaaucgcgacuuuguagaaggcuuaaguggcgcaacauggguagacguaguauuagaacauggcgguugcgugaccaccauggcuaaaaauaaaccaaccuuagacauagaauugcagaaaacugaagcuacacaauuagccacauuaagaaaacuguguauagaaggcaaaauaaccaacgugaccacugacagucgauguccaacccaaggugaggcaauccuaccagaagaacaggaccaaaauuauguauguaaacauacauacguggaucguggauggggaaauggauguggccuauuuggaaaaggcucucuuguuacaugugccaaauuucagugccuagaacuaauagaggggaaaguaguccagcaugagaaccuuaaauauacaguuaucauaacuguucauacuggggaucaacaccaagugggaaaugaaacucagggagucacagcagaaaucaccccgcaggcaucaacgguggaggcaauccuacccgaauauggaacgcuaggucuagaaugcucaccaagaacaggauuagacuuuaacgaaaugauauuacuaacaaugaaaaauaaagcauggaugguacaccggcaaugguucuuugacuuaccauugcccuggacgucuggggcgacuacugaaacgccaacguggaauaagaaagaacuguuggugacauuuaaaaacgcccaugccaagaaacaagaaguugucguacuagguagucaagagggugcgaugcauaccgcauuaaccggcgcaacagaaauccagacgagugguggaacaucuauauuugccggccauuugaaauguaggcuaaaaauggacaaauuggagcucaaaggcaugagcuaugcaauguguucuaaugcauuuguacuaaagaaagaaguuagcgaaacacaacauggaacaauucucaucaaaguugaauacaaaggagaagaugcaccaugcaaaauccccuuuucaacagaggacggccaaggcaaagcacauaauggccgccuaauuacagcaaaccccguaguuaccaagaaagaagaaccagucaacaucgaggccgagcccccuuuuggagaaucaaauaucauuauuggaauuggggacaaagcacuuaaaauuaauugguacaagaaaggauccaguaucggcaaaauguuugaagcaaccgcaagaggggcacgaaggauggcaauauuaggggacaccgccugggauuucggauccguaggugggguauuaaauucuuuagggaaaaugguucaccaaauuuuuggaagugcauauacugcacuuuucuccggaguaucauggauaaugaaaauuggaauugggguauuauuaacauggauaggacuaaauagcaaaaacacaucuaugucauucagcuguaucgugauaggcauaauuacucuauauuuaggugccguuguccaagcagacaugggcugcguaauaaacuggaaaggcaaagaauuaaaauguggcucuggcauuuuuguuaccaacgaaguucacaccuggaccgaacaauauaaauuucaagccgauagcccgaaaagauuagcgacugcuauagcaggagcaugggaaaacggagucugcggaauuaggaguacaacgcgaauggaaaauuuacuauggaaacaaauagcgaaugaacuuaauuauauacuaugggaaaauaauauuaaacuaacggucguaguaggcgauaucauagggguauuagagcaagguaaacgaacacuaacgccccaacccauggaauuaaaauauucuuggaaaacuuggggaaaagcaaaaauagucacagcggaaaagcaaaauucaucauucauuauagauggaccaaauacuccugaaugcccaaaugcaucgagggcguggaaugucugggaaguugaagauuacgguuucggaguauuuacaacgaauauaugguuaaaguuaagagaaauguacacacaauuaugcgaccauaggcucaugucggcggcgguuaaagacgaacgagcaguucaugcagauaugggguacuggauagagucccagaaaaaugguaguuggaaacucgagaaagcuagucucauagaaguaaaaaccugcacauggcccaaaagucauacucuuuggucaaacggcguauuagaaagcgauaugauuauacccaaaaguuuagcgggcccaauaucucaacauaacuaccgaccaggcuaucauacacaaacggcugggccauggcaucuaggaaaacucgagcucgacuuuaauuacugugaagggaccacagucgucauaacggaaaacugugguacucgaggaccuucuuuacguacaacgacagugucagguaaauugauucacgaaugguguugucgaagcugcaccuuaccuccacuaagguacaugggugaagacgguuguugguacggaauggaaauacggccaauuaacgagaaggaagaaaauaugguaaaaucccugguuucagcuggcagcggaaaaguagauaacuucacgaugggaguacuauguuuggcgauucuguuugaagaagugaugaggggaaaauuuggcaaaaagcauaugauagccggagucuuguucaccuucguucuucuucuaagcgggcaaauaaccuggcgagauauggcucgaacauugauaaugauaggcucaaacgcaucugaucguaugggaaugggagucacauacuuagcccugaucgcuaccuuuaaaauacaacccuuucuagcgcuaggauucuuuuugagaaaauuaacuucucgcgaaaaucuucuacuugguguaggcuuggcuauggcgaccacacuucaacucccagaagacauugaacaaauggcuaauggaauagcauuaggcuugauggcuuuaaaguugauaacacaauuugaaacguaucaacucuggacugcccuaguaucguuaaugugcucgaauacgaucuucacacuuacgguagcauggagaacagcaacgcucauucucgcuggaauuucuuugaugccaguaugucaaucgucaucaaugagaaaaaccgauugguuaccaaugacaguggcagcuauggguguaccaccucuaccacuauucauuuucucauugaaagacacauugaaaaggaggaguuggccccuaaaugagggaguaauggccguaggccucguuucuauuuuagcaucaucgcuacugcgaaacgacguaccaauggcuggaccguuaguagcugggggauuguuaauagcaugcuauguuauuacagguacaucugcagaucucacaguugagaaagcggcagaugucacuugggaggaagaggcagagcagacgggugucagucacaaucugaugaucacgguagacgaugaugggacuaugagaauuaaagaugaugagacggaaaauauucuaacaguuuuguuaaagacagcacuccugauuguuaguggaauauuuccauauaguauaccggcaacgcucuuaguauggcacacauggcagaaacaaacccaaagaucagggguauugugggauguacccaguccaccugaaacacaaaaagcagaauuagaagaagguguguaucgaauaaaacaacaagguaucuucgguaaaacgcaaguuggcguaggagugcagaaagagggcguuuuccauacgauguggcauguuacaagaggggcaguguugacguacaacgguaaacgauuagaacccaauugggcaucagucaagaaagaucuuauaagcuaugguggcggguggcgacuuucugccuacuggcaaaaaggugaggaaguacaagucaucgcgguagaaccggguaaaaaucccaaaaauuuucagacaaugccugguauuuuucaaacaacaacaggggaaaucggggcaauugcacuagauuuuaaacccggaacauccggaucaccuauuaucaaucgagaaggaaaaguaguaggacucuauggcaauggaguggugacuaaaaauggcggguauguaagugggaucgcacagaccaaugcagaaccugauggaccgacaccagaacuagaagaagaaauguuuaaaaagaggaaucugacaauuauggauuugcauccagguucagguaaaacuaggaaauaucugccggcaauaguacgagaagcuauuaagcguagauuacgcacguuaauacuggcuccaacaagagucguggccgcggagauggaggaagcacuuaagggacugccuguaagauaucagacuaccgcaacaaaaagcgaacauacagggaaggaaauuguggauuuaaugugucacgccacauucacuaugagacuacuaaguccgguaagaguaccuaauuacaaccuuauaauuauggaugaagcucacuucaccgaccccgccagcauugcugcaagaggauacauauccacucgcguaggaaugggggaagccgcugcgauauuuaugacagcaacaccacccggaacagccgacgcauuuccgcaaagcaaugcuccuauacaagacgaagaacgagacauaccagaacguaguuggaacucaggcaaugacuggauaaccgacuuugcagguaaaacuguaugguuuguaccaagcauuaaggcuggaaacgauauagcuaacugucuuaggaagaaugguaagaaaguaauacaauuaucucgaaaaacuuuugauacagaauaccagaaaaccaaacuuaaugacugggauuucguuguaacaacagauaucucagaaaugggugcaaauuucaaggccgaucgcgucaucgacccucgaagaugccuuaaaccaguuauccuaacagacgguccggaacgaguaauccuggcaggaccgaugcccguaacaguagcuuccgcugcacagcgucgagguaggguaggaagaaacccacaaaaggagaacgaucaauauauuuucacaggccaaccucuaaauaaugaugaggaccaugcucauuggacugaagccaaaaugcuauuagauaacauuaauacacccgaagggauuauaccggcguuauucgagccggaaagagaaaaaucggcggccauagauggugaauaccgaccaaaaggagaaucucguaagaccuucguagaacugaugcgacggggagaucuuccggucugguuagcucauaaaguagcuucugagggcauaaaguauaccgaucguaaaugguguuuugauggagaaaggaauaaucaaauacuagaagaaaauauggacguagaaaucuggacgaaagaaggugagaaaaagaaacugagaccccgcuggcuagaugcacgaacguauagcgauccuuuagcacuaaaggaauuuaaggauuucgcugcaggaaggaaaucuauagcacuagaccugguaacagaaauuggacguguaccgucccaccuggcucacagaacuagaaacgcauuagauaacuugguaaugcuccauaccucagaacaugggggcagggcauauaggcacgcuguggaagaauuacccgaaacuauggaaacucucuuacuccuaggucugaugauacuauuaacuggcggugcuaugcucuuuuugauaaguggaaaaggagucggaaaaacgaguauaggauugaucuguguaguagccagcucuggcauguuguggauggcugacaucccauugcaauggauagcaagcgcuauuguguuagaguucuuuaugauggugcuacucaucccagaaccagaaaaacaacguacaccacaagacaaucagcuagcauauguaguaaucggcauacuuacacucgcagcaauaguggccgcgaaugaaaugggccuauuagagacaacaaaaagagaucucggaaugucuaaagaaccaggaguuguuagcccaacgagcuaucuugauguugauuugcaucccgcgucugcuuggacguuauacgcuguagcuacuacagucauuacgccgaugcuuagacauaccaucgaaaauucaacagcaaaugugaguuuggcugcaauagcuaaccaagcagucguauuaauggguuuggacaaaggcuggcccauaucaaagauggaucucgggguaccacuuuuagcguuaggcuguuacucucaggugaacccgcuuacuuuaacagcagccguuuuauuacucguaacacacuaugcuauuaucggcccuggucuucaagcuaaagcuacucgcgaggcgcagaaaagaacagccgccggcauaaugaaaaacccuacaguugauggaauaaugacuauugacuuagauccgguaauuuaugauucgaaauuugaaaaacaacuaggacaaguaaugcuauuaguacucugugcaguucaauuacuucuuaugagaacuucaugggcguuuugcgaagcauuaacauuagcgacaggaccaauaacaacauugugggaagguucaccaggaaaauuuuggaacacuacgauagccguauccauggcaaauauuuucagaggcagcuaucucgccggagcaggcuuagcguucaguauaaugaaauccguaggaaccggcaaaaggggaacugguagccaaggagaaacucucggugaaaaauggaagaagaaacugaaucaacuauccagaaaagaauuugaucuuuacaagaaaagugggaucacagagguagauagaacugaagcaaaagaaggcuuaaaaagaggagaaaucacucaucacgcagugucccggggcucugcuaaacuacaaugguuuguagaaagaaacauggucauuccagaaggucgcguaauagaucuaggguguggacgaggcggcuggaguuauuauugugcgggucuaaagaaaguuaccgaaguccgaggcuacaccaaaggaggaccgggacaugaagaaccagucccuaugaguacguaugguuggaauauugucaagcucaugucggguaaagauguuuucuaucuacccccugaaaaaugcgacacucuuuuaugugacauuggggagucaucacccaguccaacggucgaagaaagcagaacaauaagaguauuaaaaaugguagagccauggcucaaaaauaaccaauucuguauaaaaguccuaaaucccuauaugccgacgguuauagaacauuuagagcgacuucagagaaaacacggaggaaugcuggugcgaaacccacugucccguaauuccacacacgaaauguacuggauaucgaauggcacaggaaauauagugagcuccguaaacaugguuucaagauuguugcuuaauagauuuaccaugacauauagacggcccacgauagagaaagauguagaucuaggcgcuggaacgcgucacguuaaugcugaaccagaaacuccgaauauggacguuauaggugaacgcauacgccgaauaaaagaagaacacucaucaacauggcauuaugacgaugagaacccauacaaaacaugggcuuaucacggaaguuaugaagugaaagccacaggaucugcgucuucaaugaucaaugguguuguuaaguuacuuaccaaaccaugggaugucgugccaacaguaacacaaauggcuaugacggauacuacaccuuucggacagcaacggguauucaaagagaaagucgauacaaggacgcccaaaccaaugccaggaacuagaaaggucauggagaucacugcagaaugguuauggagaacgcuaggcaggaauaagcgaccacgguuauguacacgcgaagaguuuacaaagaagguacgaacuaacgcagcaaugggugcggucuuuacagaggagaaucaaugggauucugcccgagccgccguggaagacgaagaauuuuggaaauugguugauagagaaagagaacuccacaaacuugguaagugcgguaguugcgucuauaauaugauggggaaacgggagaagaaacuuggugaguucggaaaagccaaagggagccgcgcaauaugguauauguggcucggagcaagauacuuagaauuugaagcguuaggguuucuuaacgaggaucacugguuuucuagagaaaauaguuacucuggaguagaaggugaaggucuacacaaauuggguuauauauuacgggacauaucuaagauaccgggaggcgcuauguaugcggaugauacggcggguugggauacacguauaacagaagaugauuuacacaacgaggagaaaauaacccagcagauggagccugaacaccggcaacuggcaaacgcgaucuuuaaauuaaccuaccagaauaaaguagucaaaguccaaagacccacaccuaaaggcaccgugauggauauaaucucucgaaaagaucaacguggcuccggacaaguugguacauauggcuugaauacguuuacgaacauggaagcccaauuaauccgccaaauggagggugaggaugugcuuagcaaaacagaucuagaaaacccccaucuacuagagaagaaaauuacucagugguuggaaacgaaaggaguagaacgccuuaaacggauggcaauaucaggagaugacuguguagugaaaccaauagacgacagauuugcaaacgcacucuuggcguugaacgacaugggaaaagucaggaaggacauaccccaauggcagccaaguaaagguuggcaugacuggcagcagguaccauuuugcagucaccacuuucaugaacuuauuaugaaagauggccguaaacuuguaguuccauguagaccccaagacgaacuaaucggaagggcaaggauaucccaaggugcgggauggucuuugaaggaaaccgcuugcuuaggcaaggcuuaugcucagaugugggcgcugauguacuuucaccgaagagacuuaaggcuagccagcaaugcaauauguucagcaguaccaguacacuggguaccaacgucacgaaccacguggucaauacacgcacaccaucaauggaugacuaccgaagacauguuaacaguauggaaucgugucuggaucgaagacaauccuuggauggaagauaaaacgcccguaacaacuugggaagauguaccauacuuggggaaaagggaagaccaguggugugggucucuaauaggacucacaaguagagcaacaugggcgcagaauauacuaacagcuauacaacagguaaggucgcuaaucgggaaugaagaauuuuuggauuauaugccgucaaugaaacguuuccgaaaggaggaggaaucggaaggagccauaugguga

SEQ ID NO: 23556 - RNA, 9873 nt, Artificial Sequence
  derived and/or modified CDS sequence (opt6) from DENV-3__AY858041__SS-prME
acuuccuugugucuuaugaugauguuacccgcuacucucgcauuucaccucacaaguagggacggggaacccaggaugaucguagggaaaaacgaacgaggaaaaucauuacucuucaaaacggcgaguggaauaaacaugugcacucucauagcaauggacuuaggggaaaugugcgacgauacagugacguauaaaugcccucuaauuacugaaguggaacccgaagacauugacugcugguguaaucugacaucaacauggguuacguaugguacuuguaaccaagccggggagcacaggcgagacaagaggucaguagcccuugccccacauguagguaugggauuagauacuagagcccaaaccuggaugucagcagaaggugcauggagacaggucgaaaaaguagaaacgugggcauuccgucauccaggguucacgauucuugcgcuauuccuugcgcacuacauuggaacgaguuuaacacaaaaagucguaauuuucaucuuacuuaugcuaguuacuccaagcaugaccaugcgcuguguagguguaggaaacagagauuuuguagaaggacuaagcggggcaacuuggguugauguagugcuugaacacggaggauguguaaccacaauggcuaaaaauaaacccacgcuagauauugaauuacagaaaacugaagcaacacaauuagcaacacuccgcaaauuauguauagagggaaaaauuacaaacguaacaacagacagcagauguccaacucaaggggaggcuauucuaccagaggaacaggaucagaacuacguuuguaaacacacguacguugaucgugggugggggaaugguugcggccuuuucgguaaagguagcuuagucacaugugccaaauuucagugccuugaacugauagaagguaaaguuguacaacaugagaacuuaaaauauacaguuaucauaaccgugcacacaggugaccagcaucaaguaggaaaugagacgcagggcgugacagcugagauaacaccacaagcuaguacuguugaagcuauacuacccgaguaugguacucuaggacuggaauguucaccucguacgggacuagauuuuaaugagaugauucuauuaacgaugaaaaacaaagcauggaugguacauaggcaaugguuuuucgaucuaccacugccuuggacuuccggagcgaccacggagacacccacauggaauaagaaagaacuccuagugacuuucaaaaaugcucaugcuaagaaacaggaaguuguuguucucggaucacaggaaggagcgaugcacacagcuuuaacaggugcgacagaaauucaaacaucaggaggaaccucaaucuucgcaggucauuuaaaauguagauuaaaaauggacaaauuagagcucaaaggaaugucauaugcaauguguagcaacgcuuucguacuuaagaaagaaguguccgagacacaacauggcacgauuuuaauaaaaguugaguauaaaggugaggacgccccuuguaaaauaccuuucuccacggaagacggacaaggccaagcacacaaugguagauuaaucacagcaaacccaguggugaccaagaaagaagaaccgguuaacauugaagcagagucaccguucggagaaagcaacauaauaauuggaaucggagauaaagcgcuaaaaaucaauugguauaagaaaggaucuagcauagguaaaauguucgaagcaacugcaaggggugcaagaaggauggccauuuuaggagauaccgcuugggauuucggcagugucgggggaguauuaaacagccucgggaaaaugguucaccagaucuucggauccgcuuauaccgccuuguuuagcggagugucguggauaaugaaaauuggcauugguguucucuuaacauggauuggacuaaauaguaaaaauacaagcaugaguuucucauguaucguaauagguauaauaaccuuauauuuaggugcaguaguacaagccgacaugggcugcguaauaaacuggaaagguaaagaacuaaaauguggaagcggcauauucguaaccaacgagguucauaccuggacagagcaauauaaauuucaagcagauucuccaaaaagauuagccacugccauagcuggagccugggaaaaugggguaugugguauacggagcaccacccgcauggaaaaucuauuguggaaacaaauagcaaaugaauuaaauuauauacuuugggaaaacaauauaaaacugacaguaguugugggagauauuauaggcguauuagagcaaggaaaacgcacauuaaccccgcaaccaauggaacucaaauauaguuggaaaacauggggaaaggcaaaaaucguaacagcagaaauacaaaauaguucauucauaaucgauggacccaacacaccagaaugucccaacgccagucgugcauggaauguuugggagguggaggauuaugguuucggagucuucacgaccaauaucugguuaaaauuaagggaaauguauacacaacuaugugaccaucgucucaugucggcggcuguaaaagaugaacgggcaguacacgcugauaugggcuacuggauugaaagucagaaaaacggcucauggaaacuggagaaagcaucucuuauagaagucaaaacaugcacuuggccaaagagucacacauuauggucgaauggaguacuagaauccgauaugaucauaccaaagagucuagcuggaccaauaucucaacauaacuaucgcccggguuaccacacgcagacagccggaccauggcauuuaggaaaacuugagcuagacuucaauuacugugaagguaccaccgucguuaucacugaaaauugcggaacaagaggaccgagccucaggacaacuacagugagugggaaacuuauacaugaauggugcugcagaucgugcacauugcccccauugagauauaugggagaugaugguuguugguaugguauggagauaagaccuauuaaugaaaaggaggaaaauauggucaaaaguuuagugagugcuggaagcggaaaaguugauaauuuuaccauggguguauuaugucuagcaauacuauuugaggaagucaugagggguaaguuugggaagaaacacaugauugcaggaguauuguuuauguuuguguuacuacuaucaggucaaaucaccuggcgcgacauggcaagaacacuaaucaugauagguuccaaugcgucagacagaauggggauggggguuacuuacuuggcacucauagcaacauuuaaaauccaaccuuuucuugcacuaggguuuuucuuacgaaaauuaacuagcagagaaaacuuacuguuaggaguuggucuagcgauggcaaccacauuacaacucccagaagauaucgaacaaauggcaaacgguauagcauugggauuaauggcguuaaaauugaucacucaauuugaaacuuaccagcuauggacagcacugguuucacuuacguguaguaacacaauauucacguuaacaguugcuuggaggacagcgacacuuauauuagcaggcauaucgcucuugccgguuugucaaucuucgaguaugcgaaaaacugauuggcuuccaaugacaguagcugcaaugggaguacccccacuaccgcuauucauauuuucauuaaaagauacauuaaaaaggcguucauggccgcuaaacgaggggguuauggcuguuggacuggucagcauacuagccucaagucuguuaagaaacgacgucccuauggcaggaccgcuaguagcaggaggacuuuuaauugcaugcuacguaauuacaggaaccucagcugaucuuacgguagagaaagcagccgaugucacaugggaagaggaagccgagcaaacugguguaagccauaaucuaaugauuacagucgacgacgacgguaccaugcggauaaaagaugaugaaacugaaaacauuuuaacgguuuuguugaaaacagcucucuuaauaguaaguggcauauucccauacaguaucccagcgacauuauugguguggcacacuuggcaaaaacaaacucaaagaagcgguguauuaugggauguaccuucuccuccggaaacucaaaaagccgaguuagaagaaggcguauauagaaucaaacaacaaggaaucuucggaaaaacacaaguagggguagggguccaaaaagagggcgucuuccauacgauguggcacgugacaagaggcgcuguacucaccuauaacggaaaacggcuugagccaaacugggccaguguuaagaaagauuuaauaaguuacggaggaggcuggagauuaagugcucaauggaagaagggagaggaaguacaaguaauagcaguggaacccggcaaaaaucccaagaauuuccagacaaugccagguauuuuccaaacuacaacaggugaaauaggagcgauagcccucgacuuuaaacccggcacgagcggaucuccuauaauuaauagagaaggcaaagucguagguuuauacgguaauggugucgucacuaagaaugguggauauguguccggaauagcgcagaccaaugccgaaccagacgguccaacucccgaauuggaagaagaaauguuuaagaaacguaaucuaaccauaauggaccuucauccugggucagguaaaacacgaaaauaccuuccagcgauaguacgggaggcaauuaaacgacgccugagaaccuuaauucuagcaccuacuagagucguagcggccgaaauggaggaggcuuugaaaggacuaccuauacgauaccaaaccaccgcgacaaagucugaacauacgggaaaagaaaucguggauuuaaugugucacgcaaccuuuacaaugcgguuacuaucuccgguacgaguuccaaacuauaauuuaauuauuauggacgaggcacacuuuaccgacccggcuucaauagcagcuagaggguauauuucuacucgugucggcaugggagaagcugcagccauauucaugacggccaccccgccaggaacugcggaugcuuucccacagucaaacgcgccaauccaagaugaagaaagggauauuccggaacguaguuggaacagugguaaugacuggauuacugacuucgcugggaaaacagucugguucguaccaucgaucaaagcaggaaacgauaucgcaaauugcuuacggaaaaaugggaagaaaguuauacagcugucacguaagacauuugauacugaauaucaaaagacaaagcucaacgauugggauuuuguuguaacgacagacaucucagaaaugggagcaaacuucaaagcugacagagucauagauccaagaagaugucucaaaccuguaauauuaacugauggcccagagcguguaauucuugcaggacccaugccgguaacaguggcaagugcggcucaaagaagaggaagagugggacgaaauccucaaaaggaaaaugaccaauauauuuuuaccggacaaccucuaaauaacgaugaagaccacgcacauuggacugaggccaagaugcuguuagauaauauuaauacacccgaagggauaauaccggcguuauuugaacccgagagagagaaaucagcggcgauagauggugaauaccgauuaaaaggcgagucccguaagacuuuuguagaguuaaugcggagaggagacuuaccugucuggcuagcgcacaagguagcaagcgagggaaucaaauauacagauagaaaguggugcuuugacggcgaacgcaauaaccagauccuggaggaaaacauggauguggagauauggacgaaagaaggcgagaagaagaaauugagaccuagauggcuggacgcaagaacauauagugacccauuagcacuaaaggaauuuaaagauuuugcggcaggucguaaaucaauagcucuagacuuagugacagaaaucggacguguuccaagucauuuagcucacagaacuagaaaugcucucgacaaccuaguaaugcuacauacaucugagcacggugggcgcgcguaucgacacgcaguagaagaacugccagaaacaauggaaacucuacuucuacuuggauugaugauacuucucacaggcggugcaaugcuguucuugauaucagguaaaggaguaggaaaaacaaguauaggacuaauauguguaguagccagcagcggaaugcucuggauggccgauauaccauugcaguggaucgcuagcgcuaucguacucgaguucuuuaugaugguucuccuaauaccugagccggaaaaacaaagaacaccccaagacaaccaacuagcauauguugugauuggaauauuaacauuagcggcaauuguagcagcaaaugagaugggacuauuagaaacaaccaaaagagaucuagggaugucaaaagagcccggaguaguuucaaguacuucauaucuagauguugacuuacauccugcaagugcauggaccuuauacgcaguagcgacaacuguaauuaccccaauguugaggcacaccauugaaaauaguaccgcuaauguuagcuuagcagcgauagcaaaccaagcagugguacugaugggauuggacaaaggauggccaauaucuaaaauggaucuaggagucccacuuuuggcucugggcugcuacucgcaaguuaauccccuaacauuaaccgcagcaguacuacuauuagucacgcacuaugccauaauagguccaggacuacaagccaaggcaacuagggaagcacagaaacguacugcggcugguauuaugaaaaauccuacagucgaugguauuaugacaauugauuuagacccagucauuuacgacucgaaguuugagaaacaacugggccaaguaauguuacuuguguugugcgcaguacaacuacuacugaugcgaaccucgugggcuuuuugcgaggcauugacguuagccaccgguccuauaacuacucuaugggaaggaucuccuggcaaauuuuggaacacuacaauugcggucaguauggccaauauuuuucgugguucuuaucuugccggugcuggacuagcauuuuccauuaugaaauccguaggcacgggcaaacgugguacaggaucacagggcgaaacauuaggugaaaaauggaagaagaaguuaaaucaacuuucgaggaaagaguucgaucucuauaagaaaucuggaaucacugaaguagacagaaccgaagcaaaagaaggucuaaaacgaggagaaauuacgcaucacgcugucaguagaggcucugccaagcugcaaugguuuguagaaagaaauaugguaaucccagaagggcgcguaauagaucuaggcugcggcagaggagguuggaguuacuacugcgcaggguuaaagaaaguaacagagguacgugguuauacaaaaggagguccggggcaugaagaaccuguaccuaugaguacauauggauggaauauagucaaauuaaugucaggaaaagacguuuucuacuuaccaccggaaaaaugugauacuuugcucugcgauauaggcgagucaucgcccucuccuacaguagaggaaagccgcacaauacgaguuuuaaaaaugguggaaccauggcucaaaaauaaucaguucugcauaaaaguacuaaauccauacaugccgacaguuauagaacauuuagaaagauugcaacgaaaacaugguggaaugcuaguacggaauccccucucaagaaacagcacccaugaaauguauuggauaagcaauggcacaggaaacauagugucaucaguuaauauggugucgaggcuguuauuaaauagauucacaaugacuuacagaagaccaacgauagaaaaagauguugaccuaggggccgguacccgacacgugaacgcggaaccugaaacaccaaacauggaugugauaggcgagagaaucagacguaucaaagaagaacauucaucaacuuggcacuaugaugacgagaauccuuacaaaacgugggccuaccauggcaguuacgaaguaaaagcaacggguagcgcauccaguaugauaaacggaguaguaaaacuucuuacaaaaccuugggauguuguaccuacugucacccaaauggcgaugacagauacaacaccauuugggcagcagagaguauuuaaagaaaagguagacacuagaacaccaaaaccaaugccgggaacacguaaaguaauggaaauaacagcggaaugguuguggaggacguuaggacggaauaagagaccaaggcugugcacacgggaagaguucacuaagaaaguaagaacgaaugcagcaaugggugcaguauucacagaagagaaccagugggacuccgcaagggcagcaguagaagacgaggaguuuuggaagcuaguugauagagagcgugagcuucacaaacagggaaaaugcggaaguuguguauacaauaugaugggaaaacgcgagaagaaauugggugaauuuggcaaagccaaaggcagcagggccaucugguacauguggcuuggggcuagauaucuagaauuugaagcacuagguuuccuuaaugaagaucauugguuuucccgcgaaaauucauacucuggaguagaaggagaaggcuuacacaaacuuggauauauacuucgagacauaucuaaaauuccagguggcgccauguaugcagacgauacugccggaugggacaccaggaucacagaagaugauuuacauaaugaggagaaaauaacccaacaaauggauccagaacauagacagcuugcuaaugcuauuuuuaaacuaacauaucagaacaaaguuguuaaaguacagagacccacuccaaaagguaccgugauggacauaauaucgaggaaagaucagcguggaucaggucaggucgggacuuauggauugaacacauucacuaacauggaagcacaauuaauaaggcaaauggagggggaggggguacugucaaaaacagaucuugaaaacccucaucuuuuagaaaagaaaauaacgcaauggcuugaaacaaaaggaguugaaagacuaaaaagaauggcgaucucaggugaugauugcgugguaaaaccgauugaugaucgcuucgcuaaugcacuccuagcucucaaugacaugggcaaaguacguaaagauauaccccaauggcaacccucaaagggguggcaugauuggcaacaaguacccuuuuguucucaucacuuucaugagcuaauaaugaaagauggacgcaaauugguaguucccuguagaccgcaagaugaacuuauagguagagcucgaaucucucaaggagcuggauggucauuaaaggaaacagcaugucucggaaaggcuuaugcucaaaugugggcguuaauguauuuucaccgucgcgaucuacgucuugcaucuaacgcgauuugcagcgcuguaccaguacauugggugccaacuuccagaaccacguggucuauucaugcacaucaucaauggaugacgacugaggacauguuaaccguuuggaauagaguauggauagaagauaacccauggauggaagauaagaccccggucaccaccugggaagacgugccauauuuaggaaaaagggaggaucaguggugcgguucgcuuauaggccuuaccucgcgagcaacaugggcacaaaauauucuaacagcuauacaacagguucgaucguugauaggcaacgaggaauuuuuggauuacaugccuaguaugaaacgcuucagaaaagaagaagaaucggagggugcaauaugguag

SEQ ID NO: 23557 - RNA, 9873 nt, Artificial Sequence
  derived and/or modified CDS sequence (opt6) from DENV-3__KC261634__SS-prME
acuucaauuugccugaugaugauguuaccugcgacccuggcguuucacuuaacgaguagagauggggaaccucguaugauaguugggaaaaacgaacggggaaaauccuuacuguucaaaacggcaaguggaaucaauaugugcacacuaauugcgauggaucuaggagaaaugugugaugacacaguuacguauaaaugcccguugauagcagaaguagaaccggaagacauagacuguuggugcaaucugacauccaccuggguaacauauggaacgugcaaccaagcgggagaacaccgacgggauaaacgaucgguagcauuggcaccucaugugggaaugggauuagacacccgcacccaaacguggaugagugcagaaggcgcauggagacaaguugagaaaguggaaacaugggccuuacgacacccuggauucacaauacuggcacuuuuccuggcucacuacauuggaacaagucuaacccaaaaaguaguaauuuuuauccuacugaugcuaguuacaccaagcaugacuaugcguugcguuggugugggaaaccgcgauuuuguagaaggauuaaguggagcgacauggguugacguuguccuagagcaugguggcuguguuacaaccauggcgaaaaauagaccaacgcuugauaucgagcugcagaaaacugaggcaacccaacuagcgacguuaagaaaauuaugcaucgaaggaaaaaucaccaacauaacaaccgauuccagauguccuacgcaaggugaagcaguuuuaccagaggaacaagaucaaaauuacguaugcaaacacacauauguagaccgagguuggggcaaugguuguggacuauuugguaaagguuccuuaguaacuugugcaaaauuucaaugccuagagccaauugagggaaaaguuguacaauacgaaaaucuaaaauacacaguaauuauaaccguacauacaggagaucaacaucaagucggaaacgauacucaagggguaaccguagaaauaacuccucaggcauccacaguagaagcagucuugcccgaguacggaacccucggacuagaaugcucgccaagaacaggacuugauuuuaacgaaaugauccuauugacaaugaaaaauaaagcguggaugguccaucgacaaugguucuuugaucugccucuaccguggacaucuggagcuacgacugaaacaccuacguggaauagaaaagagcuauuaguaacguuuaaaaacgcucaugcuaaaaagcaagaaguaguaguauuagggucacaggaaggcgccaugcauacagcacuuaccggcgcuacagagauacaaaacagcggcgggacuucuauauuugcuggucaucuuaaaugucggcucaaaauggauaaacuugagcuaaaagguaugaguuaugcaaugugcuugaacacauucguucucaagaaagaaguaagugaaacacagcacgguacgauccucauaagaguugaauacaaaggagaagaugccccuugcaaaaucccauuuucaacagaagauggacaaggaaaagcucauaacggacgucuaauuacagcaaaucccgucguaaccaagaaagaggagccaguuaacauagaagcagagccgccuuuuggagaaucaaacauuguaauagguacgggggauaaagcccuaaaaauuaauugguauaagaaagguucaucaaucggaaagauguuugaagcaacugcucgaggcgcaaggcgaauggcuauuuuaggcgacacagcaugggacuuuggcaguguagggggcguguuaaacucucuaggaaaaauggcacaccaaauauucggaagcgcguacacugcacuuuuuaguggagucaguuggauuaugaaaauaggcauaggugugcuacuaacauggauaggacugaauagcaaaaacacgaguaugaguuuuucauguauugugauaggaauuauaacccuauaucugggugcuguagugcaagcagauauggggugugucauaaacuggaaaggaaaagaauuaaagugugguagcggcaucuuuguaacaaacgaagugcacacuuggacggaacaauacaaauuccaggcagacucgccgaagcguuuagcuacagcaauagcgggagcuugggagaauggaguuuguggaauacgcaguacaacgagaauggaaaauuuguuauggaaacaaauagcuaaugaauugaauuauauauuaugggaaaauaacauaaaacucacgguaguugucggagauauaauagguguguuagaacagggcaagcgaacacuaaccccacaaccuauggaauuaaaauauucauggaaaacguggggcaaagccaaaauaguuacagcagaaauacaaaauuccucuuucauaauugacggaccgaauacgccagaguguccuucugcaaguagagcauggaauguuugggagguggaagacuaugguuucggagucuuuacaacuaauaucuggcuuaaacuaagagaaguauacacccaauccugcgaucauaggcuaaugagugcagcuauaaaagaugaaagagccguacacgcagauaugggauacuggauugagagucagaaaaauggaucauggaagcuagagaaagcaucauuuauagaaguuaagacauguaccuggccuaaaucacacacauuauggaguaauggcguucuagaaucagacaugauaauucccaaaucccuugcgggcccuauaucucaacacaaucaucgaccggguuaucauacacagacagcaggacccuggcaucuaggcaaacuggagcuagacuuuaauuauugcgagggaacuacaguaguuaucacagaaaauuguggaacccguggacccagcuuacgaacaacgaccguuaguggcaaacucauacacgaaugguguuguagaaguuguacuuuaccuccguugagguauaugggagaagacgggugcugguaugguauggaaaucagaccaauaaacgagaaagaagagaacaugguaaaaucauuagugagugcugguagugggaaagucgacaauuuuacaauggguguauuauguuuagcuauauuauucgaggaaguaaugagagggaaguucgguaagaaacacaugauaguuggagucuuauucacauucguguuacuacuuucgggucaaauaacuuggcgagauaugacgcauacccucauuaugauagguagcaacgcaucugaccggauggguaugggcguaaccuaccucgccuugauugcaaccuuuaaaauucagcccuucuuagcuuuggguuucuuucuucguaaacuuacuucgcgcgagaaccuacuucuagguguaggguuggcaauggcaacaacccuccagcuaccugaggauauagagcagauggcuaacgguauugcuuugggguugaugacacuaaaacuaauaacccaauuugagacauaccagcuauggacugcccugguuagcuuaacuuguagcaauacaauauucaccuuaacaguagccuggcgaacagccacauugauuuuagcaggaguaucgcuauuaccguuaugucaaucaagcagcaugaggaaaaccgauuggcuuccuaugacuguagcagcaaugggugucccaccacuaccacuuuuuauuuuuagcuuaaaagaugcacccaagaaaagaucauggccauuaaaugaaggaguuauggccguagguuuaguaaguauauuggcuagcagccuacuuagaaacgacguaccaauggcugggccguugguagcaggcggucuuuugaucgccuguuaugucauaacagggacaucggcugauuugacaguugagaaagcggcugauguuacuugggaggaggaagccgagcaaacuggagugucucauaaccuaaugaucaccguagacgaugauggaacaaugcgcauaaaagacgacgaaacagagaacauuuugacaguguugcugaaaacggcauugcuuauuguuagcgggauauuuccauacaguauaccagcgacacuuuugguuuggcauaccuggcagaaacaaacacaaaggagcggggugcuuugggaugucccaucucccccggagacucaaaaagcagaauuagaagaaggcgucuauagaauaaaacaacaaggcaucuuuggaaaaacacaaguaggagucgggguucaaaaggaaggugucuuucacacaauguggcacguaacacgaggugcuguuuuaacacauaacggaaaacggcucgagcccaacugggcuucggucaagaaagaucuaauuaguuacggaggaggauggcgccugagcgcgcaauggcaaaaaggcgaagaaguacaagucauugcuguagaaccaggcaaaaacccgaaaaauuuucaaacuaugcccggaauauuccaaacaacaaccggcgaaauaggggcaauugcucuggacuucaaaccggguacuucgggcaguccaauaaucaauagagaaggcaagguuguaggccucuaugguaacggaguuguuacuaaaaacggaggguauguaucagguaucgcccaaacuaaugcagagccagacggccccacuccagaguuagaagaagagauguuuaagaaaagaaaucuuacaauaauggauuugcaucccgguucugggaaaacaagaaaguaucuucccgcaauagugagggaagcaauuaaaaggagacuacgaacacugauccuggcaccaacaagggucguagccgcggaaauggaagaagcauuaaaaggacugcccauacgcuaccaaacgacagcuacaaaauccgaacacacuggacgugaaaucgucgaucugaugugccaugcuacauuuacaaugagacuauugucaccagugcguguaccuaauuauaaccuaauuaucauggacgaagcucauuuuacugacccagcaaguauagcugcaagaggguauaucucuacucguguuggaaugggagaggcugcagccauuuuuaugacagccacgccaccagggacagcagaagcauuuccucaaucuaacgcaccgauccaagaugaagagagagacauacccgaacgaucauggaauagugguaaugaauggauaacagauuucguaggaaagaccguuugguuuguuccuucaauuaaagcaggaaaugauauagcaaacugcuuaaggaaaaacggcaagaaaguaauacaacuuucccgaaagaccuucgauacggaauaccagaaaacgcguuuaaaugacugggauuuugucguaacaaccgacaucucagaaaugggugcgaauuucaaagccgacagaguaauagauccacguagaugucuaaagccagucauccuaaccgacggcccagaacgcguaauccuugcgggaccaaugccuguaacagcugcaagugccgcgcaaagacguggacggguagggagaaauccucaaaaagaaaacgaucaauauauauucacaggacagcccuuaaacaaugacgaggaucacgcccacuggacugaggcuaaaauguugcucgacaacauuaauaccccggagggaauuauuccugcguuguucgaaccagagagagaaaaaucagcggcaauagacggugaauacagauuaaaaggagaaucacgaaaaacguuuguagaacucaugagaagaggagacuuaccgguuugguuggcacacaaaguggcaagugaagguauuaaauacacagaccgcaaauggugcuucgauggugaacggaacaaccaaaucuuagaagaaaauauggacgucgaaaucuggacuaaggagggcgaaaggaagaaacugagaccacgauggcuggaugcaaggacauacucagauccccucgcauuaaaagaauuuaaggauuuugcagcgggaagaaaaaguauagcucuagaucugguaacagaaaucgggagaguuccaagucauuuagcucaucguacaagaaaugcccuagacaacuuaguaauguuacauaccagugaacauggagguagagcguaccgacaugccguugaagaacuuccggaaacaauggaaacacuacuacuacuagggcucaugauauugcuaacagggggagcuaugcucuuuuuaauuuccggaaagggaauuggcaaaacgagcauugggcucauaugcguaauaguaucaucaggcaugcuauggauggcagacguaccccuacaauggauugccucugcaauuguuuuagaauuuuucaugaugguuuugcuaauaccggagccagaaaagcaaagaacuccacaagauaaccaauuagcuuacgucguaauuggaauacuuacccuugccgccauuguagccgcgaaugaaaugggacugcuagaaacgacuaagcgagauuuggguaugagcaaagagcccggcgcgguuucgucaacaagcuaccuagauguugaucuacacccagcaucggccuggacucuauaugcuguggcaacgacaguaauaacgccaauguuacgacacacgauagaaaacuccacagccaauguaucuuuagcagcuauugcaaaucaagccguuguuuugaugggacuugauaaaggguggcccauuucaaaaauggaccuaggaguuccuuuauuggcacugggcuguuacucucaaguaaauccauuaacacuaacugcagcagugcuauuauuggucacacacuacgcaauuaucggaccagggcuacaagcuaaagcaaccagagaagcccaaaaacguacugcugcugguauuaugaagaauccaacgguggauggcauuaugacgauagauuuagacccagugaucuacgauaguaaguuugagaagcaacuugggcagguaaugcuacugguuuugugugccgugcaauuacuuuugaugagaacaaguugggcgcugugugaggcuuuaacuuuggcaacagggccaauaacgaccuugugggaagggucaccggggaaauuuuggaauacgacuauagcaguaucuauggcgaauauauuucgcggaucauaucuagcuggcgcgggucuugcguuuucaauaaugaaaucgguaggaacaggcagaagaggcacagguagccagggagaaacccugggggaaaaauggaagaaacgauuaaaucaauuaucgcggaaggaguucgacuuauauaaaaagucaggcauaacugaaguugauagaacagaagcuaaagaaggucuuaaacgcggcgaaacaacgcaccacgcaguuucaagaggaucagcgaaauuacaaugguuuguagagagaaacaugguaauuccagagggccgcguuauagaucuaggauguggaagaggcggauggaguuacuauugugccggccugaagaaagucacagaaguacgaggguauacaaaaggagguccgggucaugaagaaccuguuccaaugaguacauauggauggaauauaguaaaacuuaugagcgggaaagauguauucuaccuuccuccagaaaaaugugauacacucuuaugugauauaggagaaucaucgccaaguccaacaguugaagaaucacguacaauacguguucucaagaugguagaacccuggcucaaaaauaaucaauuuuguauuaaagugcuaaacccauauaugcccacgguaauugaacaucuggaacgucuccaacgaaaauauggagggaugcuuguuaggaaccccuuaagucgaaacucaacgcaugagauguacuggauuagcaacggcacuggcaauauuguauccucuguaaacaugguuagucgauuacuauuaaaucgcuuuacaaugacacauagaagaccaacgauggaaaaagauguugaccucggagccggaacucgacaugucaacgccgagccagaaacuccuaauauggacguuauuggggaaaggauaaaaagaauaaaggaagaacauucaaguacguggcauuaugaugaugaaaacccauacaaaacaugggcuuaccacggcucauacgaaguaaaagcuacagggagcgcaucuaguaugauuaacggaguagucaaacuacucacaaaaccuugggacguaguaccuaugguaacccaaauggccaugacagauacuacuccuuuuggucagcaacgaguauuuaaagaaaaaguagacacacgaacaccucggcccaugccaggaaccagaaaagugauggagauaacugccgagugguuauggaggacuuuaggaagaaacaagaaaccucgacuuugcacgagggaagaguuuacgaaaaaggucaggaccaaugcggccaugggcgcgguauucacagaggagaaccaaugggauagugccagagccgccguugaagaugaagaauuuuggaaauuaguggacagagaacgugaacugcauagauuaggaaaauguggaucuugcguguauaacaugauggguaaaagggaaaagaaauuaggagaguucggaaaagcaaaagguagccgagcgauaugguauauguggcugggcgcacgguaucuggaauuugaagcguuaggauuuuugaaugaagaccauugguucagcagagagaacaguuauaguggaguugaaggagaaggauugcauaaauugggguacauacuaagagacaucagcaaaauuccagggggagcgauguaugcagacgacacagccgggugggacacaagaaucacggaggacgaucuacacaacgaagagaaaauaacacagcaaauggauccagaacacagaagacuagcuagcgcuauuuuuaaacucacauaucaaaauaaaguagucaaaguacagcgacccacccccaaaggcacgguaauggauaucauuaguagaaaggaccaaagaggguccggacaaguaggaaccuauggcuuaaacacauuuaccaauauggaggcacagcuggucagacaaauggaaggcgaaggaguguuaaguaaggcagacuuggaagauccacauuuacuugagaagaaaaucacacaauggcuagagacaaaaggagucgagcgauuaaaaaggauggcuaucucuggagaugacugugugguaaaaccaauagaugauagauuugcaaacgcacuucuagcccuuaaugauaugggaaaaguaagaaaagauauaccucaauggcaaccuucuaaaggauggcaugacuggcaacaaguuccauucuguucgcaccauuuucacgagcuaauaaugaaagacggaagaaaauuaguaguaccaugucguccgcaagaugaauugauaggcagagcuagaaucagccaaggagcaggauggagccucaaagaaacugccugucuaggaaaagcauaugcccaaauguggagcuugauguauuuucaccgucgagacuuaagacuugcguccaaugcaauaugcucggcuguaccaguccacugggugccaacaucuagaacuacaugguccauacaugcacaucaccaauggaugaccacagaggacauguuaacgguauggaauagaguauggauagaagauaauccuuggauggaagauaaaaccccaguaacaaccugggaggauguaccuuaucuugggaagcgggaagaccaauggugcggaagucuaauagguuuaaccuccagagcaaccugggcacagaacauauuaacagcaauacaacaaguacgcagucuaauuggggaugaggaauuuuuagacuacaugccaucaaugaagcgguuucggaaagaggaagaaucggaaggugcaauaugguaa

SEQ ID NO: 23558 - RNA, 9873 nt, Artificial Sequence
  derived and/or modified CDS sequence (opt6) from DENV-3__JN662391__SS-prME
acgagcuuaugccuuaugaugauacugccugcagcccuagcauuucacuuaacauccagagauggagaaccuaggaugauuguuggcaaaaaugaaaggggaaaaucucuuuuauuuaaaacagcaucugggauuaauauguguacauuaauagcgauggaccugggugaaaugugugacgauacggucacuuauaaauguccacauauuacagaaguagaaccugaagauauagauuguuggugcaaucuaacuagcacuuggguuaccuauggaacaugcaaccaagcgggugaacaucguagagauaaaagaucaguugcacucgcaccacauguggguaugggcuuagacacccgaacucaaacuuggaugucagcagaaggugcguggcgacaagucgaaaaaguugaaacaugggcgcuaagacaccccggauuuacaaucuuagcauuauucuuggcacauuauaucggaacaagucuaacgcaaaaaguugugaucuuuauucugcuaaugcuagugacuccgagcaugacaaugcguugcguaggaguagggaauagggacuuuguugaaggacucagcggugcuaccuggguugauguuguauuagaacacggaggaugugucacaacuauggcuaaaaauaaaccgacccuugauauagaacuucagaaaacugaagcaacucaacuagcaacacuaagaaaacuguguauagaaggcaaaauaacuaauaucacuaccgacagucgaugcccuacucaaggagaagcagucuuaccugaagaacaagaucaaaacuauguauguaaacauacauauguggauagagguugggguaauggauguggacuuuucggaaaaggaaguuuaguaacaugcgcaaaauuucaaugccuagaaccaauagaagggaaagucguccaauaugaaaaucucaaauacacggucauaauuaccguccauacaggugaucaacaucaagucgggaacgaaacacaaggagugacagcagaaauaacaccgcaggcaaguaccacagaagccauucuccccgaauaugguacauuaggacucgaauguucaccacguacagggcuggauuuuaaugaaaugauucuauuaacuaugaaaaauaaggcuuggaugguacaucgucaaugguucuucgaccuaccguugccuuggaccaguggagcaaccacagagaccccuaccuggaaccgaaaagaacuauuaguaacuuucaaaaaugcacaugcuaagaaacaagaagugguaguccuggggagucaagaaggagcaaugcacacagcauuaacaggggcuacugaaauacaaaacuccggaggaacaagcauauuugcagggcaccuuaaaugucguuuaaaaauggauaaacuugaauugaaagguaugucauaugcuauguguacaaacacguuuguacuuaagaaagaagucucugagacacagcacgguacaauauuaaucaaaguagaauacaaaggagaagaugcuccauguaaaauaccauuuucaaccgaagaugaacaagggaaagcccacaaugguagacucauuacagcuaacccagucguuaccaagaaagaagaaccggucaauauugaagcggaacccccauuuggggagucgaacauuguuauugguauuggagacaaugcauuaaaaauaaauugguauaagaaaggauccucaauugguaaaauguucgaagcgacagccaggggagcaagaagaauggcgauacuuggugacaccgcaugggauuucgguucuguaggagggguccuaaacucccuugguaaaaugguccaccaaauauucggcagcgcauauacggcccuauuuucuggaguuaguuggguuaugaaaauaggaaucggaguacuguugacuuggauuggccuaaacagcaaaaauacuucaaugucguuuucauguauagcuauugguauuauaacuuuauauuuaggagcggucgugcaagcagacaugggaugcgugaucaauuggaaagguaaagaacuaaaaugugggucugguauuuuugugaccaaugaaguccacacuuggacagagcaauauaaauuccaagccgacucucccaaaagacucgcaacagcaauagcaggagcuugggaaaacgggguuugugggauacggaguacuacaagaauggagaauuuauuauggaaacaaauagcgaaugaacugaauuacauacuaugggaaaacaacauuaaacuuacaguaguagucggcgauacuauaggaguacuagagcaaggaaaacgaacgcuaaccccacaaccgauggaauugaaauauagcuggaaaaccuggggaaaggcuaagauaguaacugcagaaacgcaaaauaguaguuuuauaauagauggaccgaauacgccagaaugcccaagugcaucucgggcguggaacguuugggagguugaagacuacgguuucggaguauucacaaccaacauuuggcuaaaauuaagagagguuuauacacaaaugugcgaucauagguuaauguccgccgcggucaaagacgagcgugcuguacacgcagacaugggguacuggauugaaucacagaagaaugguucauggaaacuugaaaaagcaucacucauagaaguuaagaccugcacauggccaaaaucucacacucuauggucuaaugggguguuggaaucagauaugaucaucccaaaaagccucgcaggaccaauuucccagcauaauuauaggccugguuaucacacgcaaacagcuggcccauggcaccucggaaaauuagaacuagauuuuaauuauugugaagggacaacuguaguuauaacagaaaacugcggaaccaggggaccaucucuacguacaacuacgguaagcggcaaacuuauucaugaauggugcugcagaagcuguacguugccuccguuaagguauaugggugaggauggguguugguacgggauggaaauaagaccaauaucggaaaaagaagaaaauaugguuaagucacucguaagugcagguaguggcaaaguugauaacuuuacuaugggcguguuaugucuggcaauucucuuugaagaaguaaugagaggaaaauuuggcaagaaacauaugauugccggagucuucuuaacuuuuaugcucuuguuaucaggucaaauuacauggagagauauggcucauacacugauuaugauuggaaguaaugcauccgacaggaugggcaugggcguuaccuaucuagcacuaaucgcuaccuuuaagauacaaccauuuuuggcacugggauucuuccuccggaaguugacaagucgagaaaauuuacuauuaggagucggacuagccauggcaacaacaauucaguuaccggaggacaucgaacaaauggcgaauggaauagcucuugggcuaauggcccucaaauuaauaacgcaauuugaaacauaucaacuuuggacggccuugauuucacugacauguuccaacaccauauuuacacuaacaguugcauggagaacagcaacucucauccucgcaggaguaucgcuacugcccgucugucagucuagcuccaugcgcaaaaccgacuggcuuccuaugacagucgcagcaaugggugucccuccauuaccuuuguuuaucuuuucucuuaaggacacuuugaaacggagaagcuggccguuaaaugaaggagucauggccguaggauuaguuagcauacuggcuaguuccuuauuaagaaaugaugucccaauggcagggccuuuaguggcagggggcuuguugaucgcguguuauguaauuacuggcacuucagcagacuuaacuguagaaaaggcagcugacgugacaugggaagaagaagcagaacaaacuggugucucucacaacuuaaugauaacuguugaugaugauggcacuaugaggauuaaagacgacgaaacugaaaacauuuugacaguauuauuaaaaacugcacuucuaauaguaucugggauauuuccuuauuccauaccagccacguugcuuguauggcauacauggcaaaaacaaacgcaaagaagcggaguuuuaugggacgugcccucacccccggagacucaaaaggcugagcuugaagaagggguuuacaggauaaaacaacagggaauacuaggaaaaacacaaguaggaguaggcguucaaaaggaagggguguuucacaccauguggcacgucacuagaggcgcaguacucacacacaauggaaagcgacuggaaccaaauugggcgagugugaaaaaggacuugauuucuuaugggggaggauggcguuuaucggcgcaauggcagaagggugaggaaguacaagugauugcgguagaaccugguaaaaaucccaaaaacuuccagacuaugccagguacguuccaaacaaccaccggagaaauaggugcuauagcguuagauuuuaaaccaggaacgagcggaucacccauaauuaaccgggaaggaaaggucgugggguuguacgguaauggagucguuaccaaaaacggcggauacguuucuggaauugcgcaaaccaacgcagaacccgauggccccacgccagaacuggaggaggaaauguucaagaaaagaaauuugacuauaauggaccuacacccaggaagcgguaaaacaaggaaauauuugccggcaauaguuagagaggcuauaaaacguaggcuuagaacgcuuaucuuagcccccacgagagucguagcugcagagauggaagaagcacuuaagggauuaccuauccgguaccagacuacagcgacgaagucagagcauacagggagagaaauaguggaccuaaugugucacgcuacauucaccaugagauuacuuucuccugugcggguuccaaacuauaacuugaucauaauggaugaagcgcacuuuaccgaucccgccucuauagcagcuagaggauacauauccaccagaguaggaaugggagaagcggcagcaaucuucaugacagcuacuccucccgggacggccgaugcguuuccacaaucaaacgccccuauacaagacgaggaaagggacauaccggagcgaucuuggaacagcgguaaugaauggauaaccgacuuugcagguaagacagucugguuuguaccuaguauaaaagcuggaaacgauaucgcuaacugccuuaggaaaaauggaaagaaaguaauacaacuuaguagaaaaaccuuugacacagaauaccaaaagacuaagcugaaugacugggauuuuguaguuacaaccgacauuucugaaaugggcgccaauuucaaagcagacagggucauugacccaagaaggugucuaaaaccaguaauacuaacggacggaccagaaagggucauuuuagcuggcccgaugccaguuacgguugcaagcgccgcgcaacgacgcggaagggugggaaggaauccucaaaaagaaaaugaucaauauaucuucacaggucaaccauuaaauaaugaugaagaucaugcgcauuggacagaagccaaaaugcuguuagauaauauaaacaccccagaagggaucauaccagccuuguuugaaccggaaagagaaaaaucagcugcaauugauggugaauaucgacuaaaaggggaaucucguaaaacauucguggaauugaugaggaggggugacuuacccguuugguuagcucauaagguagcuucggaaggaauuaaauauacagauagaaaaugguguuucgauggacaacgaaauaaucaaauccuggaagaaaacauggacguagaaauauggacgaaagaaggagagaagaagaaacugcgacccaggugguuagacgcgagaacauacucagacccguuagcucucaaagaauuuaaagauuuugcugcgggccgcaaaucaauagcauuagauuugguaacagagauuggaagaguuccgagccaucuugcacaucggaccagaaacgcccuggacaaucugguuaugcuucauacaagugaacauggaggucgagcguauagacacgcaguagaggagcucccggaaaccauggaaacacuuuuauuacuaggacuuaugauuuuauugacugggggagccauguuguuccucauuuccgggaaggguauagguaaaacuuccauuggcuuaauaugcguuauugccucuagcgguauguuguggauggcugagauuccauugcaguggauugccucagcuaucguucuagaguucuuuaugaugguacuccuaauaccggagccagagaagcagcgaacgccucaggacaaccaguuagccuaugucgucauaggaauauugacgcuugcugcaauaauagcggcaaacgaaaugggccugcuagaaacgacaaaaagggacuuaggaaugucgaaagagccaggaguagugagcccuacaaguuauuuagauguugaucugcacccggcgagugccuggacucuauaugcaguagcgacaaccgucaucaccccuauguuaaggcauacuaucgaaaauaguacggcgaacguuucuuuagccgcaauagcgaaccaagccgugguguugaugggguuagacaagggauggccuaucuccaaaauggaucuaggaguuccauuauuggcauuaggauguuacucacaaguaaauccacucacguuaacggcggcuguacuauuauuagucacacauuaugcaauaauaggaccuggucuucaggcaaaagcaacuagagaggcacagaaaagaacagcugccggaauuaugaaaaauccuacgguugaugggauaauaacaauagauuuagacccggucauauaugauucuaaguucgaaaagcaacuagggcaaguuaugcuacuuguuuuaugcgcgguacaguuacuguuaaugcgaacaaguugggccuuaugugaggcacuuacucuagcaacaggaccaauaacaacccuaugggaaggaagcccgggcaaguuuuggaauacaacaauugcaguauccauggcgaauauauuuagaggaaguuauuuagcuggcgcuggccuugcuuucagcaucaugaaaucgguugggacagguaaacgcggcaccgggagucaaggagaaacuuugggggaaaaauggaagaagaaauuaaaucaguuaucgcgaaaagaauuugauuuguacaagaaaaguggcaucaccgaaguagaucgaacggaggccaaagaaggguuaaaacgcggagaaacuacucaucacgcaguuucccgcgguucagcuaaacuucagugguucguugagagaaauauggucauucccgagggaagagugauagaucugggauguggcagaggagguuggucuuacuacugcgcgggucucaagaaaguuaccgaagugcgugguuacacaaaagguggaccaggacacgaggaaccagugccaaugagcacgcauggauggaauauaguaaaacuaaugagcggcaaagauguuuucuaccucccuccggagaaaugugauacauuauugugcgacauuggugaaucuagcccaaguccaaccguagaagaaagccggacgauucgcguacuaaagaugguagaaccaugguuaaagaacaaucaauuuugcauaaagguucugaaucccuauaugccugcgguaauagaacacuuagaaaggcuccaaagaaagcacggcgguaugcuuguaaggaacccucuauccagaaauaguacucaugaaauguauuggaucucaaauggcacggguaacauuguaucaucaguuaauaugguaucaagacuacucuuaaacagguuuacaaugacgcauagacgaccaacgauagaaaaagacgucgaucucggcgccggcacaagacauguaaaugcagaaccagaaacacccaacauggauguaauaggggaacgcauacgccgaauaaaagaagaacacaacuccacguggcacuaugaugaugaaaaucccuauaaaacuugggccuaccauggaucuuacgaggugaaggcuaccggaagcgcgucaucuaugauaaauggaguaguaaaauuacuuacgaaaccaugggauguaguccccauggucacgcaaauggcaaugacagacacgacgccuuucggacaacagagaguauucaaagaaaaaguagacacaagaacaccaaggccuaugcccggaacgcgaaagguuauggagauuacugcagaaugguuguggcggacccuaggccggaacaaaagaccccgguuauguacuagagaagaguuuacaaagaaaguacggacuaaugccgcaaugggugcaguauucacagaggaaaaccaaugggauagcgcaaaagcagcugucgaagaugaagaguucuggaaacucguagauagagaacgugaguuacacaaacuaggaaaaugcggaucuuguguuuauaauaugaugggaaaaagagagaagaaacuaggcgaauuugggaaagcaaaaggaucacgggcgauaugguauauguggcuuggagcuagauauuuagaguuugaggcacuaggguucuuaaaugaggaucauugguuuagucgugaaaauucauacaguggaguagaaggggaaggacugcacaaauuggguuacauacugagagauauaucaaaaauuccgggaggggcuauguacgcggacgacacagcagguugggauacgcgaauuacagaggaugaucugcacaaugaggaaaagauuacccaacaaaugaauccagagcauagacuauuagcgaaugcuauuuuuaaguuaacauaucaaaauaaaguuguuaaaguacaaagacccacaccuacugggacgguaauggacauaauuucacgcaaggaucaaagagguucgggccagguaggaacauacggacucaauacuuuuacaaauauggaagcacaauuaguacgccaaauggaaggugaagguguauugaguaaagcagauuuagaaaacccgcaccuaccggagaagaaaauaacacaguggcuagaaacuaaaggaguugaaagacuuaagagaauggcuauaaguggugacgauugugucgucaaaccaaucgaugauagauucgcuaacgcguuauuagcgcuaaaugauauggggaaaguuagaaaagauaucccacaauggcaaccgucaaaaggguggcacgacuggcagcagguucccuuuuguagccaccauuuucacgaacuuaucaugaaggacggaagaaagcuagucguaccgugucgaccucaagacgaauuaauugguagagcuaggaucucccagggggcagguugguccuuaagagaaacagcaugucuugguaaggcuuacgcacaaauguggagucuaauguacuuucauaggagagaucugagauuagcuucaaaugccauauguucugcaguaccgguucacuggguaccgacgucgcguacaaccuggaguauucaugcgcaccaucaguggaugacaacagaagauaugcuaaccguuuggaacaggguauggauagaagauaaucccuggauggaagacaaaaccccgguuacaacuugggaaaaugugccuuaucuuggaaagcgcgaggaccaauggugcgguucauugauaggucucacuagccgcgcgacuugggcacaaaacauuucaacagcaauucaacaaguccgaaguuugauagguaacgaagaauuuuuagacuauaugccaucaaugaaacguuuuagaaaggaagaagaguccgaaggcgcaauaugguaa

SEQ ID NO: 23559 - RNA, 9873 nt, Artificial Sequence
  derived and/or modified CDS sequence (opt6) from DENV-3__AY858043__SS-prME
acaucguuaugucuaaugaugaugcuuccugcaacacuagcauuucauuuaacaucgcgagauggagaaccaaggaugauaguggggaaaaaugaaagaggaaaaaguuuacuauuuaaaacugcgucaggaauaaacaugugcacacuaauagcuauggaucuaggugaaaugugugacgauaccguaacauauaaauguccacuaauaacagaaguugagccagaagauaucgauuguuggugcaacuuaacuucgaccugggugacauacgggacauguaaucaagcaggagaacaccguagagacaaaagaaguguggcgcuggccccgcacguagggaugggacuagauacaagagcccaaacauggaugucagcugaaggagcuuggcgucaagcagaaaaaguagaaaccugggccuuacgucacccagguuuuacaauacuagcuuuguuucuugcucacuauaucggcacaucucuaacucaaaaagucgucauuuuuauauugcuaauguuagugacaccaaguaugaccaugagaugcgucggaguaggaaaucgagauuucguugaagggcuuagcggggcuaccuggguagauguagucuuagaacaugggggaugcguaacgacaauggcuaaaaacaaaccuacgcuagacauagaacuucagaaaacagaagcgacacagcuugcuacccuaagaaaacuauguauagaaggaaaaauaacgaauguaacaacagauagccgaugcccuacacaaggagaagccauauuaccggaagaacaggaccagaauuacguaugccgucauacauauguagauaggggcuggggaaauggauguggcuuauucgguaaagguucuuuagucacaugugcaaaauuucagugccuugaauuaaucgaagggaaagucguacagcaugagaacuuaaaauauacagugauuauaaccgugcacaccggggaccaacaccagguugguaaugaaacucaagguguuacagcagaaaucacgccucaagccucaacgguugaggcgauacucccugaauaugggacuuuaggauuggaauguucuccaagaacuggauuagauuuuaacgaaaugauuuuacugacaaugaaaaauaaggcuuggaugguacacagacaaugguucuuugaccucccucugccuuggacauccggcgcaacuacugaaacaccuacauggaauaagaaagaacuguuggucacguucaaaaacgcgcacgccaagaaacaagagguaguuguacuaggaucacaagaaggugcgaugcauacagcgcucacaggagccacggaaauucaaaccaguggcgguacaagcaucuuugcgggacauuuaaaauguagauuaaaaauggacaaacuugaacuuaaagggaugucauaugcgauguguucuaacgcauuuguacuaaagaaagaaguaagugaaacccaacaugguacaauucuaauaaaaguagaauauaaaggcgaggacgcuccauguaaaauaccauucucaacagaagauggacaagguaaagugcauaacggacgcuugauuacggccaacccagucgugacuaagaaagaagaaccgguuaacauugaagcggagccgccauucggggaaagcaacaucauuauugguauaggagacaaagcccuuaaaaucaacugguauaagaaaggaucaucaaucgggaaaauguuugaagcaacugcaagaggagcaagacggauggcaauacuuggcgauacagccugggacuucggaucaguaggagggguacucaacucccucggcaaaaugguucaucaaaucuuuggcucagcauacacagcucucuuuaguggaguaucuuggaucaugaaaauaggcauaggcguucugcuuacauggaucggacuuaauuccaaaaacaccucaaugagcuuuucuuguauagugauuggaaucauaacuuuguacuuaggagccgucguucaagcagauaugggaugugugauaaacuggaaagguaaagaguugaaaugcgguucaggaaucuuuguuacgaaugaaguccacacauggacagaacaauauaaauuccaggcugacaguccuaaacgacuagccaccgcuauagcaggagcaugggagaauggagugugcggaaucaggaguacgacucgaauggaaaaccuauuauggaaacagaucgcuaacgaauugaauuauauucuaugggaaaauaauauuaaacuaacagugguaguuggggacaucauaggaguuuuggaacaaggcaaaagaacacuuacaccacagccaauggaacuaaaauauucuuggaaaacguggggcaaggccaagguaguaacugcugaaauacagaauaguucauucaucauagauggcccuaauaccccagaaugucccaaugcaagucgugcauggaacguaugggaaguagaggauuauggcuuugguguguucacaaccaauauauggcuaaaguuaagagaaauguauacucaacuaugugaucaccgguuaaugucagcggcaguuaaagacgaaagagcuguacaugccgacaugggauauuggaucgaaucucagaaaaauggcaguuggaagcucgaaaaagcaucguuaauagaagugaaaacauguacuuggccaaaaagccauacuuuauggucaaauggcguauuagaaucugacaugauuaucccuaagagucuagcaggucccauuagucaacacaauuauagaccuggauaccauacucaaacugccggaccuuggcaucucggaaaacuugagcuugacuuuaauuacugugaaggcacaacagugguuaucacagaaaauuguggaacuagaggaccuuccuugagaacgacaacagucagcgggaaguuaauacacgaauggugcugcagaaguuguacguuacccccauuacgcuauaugggcgaggaugguugcugguauggcauggaaauaagaccaauuaacgagaaggaagaaaauaugguuaaaucccuaguuucagcagguucuggaaagguugauaacuuuacaauggguguacucuguuuagcgauacuguuugaagaaguaaugagaggaaaauuuggcaagaaacauaugauagcaggaguacucuucauguuuguuuuauuacuuucuggucaaauaaccuggagagacauggcuagaacguuaaucaugaucgggaguaacgcaucagacagaauggggaugggaguaacuuacuuagcacuuauugcaacguuuaaaauccaacccuuucucgcauuaggauucuuuuugagaaaacuaaccagccgggaaaaucuccuccuuggaguuggucuggccauggccaccacucuccaauuaccggaagauauugagcaaauggcuaaugguauugcuuuaggguuaauggcgcuaaaacuaauaacucaauuugaaacauaucaacuuuggacagcacugguaagucuaaccuguucaaacacaaucuucacuuuaaccguugcuuggcguacagcaacacuuauuuuagcggguauuagcuugcuacccguaugccaaucuaguucaaugaggaagaccgauuggcuccccaugacagucgcggcuaugggggugcccccuuuaccacuauucaucuuuagucucaaagauacgcucaagcguaggagcuggccguuaaaugaggggguaauggcugucggccuagucucaauucuagcgagcucuuuauuacgaaaugacgucccaauggccgggccauuagucgcgggaggucuauuaauagcaugcuauguaauuacuggaacgagcgcagacuuaacaguugaaaaagcugcggauguuacuugggaagaagaggcugaacaaaccggcguaagccauaaucuaaugauaacaguagaugacgauggaacgaugaggaucaaagaugacgaaacugaaaacauacuuacgguuuuacuaaagaccgcacuccuuauaguuucaggaauuuuuccauauucuauaccggcaacacuauugguauggcauacauggcaaaaacaaacgcaaaggucaggcguauuaugggacguaccaucuccuccugagacacaaaaagcagaacuugaagaaggcguuuacagaauaaagcaacaaggaaucuucggaaagacccaaguagggguaggaguccaaaaagagggaguauuucacacaauguggcaugugacaaggggcgcggucuugacuuauaacggcaaaagauuagagccuaauugggcaagugucaagaaagauuuaauaucauaugguggcggauggcggcuuagcgcacaauggcgaaaaggagaggaaguacaaguaauagcgguggaaccgggcaaaaauccuaaaaauuuucaaacuaugccagggaucuuccaaaccacuacaggagagauaggagcaauagcccuagacuuuaaaccaggcacaucuggaucuccaauaauaaauagagagggcaaaguaguaggcuuguaugguaaugggguuguaaccaaaaauggugguuacguaucaggaauagcacagacaaacgcugaaccggacgguccaacaccggaacuagaagaagagauguuuaagaaacgaaaucugaccaucauggaucuccacccaggaaguggaaagacaaggaaguaucugccagcgauagugagagaagcaauuaaaagacgucucagaacacuaaucuuagcuccuacgaggguaguugccgcagaaauggaggaggcacuaaaaggauuaccuauacgcuaucaaaccaccgcaacaaaaagcgaacacacaggaaaggaaauagucgaucuaaugugccaugcuacuuuuacaaugcgcuuauuaucgccagugagagugccuaauuauaacuuaauaauaauggaugaagcacacuuuacagaucccgcauccauugcugcacgaggauauauuucaacucgaguuggaaugggagaggcggcugccaucuucaugacggcaacaccgccuggaaccgcagaugcauucccucagucuaaugcaccaauucaagacgaagagagagauauaccagaacgaucguggaacucagguaaugauuggaucaccgacuuugccggaaagaccguuugguucguaccauccauaaaggcaggcaaugacaucgcaaacugcuuaaggaaaaauggaaagaaagugauacagcuguccaggaaaaccuuugauacagaauaucagaaaacuaaauuaaaugauugggacuuuguagucacaacugauaucucagaaaugggcgcaaauuuuaaagcagauaggguuaucgacccaagaaggugcuugaagcccguaauauuaacagacggaccagaaagaguuauuuuggcaggcccgaugcccgucacagucgcaucggcagcacaacguagagggaggguuggcagaaacccucagaaagaaaaugaucaauacaucuuuacaggucagccuuuaaacaaugaugaggaccacgcccauuggacggaggcuaaaaugcuguuggauaauaucaauacuccagaagggauuauaccugcauuguuugagccagaaagagaaaagagcgcagcuauagacggugaguaucgucugaaaggcgaaaguagaaagaccuucguggaacucaugagacguggggauuuacccguuuggcucgcgcacaagguagccagcgaagguauuaaauacacugauagaaaauggugcuuugauggagaaagaaacaaucaaauccucgaggagaauauggacguagaaauuuggacaaaggaaggugagaagaagaaacuucguccacgauggcucgaugcaaggacauacagugacccguuggcucuuaaggaguucaaagauuuugccgcugggcgaaaaucuaucgcauuagacuuaguuacugaaauuggacguguucccagucaccucgcucauagaacacgcaaugcguuagauaaucuaguuaugcuccacaccucugagcacggaggucgggcauauaggcaugccguagaagaguuaccagaaacaauggaaacauuuuugcucuuaggauuaaugauacucuuaaccgguggugcuauguuauuccuaaucaguggaaaaggggucggaaagacaucaauaggguuaauuugcguaguagcuagcagugggauguuauggauggcagauauaccuuuacaauggaucgcaucugcaauugucuuagaguucuuuaugaugguacuacucauaccagaaccugaaaaacaacgaacaccgcaggacaaucaauuggcuuauguagugauuggcauucugacguuggccgcuauugucgcugcuaaugagauggggcuucuagaaacgacuaaacgugacuuaggaaugucuaaagaaccugguguuguaucgccuacaaguuaucuugacguagaucuccacccggcuagugcuuggacauuauacgcaguugcaacgacuguuaucacaccaauguuacgucauacgaucgagaacuccacagcaaacguuucacuugcagcaauagccaaucaggcgguaguauugauggggcucgacaaggguuggccaauauccaagauggaucuagguguuccuuuacuugccuuaggaugcuauagucaagugaacccgcucacguuaacugcagccguucuccucuuaguuacacacuaugcgauaaucgggccgggcuuacaagcuaaggcaacgagagaagcacaaaaacgaacugcugcagguauuaugaagaacccaacuguagauggcaucaugacuauagauuuagacccaguaauauaugacagcaaguuugaaaaacaguuaggacaagugaugcuccuaguacugugugccguccaguuacuauuaaugaggaccuccugggcuuuuugcgaggcauuaacacuagccacagguccaauuacuacauuaugggaggguucgcccggaaaguucuggaacacaacuaucgcuguaucaauggcaaacauauuccgggguagcuauuuagcgggagcugggcuagcuuucucaauaaugaaaucaguagguacagguaaaaggggcacaggaagucaaggagaaacucuuggagaaaaguggaagaagaaauuaaaccaacuuucucguaaagaauuugaucucuauaagaaaucagguauaacugaaguugacaggacugaagcaaaagaaggucuuaagcggggagaaaccacacaccaugcagucaguagagguucugcaaaacuacaaugguuuguggaaagaaacaugguuauuccagaaggacgaguaauagaccucggcugcggaagagggggauggucguacuauugugcaggucuuaaaaagguaacggaaguccgaggcuauacaaagggcgguccagggcacgaggaaccaguuccaaugucaaccuaugguuggaacauaguuaaauuaaugucggggaaggauguauucuaucuacccccagaaaaaugugauacuuuauuaugugacauuggagaaucaucaccaagcccuacaguugaagagaguagaacuauuaggguauuaaaaauggucgaaccauggcugaaaaacaaccaauucuguauuaaaguuuugaacccuuauaugccaacuguaaucgaacaucucgaaagauuacaaagaaaacaugggggaaugcuggugcguaauccucuaucacguaauaguacgcaugaaauguacuggauaucaaacggaacuggaaauaucgucucuagcguaaauauggucucccgacuuuuauugaauagauuuacaaugacauaccguagaccuacaauagaaaaagaugucgacuuaggggcaggaacccgacaugucaaugccgaaccugaaaccccaaacauggauguaaucggugaacgaauacggagaaucaaagaggaacauaguucaacauggcacuaugacgaugagaauccguauaaaaccugggcuuaccauggcaguuaugaggucaaagcuaccggaagugcaucuaguaugauaaauggagucguuaaacugcuaaccaaaccaugggauguaguacccacgguaacucaaauggcaaugacagauaccacgccuuuuggacagcaaagaguuuuuaaagaaaagguugacacacguacuccuaaaccaaugccaggaaccagaaaaguuauggaaauaacagcagaauggcucuggcgaacccuaggucgaaauaaacgaccaagauuaugcacgcgagaggaauuuacuaagaaagugcgaacuaacgcagcaaugggggccguuuuuacggaagagaaucaaugggacagcgccagagcagcaguggaagacgaagaauuuuggaagcucguugaccgcgaaagggaacuucauaaacaaggaaaauguggcuccugcgucuacaauaugaugggaaaaagggagaaaaagcuaggagaguuugggaaagcaaaaggcucuagagcuauuugguacauguggcuaggugcaagguaccucgaauuugaggcucuuggcuuucuuaacgaagaucauugguuuagccgagaaaauagcuauagcggaguagaaggugaggggcugcauaagcucgguuacauccuacgagacauaagcaaaauaccuggcggcgcaauguacgcugaugacacagcuggcugggauacacgcauuacagaagacgaucuccauaacgaagagaaaauuacacaacaaauggacccugaacaucgacaguuagcgaacgcaauuuuuaaguugacauaucaaaauaaaguaguuaaaguccaacggcccacuccuaagggcacuguaauggauaucaucagucguaaagaccagagagguucuggccaaguuggaacguacggacuaaauacauuuacuaacauggaagcucaacuaauaagacaaauggaaggcgaagguguauugaguaaaacugauuuggaaaacccgcaccuccuggaaaagaagauaauacaguggcucgaaacaaagggcguugaacgacugaagagaauggcgauuucaggagacgauuguguagucaaaccaauagacgaucgcuuugcuaaugccuuacuagcauuaaaugauaugggaaaaguaaggaaagauauaccucaauggcaaccaucuagaggguggcaugauuggcaacaaguaccauucugcagucaccacuuccaugaacuaauaaugaaagacgguaggaaauugguaguaccuuguaggccucaagaugagcuuauagguagagcgcgaauaagucagggagcuggcuggagucuuaaagagacugcaugucuagguaaggcuuacgcacaaaugugggcucuaauguauuuucacaggcgagaucuuagacuugccucuaaugcaaucuguucugcaguaccgguccauuggguucccaccucuaggacaacuuggucaauacacgcucaccaucaauggaugacaacagaagauaugcuuacuguauggaaccgaguuuggaucgaagauaaccccuggauggaagauaaaacgccuguaaccaccugggaagacguaccuuauuuagggaaaagagaagaucaauggugcggaucccuaauaggucuuacgucacgagcuaccugggcgcaaaauauacuaaccgcaauucaacagguucguucucugaucgggaacgaggaauuucuugacuauaugccaaguaugaagagauuccgaaaggaagaggagucagagggggcgauaugguaa

SEQ ID NO: 23560 - RNA, 9873 nt, Artificial Sequence
  derived and/or modified CDS sequence (opt6) from DENV-3__AY858044__SS-prME
acuucauuaugucuaaugaugauguuaccagcaacucuagcauuucauuuaaccucuagagauggagaacccagaaugauaguuggcaaaaacgaacgcggaaaaucacuacuauuuaaaacugcaagcggaauaaauaugugcacucuaauugcaauggauuuaggugaaaugugugacgacacaauaacauacaaauguccacugauaacugaggucgaaccagaagauauagacuguugguguaauuuaacaucaacaugggugacuuauggaaccuguaaccaagcgggugagcacagaagggacaaaagaaguguagccuuagcuccgcauguuggaaugggucuggauacacgagcgcaaacuuggaugucugcggaaggggcguggaggcaaguugaaaaaguagaaacaugggcauuucgucauccuggauuuacuauccucgcauuauuucuggcucauuauauugguacuucgcuaacccaaaaagucguuauauuuaucuugcugauguuagucacgcccucaaugacuaugcguugcguuggaguaggaaaucgcgacuuuguugaaggacugucuggagcaacauggguugacguuguauuagaacauggagggugcgucaccacaauggcuaaaaauaaaccaacauuagacauugaauugcagaaaacugaagcaacacaacuggcgacucuucgaaaauugugcauagaagguaaaaucacuaauguaacuacggauucaagaugcccaacacaaggagaagcaauucuaccagaagaacaagaccaaaauuaugucugcaaacauaccuauguggacaggggauggggaaacgggugugguuuguuuggaaaagguagcuuaguuacuugcgcaaaauuccaaugucuugagcuaaucgaaggaaaaguuguacaacacgaaaaucucaaauacacagugaucauaacgguccacacgggagaccagcaccaaguaggaaacgaaacacagggaguuacagcugagauuacaccacaagcaucaaccguagaagcgauacuucccgaauaugguacauuaggucuagaaugcagcccucgaacagguuuagauuucaaugaaaugauauugcuuaccaugaaaaauaaagcauggaugguccacagacaaugguuuuucgaucuuccauuaccauggacauccggagcuacuacagagacuccuacauggaacaagaaagaacuauuagugacuuuuaaaaacgcacaugcuaagaaacaagaagugguuguguuagggagucaagaaggggcuaugcacacagcauugacaggugcaacagagauccaaacauccgguggaacaaguauauucgcgggacaucugaaaugccgauuaaaaauggacaaauuagaacuuaaagguaugucauacgcuauguguucaaaugccuuugugcucaagaaagaagugucagaaacacaacauggaacaauuuugaucaaaguagaauacaaaggugaggaugccccauguaaaaucccuuucucuacagaagaugggcaaggcaaagcacauaacggucguuugauaaccgcuaaccccguuguuacuaaaaaggaggaaccuguuaacauagaagcagaaccgccuuuuggagaauccaacauaauaauaggcaucggagauaaggcuuuaaaaauaaauugguauaagaaagguaguaguauuggaaaaauguuugaagcuacggcucgaggcgcgaggcguauggcaauacuuggugauacagccugggacuucgguagcguuggaggaguguuaaauucgcuaggcaagaugguccaucagauauucggaucugcuuacacggcuuuauucucaggggucagcuggauaaugaagauagguauuggcguucuauugacuuggauuggauuaaacagcaaaaauacuucaaugaguuuuaguuguaucguaauugguauaauaacacuuuacuuaggggcgguaguacaagcagacauggggugugugaucaauuggaaagggaaagaacuaaaaugugguucugguauuuucguuacuaacgagguacauacauggacagaacaauauaaguuucaagccgacucaccaaagagacucgcuaccgcaauagcuggagcuugggaaaauggaguaugugggauccguucgacaaccagaauggaaaaucuucuauggaaacaaauagcgaaugagcucaauuacauacucugggagaauaauauaaaguuaaccguuguagucggagacaucauuggaguucuagaacaaggcaaacgaacucucacaccucaacccauggaacuaaaauauucguggaaaacuuggggaaaagcaaaaauaguaacugcagaaauccaaaacagcucuuucaucauagaugguccuaauaccccagaauguccuaaugcuucccgagcauggaacgucugggagguagaagacuacgguuuuggaguauuuacaacuaauauuugguuaaaacugcgggaaauguauacacaacugugugaccauagacucaugagcgcugcuguaaaagaugaacgagcugugcaugcggacauggguuauuggauugaaucucagaaaaaugguucauggaaauuagaaaaagcuagucugauugaaguuaaaacgugcacuuggccuaaaucgcauacccucuggaguaacggaguucuugaaucagacaugauaauuccgaaaucauuagcaggacccauuagccaacauaauuaucggccaggcuaucacacacaaacagcgggcccguggcaucuaggaaagcuagaacuugauuucaauuacugcgaagggacaaccgucguuaucacggaaaauuguggaacaagaggaccaagccuucgaacaacaaccgucaguggcaaauugauacacgaauggugcugccguucauguacauugccgccgcuccgcuauaugggagaagacgguuguugguaugggauggagauaagaccuauaaaugaaaaagaagagaauaugguaaagagucuuguuucugcagguucuggaaaaguggacaacuuuacuaugggcgucuuaugucuagccauccuuuucgaagaagugaugcgagggaaauuugggaagaaacauaugauugccgguguacuuuuuauguuugugcucuugcuaagugggcagaucacauggagggacauggcaagaacucucauuaugauuggaucaaaugcaagcgacagaaugggcaugggaguaacauaucuugcauuaauagccacauuuaaaauucaacccuuuuuagcacuuggauucuuuuuaaggaaacuuacaucccgggaaaacuuauugcuugguguaggacuugccauggcaacuacauuacagcuacccgaagacauagaacaaauggcgaauggcauagcucuaggauuaauggcccucaaacuuauaacacaauuugagacauaucaauuauggacugccuuaguaucacuuaccuguagcaacacaauuuucacacuuacgguugcuuggcggacagcaacacuaauuuuagcagguaucagcuugcuuccaguaugucagucaucaucaaugaggaaaacggauuggcugcccaugacaguugcugcgaugggagucccacccuuaccacuauucauauucucacuaaaagauaccuuaaaacgcagaagcuggccguuaaaugagggggugauggccguuggccuaguaagcauauuagcuaguucauuacuaagaaacgauguaccuauggcggggccauugguagcuggcggguuacuuauugcauguuaugugauaacaggaaccagugcagauuuaacagucgaaaaagcggcugauguuacaugggaagaggaagcagaacaaacugggguaagucauaaucuaaugauaacaguggaugaugauggcaccaugagaauuaaagaugacgagacugaaaacauacugaccguauuauuaaagaccgcacuauuaauuguuucagggauauuuccuuacaguauccccgcgacacugcucguauggcauacauggcagaaacaaacacagagaagugguguauuaugggaugucccuaguccuccggaaacccagaaggccgaguuagaagagggaguuuauagaauuaaacagcagggaauauucggcaaaacacaaguagggguugggguccaaaaagaagguguguuucauacuauguggcauguuacaagaggagcaguucucacauacaauggaaagagacuagaaccgaacugggccucugucaagaaagaucugauuucuuaugguggaggauggcgccugagugcccaauggcagaaaggcgaggaaguacagguaauugcagucgaaccugggaagaaucccaaaaauuuucaaaccaugccuggcauauuucaaacaacuacuggagaaauaggagcaaucgcauuggauuuuaaaccaggaacaaguggaucacccaucauaaaucgagaggguaagguaguaggucuauaugggaaugguguagucacuaagaacggcgguuacgucagcggaauugcgcagacgaaugcugaaccagaugguccaacgccugaauuagaggaagagauguuuaagaaaaggaacuugacuauaauggaucuacacccagggucagguaaaacgagaaaauaccuuccugcaauuguaagagaagccauuaaaagacgacuucguaccuuaauacuggcaccuacgagggugguugcagcagagauggaagaagccuuaaaaggucuuccuauaagguaccaaacaacggcaacaaaaucagaacauaccggaaaggaaaucguagauuugaugugccacgcgacguuuacuaugagacuguuauccccagugaggguaccuaauuauaaccuaauuaucauggaugaagcacacuucacggacccugcuaguauugcggcaagaggauacauuucuacacgggucgggaugggagaagcagcagccauuuucaugacggcuacuccgccagggacggccgaugcguucccacaaucuaacgcuccaauccaagacgaggaacgggacauuccagaacgcagcuggaacaguggaaaugauuggauaacagauuuugcagggaaaaccgucugguuuguaccaagcauuaaagcaggaaaugauauagcaaauugcuuaaggaaaaauggcaagaaaguaauccaauugucaaggaaaacauuugacacagaauaucagaaaacuaaacuaaaugacugggacuucguagugacgacagacauuagugagaugggggcgaacuucaaggcagaucguguaaucgauccacgacgaugucugaagccagucauacugacggacggacccgaacgagugauacuagcgggcccaaugccaguuacaguagcaucggcagcucaaaggaggggaagagucgggagaaacccacaaaaagaaaacgaccaauacauauuuacgggacaaccauuaaauaaugaugaagaucacgcgcacuggaccgaggccaaaauguuacucgacaacauaaauacuccggaagggauaaucccugcuuuguucgagccagaacgggagaagucagcagccauagauggggaauacaggcuuaaaggggagucacguaaaacauucguagaauuaaugagaagaggagaucucccgguaugguuggcgcauaagguagcaucagaggguauuaaauacaccgacagaaaauggugcuucgauggagaaagaaauaaccaaaucuuggaagaaaauauggacguugagauuuggacgaaagaaggggagaagaagaaauugcgcccacgaugguuagaugcaagaacauacucagauccuuuggcauuaaaagaauuuaaagacuucgcagcuggcaggaaaagcaucgcauuagacuuaguuacagagauuggcaggguccccucacacuuagcccauagaacaagaaaugcuuuagacaauuuaguuauguuacauacauccgaacacgggggcagagcguaccgacacgccguugaagaacuaccagaaacuauggaaacauuauuguuacuaggucuaaugauacuguuaacaggcggagcuaugcuuuuucuuaucaguggaaaaggaguaggaaaaacuucaauaggccucauauguguaguagcauccucugguaugcuuuggauggcagauauaccgcuucaguggauugcuucagcgaucguauuagaguucuuuaugauggucuuauugaucccagaaccagagaagcaacggaccccacaggacaaccaguuagcauacgucguuauagggauacugacacuagcugcaauaguagcugccaaugaaauggggcuuuuagaaacgacaaaaagagaccuuggaaugucaaaagaaccuggaguaguuuccccuacaaguuaccuagauguugaccuccauccagcaucagcguggacccuuuacgcaguugcaacaacuguaauaaccccaauguugagacauacgauagaaaauucaaccgcuaacguaucauuagcugcaauugcaaaucaagcaguuguuuuaaugggauuagauaagggcuggccgauuagcaagauggaccuagguguaccgcucuuggcacugggaugcuacucacaaguaaauccauugaccuuaacugccgcaguauuauuauugguaacacacuaugcgaucaucggacccggauuacaagcuaaagcaacaagagaagcgcagaaaaggacugcugcaggaauaaugaaaaacccaacaguggauggaauuaugacuaucgaucucgauccaguaauuuaugauaguaaauucgaaaagcaacuagggcaaguaauguuacucguauugugugcggugcaauuacuauuaaugagaacaucaugggcauucugcgaagcacuaacauuagcaacggguccaauaacuacucucugggaagguucgccuggaaaauuuuggaauacaacgauugcugucucaauggcaaauauuuucagggguucguaucucgcgggcgcuggguuagccuucaguauaaugaaaaguguggggaccggcaagcgcggaacagggucccaaggagaaacauugggugaaaaguggaagaagaaauuaaaccaguuauccagaaaagaauuugacuuauauaagaaaucagguaucaccgagguagaucgaacagaagcgaaggagggccuaaagcguggugagacuacacaccaugcugucagucgagggucagccaaguugcagugguuuguggaacgaaacaugguaauaccagagggcagggugauugauuugggaugcgguagaggggguuggucguauuacugcgcaggacuaaagaaaguuacagaaguuaggggguacacaaaagguggcccaggucacgaggaacccgugcccaugagcacauauggauggaacauuguaaagcugaugagcggaaaggacguguuuuaucucccgccggaaaaaugugauacauuauuaugcgauaucggagaauccaguccaucgccaacaguugaggaaucucggacuauacgcguucuuaaaaugguggagccauggcuuaaaaauaaucaauucuguauaaagguucuaaaccccuacaugcccacagugauugagcaccuugaacgucuacagcgcaagcacggggguaugcucgucagaaauccacuaaguagaaauuccacacacgaaauguacuggaucucaaauggaacaggcaacaucguaucaucugugaauaugguuucuagauugcuucucaacagguucacuaugacauaccguaggccaacaauugaaaaagacguagaucucggcgcaggaacaagacauguaaacgccgaacccgaaacacccaauauggaugucauaggcgaaaggauucggagaauaaaagaagaacacagcucaacuuggcauuaugacgacgaaaauccuuacaaaacuugggccuaucaugguucauaugaagugaaagcaacuggcuccgccagcucaaugauuaacgggguaguaaaacuauuaaccaaaccuugggacgugguaccaacuguuacacagauggcaaugacagauacaacuccauucggucaacaaagaguuuuuaaagaaaaaguagauacucgaaccccaaaacccaugccggggacaaggaagguuauggaaaucaccgccggaugguuguggcguaccuuagguagaaacaagcguccuagacucuguacgagagaggaauuuaccaagaaagugagaacgaaugcugcuaugggagcgguauucacagaagagaaucaaugggacuccgcgagggcggcgguagaagaugaagaauuuuggaaauuaguugaucgcgaaagagaguuacacaagcaagguaaauguggaucuugugucuauaauaugaugggcaagagagagaaaaagcuaggugaauuugguaaagcaaaaggcagccgcgcaauaugguauauguggcuaggcgcaagauauuuagaguucgaagcccuaggguuccuuaacgaagaccacugguuuagucgagaaaauucauauuccggggucgaaggugagggauuacauaaacuaggcuauauucuacgagacaucucgaaaaucccuggaggggcaauguacgcugacgauacugcaggaugggacacucguauaacagaggaugauuuacauaacgaagaaaagauaacccaacaaauggacccagagcaccgucaacuggcuaacgcgauuuucaaauuaaccuaccaaaauaaaguugugaaaguacaaaggccaacuccaaaggguacgguaauggacauaauuucaagaaaagaucagagaggaucuggucaagucgguaccuaugggcuaaauacuuucacuaacauggaggcacagcugauacgacaaauggaaggggaagguguauuaucaaaaacugauuuagagaacccacaucuguuagagaagaaaauuacacaaugguuagaaacuaaagguguagaacgacuaaaacgaauggccauaagcggagaugauuguguuguaaagccaauugacgauagguuugcaaaugccuuguuagcacucaaugacauggguaaaguaaggaaagauauaccccaauggcaacccucuaaagguuggcaugauuggcaacaagucccauuuugcagucaccacuuucacgaacuaauaaugaaagauggcagaaaacuuguagucccgugcagaccucaagacgaacuuauaggcagagcgagaauaucccagggggcagguuggucgcuuaaggagacugcuugccuaggaaaggcuuacgcgcaaaugugggcacuaauguauuuucauagaagagaccuaagacuagcuaguaacgcaauuuguuccgcgguuccaguacauuggguuccaacuucaaggaccacgugguccauacacgcccaucaucaauggaugacgacggaggauauguuaacuguuuggaacagaguauggaucgaagacaacccuuggauggaagacaaaaccccuguuaccacuugggaagauguaccguacuuagguaaacgagaagaccaguggugcggaucauuaauaggacucacuucgcgcgccacaugggcgcaaaacauuuuaacagcgauucaacaaguccguagccuaauagguaaugaagaguuucuugacuacaugccgucaaugaaacgauuccgcaaggaggaggaaagugaaggcgcuauuugguaa

SEQ ID NO: 23561 - RNA, 9873 nt, Artificial Sequence
  derived and/or modified CDS sequence (opt6) from DENV-3__AY858045__SS-prME
acuucccucuguuuaaugaugauguuacccgcaacucuggcuuuucaccuaaccagucgugauggggaaccccguaugaucguugguaaaaaugaaagaggaaaaaguuugcuuuucaaaacggcaucagggauaaauaugugcacccuuauagcgauggaucuuggugaaaugugcgacgauacaauuacuuauaaaugcccgcugaucacugaaguagaaccugaagauaucgauuguugguguaaccuaacuucaacauggguaacauacggcacauguaaccaggccggugaacacagacgagauaaacguuccguugcauuagccccgcauguugggaugggauuagauacaagagcacaaacauggaugucagcagaaggggcuuggcgacaaguggaaaaaguugagacaugggcauuuaggcauccggguuucacaauacuagcccuauuucucgcacacuauauagguaccucucucacccaaaaaguagugauauuuauuuuacucaugcuaguaacacccucuaugacaaugagauguguaggugucgguaauagagacuuuguagaaggauuaagcggugcgacaugggucgacguaguauuggagcauggaggcugcgucacuacgauggccaaaaauaaacccacacuagauaucgaauuacagaaaacggaagccacacaacucgccacauuacgaaaacucugcaucgaagggaaaauuacuaacguaacaacugacagccgcugucccacacaaggggaagcgauacuaccagaagaacaagaucaaaauuaugucuguaaacauacauauguugaucguggguggggaaacgguugcgguuuauucgguaaaggaucuuuaguaaccugcgccaaauuucaaugucucgaacuaauagaaggcaaaguuguccaacaugagaaucucaaauauacugugauaauaaccguacacacaggcgaccagcaccaagucgggaaugagacucaagggguuacggcagaaaucacaccccaagcaaguacagucgaggcaauucuuccagaauacgguacacuaggauuagaauguucaccuagaacagguuuagacuucaaugaaaugaucuuguuaacuaugaaaaacaaggcuuggaugguacaucggcaaugguucuuugaucuuccccuaccauggacaagcggagcgaccaccgaaacaccaacuuggaauaagaaagagcuacuuguaaccuuuaaaaacgcucaugccaagaaacaggaagucgugguauugggcucccaagaaggcgccaugcacacggcacuuacuggagcuacagaaauucaaacgucuggugguacuuccaucuuugcgggccaucuaaaauguagauuaaaaauggauaaauuagaauuaaaagguaugagcuaugccauguguucuaaugcauuugugcugaagaaagaagucuccgaaacacaacacggaacaauucuaauaaaaguagaauacaaaggcgaggaugcucccugcaaaauaccauuuucaacagaagacggucaagguaaagcccauaacggccgacugauaacagcaaacccaguuguaacuaagaaagaagaaccgguaaacauagaagcugagccaccuuuuggcgagagcaacauaaucaucggcauaggagauaaagcccugaaaauuaacugguacaagaaaggauccucaauuggcaaaauguuugaagcuacagcaagaggagccagacgaauggcgaucuugggagauaccgcaugggauuucggaagugucggaggaguccuaaauucgcuuggcaaaauggugcaucaaauuuucggauccgcauacacagcgauauuuagcggagugucuuggaucaugaaaauagggauagggguauuguuaacguggaucggguuaaacaguaaaaauaccuccaugaguuuuucauguauaguaauaggaaucaucacacuauaucucggggcuguuguucaagcagacaugggauguguuauaaacuggaaagguaaagaauuaaaaugcggaucaggaaucuuuguaacgaacgaaguacacacauggacugaacaguauaaauuccaagcggauucaccaaaaagguuagccaccgcuauagcuggagcuugggaaaacggaguguguggcauaaggaguacaacccguauggaaaacuugcuauggaaacagaucgccaaugaacucaacuauauauuaugggaaaauaauauuaaacuuacuguaguagucggagauauaauaggaguccucgagcaaggaaagagaacacuuacaccgcaaccaauggaacugaaauauucuuggaaaacauggggcaaagcaaaaauuguuacagcagaaauacaaaacagcuccuucaucaucgauggacccaacacuccagaaugcccuaaugcaagcagagcuuggaauguaugggagguggaagacuauggauucggaguuuucacaacuaauauauggcuaaaacuacgugagauguauacgcagcucugcgaucauagauuaaugucugcagcaguaaaagaugaacgagcuguacaugcagacauggguuauuggauagaaucacagaaaaacggcuccuggaaauuagaaaaagcuagccuaaucgaaguaaagacuuguacauggccuaaaucacauacucucuggagcaacgguguucuugaaagcgacaugauaauucccaagucuuuagcuggaccaaucucacaacacaauuauagaccagguuaccacacucaaacagcgggaccauggcauuuagguaaauuagaguuggacuuuaauuauugugaaggaacgacaguaguaauuaccgagaauugcgggacacgagguccgagccucagaacuacaacaguuagcggaaaacuaauacacgagugguguuguagauccugcacgcuuccgccacugagguacaugggagaagacgguugcugguauggaauggaaauaagaccaauaaaugaaaaagaagaaaauaugguaaaaucauuaguuucugcagguucaggcaaaguagacaauuuuacuaugggagucuuauguuuagcaauauuauucgaagaagugaugagaggaaaguucgggaagaaacauaugauagcuggaguuuuauuuauguucguuuuacuccucaguggccaaauaacauggagagacauggcaagaacauugaucaugauaggguccaacgccucagacagaaugggaaugggaguuacauauuuggcgcuuauugcuacguucgagauacaaccuuuucuagcacugggcuucuuucuuaggaaauugacaucacgagaaaauuuauugcugggaguuggccuagcaauggcaacgacacugcaacuaccggaagauauagaacagauggcuaauggaauagcacuuggauugauggcacucaaacucauaacgcaauuugaaacguaucaauuauggacagcacugguuagccuaacauguucuaauacaauuuuuacacugacagucgcauggagaaccgcuacauugauuuuggcuggaauaucgcuauugcccgucugccaaucgagcucaaugagaaaaacugauugguugccaaugacaguggcagcaaugggaguaccaccccucccccuuuucaucuucucacucaaagacacuuuaaaacgaagaaguuggccacugaaugagggcguuauggcuguaggacuugucagcauacuugcaucaagucuguuaagaaacgacguaccaauggccgguccuuuagucgcuggagguuuauuaauagcuuguuauguaauaacggguacuucugcggaccucacaguagagaaagcagcggacgugacaugggaagaagaagcggaacaaacgggggugucacacaaucucaugauaacugucgaugacgaugguacaaugcguauaaaagacgacgaaacugagaauauucuuaccguucuauugaaaacggcacugcuuauagucuccggaauuuuucccuacaguauacccgcuacuuuauugguuuggcauacuuggcaaaaacaaacgcaaagaucaggugugcucugggaugucccaaguccacccgaaacacaaaaagccgaauuggaggaaggggucuaucgcauuaaacaacagggaauauucggaaaaacucaaguugguguuggaguucaaaaagaaggaguuuuucauacaauguggcacguaacaagaggggcugugcuaaccuauaacgguaagcgacuagaacccaacugggccagcgucaagaaagaccuaauauccuacggaggcgguuggagguuaucagcacaauggcaaaagggcgaagaaguucaagugauagcaguagagccgggcaaaaaucccaaaaauuuucaaacuaugccagguauuuuucaaaccacgacgggagaaauaggugcaaucgcacuagacuucaagccaggaacuucaggaucaccuauaaucaauagggaggguaaaguagucggacuauacgggaaugggguugucacuaagaaugggggauacgucucagguauagcucagacgaacgcugagccugacgguccaacacccgaauuagaagaagaaauguuuaagaaacgaaaucuaaccauuauggaucuucauccaggaucagguaagacacggaaguaucucccagcuauuguaagagaggcuauaaagcgaagauuaagaacgcuaauccuugcaccuacacgagucguagcggcagagauggaagaggcuuuaaagggauuaccuauacguuaucaaacaacugcaacuaagagugaacauacagggaaagaaaucguagauuugaugugccacgcaacauucacaaugagacuguugucacccguccggguaccuaacuacaaccugauaauaauggacgaggcucauuuuacagauccugcuagcauagcagcccguggauauaucucgacacgcguaggaaugggugaagcagcggcuauauucaugaccgccacaccaccaggaacagccgaugcauuuccacagagcaacgcacccauacaagacgaagaacgagauauuccagagagauccuggaauagcggaaacgacuggauaacugauuuugcugguaaaacgguuugguuugucccuucaaucaaagcuggcaacgacauugcaaauuguuuaagaaagaacgggaagaaagucauacaauuaagucgaaagacauuugauacagaguaccagaaaacuaaacuaaaugauugggauuucgugguuacaacagauauaagugaaaugggcgcuaacuuuaaagcagaucgagucauagacccgagaagaugccuaaagccaguaauacuaacagaugguccagaaagagugauacuggcaggcccaaugccaguaacuguagcgucggccgcucaaagaagaggucgaguaggaagaaauccucaaaaagagaaugaucaauacauuuuuacaggucaacccuuaaacaaugaugaggaucaugcacauuggacggaagcaaagaugcuucuagacaacaucaacacaccagaagggauaauuccugccuuauuugaaccggaacgcgagaaauccgcggcaauugauggcgaauaccguuuaaaaggugaaucaagaaagaccuuuguagagcuaaugagacgaggcgaccuaccaguguggcuagcgcauaaaguggcaucagaaggaauuaaauacacggauaggaaaugguguuuugauggagaacgaaauaaucagauacuugaagaaaauauggacguagagauuuggacaaaagaaggagagaagaagaaacuucgcccaagguggcuagacgccagaaccuacucugacccuuuagcacuaaaagaauuuaaagacuuugcagcagguagaaagucgaucgcuuuggaccugguuacagagauagguagagugccaucacacuuggcacauagaacgcguaacgcacuugauaacuuaguuauguugcauacaagugaacacggagggcgagcguauagacaugcggucgaagaacuuccugagacgauggaaacauuacuucuauuggguuuaaugauucuuuuaacaggaggugcuauguuauucuuaauaucgggaaaggguguagguaaaaccucaauuggauugauauguguaguagcaucuagcggaaugcuuuggauggcugauauuccguuacaauggauagcaucugccauaguucuagaauuuuucaugaugguacuauuaauuccagaacccgaaaaacagaggacaccccaagauaaucaacuagcuuacguaguaauaggaaucuuaacgcuggcagcaauaguagccgccaacgaaaugggccuauuagagacaacaaaacgcgaccugggaaugucaaaagaacccgguguuguaagcccaacaaguuauuuagauguagacuuacacccagcgagugcuuggacauuauacgccguggccacgacugucauaacaccaaugcuacggcauacgauagaaaauuccacagcgaaugugagccuggcugcaaucgccaaucaggcuguuguuuuaauggguuuagauaaaggauggccuauaucuaagauggauuuaggggucccauuacuagcacuagguuguuacucacaagucaauccuuugacccuaaccgcggcaguacucuuauuaguaacucacuacgcgauuaucggcccgggauugcaggcuaaagcgacuagggaagcacaaaaacggaccgcggcagggauuaugaagaacccgacuguagaugggauaaugaccauugacuuagauccuguaaucuaugauucaaaauuugagaagcaauugggucagguaaugcuauuaguacuaugugccgugcaacuacugcuaaugagaacaaguugggcguuuugugaggcacuuacacuagcuaccgggcccauuacuacacuaugggaagguuccccaggaaaauuuuggaauacuacuaucgcgguaagcauggcuaauaucuuuagaggaucauacuuggccggagccggacucgcauuuucgaucaugaagucagucggaaccgguaaaagagggacaggcucacaaggcgaaaccuuaggcgagaaauggaagaaaagacuuaaucagcuuucucgaaaagaauuugaucuguauaagaaguccggaaucacggaaguugaucguacagaggcaaaggagggauugaaacgaggcgaaauuacucaucacgcagugucuaggggcucagcaaaauuacaaugguucguagaaagaaauauggucauucccgagggaagagugauagauuuaggguguggaagaggggguuggaguuauuauugugcuggccuuaagaaaguaacugaagucaggggauauacaaaagguggccccggccaugaggaaccaguucccaugucaacguauggauggaauauuguuaaauuaaugagcggaaaagacguauuuuaccucccuccugagaaaugugauacacuacuuugcgauauuggugaaucaaguccaucucccacuguagaagagucuagaacuauaagaguccuaaaaaugguagaaccgugguuaaagaauaaccaguuuuguaucaaaguucuuaacccguacaugccaacaguaauagaacaucuagaaagacuucagagaaagcauggagggauguuaguacguaaccccuuaagcagaaauucaacacacgaaauguauuggaucucaaacgggacaggaaauauaguaucaagcguuaauaugguaucuaggcuccuuuuaaacagauucaccaugacauacagaagaccuaccauagaaaaagauguagaccugggcgcaggaacucggcacguuaaugcagaaccggaaacaccuaauauggacguaauaggcgaaaggaucagaagaaucaaagaagaacauaguagcacguggcauuaugaugaugagaauccauauaaaacuugggccuaccaugguuccuacgaaguaaaagcgacaggcucagcaucaucgaugauaaauggagucgucaagcuauuaacaaaaccaugggacgucguaccgacgguaacucaaauggcaaugacggacacaaccccguuuggucaacaacgaguuuuuaaagaaaaaguggauaccagaacuccuaaacccaugccagggacucgcaaaguaauggaaauaacugcggggugguuauggcgaacauugggccggaacaagcgaccgcgccuuuguacaagagaggaauuuacaaagaaggucagaacuaacgcagcuaugggagcagucuuuacagaggaaaaucagugggacucagcgcgugcagcuguggaagacgaagaguucuggaaauugguggacagagaaagagaacuccacaagcaagguaaaugcggaagcuguguauacaauaugauggggaagagagagaagaaacuuggugaguucgguaaggcuaaaggaaguagagcaauaugguacauguggcucggagcucgcuaucuugaauuugaagcacuaggauuuuugaaugaagaccacugguucaguagagaaaacucauauagugggguagaaggagagggccuccauaaacuuggguacauauuaagagauauaucaaaaaucccgggaggcgcgauguaugcggaugauacggcaggaugggauacgagaauaacggaagaugaccuacauaaugaagagaaaaucacacaacaaauggaccccgaacaucgucaacuagcuaaugcgauuuuuaaauuaacauaucagaauaaaguaguaaagguacaacgacccacaccaaaaggaaccguuauggauauaauaagccguaaagaucaacggggaaguggucaagucgguacauacgggcucaacacauucacaaauauggaagcacaacuaauucgccagauggaaggcgaaggcguacuuucaaaaacugauuuagagaauccacauuuauuagagaagaaaauuacacaaugguuggaaacuaagggaguggaaagauuaaaaagaauggcaaucuccggagaugacuguguaguuaaacccauugaugaucgcuucgcuaacgcuuuauuagcccuaaacgauaugggaaaaguuaggaaggauaucccccaguggcaaccuucaaaaggcuggcacgauuggcagcagguaccauuuuguagccaucauuuucacgaguugauaaugaaagacggaaggaaacugguggugccauguagaccacaagaugaacuaauaggacgggcaagaauaucucagggugcgggauggucacucaaagaaacggcuuguuuggguaaagcauacgcucaaaugugggcguuaauguacuuccacagacgagaccuaagauuggcaucuaaugcgauaugcucagccguuccaguacauugggugccgacuucuaggacaacauggucaauucaugcgcaccaccaauggaugacaaccgaagauaugcuuacuguauggaauagaguguggauugaagauaacccuuggauggaagacaaaacaccgguaacaaccugggaagaugugccauaccugggaaaaagagaagaccaaugguguggaucauuaauuggccucacaagucgggcgaccugggcucaaaauauccucaccgccauacaacaaguccgaagccucaucggaaaugaagaguuccuggauuacaugccaaguaugaagcgauuucgcaaagaagaggaaagugagggcgcaauaugguaa

SEQ ID NO: 23562 - RNA, 9873 nt, Artificial Sequence
  derived and/or modified CDS sequence (opt6) from DENV-3__AY858046__SS-prME
acaaguuuaugccuaaugaugauguugccggcgacuuuggcguuucaucuaacaucccgagauggugaaccaagaaugauagucgguaaaaaugaaagagggaaaagccuacuauuuaaaacggcaucagguauaaacaugugcacucuaaucgcgauggauuuaggggaaaugugugacgauacaauaacauauaaaugcccauuaauuacagaaguugaaccagaagauauagacuguugguguaaccucacaucuacauggguuacuuaugguacguguaaucaggucggggaacacagacgcgacaagaggagcguagcauuagcuccacauguggggaugggauuagauacacgugcgcaaacuuggauguccgcagaaggugcauggagacaaguagaaaaagucgaaacuugggcauuccgacacccaggguucacuauauuggcauuguuucuggcacauuacauaggaacaucauuaacacaaaaaguuguaaucuucauacuauuaauguuagucacaccaaguaugaccaugcgaugcguugguguuggaaaucgagacuuuguugaaggauuaaguggggcaacgugggucgaugucguuuuggaacaugguggauguguaaccacaauggccaaaaauaaaccaacguuggauauugaacuccagaaaacggaagcgacacaauuagcgacuuuacgaaaacuguguauagaagguaaaauaacaaaugucacaacagauucacgauguccaacacaaggagaagcuauccucccagaagaacaagaccaaaauuauguauguaaacacacauaugucgauagaggaugggggaauggaugcggcuuauucggaaaagguucacuuguaacaugugcgaaauuccaaugcuuagaauuaauagaaggaaaagucguccaacaugaaaaucuaaaauauacagugauaauuaccguucacacgggggaucagcaucaaguaggcaacgaaacccaaggcgucacagcagaaauaaccccgcaggcuucaacaguagaagccaucuuaccugaauacggaacucugggauuagaauguucaccaagaacuggacuagacuucaaugaaaugauucuucucacgaugaaaaauaaagcguggaugguacaucgucaaugguucuuugauuuaccuuugccguggacaucuggcgcaacgacugaaacgccgaccuggaauaagaaagaauugcuaguaacauucaaaaacgcgcaugcuaagaaacaagaaguugucguacuuggcucacaggagggggcgaugcauacagcguugacaggcgcaacugaaauacaaacgucugggggaacaagcauuuucgccggccacuuaaaauguagauuaaaaauggacaaauuagaguuaaaaggaaugucauaugccauguguucgaaugcauucguguuaaagaaagaagucucugaaacucagcaugguacuauucuaaucaaaguggaguauaaaggcgaggaugcuccaugcaaaauaccauuuucaacggaagacggccaagguaaagcacauaaugggagguugauaaccgcuaacccaguaguaacuaagaaagaggaaccuguaaacaucgaagcagaaccacccuuuggggaaagcaauauuaucauugguauaggagauaaagcgcuaaaaauuaacugguauaagaaagguucaagcaucgguaaaauguucgaagcaacagcaagaggagcaagacgaauggccauucuaggagauacggcaugggauuuugguucuguaggaggaguucuaaauucuuuagguaaaaugguccaucaaauuuucggcucagccuacacugcauuguucucgggugucucguggauaaugaaaauaggcauuggcguauuacucaccuggauagguuuaaauagcaaaaacacuucuaugucauuuaguugcauaguaauaggaauaaucacacuguauuugggggcuguagugcaagcagauaugggaugcguaauuaauuggaaagggaaagaauuaaaauguggaucagggaucuuugucacaaaugaagugcauacguggacugaacaguauaaauuucaagccgauucaccaaaaagauuagccacggcaauagcaggggcaugggaaaaugggguaugcggaauuagaucgaccacaagaauggaaaaucuuuuguggaaacaaauagcaaacgaauuaaauuacauacugugggagaauaacauuaaacuaacggucguugucggcgauauuauuggagucuuagaacaggguaaacguacauuaacaccucaaccuauggaacucaaauauaguuggaaaacuugggggaaagcuaaaaucguaacugcagaaauucaaaauaguucguucauaauagauggaccuaauacuccagaauguccaaaugcuucacgugccuggaauguaugggagguggaagauuacggguuuggugucuucacaaccaauaucuggcucaaauuaagagaaauguauacacaacuaugugaucauagauugaugucagcugcaguaaaagaugaaagagcaguucacgcugacaugggguacuggauugagucucagaaaaauggaaguuggaagcuagaaaaggcuucacuaauagaaguaaagacaugcacguggccaaaaagccauacauuguggucgaauggaguauuagaaucagacaugaucauuccaaaaagucuagcggguccaauaagucagcauaacuaccguccugguuaccacacgcagacagcaggaccauggcaucugggcaaguuggaauuggauuuuaacuacugcgaggggaccacggucguaauaacggaaaauuguggcacgaggggaccuucgcuuaggacaacaacuguuagcgguaaguugauacaugaauggugcuguagaaguuguacuuuaccaccucuacgauauaugggagaagacggaugcugguauggaauggaaauacgaccaauaaaugagaaagaggagaacaugguaaaaucuuugguaagugcagguagcgggaaagucgacaauuucacaauggguguucucugccuagcaauccuguuugaagaagugaugcgcggaaaauucggcaagaaacacaugauagccggaguacuuuucauguuuguauuauuauuauccggucagauaacauggagagacauggccagaacuuuaauaaugauugguagcaaugcaagcgaucguaugggcaugggggugaccuauuuagcauuaaucgcuacauucaaaauucagccguuucuggcacuuggauucuuuuuaagaaaacugaccagucgggaaaauuuguuacucgguguggguuuggcuauggcgacuacacuacagcugccggaagauauagaacaaauggccaauggaauugcacuugguuuaauggcacuaaaauugauuacccaauuugaaacuuaccaauuauggacagccuugguaaguuuaacuugcucaaauacuauuuuuaccuugacuguagcauggagaacagcuacuuuaauccucgcugguauaucuuuauuacccgugugucaaucuucaaguaugcgcaaaacagacugguuaccaaugaccguugcugcaauggguguuccuccacuaccgcuguucaucuuuucgcuaaaagacacucuaaagcgcaggaguuggccuuuaaaugaaggcguuauggcgguaggauuggugagcauacuagcgucaucauuacucagaaacgauguacccauggccggaccccuaguugccggugguuugcuuauagcgugcuauguaaucacagguacaagugcagaucuaacaguugaaaaagcggcagauguaacuugggaggaagaagcggaacagaccggaguaagucauaacuuaaugaucacuguggaugaugacgguacaaugcggauaaaagaugacgaaacagagaauauacuaaccguacuacuuaaaacagcacugcuaauaguaucggguauuuuuccguauucgauaccagcgacccuucuuguauggcauacauggcaaaaacagacacaacgaucaggaguucucugggauguaccgucgcccccugaaacccaaaaagcagaacuagaagaaggcguauaucgcauaaagcaacagggcauauucggaaaaacucagguagguguggggguucaaaaggagggaguauuucauacaauguggcauguuacacgcggcgcagugcuuacauacaauggaaaacgacuggaaccaaauugggccagugucaagaaagaucugauaagcuaugguggagguuggaggcuaucugcgcaauggcagaaaggagaagaaguucaaguuaucgcuguagaacccggcaaaaaccccaaaaauuuucaaaccaugccgggaaucuuccagacaacgacgggcgagaucggagccauugcacucgauuuuaaaccuggaacaaguggcaguccaauaauuaauagagaaggaaaaguagugggauuauacgguaauggaguaguuacgaaaaacggaggguauguaucggggaucgcucaaacgaaugccgaaccugaugggcccacuccugaauuagaagaagagauguuuaagaaacgcaauuugacaaucauggauuuacacccuggcucgggcaaaacuagaaaauaucucccugccauuguucgagaggccauaaagcgucgacuaagaacacuaaucuuggcuccuaccagaguuguggccgcggaaauggaggaagcccuaaaggggcucccaauacguuaccaaacaacggcuacaaaaagugaacauaccggaaaagaaauaguagacuugaugugccaugcgacauuuaccaugaggcuguuguccccggugcgagugcccaacuauaaucuaauaauaauggacgaggcacauuucacagaccccgcaaguauagccgcucguggguauauauccacucgaguuggaaugggugaagcagcagcaauauuuaugacagcaacgccuccagggacugcagaugcguuuccacagucgaaugcaccaauccaagacgaggagcgcgacaucccggaaaggucauggaacuccgggaacgauuggauaacggacuucgcagguaaaacaguuugguucgucccgagcaucaaggccggaaaugauauugcuaauugccugaggaaaaauggaaagaaaguuauacaacuaagucgcaaaacuuuugauacggaauaucagaaaacuaagcuaaaugauugggauuuuguuguuacaacugacauaagugagaugggugcgaauuucaaagcagaccguguaauagauccucggcgcugccuaaaaccgguaaucuuaacagauggaccagagagggucauacuggcagguccuaugccgguuacaguagcaagugcggcucaaaggaggggcaggguuggccguaacccccaaaaagaaaaugaucaauauauauuuacaggacaaccguugaacaaugaugaagaccacgcucacuggacagaagcgaaaaugcuccucgacaacauaaacacuccggaagggauuauuccagcgcuuuuugaacccgaacgugaaaaaucugcagcuauugauggggaauauagauuaaaaggagaaagccgaaaaacauucguugaacugaugcggcguggggauuuaccggugugguuagcacauaaaguagcuagugagggcauaaaauauaccgacaggaaauggugcuuugacggagagcguaauaaccaaauccuagaggaaaauauggacguggaaauauggacuaaagaaggugaaaagaagaaauuacggccacgauggcuggaugcaagaacguacagcgauccacuugccuuaaaagaguucaaagacuuugcggcuggaaggaaaaguauagcgcuagaccucgugaccgaaauaggaagagucccaucacauuuggcacacagaacucggaacgcuuuagacaauuuagucauguugcacacuucagaacauggaggaagggccuauaggcacgccguugaggaguuacccgagacaauggagaccuugcuccuauuaggacuaaugauuuuauuaacgggaggggcaauguuauuucuaaucucagguaaagggguaggaaaaacaaguaucggccuuaucugugugguagcuucaagugggauguuguggauggcagacaucccauuacaauggauagcuagugcuauaguguuagaguucuuuaugauggucuuacuaauaccugaaccugaaaaacaacgcacaccacaagauaaucaacuugccuacguaguaauugguauucuaacguuagcagcaauuguugcugcuaaugagauggguauguuagaaacaaccaaacgugauuuaggcaugucaaaagaaccaggggucgugucgccuacaucuuaucuagauguagaccuucauccggcuucggcauggacccuauacgcaguagcaacaacugugauuacgccuauguuacgacacaccauagaaaacucuacugcaaacgucagccuagcagcuaucgccaaucaggcaguaguuuuaauggguuuagauaaaggauggccuauauccaaaauggaccuuggagugccccuacuugcccuaggguguuauagccaaguaaacccacuuacucuaaccgcagcugugcuauuauuaguaacucacuaugccauaauaggaccugguuuacaagccaaagcaaccagagaggcacagaaacgcaccgccgcagguauuaugaaaaauccgacuguagaugguauuaugacuaucgacuuagaccccguaauuuaugauucaaaguuugaaaaacaacuaggccaaguuaugcucuuagucuuaugugcuguucaacuucuacuuaugagaacaucgugggccuuuugugaggcacuaaccuuagcuacuggacccauaacuacccuaugggagggaaguccaggcaaauuuuggaauacaacaauugcaguguccauggccaacauuuuuagaggauccuauuuagcaggagccggauuagcguuuucaaucaugaaaagcguuggaacagggaaacgaggaacagguucacagggagaaacauuaggagaaaaauggaagaagaaacuaaaccaacuaucuagaaaagaauuugaccuauacaagaaaagcgguauaacggagguggaucgaacagaagcaaaggaaggcuuaaggcggggcgaaauaacgcaccaugcgguaucuagagguucugcaaaacuacaaugguucguggaacguaacaugguaaucccagaaggaagagugauugaucuagguuguggaagggguggcuggaguuauuauugcgcuggucuuaaaaagguaacagaaguucgugguuauaccaaaggcggaccaggccaugaggagccuguaccaauguccaccuaugguuggaauauaguuaaacuaauguccggaaaggacguauuuuaucuaccaccagaaaaaugcgauacauuacugugcgauauuggugaaucaucgccaucgccaaccgucgaagaaucuagaacgauaaggguuuuaaagaugguagaaccauggcucaaaaacaaccaguucuguaucaagguacucaauccguauaugccaacagucauagaacaccuagagagacuacaacgaaaacauggagggauguuaguaaggaauccacuaucuagaaacaguacucaugagauguauuggauaucgaacgggacgggcaauauagucucuucaguaaauaugguaucaagauugcuacuaaauagguuuaccaugacauauagaagaccaacaauagaaaaagaugucgaucuaggugcugggacgcgacauguuaacgcugaaccugagaccccuaacauggauguuaucggggaaaggauucgaagaauuaaagaagaacauaguagcacguggcauuacgacgacgaaaacccauacaaaaccugggcauaucaugguucuuacgaaguaaaagcaacuggaagcgcgaguuccaugauuaaugguguaguuaaacuauuaacaaaaccaugggacguagugccuacugugacacaaauggcaaugacugauaccacaccuuucggucaacaaaggguuuuuaaggagaagguugauacccgaaccccaaaaccgaugccuggaacuaggaaggcuauggagauuaccgcuggauggcuuuggagaacguuagggcggaacaagagaccaagacuguguacgcgagaagaguuuacgaagaaaguacguacaaaugccgccaugggagcggucuuuaccgaagaaaaucagugggacuccgcaagagcggcagucgaagaugaagaauuuuggaaacugguugacagggagagggaauuacauaaacagggcaaguguggguccugcguuuauaauaugaugggcaaacgcgagaagaaauuaggcgaguucggcaaagcaaaaggaucucgcgccauuugguauauguggcuuggagcgagauacuuagaguucgaagcccuaggauuuuuaaaugaggaucauugguuuucacgcgagaauaguuauucaggugucgaaggagaaggguuacauaaauuagguuauauacuaagagauauuaguaagauaccuggcggggcaauguaugccgaugauacggccggaugggacacacguauaacugaggaugacuuacacaaugaggagaaaauaacgcaacaaauggacccggagcacagacaauuggccaaugcuauuuuuaaacuaacuuaucaaaacaaagucguaaaaguccagcggccgacacccaaagguacaguuauggauaucauaagccgcaaggaucaacgcgguucaggacaggucggcacauauggguugaauacauuuacgaauauggaaguccaacucaucaggcaaauggagggugagggaguucuauccaaaacugaucuggaaaauccucauuuauuagagaagaaaaucacacaguggcuggaaacaaaaggcgucgaaagguugaagaggauggcaauuaguggagacgacugcguaguuaagccaaucgaugaucgauuugcaaaugccuugcucgcguuaaaugauaugggaaaggugagaaaggacauaccgcaauggcaacccucuaaaggauggcaugauuggcaacagguccccuucuguagucaucauuuucaugaauuaauuaugaaggaugguagaaagcuagucgucccaugcagaccacaagacgaguuaaucggacgagcaagaauuucucagggagcaggguggagucuuaaagaaacagcauguuuggguaaggcuuaugcacagaugugggcgcuaauguacuuucaucgacgagaucuaaggcuggcuuccaaugcaauauguagcgcgguucccguucauugggugccaacaagcagaacuacauggucaauacacgcgcaucaucaauggaugacaacugaagauauguuaaccgucuggaacaggguauggaucgaagauaauccuuggauggaggauaaaacccccguuacaacgugggaagacguaccauauuuagguaaaagggaagaucagugguguggcagcuuaauaggauuaacgucgcgcgcaacaugggcgcaaaauauccuaaccgcaauacaacaggucagaucauugauugguaaugaagaauuucuugauuauaugccuucaaugaaaagguuccguaaagaagaggaaucagaaggagcaaucugguag

SEQ ID NO: 23563 - RNA, 9873 nt, Artificial Sequence
  derived and/or modified CDS sequence (opt6) from DENV-3__AY858047__SS-prME
accucacuaugucuaaugaugauguuaccagcaacucucgcuuuucacuuaacuucgagagauggagaaccgagaaugaucguaggcaaaaacgaaagagggaaaucuuuacuauuuaaaacugcgucuggaauaaacaugugcacgcucauugcuauggaucuuggggaaaugugugaugacacagugaccuauaaauguccauuaauuaccgaaguagaaccagaagauauagauuguuggugcaacuuaacaaguacauggguaacauacggaacauguaaccaagcaggagaacaucgaagagauaaacgaucaguagcgcuggccccacacguaggaaugggauuagacacgagggcacaaacauggaugucagcggaaggugccuggaggcaaguagaaaaaguagaaacgugggcguuccgucacccaggauuuacgauacuggcuuuguuucucgcgcacuauauaggaacaucguuaacgcaaaaaguagugauauuuauacuucucaugcuaguuacgccaucaaugacaaugagaugcguagggguagguaacagagauuuuguggaaggauuauccggugcaacauggguggaugucguccuagagcacggcggaugugugacgacaauggcuaaaaauaaaccuacauuagacauagagcuacagaaaacugaagcaacacaacuugccacuuuacgcaaauuaugcauugaaggaaaaauaacaaacgugacaaccgacaguagguguccaacucaaggcgaagcaauauuaccagaagaacaagaccaaaacuaugugugcaaacacaccuauguagacagagggugggguaacggaugcggacuguucggaaaaggcaguuuagugacuugugcaaaauuucaaugccuagaauuaaucgaaggaaaagucguucaacacgagaaucuuaaauacacggucauuauaaccguacacacaggugaccaacaucaagugggaaacgaaacccaaggugucacggcagaaauaaccccucaagcaaguacuguagaagccauuuuaccggaauauggaacucuaggucuggaaugcaguccucgcaccggacuggacuuuaaugagaugauauuacuaacgaugaaaaacaaagccuggaugguacacaggcaaugguuuuucgacuuaccccuuccuuggacuucuggugcuacaacagaaacaccuacguggaauaagaaagaauugcucguaacauuuaaaaacgcacacgcgaagaaacaagagguaguuguauuaggcucacaagagggagcaaugcacaccgcauugacaggggcaacugaaauacaaacgucagggggaacauccaucuuugccggacaucuuaaaugucgauuaaaaauggacaaacucgaguugaaagguaugagcuaugcaaugugcaguaaugcauuuguucuaaagaaagaggucucugagacucaacaugguacaauucugauuaaaguagaauacaaaggagaggacgcgccauguaaaauuccauucucuacugaggacggucaaggaaaagcgcacaacggacgauuaaucacggcaaaucccgugguaacgaaaaaggaagaaccagugaacauugaggcagaaccuccguucggugagucaaauaucauaauuggcauaggugauaaagcauuaaaaaucaacugguauaaaaaggggucaucuauagguaaaauguucgaagcaacugcuaggggagcacgcagaauggcgauucuaggggacaccgcaugggacuuuggaucagucggaggaguacuaaacagcuugggcaaaaugguccaccaaauauuuggaucagcuuauacugcacucuucaguggaguguccuggaucaugaaaauaggaauaggaguacuccucacauggauaggucucaacuccaaaaacacaagcaugagcuuuucauguauagucauuggaaucaucacacuauaccugggagcuguagugcaggcugacaugggauguguaauaaauuggaaggguaaagaacuuaaaugcggaaguggaauauuugucaccaaugaggugcauacauggacggagcaauacaaguuucaggcagauagcccuaagcgucuagccacagcuauagccggagcuugggaaaauggcgucuguggaaucaggucaaccacucgcauggaaaaucuguuauggaaacaaauagcuaaugaacuaaauuacauacuuugggaaaacaacauuaaacuaaccguuguggucggggacaucauagguauauuagaacagggaaaacgaacauuaacuccccagccaauggaacucaaauauuccuggaaaacguggggcaaagccaaaauugugacugcagaaauucaaaauaguagcuuuaucaucgacggaccgaacacgcccgaauguccuaaugccuccagagcuuggaacguuugggagguggaagacuaugguuuuggcguauuuacaacaaauaucuggcuaaaauuacgagaaauguacucucaacugugugaucacagacucaugucagcugccguuaaagaugagagggcaguucaugcagauauggguuauuggauagagagucagaaaaacgguucauggaaacuagagaaagcgucacuuauagaaguaaaaacuuguaccuggccuaaaagucacaccuuguggucgaaugguguauuggaaucugacaugauaauaccaaaaaguuuagcagggccaauaagucaacauaacuaucgcccgggcuaccacacgcaaacagcgggcccauggcaccuaggcaaacuagaguuagauuuuaauuauugugaaggaaccaccgucguaaucacugaaaauugugguacuaggggaccaucacuuagaacaacaacuguguccggaaaacuaauacaugaauggugcuguagaaguuguacucucccuccacuuagguauaugggagaagauggcuguugguauggcauggaaauuagacccauuaacgaaaaagaagaaaacaugguuaaaucccucguuucagcaggaucuggaaaaguagacaauuucaccaugggaguauuaugccucgcuaucuuauuugaagaaguaaugaggggaaaauuuggcaagaaacacaugauagcaggaguacuguuuacauuuguuuuacuacucucaggccaaauuaccuggcgcgauauggcaaggacgcuuauuaugauaggaucaaacgccucagaccggaugggaaugggcguaaccuaucuagcgcuaaucgcuacuuuuaaaauccaaccauuucuagcauuaggcuuuuucuuaaggaaacugacgaguagggaaaaccuuuuacugggaguggguuuagcaauggcaacaacauuacaauuaccagaagauaucgaacaaauggccaacgggauagcacuagguuuaauggcauuaaaauuaauaacccaauucgagacuuaucaacuguggacugcacuugucucauuaaugugcucuaauacgaucuuuaccuuaacgguggcauggcgaacugcaacuuugauacuugcaggaaucucacuuuugcccuuaugccagucgaguaguaugcgaaaaacagauuggcuaccaaugacuguagcagcaaugggcguacccccauuaccuuuauuuaucuucucucuaaaggacacucucaaaaggagaucguggccucugaaugaaggcgugauggccgugggauuggucaguauacucgcgucaucuuuacuucgaaaugaugucccaauggcggggccauuagucgccggaggacugcuaaucgcguguuaugucaucacugggaccucugccgaucuuacuguagaaaaagcagccgacgugacaugggaagaagaagccgaacagacaggaguuagucauaauuuaaugauaacagucgacgacgauggaacgaugagaauuaaggaugacgagaccgaaaauauacuaacaguacuuuuaaaaacggcauuauuaauuguuagcggcauauuuccuuacucaauaccagcgacauuacugguauggcacacauggcagaaaagaacucaacguucugguguacugugggacgucccaaguccgcccgaaacccaaaaggcagaauuagaagaaggaguguauaggauaaaacaacaaggaaucuuaggaaaaacacaagugggcguugggguacaaaaagaaggaguguuccacacaauguggcauguaacacgaggugcaguacuaaccuauaaugguaaaagauuagaaccuaauugggcuucggucaagaaagaucucaucaguuauggcggggguuggagauuaucagcacaguggcaaaagggagaggaagugcaaguaauagcugucgagccuggcaaaaaccccaaaaauuuccagacaaugcccgguauuuuccaaaccacaacuggagaaauuggagcuauugccuuagauuuuaagccuggaacaucagguagcccaauuauuaauagagaaggcaaagugguaggcuuauacgggaacgggguagugacuaaaaaugggggauacgucagcggaauagcccagacaaacgcggaaccagacggaccaacaccugaauuggaagaggaaauguuuaagaaaagaaaucuaaccauaauggauuuacauccaggaagcggaaaaacaagaaaauaccuccccgcaauaguuagagaggccauuaaaagacggcuuagaacacuuauucuagcgcccacacgcguaguggccgcugaaauggaggaggcauuaaaaggauuacccauuagauaccaaacgacugcgacaaaaagugagcacacaggcaaagaaauuguagaucuaaugugucaugcuacauuuacuaugcgacuacuuucuccuguccgagugccgaacuauaaccuaaucaucauggacgaagcacacuucacagauccggcaucaaucgccgcgagaggcuacauaucaaccagagugggaaugggagaggcugcugcaauuuucaugacagcuaccccaccgggaacugcagaugcuuuuccccaaaguaaugcaccaauccaagacgaagaaagagauauuccugaaagaucguggaauagcgguaaugacuggauaacggacuuugcugguaagacagugugguucguaccgucuaucaaagcugguaacgacauagcaaauuguuugagaaagaaugguaagaaaguaauacaauuaucucgaaaaacguucgacaccgaauaccagaaaacgaaauuaaacgacugggacuucgucguuacaacagacauuucagagaugggagcuaacuucaaggcagaccgaguuauagacccacgccgaugccucaaaccaguaauauuaacugacggaccggaacgaguaauacuugccggcccaaugccuguuacuguagcaucugcugcacaacgccgggguagaguagggcguaauccucaaaaagagaacgaccaguacauuuuuacaggccagccucucaacaacgacgaagaucaugcacauuggacagaagcaaaaaugcuauuagauaauauaaacacaccugaagguaucaucccugcacuauucgaacccgaaagagaaaaaucagcagcaauagauggugaauauaggcuaaaaggagagucgagaaagacauuuguggaacuaaugagaagaggagaucugccagucuggcuugcacacaaggucgcgucagaggguauaaaguauacggauaggaaaugguguuucgacggcgaaagaaacaaccaaauucuugaagaaaauauggacgucgaaauauggacaaaagagggcgagaagaagaaauugagaccgagauggcuagaugcaagaacuuacucagauccgcuagcauuaaaagaauuuaaagacuuugcagcugguagaaaaucaauagcacuagacuuaguaacagaaauaggacgcgucccuucccauuuagcgcaccgaaccagaaaugcguuagauaauuuggucauguuacacaccucagaacauggaggcagagcuuauagacacgccguagaggaacuaccagaaaccauggagacuuuauuacuacucggauugaugauacuacuaacagggggaguaauguuauuucuaauuucggguaaaggaguuggaaagacgaguauugguuuaaucugugugguugcgucuucagguaugcuauggauggcugauauucccuuacaguggauagccagcgcaauuguacuugaguucuucaugaugguauuguugauuccugaacccgaaaaacaaaggacaccacaggacaaucaacuugcauacguugucaucggaauauugacauuagccgcaauuguugcagcgaacgaaaugggguugcucgaaacuacaaaacgagaccuuggaaugaguaaagagcccggaguugcaucaccgacgagcuauuuagacguugaccuacauccugccagugcauggacauuguacgcaguagcuacaacaguaauaacucccauguuacgucacacuauagaaaauucaacagccaacguuucauuagccgcuauagccaaccaagcaguaguucucaugggucuagacaaaggguggccgauaucaaaaauggaucuaggaguuccacuacuugcuuugggcuguuauagucaagucaauccgcucacccucaccgcugcuguucugcuuuuaguaacucauuaugccauaaucggcccuggccuacaagcuaaagcaacuagagaggcacagaagagaacagcagcgggaauaaugaaaaacccaacuguugacggaauaaugacuauagaucucgacccaguaauauaugacucaaaauuugagaaacaauugggacaaguuauguuacugguucuaugugcaguucaauuauuacugaugagaacaaguugggcguuuugcgaggcgcuaacauuagcuacaggcccuaucacuacauuaugggaagguucuccaggcaaauucuggaauacgaccauagcgguuaguauggcuaauauuuuucgaggaaguuauuuagcaggagccggguuagcauuuagcauuaugaaaucugucgggacagguaaaagagguacaggcagucaaggugagaccuugggagaaaaauggaagaagaagcuaaaccaauuaucacguaaagaguucgaccuuuacaagaaaucagggauaacggaagucgaccgaaccgaggcgaaagaaggucugaagagaggugagauaacccaccacgccgugaguagagguucugcgaaacuacaaugguucguggaaagaaauauggucauaccggaaggucgggugauugaucuaggaugcgggagaggugguuggucauacuauugcgcggggcucaaaaaggugacugagguuagagguuauacgaaaggugggccgggacacgaagaaccuguaccaaugucgaccuaugguuggaauauagucaaguuaaugucaggcaaagauguauuuuacuuaccaccggaaaaaugcgacacacuguugugugauauaggggaaaguucuccgaguccgacagucgaggaaucccguacaauccgggucuuaaagauggucgaacccugguugaagaauaaucaguuuuguauaaaagucuugaauccauacaugccagcagugauugaacacuuagaaagacuacaaaggaaacauggggguaugcuaguaagaaauccucuuucacguaacagcacacaugaaauguauuggaucucaaauggaacgggaaauauuguaaguucuguaaacauggucagucgauugcuccucaacagauuuacuaugacuuaccgucgaccuaccauugaaaaagacgucgaccuaggggccggaacucgacacgucaacgcugaaccagaaaccccaaacauggaugucauuggugaaaggauucgccgaauaaaagaagaacauaguuccacauggcacuaugaugacgaaaauccauauaagacaugggcguaccauggaaguuaugaaguaaaagcgacaggcagcgcaucaucgaugauuaacggaguuguaaaauugcuuacaaaaccaugggacgucguuccuacaguaacccagauggcuaugacggauacgacgccguuugggcaacaacgaguauuuaaagaaaaaguagauacuagaacuccaaaaccuaugccuggcacuagaaaaguaauggaaauaaccgcagaaugguuauggaggaccuuaggucgcaauaagcggcccaggcuauguacgagggaggaauuuacaaagaagguccgcacgaaugcggcaaugggagcgguuuuuacagaagaaaaccagugggauucugcaaaggcagcuguugaagacgaagaauuuuggaaauuaguagaucgagaaagagaauuacacaaacuuggaaaguguggcagcugcguauacaacaugauggggaaacgugagaagaaauugggugaguuuggaaaagcuaagggaagccgcgcuauuugguacaugugguuaggagcacgcuaccuagaauuugaagcacuaggauuccuaaaugaagaccacugguuuucacgagaaaacagcuacaguggaguugaaggugaagggcugcacaaacuaggcuauauacuacgagauauuaguaaaauaccaggaggggcuauguaugcagaugauaccgcaggaugggauaccaggauaacagaagacgaucuacauaaugaagagaaaauaacucagcagauggauccggagcaccggcagcucgcaaaugcuauuuuuaaguuaacauaucaaaacaaaguaguuaaaguacaacgaccuacacccaagggaacaguaauggauaucauuucgagaaaagaccaacgagggagcggacaaguaggaacauauggccucaauacguucacaaauauggaggcacaacuaauuagacagauggaaggcgaaggcgucuuaagcaaaacugacuuggaaaacccgcauuuauuagagaagaaaauaacacaaugguuggaaacgaaaggaguggagcgccugaagagaauggcgauaaguggugaugacuguguuguaaagccaauugaugacagauucgcaaacgcucuauuagcacuaaaugacauggggaaaguacgcaaagacauaccccaguggcaaccaagcaaaggguggcaugacuggcaacaagugccauucuguagucaucacuuucaugagcuuauaaugaaggauggcagaaaauuaguaguaccgugccgcccccaagacgaguugauaggcagagcaagaauaucucaaggagcaggaugguccuuaaaggaaacagcuugcuuaggcaaggcuuaugcccaaaugugggcacugauguacuuccauaggagagaucuaagauuagcuucaaaugcgauaugcucggccguaccgguacauuggguaccaacgucgagaacgacauggagcauucaugcccaccaccaguggaugacaacugaagauaugcucauaguuuggaacaggguauggaucgaagacaacccauggauggaagauaaaacgccggucacuacgugggaggauguuccauacuuaggaaagcgagaagaucaaugguguggcucauuaauagggcugacgagucgagcgaccugggcccaaaacauacugacagcuauacaacaaguaaggucguuaauagguaacgaggaguucuuggacuacaugccaucaaugaagcgguuucggaaagaggaagaaagugaaggugccauaugguaa

SEQ ID NO: 23564 - RNA, 9873 nt, Artificial Sequence
  derived and/or modified CDS sequence (opt6) from DENV-3__HQ332170__SS-prME
acaucauugugcuugaugaugauucugccugcagcucuagcauuucaucuaacuucuagggacggugaaccacgaaugauuguaggcaaaaaugaacgcgggaaaucuuuauuauuuaaaaccgcuucagguauuaauaugugcacgcugauagcaauggaucugggagaaaugugcgaugacacaguaaccuauaaaugcccacauauaacugaaguugaaccugaagauauugauugcuggugcaauuuaacaucuacguggguaaccuaugguaccugcaaucaagcaggagaacaccgacgagauaaacguaguguagcacuugcuccccacguaggaaugggcuuagacacuagaacgcaaacauggauguccgcggaaggagcauggcgccaaguagaaaaaguagaaacaugggcguuaaggcauccaggcuucacaauuuuagcauuauuucucgcgcacuacauugggaccuccuuaacgcaaaaaguagugauauuuauucugcucaugcuaguaaccccaucaaugacuaugagaugcgugggaguaggaaaucgagacuuuguugaaggcuuauccggagcgaccuggguagacguaguauuagaacauggugguuguguaacaacaauggcuaaaaauaaaccaacuuuggacauugaacuacagaaaacagaagcaacgcaauuagcaacccucaggaaauuauguauagaaggcaaaaucacaaacaucacaaccgauuccaggugucccacucaaggagaagcuguacuaccagaagaacaagaucaaaacuacguaugcaaacauacguacguagaccguggcugggguaaugguugcggucucuuuggaaaagguucgcucguuacgugugcuaaauuucaauguuuggaaccuauagaaggaaaaguuguucaauaugaaaacuuaaaauauacagugauuauuacaguacauaccggagaccaacaccaaguaggcaacgaaacacaagggguuacagcugagaucaccccacaagcauccacaacagaagcuauauugccugaauacgguacgcuaggucucgaaugcucaccacgaacaggguuagacuuuaaugaaaugauacuuuuaaccaugaaaaauaaagcauggauggugcacagacaaugguucuucgaucucccauuacccuggacaagcggggcuacgacagaaacuccuacauggaaccgcaaagaacuucuagugacauuuaaaaaugcgcaugccaagaaacaagaaguagucguacuaggaagccaagagggugcaaugcacaccgcauuaacuggggcaacagaaauccaaaacucuggugggacaucuaucuuugccgggcauuuaaaaugcagacuaaaaauggauaaacucgaacuuaaaggcaugucauaugcuaugugcacgaacaccuuuguuuuaaagaaagaggucucagaaacacaacaugguaccauacucaucaaaguagacuacaaaggagaagacguuccuuguaaaauuccauuuucuacggaagacggacaaggcaaagcucacaauggucgacucauuacagcuaauccuguagugaccaaaaaggaagaaccaguaaacauagaagcagaaccaccguuuggcgaaucaaacauagucauugguauuggcgauaaugcgcuuaaaauaaauugguauaagaaaggcagcaguauagguaaaauguuugaagcgaccgcacguggugcacgaaggauggcuauacuaggcgauacagcaugggauuucggaucuguaggugguguauuaaauucguugggcaaaaugguccaucaaaucuucggaucagcauacaccgcacuuuucucuggcgucucauggguaaugaagauuggaauaggaguccuacuaacguggauuggucuaaauuccaaaaauacgucuaugucguucuccuguauugcuauugguauuauaacgcuuuaucuaggagcgguuguacaagcagauaccggaugugugauuaacuggaaaggcaaagaauuaaagugugggagcgguaucuucguaacuaacgaagugcauacauggacugaacaauauaaauuucaagcggacagccccaaaaggcuagcaacggccaucgccggagcaugggaaaauggcgugugugggauccggucuaccacaagaauggaaaaucuauuguggaaacaaaucgcgaacgaauuaaacuauauuuugugggaaaacaacauaaaauuaacaguaguaguuggagauauaaucggaguacuggaacaaggaaagcgaacauuaacuccacaaccaauggaacuaaaauauucauggaaaacauggggaaaagccaagauuguuacagcagagacucagaacucauccuucauaauugacgggcccaauacuccugaauguccgagcgccucaagggccuggaacguaugggaggucgaagacuauggcuuuggaguauuuacaacaaauauauggcucaaacuaagagaggucuauacucaacaaugcgaccauagacuuaugagugcagcugucaaagaugaacgagcagugcaugcagauaugggcuauuggauagaaagccaaaagaaugguucauggaaacucgaaaaggcuucucuaauagaaguaaagacguguacuuggccgaaaucccauacucuuuggaguaaugggguucuagagagugacaugauaauuccaaagucacuugcagguccaaucucacaacacaauuaucgucccggauaucauacacagacagcaggaccauggcaccuuggaaaauuggagcuugauuuuaauuacugugaaggaaccacuguaguaauuacagaaaauugcggaacgagggggccuucauugcgcaccacaacugucucuggcaaacuaauacaugaauggugcugccguucuugcacauuaccaccauugagauacaugggcgaggacgguuguugguacgguauggaaauacgaccaauuagugaaaaagaagaaaauaugguaaaaucgcucgucagugcuggaaguggcgagguagacaauuuuacaauggggguauuaugucuugcuauacuauucgaggaaguaaugagagggaaguuugguaagaaacauaugauugccgguguguuuuucacguucguuuuacuuuuaagugggcagauuacauggagagacauggcacacaccuuaauuaugauaggaucaaaugccagugaucgcaugggaaugggaguaacauaccuagcauuaaucgcaacuuuuaaaauacaacccuuuuuggcccuuggauucuuucuaagaaaauugacgucuagagagaaucuccucuugggagucggucuagcuauggcuacgacuuugcaauuaccagaggacauugaacaaauggcaaauggaauugcccuagggcuaauggcccuaaaauugauaacgcaauucgagacguaccagcuauggacagcacuaauaaguuuaacaugcucuaacaccauauucacacuaacaguagcauggagaacagcaacguuaauacuugcagggguaucccuauuaccuguaugucaaucauccucgaugcgaaaaaccgacuggcuucccaugacaguagcagcaaugggcguuccgccauuacccuuauuuaucuuuucuuugaaggauacccuaaaacgaaggucguggccacuaaaugaagguguaauggcagucggauuaguauccauuuuagcuagcucguuacugaggaacgacguaccuauggcaggaccauugguagcaggcggauuacuuauugcuuguuauguaauaaccggaacaucagcagaucuaacuguugagaaggccgcagauguaacaugggaagaagaggcagagcaaacuggggugucgcauaauuuaaugaucacaguggaugacgaugguacaaugagaaucaaggacgacgagacugagaauauucuaacaguacuccugaagacagcuuugcuaauuguaucuggcauauucccauauucaauuccagcuacacuauuaguauggcacacauggcaaaaacaaacucaaagaucggggguacuaugggacguuccuagcccaccugaaacacagaaagcugaacuagaagaaggaguguaucgcauaaaacaacagggaauauuugguaaaacacaggugggaguuggcguucaaaaggaagggguauuccauacaauguggcacgugacaagaggagccguacuuacuuacaauggaaaaagauuagaaccaaauugggcaucggucaagaaagauuuaauuagcuacggagggggcuggaggcucuccgcacaauggcaaaaaggugaggaaguacaaguuauagcugucgaaccaggcaaaaauccgaaaaauuuccaaacaaugccuggaacguuucaaacuacaacuggagagauuggggcuauagcguuagauuucaaaccagggacuucagguaguccaauaaucaaucgagaaggcaaaguggucggacuguacggaaauggaguaguaaccaaaaaugguggauauguaagcggaauugcccagacgaacgcagaaccagacgggccaacacccgaacuugaggaagaaauguucaagaaaagaaaucuaacaauuauggaccuccauccaggauccggaaaaacccgcaaauaucuucccgcaauagugagggaagccauaaagagacggcugagaacguuaauacuagcaccaaccagagucguugccgcagaaauggaagaggcuuugaaaggacucccaauucgcuaccaaacaacagcgacgaaauccgaacacacaggucgcgagauaguggaucuuaugugucaugcgaccuuuacgaugaggcuccucuccccuguuaggguacccaauuacaauuuaaucauaauggacgaggcacacuucacagauccagcguccauagcggcucggggauacauaaguacuagaguagguaugggagaagccgcggcaauuuucaugacggccacgccuccuggcacugcagaugcauuuccacaguccaaugcuccuauacaggacgaggaacgagauauacccgaaagaucguggaacucaggaaacgaguggauaacugauuuugcagggaaaacugucugguuuguaccaucgauaaaggcugguaacgauaucgcgaauuguuuacgcaagaacggcaagaaaguaauccaacuuagucgcaagacuuuugauacggaauaccagaaaacuaaacucaaugauugggauuuuguagucaccacagauauaucugagaugggagccaauuuuaaggcugauagaguaauugacccgcgacgcugccuaaagccggugauacuuacugacgguccugagagaguaauuuuagccgguccaaugccagucaccgcagcaagugccgcgcaacgaagggggagaguggguagaaauccucaaaaagagaaugaucaauacaucuuuacuggucaaccacuuaauaaugaugaggaucacgcucacuggacggaggcaaaaauguuacuagauaauauuaacacaccggaaggaaucauuccagccuuauuugaaccagagagggagaaaagcgcugccauagauggagaauauaggcucaaaggcgaaagccgcaagaccuuuguggaauuaaugagacguggagaucuuccugucuggcuagcgcauaaaguugcaagugaagguauaaaguacacggaccgaaaguggugcuuugauggccagaggaacaaccagauacuagaagaaaauauggauguggaaauuuggacaaaagaaggagagaagaagaaauugcggccgcgaugguuggaugccagaacguacagugauccacuagcuuuaaaagaauuuaaagacuuugcagccggccgaaaauccaucgccuuggacuuaguaacagaaaucggccgaguucccagccauuuagcucacagaacacgaaaugcauuggacaauuuaguaauguuacauacgucggagcaugggggaaaagccuaucgacaugccguagaagaacuaccagaaacuauggagacgcuauuacuucuuggguuaaugauucuacucacuggcggagcgaugcuguucuugauaagugggaaagggauagggaaaaccaguauuggauugauuugugugauagcgaguucaggaauguuguggauggcugaaauaccacuucaauggauugcaucagcgauaguauuagaguucuuuaugaugguauuacuaauaccugaaccagaaaaacaaaggaccccucaggauaaucaauuagcauaugucgucauagguauccucacauuagcagccauaauagcugcuaaugagauggguuuacuagagacaacaaaacgugacuugggaaugagcaaagaaccuggaguugugucaccgacuucauaucucgaugucgacuugcaucccgcaagcgcuuggacgcuauaugcaguagcaacaaccguaaucacgccaauguuacggcacacuauagaaaauaguacugcaaacgucagcuuagcggcaaucgcuaaccaagcaguaguacugaugggccucgacaaaggauggcccauaucuaaaauggauuuaggggugccacuacuugcgcuggguuguuacagucaagucaauccacuuacuuuaacggcagcggucuuacucuuaauaacucauuacgcaaucauuggcccgggacuacaagcaaaagcuacucgagaagcucagaaaaggacugcagcuggcauaaugaaaaacccuacgguagauggaauuaugacuauugaccuggacccugucauauaugacagcaaauucgaaaaacaacugggucagguaaugcuguuaguauugugcgcuguccaauuacuauuaaugcgaacaucuugggcauuaugugaagcgcuaacauuagcgaccgguccuauaacaacacugugggagggaucacccggaaaauucuggaacacgacaauugcuguaucuauggcgaacauuuuuagaggaagcuauuuggcgggagcagggcuugcguuuucuaucaugaaaucaguaggaacaggaaagagaggcacgggaucccaaggagagacacuaggugagaaauggaagaagaaauuaaaccaacugagucgaaaagaauuugaccuuuacaagaaaucuggaauaacagaggucgaucggaccgaagcaaaagaaggacuaaaaagaggcgaaauaacccaccaugcgguaagcagggguagcgcuaaacuccagugguuuguagaacgaaguaugguaauaccugaggguaggguuauugaucucggcugcgggagaggaggauggaguuauuacugugcaggccuaaagaaagugacugagguucgaggcuauacaaagggagguccaggacaugaagaacccgugccuaugaguacauauggguggaacauuguaaaauuaaugaguggaaaagaugucuuuuauuuaccuccagaaaaaugcgacacccuucugugugacaucggagaaucaucuccuucgcccacuguagaagaaucgaggacgauaagaguauuaaaaaugguagaacccuggcucaagaauaaccaauucugcauuaagguacuuaauccauacaugccuacaguaauagaacacuuagagagacuccaaagaaagcauggcgguaugcuagucagaaauccuuugaguaggaauaguacucaugagauguauuggaucaguaaugguacggguaauauaguugcuuccguuaauaugguaagcagguuauugcugaauagguuuacaaugacccauagaagaccaacuauugaaaaagauguggauuugggcgcaggaacaagacauguuaaugccgaaccagaaacaccaaacauggacguaauaggugaaagaauaaagagaauaaaggaagaacacaauagcacauggcauuaugaugaugaaaaccccuauaagacaugggcguaucauggcucuuaugaaguaaaagcaacaggcucagccucaucgaugauuaacgguguuguuaagcuauuaacgaaaccaugggauguugucccaaugguuacucaaauggcuaugacugacacgacaccuuuuggacaacaaaggguauuuaaagagaaaguagacacucggacgccaaggagcaugccagggacacgucgggugaugggaauuacagcugaauggcuauggagaacguuaggaaggaauaagaaaccacgacuguguacaagagaagaguucaccaagaaaguacgaacuaaugcagccaugggagcuguauuuacagaagagaaccagugggauucagcgaaggccgcagucgaagacgaggauuucuggaagcugguagaccgcgaaagggaguuacauaaauuaggaaaauguggaucaugcguauauaacaugauggguaaaagagaaaagaaguuaggugaguucgggaaagcuaaaggaucaagagcaauuugguauaugugguuaggagcgagauacuuagaguucgaagcccuaggguuucuuaaugaagaccauugguuuagccgggagaacucauacucagguguagaaggagaaggauuacacaaauugggcuauauccuucgugacauaucuaagauacccggcggagcaauguacgccgaugauacagcuggcugggacaccagaauuacugaggaugaucuucacaaugaggaaaagauaacccaacaaauggacccagaacacaaacaacuagccaaugcaauuuucaaacucacauaucaaaacaaaguaguuaaaguacaaagaccuacuccaacaggaacaguuauggauauaauaagccgaaaagaccagcgggguucgggucaaguagguacauacgggcuaaauacguucacuaacauggaagcacaacucauucgacaaauggaaggagaaggcguacuuucaaaagcagaucuugagaauccucaucugccggagaagaaaauaacacaguggcuggaaacaaaaggaguugaacgacuuaaaaggauggcaauaucaggggaugauuguguaguaaaaccaauugaugaucgcuuugcaaaugcacuccuagcacucaacgacaugggaaaaguccguaaagauauaccacaauggcaaccuucaaaaggguggcacgacuggcaacaagugcccuuuuguucacaucacuuucacgaacuaauaaugaaagacgggcgaaaauuggucguaccgugucgaccgcaagaugaacuuaucgggagagcucgaauaucacaaggagcuggauggucacuccgcgaaacggcuugucugggcaaagcauacgcacaaauguggucgcuaauguacuuccauagaagagauuugcgacuagcaucgaaugcgauuuguagugcgguaccuguacacugggugccuacaucucggacgaccuggaguauacacgcacaccaucaauggaugacgacagaagauauguuaacaguuuggaauagaguauggaucgaagacaaucccuggauggaagauaaaacaccaguuacuacaugggaaaaugucccuuacuuaggcaaacgagaagaccaguggugcgggucauuaauaggacuaacuucgcgagcuacgugggcccaaaauauacccacggcgauucagcaaguaaggucacucauagguaaugaagaauuucucgauuauaugccuucaaugaaaagauucagaaaagaggaagaaucagaaggagcgaucugguaa

SEQ ID NO: 23565 - RNA, 9873 nt, Artificial Sequence
  derived and/or modified CDS sequence (opt6) from DENV-3__AY858038__SS-prME
acuuccuuaugcuugaugaugauguuacccgcaacguuagcguuucaccugacuucaagagacggugaaccuagaaugaucguuggcaaaaacgaacgagguaagucccuauuauuuaaaacugcaagcgguauaaacauguguacauugauagcuauggaccuaggcgaaaugugcgaugauacgguaacauacaaaugcccauuaauaacagaaguugaaccagaagauauagauugcuggugcaacuuaacauccacuuggguaacguacggaacaugcaaccaagcaggggaacauagaagagauaaaagaucgguagcucuagcuccucaugugggcauggggcuagauaccagaacccaaacuuggaugagugcugaaggugcguggagacagguagaaaagguagaaaccugggcauuccgacauccggguuuuacuauacuagcacuauuccuugcacauuacaucggaacaucacugacgcaaaaagucgugauuuucauucucuuaaugcuaguuaccccuagcaugacuaugcguugugugggaguuggcaauagggauuucguugaaggcuugucaggagcuacuuggguggauguaguucucgaacacggaggaugcgucacaacaauggccaaaaauaaaccaacauuggacaucgaauuacagaaaacagaagcaacgcaauuagcaacacuucguaagcucugcauagaaggaaagauaacaaacguaaccaccgauuccaggugccccacacaaggagaagcaauacuaccagaagaacaagaucagaauuaugugugcaaacauacauacgucgauagaggauggggcaacgguuguggacuauucggaaaaggaucucuugucacaugugcgaaauuccagugccuagaaucaauagaaggcaagguaguacaacaugaaaaccuaaaauauacugugaucaucacaguccauacuggcgaccagcaccaaguuggaaaugagacgcaaggggucacugcagaaauaacaccccaagcuaguacaguagaagcaaucuugccagaauacgguacacuaggauuagaauguaguccucguacuggucucgauuucaaugagaugauucuacuaacgaugaagaauaaggcuuggaugguacaccggcaaugguucuucgacuugccauuacccuggacgucaggugccacaacagagacaccuaccuggaauaaaaaggaauuacuggucacuuucaaaaaugcgcacgcuaaaaagcaagaggugguaguguuagggagucaagagggagcaaugcauacggcauuaacgggugcuacugagauucaaacgucaggcgguaccaguauuuucgcuggacauuuaaagugccgacuuaagauggauaaacucgaauugaaagggauguccuacgcaaugugccugaacgcauuuguacuaaagaaagagguaucggaaacucagcacggcacaauacucauaaaaguggaguauaaaggagaagacgcaccgugcaaaauaccauucucaacugaggacggacaagguaaggcgcacaauggacgauugaucacagcgaauccugugguuacuaaaaaggaagaacccgucaauauugaagcagagccaccauuuggagaaucgaacaucguaauaggcauaggggauaaagcgcugaaaauuaacugguauaaaaagggaucuucaauaggaaaaauguucgaagcgacagccagaggcgcucgaagaauggcuauacuaggcgauaccgccugggauuuuggaaguguaggagguguucuaaauucuuugggaaaaauggugcaccaaauauuuggaucagcauacacagcacuauuuucaggcguaagcuggauaaugaaaauugguauaggagugcuccuuacauggaucggauuaaauuccaaaaacaccaguaugucauuuaguuguauugcaauagggauaauaacguuauaucugggagccguuguccaagcagauaugggguguguuaucaacuggaaaggaaaagaacucaagugcgguucuggcauauuugucacaaacgaaguucacacauggaccgaacaauacaaauuccaggcugacuccccaaaaagacuggccacggcaauagcaggggcaugggaaaauggcguaugcgguauucguagcacuaccaggauggagaaucucuuauggaagcaaauugcuaacgagcuaaauuauauauuaugggagaauaauauucgauuaacugucguuguaggugacacuauagguguacuucaacaagguaaaagaacccuaccaccccaaccaauggaauuaaaauacucauggaaaacauggggcaaagccaaaauaguuacagcaaaaacacaaaacucuucauuuauaauagaugggccuaauacuccagaguggccaucugcuaguagagcauggaacguaugggagguagaagacuauggauucgguguauucacuacaaauauauggcuaaaauuacgggaaauguacacacagcugugugaucaucggcuuaugucagcugcagucaaagacgaacgagcaguucacgcugacaugggauauuggauagaaucacagaaaaacgggucauggaaacuagagaaggccaguuugauagaaguaaaaacaugcacguggccaaagagccauacacuguggucuaauggcgugcuagaaagcgacaugauuauaccuaagucuuuggcugguccgauaucgcaacauaauuacagaccugguuaucacacccaaacggcaggaccuuggcacuuagggaaacuagaacucgacuuuaacuauugcgaagggacaaccguagugauuacagaaaacugcggcacaagagguccaagucuccgaacaaccacagugaguggaaaguuaauacacgaauggugcugccgcucauguacacuaccaccauuaagauacaugggcgaagaugguugcugguacgggauggaaauacgcccgauaaaugaaaaagaggagaacaugguuaaaagccucguuagugccgguaguggcaaaguagacaacuuuacuaugggcgugcuuuguuuggccauauuguucgaagaaguaaugagaggaaaguuuggcaaaaagcauaugaucgcgggaguuuuauuuacauuuguguuauuauuaaguggccaaauuacuuggcgcgauauggcaagaacacugauaaugauaggaagcaacgcaagugauagaaugggaauggggguaacuuaucucgccuuaaucgcuacguucaaaauucagccauuccuugcauuggguuucuuuuugaggaaacuaacuucccgugaaaaccuauuacuagggguuggucuagcuauggcaacaacuuuacaauugccugaagacaucgaacaaauggcgaauggcauugccuugggucuaauggccuugaaauuaguaacccaauuugaaacauaucaauuauggacagcucuaguuucauuaauguguaguaauacgauauuuacucucaccguugccuggagaacagcaacccugaucuuggcaggcauuaguuuguuaccgguaugccaguccagcuccaugagaaaaacagauugguuacccaugacuguugcagccaugggcguaccaccacuacccuuauucauuuucucccuuaaagauacacuaaaacgaaggucauggcccuuaaaugaagguguaauggcagucggguuagucucaauacuagccaguucccuuuugcgaaaugaugucccuauggccggaccccucguagccgguggccuguuaauagcauguuacguaauuacagguacaucugcagacuuaacuguagaaaaagccgcugacgucauuugggaagaagaagcagaacaaacagggguuucucacaauuuaaugauaacaguagacgacgacgggaccaugcgcauaaaggaugaugagacggagaacauuuuaacaguauuacucaaaaccgcacuacuuauagucucaggaaucuuuccuuacagcauaccagcaacacuauuaguuuggcacacguggcaaaagcaaacacaacgaucuggaguacucugggauguaccuucuccaccggaaacucaaaaggcagaauuagaggaaggcguguacaggaucaaacaacaaggaauauuugguaaaacgcaaguuggaguaggaguccaaaaagaaggaguuuuucauacgauguggcacguuacucgcggugcaguucucacgcauaaugguaaaagguuagaaccuaacugggcaucagucaagaaagaccugaucucauacggagguggcuggagacucagugcacaauggcaaaaaggggaggaagugcaaguuaucgcggucgaaccaggcaagaaucccaaaaacuuucaaacaaugcccggaauauuucagacuacaaccggagaaauaggggcaauugcucuggauuuuaaaccaggaacuucagguucgccuauuauuaaucgugaagguaaaguugucgguuuauauggcaauggaguagugaccaaaaacggcgguuauguuucaggaauugcacagacuaacgcugaaccggacggaccaacuccagaauuagaagaagaaauguuuaaaaagcguaacuugacaauaauggaucugcauccggguagugguaaaacacgaaaauaccuuccagcaauaauacgagaagcgauaaaaagaaggcuaaggacccuuauacuagcuccaacgagaguugucgcggcggaaauggaagaagcauugaaaggacuaccgauaagauaccaaacaacggccacaaaaucugaacacacuggcaaagaaauaguugaccuaaugugccaugcaacuuuuacaaugcggcuacuaagccccgucagaguacccaauuauaacuugauaauaauggaugaagcccauuucacugacccugcgagcauugccgcacgcggauauauuucgacucgagugggcaugggagaagcugcagcaauauuuaugacugcgacuccaccugggaccgcagaugcuuuuccccaaucuaacgcaccuauucaagaugaggaaagagauauaccugaacgaucauggaauaguggcaaugacuggauaaccgacuuugccggcaagacuguaugguucgucccaagcauaaaagcaggaaaugauauugccaacugucuaaggaaaaacggaaagaaagucauacagcugagucguaaaacauuugacacugaguaucagcgaacuaaauuaaacgacugggauuucgugguaacaacugacauuagugaaaugggugcgaauuucaaggccgacaggguaauugauccccgacguugcuuaaaaccugucauacuaacagauggacccgaaagagucauauuagccgggccaaugccugugacuguugcaagcgcagcgcaacgacgaggacgaguaggacgaaauccacaaaaagagaacgaucaauauaucuuuaccggacaaccacuaaacaacgaugaagaccaugcacauuggacugaagcaaaaaugcuacuugacaacauuaacaccccagaaggaauaaucccagcacuguuugaaccggaacgcgaaaagagcgcggcaauagauggggaauauagacuaaaaggcgaaaguagaaaaacauuuguugagcugaugaggcgaggcgacuuaccaguaugguuggcacauaaaguagcaucugagggcauaaaguauacagaucgaaaauggugcuuugauggugaaagaaauaaucaaauacuagaagaaaauauggacguagaaaucuggaccaaggagggcgagaaaaagaaauuacggccucguuggcuagaugcacgaacauauagugauccacuagcucuaaaagaguucaaagauuucgcggcuggaaggaaaucgauagcucuagaccuggugacugaaaucggccggguuccaucacauuuggcccauagaacuagaaaugcucuagauaaccuaguuauguuacacacgucugagcacggagggagagcauaccgucaugcgguagaagaacuccccgaaacgauggagacauuauuacugcucggucuaaugauuuuauuaaccgggggcgcgaugcuuuucuuaauaucagggaaagguauugggaagacuucaauaggcuugauaugcgugguagcgucaucgggcauguuauggauggcagaugugccucuucaguggaucgcuucugccauaguguuggaauuuuucaugaugguuuuauugauuccagaaccugaaaaacaaagaacaccccaagacaaccaauuagccuauguggucaucggaauccuaacacuagccgcaauuguagcggccaaugaaaugggacuuuuagaaaccaccaaaagagaccugggaaugaguaaagaaccaggagugguuucaccaacauccuaccuagauguagaucuucauccagcuagugcauggacuuuauaugcaguugcaacaacugugauaacuccgaugcuacgucauaccauagaaaacucaacagcuaacguuucccuugcggcaauagccaaucaagcagugguacuuaugggucuugauaaaggguggccgaucucuaaaauggaucuaggagugccucuauuagcuuuagggugcuacucacaggucaacccauuaacgcuuaccgccgcgguuuuacugcuaguaacucauuaugcuauaauaggaccggguuuacaggcgaaggcaaccagggaagcacagaaacggacggcagcggguauaaugaagaacccgacaguagaugguauaaugacaauagacuuagacccuguaaucuacgacucuaaauuugagaaacaauuagggcaagucauguuacucguacuaugugcaguacaauugcuucugaugagaacaaguugggcguucugugaagcccuuacuuuggcgacaggcccgaucacuacauugugggaagguagcccuggaaaauuuuggaacaccacaaucgcgguaagcauggccaacauuuuucgaggaaguuaccucgcgggagcaggauuagcauuuucgauaaugaaaucgguaggcacaggaaaaagagguaccggcagucaaggagaaacauuaggggagaaauggaaaaagaaacuaaaucaguuauccagaaaagaguucgaucuauauaagaaaucuggaauuacagaaguagaucguacagaagcgaaagaaggauugaagagaggagaaauaacacaccaugcagugucacgugguucagccaaauugcaaugguuuguagaaagaaauauggugauaccggaaggacgcguaauagaucucggcugcggaaggggaggguggucauacuacugugcaggacucaagaaaguaacagaagugagaggcuauacaaaaggugguccgggacaugaagaaccggugccuaugucaaccuauggauggaauauuguaaaguuaaugagugguaaagauguauuuuaccuuccuccagagaaaugcgauaccuuauugugcgacauuggagaaucaaguccaagcccuacuguagaagaaagucguacgauucguguacuuaagaugguagaaccaugguugaaaaacaaucaauuuuguaucaaagucuuaaauccuuacaugccgacuguaaucgaacauuuagaaagguuacaacgcaagcauggcgggauguuaguuaggaaucccuuaaguagaaauucaacacaugaaauguacuggauaaguaauggaacaggaaauaucguuuccaguguaaauaugguaucuaggcugcuguuaaauagguucacaaugacgcacagacgacccacaauagaaaaggaugucgacuugggugccggaacacgucauguaaaugcggaaccagagacaccaaauauggauguaauuggagaaaggaucagaaggaucaaagaagaacacuccucuacuuggcauuacgaugaugaaaauccuuauaagaccugggcguaucaugggaguuaugaagugaaagcuaccgguucagcaagcaguaugauaaauggaguaguaaaguugcuuacaaagccuugggacguggucccuacuguaacacaaauggcaaugacugacacaacaccuuucggucaacagagaguauuuaaagaaaaaguggacacaagaacaccuagaccaaugcccgguacccguaaaguaauggagauaacagcugaauggcuuuggaggacuuuaggccgaaauaaaagaccucgguuguguaccagagaggaauuuaccaagaaaguaaggacaaacgcagcgaugggagcaguguuuacagaagagaaucaaugggauagcgcccgagccgcgguugaggaugaggaguucuggaaacugguugaucgagaaagggaacuccauaaauuaggaaaauguggauccuguguuuacaauaugauggguaaacgcgagaaaaaguuaggagaauuuggaaaagcaaaagggagucgcgcaauaugguacauguggcuaggagcgcgcuauuuagaauuugaagcccugggcuucuugaacgaagaccacugguuuagucgagaaaacuccuacuccggcguagaaggagagggucuacauaaauugggauauauucuuagagauaucucaaaaauaccagguggcgccauguacgcugaugauaccgcagguugggauacucgaauaacugaagaugaucugcacaaugaagagaaaauuacgcaacaaauggauccugagcauagacaauuggccaaugcuauauucaaauuaacguaucaaaacaagguaguuaaagugcaacguccaaccccuaaggguacaguuauggauauaauaagccgaaaagaccagagaggaaguggccaaguagguacuuacggacuaaauacauucacaaacauggaagcacaauuaauuagacaaauggaaggggaaggaguccugagcaaagccgaucuagaaaauccacaccuacuugaaaagaagauaacgcaauggcuugaaaccaaaggaguagagagacucaaaaggauggcaauuucaggugacgauugcgugguuaaaccgaucgaugacagauuugcgaaugcuuuauuagccuugaaugauaugggcaaaguacggaaagauauaccccaguggcaaccgagcaaaggcuggcacgauuggcaacaaguccccuuuuguagccaucauuuccacgagcugaucaugaaagauggacggaagcucguaguuccgugucgaccacaagaugaacuaaucggacgggcuaggauaucacaaggugcaggauggucauuaaaagaaacugcuuguuugggaaaagcauacgcgcaaaugugggcacuuauguacuuccaccgaagagaucuucgccuagcaucaaaugcaauaugcucggcuguaccaguacauugggugccaacgagcagaacaacauggucgauacacgcucaccaccaguggaugacuacugaagauauguuaacaguuuggaacaggguguggauagaagauaauccauggauggaagauaagacaccgguaacuacuugggaggaugucccuuaucuaggaaaaagagaagaccaauggugugguagccuaauagguuuaaccagccgugcgacgugggcacagaauauccuaacggcaauacaacaaguaagaucccugauaggaaaugaagaguucuuagauuacaugccaucaaugaaacgauuuaggaaggaggaagaaagcgaaggagccaucugguga

SEQ ID NO: 23566 - RNA, 9873 nt, Artificial Sequence
  derived and/or modified CDS sequence (opt6) from DENV-3__AY858039__SS-prME
accagucuuugccucaugaugaugcucccggcgacguuagcauuucaucucacgucgcgagauggggaaccuagaaugauuguugguaaaaaugaacgugggaaaagccucuuauuuaaaacagcuaguggaauuaacaugugcacauuaauagcaauggaucucggggaaaugugugaugacacaguaacguauaaauguccucuuaucacagagguugaaccggaagauauagauuguugguguaacuuaaccucaacaugggucacuuauggaacauguaaucaagcaggagagcaccgacgcgacaaaagaucagucgcauuagcuccccacgugggaaugggacuggacacacgugcacaaacauggaugagcgcagagggugcauggagacaaguugaaaaaguugaaacaugggcauuccgucacccaggauuuacgauucuugcacuguuuuuagcacacuauaucggaacuucgcucacacaaaaaguaguuaucuucauacuuuuaauguugguaacaccuucaaugaccaugcguuguguuggagucgggaaucgagacuuuguagaaggccuaucaggugccacauggguugauguuguacucgagcauggaggguguguuacuacuauggcuaaaaauaaacccacacuggauauugaacugcagaaaacagaggcuacacaauuagcaacgcuaagaaaauuaugcaucgaaggcaaaauuacaaaugucacuacagauucccgaugcccuacacaaggagaggcaauucuaccggaggaacaagaucaaaauuacgucugcaaacauacauauguugauagagguuggggcaauggcugcggauuauuugguaaagggagcuuagugacaugugcgaaauuucaauguuuagaacucauagaaggcaaaguuguacaacaugaaaauuuaaaauauaccguaauuauaaccguucacacuggugaucaacaucaaguaggcaaugaaacccaaggaguaaccgcagaaauaacaccacaggcauccacuguagaagcaauucuaccugaauauggcacgcuaggguuagaguguucaccccgaaccggacucgauuucaaugaaaugauauuacucaccaugaaaaacaaggcuuggaugguacaucgucaaugguucuuugacuuaccucuuccuuggacaucuggugcuacaacagagacuccuacauggaauaagaaagaauugcuaguaacguuuaaaaaugcgcacgccaagaaacaagaaguugucguauugggaucucaggaaggugcaaugcauaccgcuuuaacaggggcuacagaaauacagacuucuggaggcaccucaaucuucgcugggcaucucaaaugcagacuuaaaauggacaaacuggaauuaaaaggaaugaguuaugcuauguguucaaaugcuuuuguucuuaagaaagagguaagcgaaacucaacaugguacgauauugauaaaaguagaauauaaaggugaagaugcgccauguaaaauuccauuuuccacagaagacggucagggaaaagcacauaauggcagacuuaucacagcgaacccugucguaacuaagaaagaagaaccagugaauauugaagcugagccuccauucggggaaucuaacauaauuauugggauuggagacaaagcucuaaaaauaaacugguacaaaaagggcaguucuauagguaaaauguuugaagcuacugccaggggcgcacgacggauggcuauacucggagacacugcuugggacuucggguccgugggcggaguucuaaauucacuaggaaagaugguacaccaaauuuuuggcagugcauacaccgcgcuauuuucuggaguaagcuggaucaugaagauaggcauaggagugcuucuaacauggauaggacuaaauucuaaaaacacaucuaugagcuucagcuguauaguaauaggcauaaucacauuauacuugggugcuguaguacaagccgacauggguuguguuaucaauuggaaagguaaggaguuaaaguguggcuccggaauuuuuguaacgaaugagguacacacguggacagagcaauacaaauuucaggcagauucaccaaagagacuggcaacagcuauugcuggggcaugggaaaacgggguauguggcauuagaaguacaacaaggauggaaaaucuucucuggaaacaaauugccaaugaauuaaacuauauacugugggaaaauaauauaaaauuaaccguuguuguaggcgauaucaucgggguacucgaacaagguaagcgaacguuaaccccacaaccuauggaguuaaaauauucauggaagacauggggaaaagcaaaaauagugaccgcggagauucaaaacagcagcuuuauaaucgacgguccuaacacaccggaaugccccaaugcaaguagagcauggaauguuugggaaguggaagauuacggauuuggaguguuuacgacaaauauaugguuaaaacuuagagaaauguauacucaauuaugcgaccaucgauugaugucagcugcgguuaaggaugagcgugcaguacaugcagauaugggauauuggauagagagucagaaaaauggaucauggaaacuugaaaaggcuucguuaaucgaaguuaagacuuguacauggccaaaaucccauacacuguggagcaaugguguucuagaaucagacaugauaaucccaaagucacuugcgggaccaauaagucagcacaacuaccgaccagguuaucauacucagacggcagguccuuggcaccuuggaaagcuggaauuagauuucaauuauugcgaaggaacaacggucguaauaacggagaacuguggcacacggggaccuucuuugcgaacaacaaccguaagcggaaaacuaauacaugagugguguuguagauccuguacccuacccccuuuacgcuacaugggcgaagacggauguugguacggcauggagauuagaccgauaaaugaaaaagaagagaauauggucaaaagucuaguaagugccggaucggggaagguggauaauuuuaccauggguguccucugucuagcaauacuauucgaagaagugaugagaggaaaauucggcaagaaacauaugauugccgguguacucuuuauauucguacuauugcuaucaggucaaauaacauggcgggacauggcaaggacccuaauaaugauaggcucgaacgcgucggacaggauggguaugggaguaacguauuuagcacuaaucgcgacauucaaaauccaaccauuuuuagcccucggcuucuuuuuacgaaagcuaaccucuagggaaaacuuguuacuagggguggguuuggcaauggcaacuacauuacaacuaccagaggauaucgagcaaauggcaaacggaaucgccuuaggacuaauggcgcuaaaacuuaucacacaauuugaaacauaccaacuauggacagcccuagucucauuaacaugcucaaauacgauauuuacacuuaccgucgcauggagaacggcuacacucauucucgcaggaauaucccuauuaccugucugccaaucaucaucgaugaggaaaacugacuggcuaccaaugacaguggcggcuauggggguaccaccaaguccccucuuuauuuuuagucucaaagacacauugaaaagaaggagcuggccuuugaaugaaggcguuauggcuguagggcuaguaucuauacuggcauccaguuuguugagaaacgaugucccgauggcgggaccccuaguugcgggcggacuacuaauagccugcuacguaauaacaggaacaagugcggacuuaacaguagaaaaggccgccgacgucacaugggaagaggaagccgaacaaacagggguaagucacaaucuuaugauaacggucgaugaugauggaacuaugcgaauaaaagaugaugaaacggagaauauuuugacaguucuuuugaagacggcauuauuaauagugucagggaucuuuccuuauagcauacccgcgacccuacucguauggcauacguggcaaaaacaaacacaacggaguggaguacuaugggaugucccgaguccuccagaaacacagaaggcagaauuagaagaaggaguauaccgaaucaaacaacgaggcauuuuuggaaaaacucaaguuggaguugggguacagaaagaaggaguauuucauacuauguggcauguaaccagaggagcaguucuaacuuacaacgggaaacggcucgagccuaauugggcguccgugaagaaagaucuaauaucuuacggugguggauggagauuaagugcacaauggcaaaaaggugaagaaguccagguaaucgcgguagagccaggcaaaaauccgaaaaacuuccaaaccaugcccggaauuuuucaaacaacuaccggcgaaaucggcgcaauugcacuggauuuuaaaccagggaccaguggaucaccgauaauaaaucgggaagguaaaguugucggacucuacgguaauggaguaguuaccaagaaugguggcuauguaucaggcauagcucaaacuaacgcagaaccugauggaccgacgccugaacuugaagaagaaauguucaaaaagagaaauuuaaccauaauggauuuacauccuggaagcgguaagacccgaaaauaccuuccagcaauuguacgcgaagcgaucaaaagacgacuacgaacauuaauauuggcaccuacacggguaguugccgcugaaauggaggaggcuuuaaaaggccugccaauaagguaucaaacaacggcuaccaaaagcgaacacacaggcaaagagaucguugacuuaaugugucacgcuacuuuuacuaugagacuauuaagcccugucaggguaccuaauuauaacuuaauuauuauggacgaagcccauuucacugaucccgcaaguauagcagcccgcgguuacauuagcacaagaguggguaugggugaagcggcagcaauauucaugacagcgacgcccccuggaacugcugaugcguuuccacaaaguaacgcgccaauucaagacgaagaacgugacauacccgaaagaucauggaacucuggaaaugauuggauaacugauuuugcugggaagacaguaugguucguaccguccauuaaggcuggaaaugacauugccaauuguuugagaaagaauggaaagaaagugauccaacucagucguaaaacauucgauacugaauaccagaaaacaaaacuaaaugacugggacuucgucgucacuacugacaucucagaaaugggugcgaauuuuaaagcagacagaguuaucgaccccaggagaugucuuaaaccuguuauccugacagauggaccagaacgagugauacuugcaggcccuaugccggugacgguagcgucagcugcucaacgacguggucggguaggcagaaacccgcaaaaggaaaaugaucaauacauauuuacuggacaaccuuuaaauaaugaugaagaccacgcacauuggacggaagcgaagauguuauuagauaauauaaacacaccggaaggaaucauucccgcgcuauuugagccggaacgagagaaaagcgcagcaauagauggugaauaucgacucaagggagaaucccgaaaaacguucguagaacuaaugcgaagaggcgaccuaccagugugguuagcucauaaaguugcaucugaaggcauuaaguacaccgauagaaaaugguguuucgauggagagagaaauaaccaaauauuagaagaaaauauggaugucgaaauuuggacaaaagaaggggaaaagaagaaauuacguccccgcuggcucgaugcucguaccuauagcgauccuuuagcauugaaagaauuuaaagauuuugccgcaggcagaaaaucuauagcucuggaccuuguaacagaaauagggcgcguaccaagccacuuagcacacaggacaagaaaugccuuagacaauuuaguuauguuacacaccuccgaacauggagggcgcgccuauagacaugccguugaagaguugccugaaacuauggaaacccuauuauuacugggucuuaugauucuccucaccgguggagcaauguuguuuuugauauccgguaaagggguagguaagacauccauaggauugaucuguguggucgcuaguagcggaaugcucuggauggccgacauaccuuugcaauggaucgcuagugcaauuguccuagaauuuuucaugaugguacuauuaaucccagagccggaaaaacagcggacgccacaagauaaccagcuagcauauguagucaucggaauauuaacauuagcggcaauaguugcugcuaaugaaaugggguuacuagagaccacaaagagagauuuaggaaugaguaaggagccaggaguuguaagucccacgaguuacuuggauguagacuuacauccagccagcgcguggacucuuuaugccgucgcaacaacagucauaaccccuauguuacgacauacaauugaaaauaguacagcgaacguuaguuuagcugcuauagcuaaucaggcuguuguacugauggguuuagacaaaggauggccaauaagcaaaauggacuuaggaguaccacuccuggcacuaggaugcuauagucagguuaauccauuaaccuugacggcagcuguucuuuuacuggucacccauuaugcgauuauagguccgggacuacaagcaaaagcgacaagggaagcucaaaaacggacagcagcagguauaaugaaaaacccaacaguugauggaauaaugacuauagaucuggacccaguaauauacgacucaaaauuugaaaaacaauuggggcagguuaugcuauuaguuuuaugugcuguacaauuacuuuuaaugagaacgucaugggcauucugcgaggcuuugacuuuagcuacaggaccgauuaccacguugugggaaggcucaccuggaaaguuuuggaauacaacaauagcgguaucaauggcaaauauuuuuagagguucauauuuagcaggagcaggacucgccuucaguauuaugaaguccguagguacugggaaaagaggcacagguucacaaggagaaacguuaggagaaaaauggaagaagaaauuaaaccaacuaucgcgaaaggaguucgaucuguauaagaaaagugguauuacagaaguugaucgaacggaagcgaaagaaggguugaagcguggcgaaauaacgcaucaugcaguaucacguggaagcgcaaaacuccaaugguucguagagagaaacauggucaucccagagggacgagucauugauuuagguugcggucguggcggcuggucguacuauugcgccggacuaaagaaaguaacggaaguaagggguuauacgaaaggcgggccaggccacgaagaaccaguuccaaugaguacauacggcuggaauaucguaaaacuaaugucagggaaagacguauuuuaucuaccaccagaaaagugugacacacuacuaugugacauaggagaguccucaccaagcccaacuguagaagaaucaagaacuauaagaguccuaaaaauggucgaaccgugguugaaaaacaaucaguuuuguaucaagguauuaaacccauacaugccaacuguaauagaacaccuggagcgauuacagcguaaacacggaggaauguuaguuagaaauccacuaucucgcaauucaacacaugaaauguacuggauaucuaacgguacugggaauaucgugaguaguguaaauaugguaaguagauuacuauuaaacagauucaccaugacguacagaagaccaacaauagagaaagacguugaccuuggagcggggacuagacauguuaaugcugaaccagaaacgccuaauauggacgucaucggcgaaagaaucaggcguauaaaagaagaacauagcucgacuuggcauuacgaugacgagaaucccuacaaaaccugggccuaucacggaucauacgaaguaaaagccaccggaucugcgagcucgaugaucaauggugucgucaaauuauuaaccaaacccugggacguaguaccuacaguaacacaaauggcaaugacagauaccacgccauucggacagcaacgcguauuuaaagaaaagguugauacuagaacaccgaaacccaugcccgguacacgcaagguuauggaaaucacagcagaaugguuauggcguacauuggggagaaauaagagaccaagguuaugcacgagagaagaauuuaccaagaaagugcgcacgaacgccgcgaugggcgccguuuuuacagaagagaaccaaugggauagugcaagagcugcuguagaagaugaagaauuuuggaagcuggucgaccgcgagagagaacuacacaaacuuggcaaauguggaucaugcguauacaauaugaugggcaaaagagagaagaaacuaggagaauuugguaaagccaaaggcucuagagcgaucugguauauguggcucggagcaagauacuuagaguucgaagcguuaggauuuuuaaacgaagaucacugguucagucgggaaaauaguuauaguggcgucgaaggcgaaggauuacauaaacuuggcuacauccuaagagauauauccaaaauacccggaggagcaauguacgcggaugauacugcuggaugggauacaagaauaacagaagacgaucuacauaaugaagaaaagaucacccaacaaauggauccggagcacagacaauuagcaaaugcgauauuuaaauugacauaccaaaacaaaguaguuaaaguacaacgacccacuccuaaaggaacagucauggacaucaucucgcggaaagaccaacguggaagugggcaaguggggacuuacggcuuaaacacauucaccaauauggaggcucaauuaauucgacaaauggaaggggaagguguauugaguaaaacugauuuagaaaauccacacuugcuagagaaaaagauaacacaguggcuggaaaccaagggaguggaacgauuaaaacguauggccauuaguggcgaugacugcguuguaaaaccgaucgacgaccgauuugcaaacgcacucuuagcauuaaaugauauggguaagguuagaaaggacauaccgcaauggcaaccuaguaaagguuggcaugauuggcaacaagucccauuuuguucucaccauuuucaugaauugauaaugaaggacgggcgaaaauuaguaguaccaugucggccacaagaugaauugauaggaagggcgagaauaagccaaggugcgggauggucgcuaaaggaaacagcauguuuagguaaagcauaugcacaaaugugggcgcucauguauuuucaucguagggaccuacgccucgccagcaacgcaaucugcagcgccguuccgguccauuggguaccuacuagccgaacgaccuggucgauucaugcccaucaucaauggaugacaacugaagacauguuaacuguuuggaaucgcguauggauugaagacaaccccuggauggaagacaaaacccccguaacaacaugggaagacguaccuuaucuagggaaacgugaggaucaguggugugguagcuuaauaggauuaaccuccagggcaacaugggcacaaaauauacuuacugcaauacaacaaguuaggagcuugaucggaaaugaagaauuucuugauuauaugcccagcaugaaaagauucagaaaagaagaagagucagaaggugcuauaugguaa

SEQ ID NO: 23567 - RNA, 9873 nt, Artificial Sequence
  derived and/or modified CDS sequence (opt6) from DENV-3__JN368477__SS-prME
acuucuuuauguuuaaugaugauguuaccugcaaccuuagcuuuucaucugacaagucgagacggugaaccuagaaugaucgugggcaaaaaugaaagaggaaaaucacuguuguucaaaacugcuagcggcauaaauaugugcacguuaauagccauggaccuuggcgaaaugugcgaugauacuguuacauauaaauguccacuaaucgcggaaguugaaccugaagauauagauugcuggugcaauuuaacaaguacuuggguaacguauggcacuugcaaucaagccggcgaacaucguagagauaaaagauccgucgcacucgcaccacaugugggcaugggguuggacacacgcacacaaacauggaugagugcagagggagcauggcgucaaguggaaaaaguugaaacuugggcccuucgccacccaggguucacuauacucgcucuauuucuagcucacuacauuggaacaucgcugacacagaaaguaguaauauucauacuauuaauguuaguuacaccaaguaugaccaugcgguguguagguguagguaaucgcgacuuuguagaaggguuaaguggcgcaacauggguggacgucguccuagaacauggaggcugugucacuacgauggccaaaaguaaaccaacacuagacauagaauuacagaaaacagaagcaacucaacuagcaaccuugcguaaacugugcauagaagguaaaauaacuaauauuacaaccgacucgagaugcccuacacaaggugaagcuacauuaccagaagaacaagaccaaaacuacguaugcaaacauaccuauguagaccgggguuggggcaauggaugcggauuauucggaaaagguucucuagugacaugcgcgaaauuccaaugucuagaaccaauagaagggaaaguaguucaauaugagaacuuaaaauacacuguaauaauuacuguacacacgggggaccaacaucaaguggggaacgacacccaagguguaacuguagaaauaacaccacaagcauccacuguggaggcgguccuaccugaguacggaacauuaggacuagaauguaguccaaggacgggccucgauuuuaacgaaaugauauuacuuacuaugaaaaauaaggcuuggauggugcaucgucaaugguucuucgauuuaccguuaccauggacaucuggcgcuacgacagagacgccuacuuggaaucggaaagaacuauuagugaccuuuaaaaacgcacacgcuaagaaacaagagguggucguccuaggaagucaagagggugccaugcauacagcauuaaccggagcaacagaaauucaaaacagcggagguaccaguauauuugcgggacaucuaaaaugccggcugaaaauggacaaauuagagcugaaaggaaugucguaugcuauguguuuaaauacuuucguccuuaagaaagaaguuucugagacacaacaugguaccauacuaaucaaaguugaauauaaaggcgaggacgcgccuugcaaaauaccauuuaguacagaagacggacaagguaaagcacauaaugggagauuaaucacagcaaauccggugguuaccaagaaagaagaaccaguaaauauagaagccgaacccccuuuuggagaaucaaacauagucauaggcaucggugauaaagcgcuuaaaauaaauugguacaagaaagguucaucaaucggcaaaauguuugaggccacggcaagaggggcaagaaggauggcaauacugggugacaccgccugggacuuugggucagucgggggaguacuaaauucucucggaaaaaugguacaccaaaucuucgguagugccuauacggcccuauuuucaggugucucguggaucaugaaaauaggcaucggagugcuacuuaccuggauaggacuaaacaguaaaaauacuagcaugagcuucuccugcauuguuauagggauaauuacacuguaucuuggugcagugguacaagcugacauggguuguguaaucaauuggaaagggaaagaauugaaaugcggaaaugguaucuucguuaccaaugaaguucacacuuggacagaacaauacaaauuucaagcugacaguccaaaaagacuagcgacagcuauugccggugcaugggaaaaugguguuugcgguauuagauccaccacuagaauggaaaaucucuuauggaaacagauagcuaaugaacuuaacuauauauuaugggagaacaauaucaaacugacugugguagucggagauauaauuggaguauuagaacaagggaaaaggacguuaacuccacaaccaauggaacugaaauauuccuggaaaacguggggaaaagcuaaaauaguaacggcugagacccaaaauucgagcuucauuaucgacggaccaaacacacccgaauguccaagcgcaucccgugcauggaauguuugggagguagaagauuaugguuucggcguguucacaacgaauauauggcuaaaauuaagggaaguuuauacgcaaucgugugaccaucgacuuauguccgccgcaauaaaagaugaaagagccguacaugccgacauggguuauuggauagaaagucagaaaaaugggucuuggaaacuagagaaggcuucguucauagaaguaaaaaccugcacuuggccaaagagccacacauuauggaguaauggaguuuuagaaucagauaugauaauaccaaaaucuuuggcugggccaauaucacaacauaaucauaggcccgguuaucauacacaaacugccggcccuuggcaccuaggaaaacuagaauuagauuuuaacuauugugaaggcacaacuguuguuauagcggagaauugugguacccgcggaccgucauugcgaaccacgacaguuucuggcaaacuaauacacgaguggugcugcagaaguugcacucuuccuccauuaagauacaugggagaagacggauguugguacggaauggaaauacgaccaauuaacgaaaaagaggaaaauauggugaaaagccuaguuucagccggaaguggaaaaguagauaauuucacuaugggugucuuaugcuuagcaauccuguucgaagaaguaaugcgaggcaaauucgggaagaaacauaugaucgcaggcguguuguuuacauuuguuuuacuauuaucaggucaaauuacauggcgcgauauggcucacacuuuaaucaugauugguucuaaugcaucugauagaaugggaaugggagucacacauuuagcacugauagcgacguuuaaaauucaaccauuuuuagcacuaggauucuuucugagaaaauuaacgucacgagaaaaucuuuuacuaggaguggguuuggcuauggcaacaacccugcaauugccugaagauauagaacaaauggcgaauggaaucgcuuuggguuugaugacauuaaagcugaucacucaauucgaaacauaccaauuguggacggcgcucguaagucuaaccuguaguaauacuauuuuuacuuuaacaguugcauggcggacugcaacccucauucuggcaggaguaagucuucucccccuaugccaaucgagcucaaugcguaaaacugauuggcucccaaugacagucgcagcgaugggagucccuccgcuuccacuauuuauauucucauuaaaagauacaccuaagcguaggucuuggccacuaaacgaaggaguaauggccguaggacucgugucaauucuggccagcaguuuguuaaggaacgaugucccgauggcuggucccuuagucgccgguggauuacucauagcauguuaugucauaacugguaccagcgcagaccugacuguugaaaaagcagcagauguuacaugggaagaggaagcugaacaaacgggcgugagccauaauuugaugauaacuguggacgacgacgguacuaugaggauaaaagaugacgaaacugaaaacauuuuaacuguucuuuuaaagacggcgcuauuaauaguuagcggcauuuuuccauauucaauacccgcaacccuauugguauggcauacauggcagaaacaaacacaacgaucggguguacucugggaugucccuucacccccggagacgcagaaggcagaacucgaagaagggguuuacagaauaaagcaacaagguaucuucggaaagacacaaguaggcgucgguguacagaaggaaggaguauuccauacuauguggcacgugacaaggggagccguucuuacucauaauggaaaacgacuagaaccaaacugggcgucggugaaaaaggauuuaauuucuuauggggguggauggcgacuaucagcacaauggcaaaaaggagaagaaguacaagucaucgcuguagaaccgggaaagaacccuaaaaauuuucaaacaaugccaggaauauuucaaacaacuacuggugaaauaggagccauugcacuugacuucaaaccaggaacgucaggguccccuaucauaaaucgcgaaggaaaaguaguaggccucuaugggaacggcguaguaaccaaaaaugguggcuacgugucagggauugcacaaacgaaugcagaaccagaugggccaacuccagaacuagaagaagaaauguucaagaaaagaaacuuaacgauaauggaucuucaccccggcaguggaaagacaaggaaauaccucccugcaaucguacgagaagcaaucaaacgaagacuccgaacgcuaauuuuggcaccaacaaggguuguggcugccgaaauggaggaggcuuuaaaaggauuaccgauaagauaucaaacuacugcaacgaaaagcgaacacacaggucgcgaaauuguagaucuaaugugucaugcaacuuuuacaaugcgacuucugucaccuguucgaguuccaaacuacaauuuaguaauaauggaugaagcccacuuuacugauccagccucgauagcugcucguggcuacauaucuacucgagugggcaugggggaagcggcagccauuuuuaugacagccacacccccuggaacagcugaggcuuuuccccagagcaaugccccaauacaggacgaagaaagggauauuccagaacgcaguuggaacagugguaaugaguggauaaccgacuuuguuggaaagacaguaugguuuguucccucgauuaaagccgguaaugacaucgcuaauugccuacguaaaaacgguaagaaagucauacagcuaucgcgcaaaacguucgacacagaauaucagaaaacuagauuaaaugacugggauuuuguuguuacuacugacaucucggagaugggagcgaauuuuaaagcagauaggguuauagacccaagacguuguuuaaaacccguaauacuuacagacggacccgagagagugauacuugcaggccccaugccgguaacagcagcuagugcggcacaacguagggguagaguaggacgaaauccacaaaaagaaaaugaucaauacauuuucacaggucaaccguuaaacaaugaugaagaucacgcacauuggaccgaagccaaaauguugcuagauaauauuaauacaccagagggaauaauaccugcguuguucgaaccagaacgggaaaaaucggccgcaauugauggagaauaccgucuuaaaggagaaucuaggaaaacuuuuguagaacugaugaggagaggggaccucccaguaugguuggcacauaaaguugcaucagaggguauaaaauauacagacagaaaaugguguuuugauggagaacgaaacaaucaaauauuggaggaaaacauggaugucgagauauggacuaaagagggugaaagaaagaaacuuagaccgcgauggcuggaugcaagaacuuacagugacccucuagcacuuaaggaguucaaagauuuugcagcugggcggaagucuauugcguuggaucuaguaacggaaauaggaagagugccaagccaucuugcucaccguacacggaacgcccuugacaaccuuguuaugcugcacacauccgaacacgguggacgugcguacaggcaugcgguagaggagcuuccagaaaccauggaaacucucuuacuucuaggacuuaugauucuucuaacuggaggggcuauguuauuucucaucucaggcaaaggaauuggaaagacaucaaucggccuuauuugcguaauugucucguccgggauguuauggauggcugaugugccacuccaauggauagcuagugcaauaguuuuagaauuuuucaugauggucuuacuaauaccagaaccagaaaagcaaaggacuccacaagauaaucaauuggcauauguagucauugguauacuaacguuagcagcaauuguugcugcaaaugaaaugggcuuacuagaaacaacaaaacgugauuugggaaugucaaaagaaccagguguuguaucucccacgucuuacuuagaugucgaccuacauccugcuucugccuggaccuuauaugcggucgccacaacaguaauuacaccaauguuaaggcacacuauugaaaacucgacagcaaacgucagucuugcagcaauugcaaaucaagccguuguacugaugggcuuagacaaaggauggccuauaucaaaaauggauuuaggcguaccauugcucgcucugggauguuauucccaaguaaauccuuuaacacugacagcagcaguauuauugcuagucacccacuaugcaaucaucggcccaggacuucaagcuaaagcgacgagggaagcucagaaaagaacagccgccgggauuaugaaaaacccuacgguagacggaauaaugacgauagaucuggauccgguaauauaugauucgaaguucgaaaaacaacuaggacaggucaugcuuuuaguacuaugcgcggugcaauuacuauugaugaggacaucaugggcucuaugugaagcauuaacccuggcuacagguccgauaacgacgcuaugggaagguucgcccgguaaauucuggaauaccacaauugcaguaaguauggcaaauauuuuuaggggaaguuacuuagccggagcgggucucgccuucucaauaaugaagucaguagggacaggacggcgcggaacuggaucacagggugagacacuuggcgaaaaauggaagaagaaauuaaaccagcuaucccguaaagaauuugauuuauacaagaaaaguggaauaacggagguugauaggaccgaagcgaaagaagguuuaaaaagaggcgaaacaacucaucaugccguuucaagagggagcgcuaaguuacagugguuugucgaacggaauauggugauaccagaaggaagaguuauagaucuggguuguggaagaggaggauggucauauuacugugcaggacucaagaaaguaacugagguaagggguuacaccaagggagggccuggucacgaagaaccgguaccuaugaguacauacggauggaacaucguaaaauugauguccgguaaagauguauuuuaucucccaccagaaaaaugugauacccuauuaugcgacauaggagaaucuagcccaucaccaacagucgaagaaagccgaaccauacguguucuaaagaugguugaaccauggcuucguaauaaccaguuuuguaucaaggugcuaaauccauacaugccaacagucauagaacacuuagaacggcuacaaagaaaauacgguggaaugcuaguccguaacccgcuaucuagaaacucaacccaugaaauguacuggauaucaaacggcaccggcaauauaguaucaucagucaacaugguuucaagauuauuacucaacagguucacaaugacgcaccggagacccaccauugaaaaagacguagaccuaggugcuggcacucgacacguuaaugcggaaccagagacucccaauauggacguaauaggagaacgcauaaaaagaauuaaggaagaacacagcaguacauggcauuaugacgaugaaaauccauacaaaacaugggcauaccacggcagcuaugagguaaaagcaacaggaucagccucaucuaugauaaauggcguuguaaaacuacugacgaagccuugggacguagucccaaugguaacgcaaauggcuaugacugacacaacgccauuugggcaacaaaggguuuucaaagagaagguggauacccgaacaccacgaccaaugcccggaacaagaaagguuauggagauuacagcggaguggcuuuggaggacauuaggacgaaacaagaaaccacgguuguguacuagagaggaguuuaccaagaaaguaagaacuaacgcugcaaugggagcaguguuuacagaagagaaucaaugggacuccgcaagagcugccguugaagaugaggaauuuuggaaauuaguagacaaagaacgugagcuucauaagcuaggaaaauguggaagcuguguguacaacaugaugggcaagagagagaagaaacuuggggaauuugguaaagcaaaaggaucaagagcaaucugguauaugugguuaggugcaagguauuuggaguucgaagcacuaggauuccuaaacgaagaucacugguucagcagggagaauagcuacagcgguguagaaggcgagggacugcacaaauuagguuacauucuuagagauauauccaagauucccggcggcgcaauguacgcagaugacacugcaggaugggacaccagaauuacagaggacgaccuacacaacgaagagaaaauuacacagcaaauggauccgggccauagacagcuagcuaaugcgauuuuuaaacuuacuuaccaaaacaaggugguaaaaguacaaagaccuacuccuaaagguacaguaauggacaucauuucgaggaaagaucaacgugggucaggacaaguagggacuuauggacuuaauaccuucacaaauauggaggcccaguuaguucgccagauggaaggcgaagguguuuugagcaaagcggauuuggaaaauccacaccuacuugagaagaaaauaacucagugguuagaaacuaaagguguagaacguuuaaaaaggauggccauaucaggagaugacugcguugucaaacccauagacgauagguucgcuaacgcauuacuagcacuaaaugauauggggaaagucaggaaagauauaccucaguggcaaccuaguaaagguuggcaugauuggcaacaaguaccauuuuguagucaccauuuucaugaguugauaaugaaggauggacggaagcuagugguuccguguaggccgcaagacgaguuaauuggucgcgcacgaauuucacaaggugcaggcuggagcuuaaaagagaccgcaugcuuaggcaaggccuacgcacaaauguggaguuuaauguauuuccaccggagagaccugcgccuggcaucaaaugcgauauguucagcuguacccguacauuggauaccaacaucaagaacuacguggagcauucaugcacaucaccaauggaugaccacggaagacaugcuuacgguauggaaccgaguuuggauugaagacaaucccuggauggaagauaagacaccaguaacaacaugggaagacguuccauaucucgggaaacgugaagaucaaugguguggcaguuugaucggucuaaccucacgggccacgugggcccagaauaucuuaacugcaauacaacaaguaagaagccuaauuggagaugaggaguuucuugauuacaugcccaguaugaaacguuuuagaaaagaagaggaaacugaaggagcuauaugguga

SEQ ID NO: 23568 - RNA, 9873 nt, Artificial Sequence
  derived and/or modified CDS sequence (opt6) from DENV-3__EF643017__SS-prME
acaucacugugccuaaugaugauacuaccagcagcacucgcauuucaccuaacaucaagagauggagaaccaagaaugauaguggguaaaaaugaaagaggaaaaucauugcuauucaaaacugcuaguggaauaaauaugugcacacuaaucgcgauggacuuaggagaaaugugugaugacacaguaacuuacaaaugcccacauauaacagaaguugaaccugaagacaucgauuguugguguaaucuuacgucgaccuggguaacuuacggaacuugcaaucaggcaggagagcgcagaagggauaaaaggagcguugcauuagcuccacacguaggaaugggauuagauacacgaacccaaacauggaugagcgccgaaggagcuuggaggcaaguagaaaaagucgaaacgugggcacuaagacacccaggcuuuacaaucuuagcgcuauuuuuagcacacuauauagggaccucccugacucaaaaagugguuauuuucauauuguugauguuaguaacaccuaguaugacuaugagaugcguuggaguuggcaaucgugauuuuguugaaggccuaucaggcgcgacguggguagacgugguccuugaacauggagguugcgugacuacuauggccaaaaacaaaccaacauuagacauagaacuucagaaaaccgaagcaacucaguuagcaacacucagaaaauuauguaucgaaggaaaaauaacaaacauaacaaccgacuccagauguccaacccaaggagaagccgugcucccugaggaacaagaucagaauuacgugugcaaacauacguacgucgauagagggugggguaacggaugcggguuauuuggcaaagggagcuuaguaacgugcgcuaaauuucaaugccuagaaccaaucgaggguaaaguuguccaauacgaaaaucuaaaauauaccgucauuaucaccguacauacaggugaccagcaccaaguuggaaaugaaacgcaaggggugacugcggagauaacuccucaagcuaguacgacagaagcaauucuaccugaauacggcacauuaggccucgaaugcucaccaagaacaggucuagauuuuaaugagaugauacuauuaacaaugaaaaauaaggccuggaugguccaucgccaaugguucuuugauuugccccuuccauggacguccggagcuaccacugaaaccccaacauggaaccgaaaggaauuacuuguuacguucaaaaaugcucacgccaaaaagcaggagguaguuguacuaggaucgcaagaaggugcaaugcauacggcgcuuacgggagcaacugagauacagaacucuggaggaacaucaauauuuuccgggcaucuaaaaugucgauugaaaauggauaaauuggaauuaaaaggaaugagcuaugcgaugugcacuaauacguuuguuuugaagaaagaaguaucagagacucaacauggaacgauauuaauaaaaguagaauaucguggcgaagaugcccccuguaaaauaccguucaguaccgaagacggucaaggaaaagcucacaauggacgauugauaacagcaaaucccguaguaaccaagaaagaagaaccaguuaacaucgaagcagaaccaccauucggagaaucaaacauaguaauugguauuggcgacaaugcauugaaaauaaauugguacaagaaagggagcucuaucggaaaaauguuugaagcuacagccaggggugcgcgaaggauggcaauucuaggggacacagcuugggauuucgguucaguuggcggaguguuaaauucguuaggaaaaaugguucaucaaauauucggcagugcauacacugcccuauuuaguggcgucuccuggguuaugaaaauaggaauaggaguauuacuaacauggauaggccugaacagcaaaaauacaaguaugucguuuucuugcauagcaauuggaauuauaacacucuaucugggagcggucguucaggcagauaugggcuguguuauuaauuggaaagguaaagagcuaaaaugcggaucugggauauuuguaaccaaugaagugcauacguggacugaacaauacaaauuccaagcagauucgccuaaaagauuagcgacagcgauagcuggagcuugggaaaacggaguauguggaauacgaaguacaacaaggauggaaaacuuauuauggaaacaaauagcaaaugaguuaaauuacaucuuaugggaaaauaauauuaaacuuacuguaguuguuggugauauuauaggcguacuugaacaagggaagagaacacuaacaccacaaccuauggaacuaaaauacagcuggaagacaugggguaaagccaaaauagugacggcagagacccaaaauagcucguuuauaauagaugggcccaauacaccagaauguccaagcgccucgagagcuuggaauguuugggaaguugaagauuacggcuucgguguuuuuaccacuaauauuuggcuaaaacugcgcgaaguauacacccaacuuugcgaccacagacugaugagugcagcuguaaaggaugagagagcgguacaugcugauaugggauacuggaucgaaucucagaaaaacggaucauggaaacuugagaaagccagcuuaauugaaguaaagacuugcacauggccaaagucucacaccuuauggucuaauggagucuuagaaucagacaugauaacaccaaaaucauuggcgggaccgauuagucaacauaaucacagaccaggauaccacacucaaacggcaggaccauggcaccuuggaaaacuggaauuagauuuuaauuauugugaagguacaacaguuguaauaacugagaauuguggaacacgugggccgucacuacgaacuacaacagucuccgggaaauugauacacgaauggugcugucgcucuuguacgcucccaccauugagguauaugggagaagacgguuguugguaugggauggagaucagaccuauaagcgaaaaagaagagaacaugguaaagagcuuaguaagugcagguucagggaaaguagacaacuuuacuaugggcguacucuguuuagcaauacuauuugaagaaguaaugcgugguaaauucggcaagaaacacaugaucgcggguguauucuucaccuucguucugcugcuuucgggacaaaucaccuggagggacaugacccacacguuaauuaugauuggaucuaacgcaucagaccguaugggaaugggcgugaccuaccuggcacuaaucgcgacauucaaaauccaaccauuucucgcucucggguucuuuuuaagaaaacucacgucacgugaaaaccuuuuacugggcguuggccuugccauggcaacuacacuacagcuaccagaagauauagaacaaauggcgaacggaaucgcacuagguuugauggcgcuaaaauuaauaacacaguuugagacuuaccaauuauggacagcguugauaucguuaaccugcaguaacacaauguuuacuuuaacugucgcguggcguacugcgacacuuauccuagcugguguaucauuacuacccgugugccaaucaaguaguaugcggaaaacugauuggcucccaauggccgucgcagcaaugggcgucucuccacuaccuuuauuuauuuucagcuuaaaagauacauugaaacgacguucguggccccuaaaugaaggcguuauggcaguaggccuagucucaauacucgcuucaucacuucugagaaaugacguccccauggcaggaccguugguagcaggcggauuacuaaucgccugcuacguuauuaccggaaccucagccgauuugacaguugaaaaggccgcugauauaaccagggaagaagaagcugagcagacaggagugucgcauaaucuaaugacuacaguugaugaugauggaacuaugcgaauuaaagacgacgaaacugagaacauacugacgguauuauuaaagacagcacuucuaauaguuagugguguauuuccauacucaauuccagcaacccugcuaguauggcauacuuggcaaaagcaaacacaacgguccggggugcuaugggacguuccaagcccucccgaaacacaaaaggccgaguuagaagaaggaguauaccgaauaaaacagcagggaaucuucggaaaaacucagguggggguuggcguucaaaaagaagggguauuucauaccauguggcaugugacucgcggugccguauugaccuauaacgguaagcguuuagagcccaacugggcuagcgugaagaaagaccuaauuucuuauggagggggcuggagacuaucagcgcaguggcaaaagggggaagaggugcaagugauugcaguggaaccuggcaaaaaucccaaaaauuuccaaacuaugcccggaacguuucaaacaacaacaggagagauaggcgcuaucgcacuagauuuuaagcccggcacaucuggaucuccuaucauaaaucgugaagguaaaguggucggauuauacgguaaugguguugucacgaaaaacgggggauacguaagcggaaucgcacaaaccaacgccgaaccagacgguccgacaccagaauuagaggaagagauguucaagaaaagaaaucucacuauaauggacuuacacccuggcagcgggaaaacaagaaaauauuugccugccauuguacgggaagcuaucaaaagaagacuaagaaccuuaauacucgccccuacaaggguuguggcugcggaaauggaagaagcucuaaaagggcuaccuauucgcuaccaaacuaccgcaacuaaaucggaacacaccggcagggaaauagucgaucugaugugccaugcaacguucaccaugcgucuacucuccccuguucgugugcccaauuacaaucuaauuaucauggacgaagcgcauuucacugacccugcaaguaucgcagcuagaggcuauauuucaacccgagucggaaugggggaagcagcagcuauauucaugaccgcuacaccgccggggacagcugaugcuuucccccaaucuaacgcaccgauucaagaugaagaaagagauauaccagagagaagcuggaacucagguaaugaguggaucacagauuuugcugggaaaaccguaugguucguaccuuccauaaaggcugguaaugauauugcuaauugcuugcguaaaaaugguaagaaaguuauucaacucagucguaaaacauucgauacugaauaucagaaaacgaagcuaaaugauugggacuucguuguaacuacagauauaucugaaaugggugccaacuucaaagcggauagagucauagauccucgucgaugccuuaagccgguuaucuugacagacgguccugagcgcguuauauuggcggguccuaugccugucacagccgcaucugcugcucaaaggcgaggacgaguugguagaaauccucaaaaagagaacgaucaauauauauucacagggcaaccuuugaacaaugaugaagaccacgcgcauuggacagaagcuaaaaugcugcuagauaacauaaauacuccugagggaauaauccccgcacuuuuugaaccggaacgagagaaaagugcagcuauagauggagaauacaggcuuaaaggugagagucguaaaaccuuuguagaauuaaugcgucggggcgaccuaccugugugguuagcacauaaggucgcaucagaaggaauuaaauacacugaucgaaaauggugcuucgacggacaacgaaacaaccaaauauuagaagagaauauggauguagaaauauggacaaaggaaggugagaaaaagaaauuaagaccccguuggcuagacgcaagaacguacucggauccucuugcguugaaagaauuuaaggacuuugcugcaggacgaaaauccauagcucuagaucuuguuacagagauaggucguguaccuucacaccuagcacacagaacaaggaaugcguuggauaaucuaguuauguuacacacaucugaacacggagguagggcuuacaggcacgcagucgaagaauuaccagaaaccauggaaacccucuugcuuuuaggauuaaugauuuuauuaacagguggcgcaaugcuguuuuuaauaucuggcaagggaauugggaaaacgucuauaggauuaaucugcgugauagcaucaagcggcaugucguggauggcagaaauuccacuacaauggauagcgucugcaauuguacuagaguucuucaugaugguucuuuuaauaccagaaccagaaaaacaacgcacaccgcaagauaaucaacucgccuacguaguaauugguauauuaacccuggcagccaucauugcagcaaacgaaauggguuuauuagaaacuaccaagagggacuuaggaauguccaaagaacccggaguagugucuccaacaagcuacuuagauguagacuuacacccagccuccgcguggacccuauacgcuguagcuacaacaguaauaacaccaaugcuaagacacacuauagaaaauagcacagcuaaugucucguuggcagcaauagccaaccaagccgucguacucaugggucuagacaaaggauggccgauaaguaaaauggaucuaggagugccacuacuugcacugggaugcuauucucaagugaaucccuuaacucuaaccgcugcuguguuauuauuaaucacucauuacgcaaucaucgggccaggcuugcaggcgaaggcuacccgagaagcacaaaaacgcacagcagcagggauaaugaagaauccaaccguagaugguauaaugacgauagaccucgacccaguuauuuaugacaguaaauucgaaaagcaguugggucaaguaaugcuauugguacucugugcugugcagcugcuucugaugcgaacaaguugggcucuuugugaggcauuaacucuggcaacuggcccaauaaccacgcuuugggaggggagcccugguaaauucuggaacacuacgauagcaguguccauggcaaauauauuucgggggagcuaccuugcaggagucggacucgcauucucgauaaugaaaucaguaggaacuggaaaaagaggaacugguucacaaggggaaacacugggugaaaaauggaagaagaaacuaaaucagcugucacggaaagaguucgacuuauauaagaaaucaggaaucacagaaguagauagaacagaagcaaaggaaggucuuaaaagaggagagaucacgcaucaugcgguaucuagagggucagcaaaguuacaaugguucguggagagaaacaugguaauuccugagggccgaguaauugaucucgguuguggacguggagguuggucuuauuauugcgcuggacucaagaaaguaacagagguacgagguuacaccaaaggugguccuggccacgaagaaccugucccaaugaguacauauggguggaauauaguaaaauuaaugucuggaaaagacguguuuuaucucccaccagagaaaugcgauacgcuauugugcgacauuggugagucaucaccaaguccgaccguugaagaaucaagaacuauuagaguacuaaaaaugguugaacccuggcugaaaaacaaucaguuuugcauaaagguacuaaaccccuauaugccuacaguaauugaacauuuggagagauuacagaggaaacacgguggaaugcuaguacgaaauccacuaucuagaaauuccacgcacgaaauguauuggauuucaaauggaacugggaacauuguagcuucuguaaauaugguaaguagacuguuauuaaaccgguucacuaugacucaucgucgucccacaauagaaaaggacguagacuugggcgcaggcacgcgacacguaaaugccgagccagaaaccccuaauauggauguuauaggagagaggauaaaacgaauuaaggaggaacauaauuccaccuggcacuacgacgaugaaaauccuuauaaaacuugggcuuaucauggcuccuaugaagucaaagcuacuggaagcgccaguaguaugauaaaugggguaguuaaacuucuuacuaagcccugggaugucguuccuaugguuacccaaauggcaaugacggacaccacgccuuucggucaacaaagaguuuuuaaagaaaaagucgauacucggacuccacgaagcaugccagguacacggcgaguaaugggcauaaccgcggaguggcuguggcgaacguuagguagaaauaagaaaccgagauuauguacgcgagaagaguucacuaagaaaguuaggaccaaugcugcaaugggagcaguauucacggaagagaaucaaugggacagugccaaggcugcaguggaggaugaagauuuuuggaaacuuguagacagggaaagggaacuacauaaacuaggaaaaugcggaucuugcgucuauaauaugaugggcaaacgugagaagaaauuaggugaauuuggcaaagcuaaagggucgagggcaauaugguauauguggcugggugcacguuaucuggaguuugaggccuuggguuuucuaaaugaagaucauugguuuucucgcgaaaauucuuacuccgggguugaaggugaaggccugcauaaacuagguuauauccuaagagauauaucuaagaucccggguggagcaauguaugcagaugauacugccgguugggacacucgcauuaccgaggaugauuuacauaaugaagagaaaauaacacagcaaauggaucccgaacaccgccaauuagcaaacgccauauuuaaacuuacauaccaaaacaaaguaguaaaaguacaaagaccgacaccaaccgggacaguaauggauauuauaucaagaaaagaucaaagaggaagugggcaagugggcaccuauggguuaaauaccuucacaaauauggaagcucaauuaaucaggcaaauggagggagaagggguucuaaguaaggcagauuuggaaaauccucaucugccagagaagaaaaucacccaauggcucgaaacgaaagggguugagcgguuaaaaaggauggccaucaguggagaugacuguguuguuaaaccgauagaugaucgauucgcgaacgcguugcuagcauuaaaugacacaggcaaaguaaggaaagauauaccccaguggcaaccgaguaaagguuggcaugauuggcaacaaguaccauucugcagucaccauuuccaugaacuuaucaugaaagauggccgaaaacuuguagugccaugccgaccucaggacgaguuaauuggaagggccagaauaagccaaggggcuggcuggucauuacgagaaacagcauguuuagggaaagcauaugcacagauguggucucuuauguauuuucaucgacgcgaccugagacuagcaaguaacgcaaucuguucagcagugccuguacauugggucccuaccucaagaacuacauggagcauacacgcucaucaucaguggaugacaacagaagauauguugacaguuuggaaccgaguauggauagaagauaacccauggauggaggauaaaacuccaguuaccacuugggaaaauguaccguaucuagggaaaagagaagaucaauggugcgguucuuuaaucggguuaacaagccgagcaacaugggcccaaaauauccccacggccauacaacaggucaggucucuaauuggcaacgaagaguuccuggacuauaugccuaguaugaaacguuuuaggaaagaagaagaaucggaaggagccauuugguga

SEQ ID NO: 23569 - RNA, 9873 nt, Artificial Sequence
  derived and/or modified CDS sequence (opt6) from DENV-3__DQ675519__SS-prME
acaucgauaugcuuaaugaugauguuaccagcuacacuagcauuccaucuuacaucaagagauggagaaccgaggaugauaguaggcaaaaacgaacgcgguaaaucauuacuuuucaaaacugccuccgguauuaacauguguacacucauagcaauggaucugggagaaaugugugaugauacagucacguauaaaugcccuuuaauaacagaagucgaaccagaagauauagacugcugguguaaucucacaucaacuugggugacguauggaacauguaaccaagcuggagaacauagacgagauaaaagaucuguagcuuuagccccacauguaggaauggguuuagacacacgaacacaaacauggaugagugcagaaggugcauggaggcaaguugaaaaaguagaaacuugggccuuucgacauccaggauucacgauucuggcguuauuucuugcacacuacauaggaacaaguuuaacucaaaaaguaguaaucuuuauauuauuaaugcuagucacuccaaguaugacgaugagauguguaggcgugggaaaucgcgacuucguagaaggucuaucuggggccacaugggucgaugucguguuagaacauggaggauguguaaccacaauggcuaaaaacaaaccaacacuugauauagaauuacagaaaacugaagcuacgcaacuugcaaccuuaagaaaauuauguauagaaggaaaaauaaccaaugucacgacagacagcagauguccgacccaaggugaagccauucuaccggaagaacaagaccaaaacuacguuugcaaacacacauauguugaucgaggauggggaaacggcuguggguuauucgggaaagggagccuugugacuugcgcaaaauuccaaugcuuagaaucuauagaaggcaaagucguacagcaugaaaauuugaaauauacgguaauuauuacggugcauacuggugaucaacaccaaguugggaaugaaacgcaaggagucacugcagaaauaacaccacaagcgaguacaguagaagcaauacuaccggaauauggaacuuuaggucuugaauguucgccaagaacagggcuagacuuuaaugaaaugauauuauuaaccaugaaaaauaaggcuuggaugguacaucgacaaugguucuucgaccuaccucuaccauggacaaguggugcuacuacagagacgccaacuuggaacaagaaagagcuauuaguaacauuuaaaaacgcccaugcuaagaaacaagagguuguuguauugggcucccaagaaggcgcuaugcacacagcuuuaacaggagcgacggaaauucaaaccagcggugguacaucgauuuuugcuggucauuuaaaauguagacuuaaaauggauaaacuagaacuaaaagguauguccuacgcaauguguuuaaaugcauucguccugaagaaagaaguaagugaaacccaacaugggaccauauuaauaaaagucgaauacaaaggagaggaugcaccuugucggauaccauuuucuacagaagaugggcagggcaaagcacacaacgguagguuaaucacugcgaacccuguuguuacaaagaaagaagaaccuguaaacauagaagcugaacccccuuuuggugaaaguaacauaguuauagguauuggggauaaagcauugaaaauaaauugguacaagaaaggaucuuccauuggcaaaauguucgaagcaacugcgcgaggagcccgacguauggcuauucuaggcgacacugcuugggacuucgguucuguuggaggaguuuugaauagucuaggaaaaaugguacaccaaauauuuggaucagcuuauacagcgcuauucucuggugugaguuggauaaugaaaauugggaucgguguccugcuaacauggauaggccuaaauagcaaaaauacuucaaugucguuuucuugcauuguaauagggauaaucacgcuauauuuaggggcagugguacaagcagauauggguuguguuauuaauuggaaagguaaagaacugaaaugcggaaacggcauuuuuguaacuaacgaaguucacacauggacugaacaauauaaauuccaagcugacucaccgaaaagauuggcuacagcuaucgcaggcgcuugggaaaacggcgugugcgguaucagaucuacaacacgaauggaaaaucuacuuuggaaacaaauagcuaaugaauuaaauuauauccuuugggaaaacaauaucaaguuaacuguagucguaggggacauuauagggguacuugaacagggaaaacguacccuaacaccacagccaauggaauuaaaauacaguuggaagacuugggggaaagcaaaaaucgucacggcggaaacacagaacucuucauuuauuauagacgguccaaacaccccagaaugucccuccgcaucuagggcuuggaacgugugggagguagaagauuacgguuuuggcguguuuacgacaaacauuugguugaaacuuagagaaguguacacucaauugugcgaccaccgccucaugucggcugcaguaaaagaugagagggccguucaugcagacaugggcuacuggauugaaagucagaaaaacgggagcuggaaacuagagaaagcaucacuaaucgaggugaagacguguacguggccaaaaucccauacauuauggucuaauggcguauuagagagugauaugauuauuccuaaaucacuugccggaccaauaagucaacacaaccacagaccaggauaccacacacagacagcaggacccuggcacuugggaaaguuagaacuugacuuuaauuauugugagggaacuacagucguuauaacagaaaauuguggaacaagagguccaucccuucgaacaacuacagugucuggaaagcuaauccacgaaugguguugccggucaugcacccuaccuccuuugagauauaugggagaagauggcugcugguauggcauggagauucgaccuauaaaugaaaaggaagaaaauaugguaaagucacuuguuagcgcagguagcggcaaaguugacaauuucacaauggguguauuaugccuagcuauauuauucgaagaagucaugagagggaaguucgguaagaaacacaugauagcugguguuuuauuuacauucguucuauuguuaaguggacaaaucacauggagagacauggcccauacgcugauuaugauaggcagcaaugcuucagauaggauggggaugggcgucacauauuuagcgcuuaucgcaacauucaaaauacagccuuuucuagcguugggauucuucuuacggaaauuaacaucaagggaaaauuuauuacuaggcguaggacuugcuauggcaacgacuuuacaauuaccagaagacauagaacagauggcaaauggcguugcuuuaggucuaauggccuugaaguuaauaacacaauucgaaacauaucaauuauggacagcuuuggucucccucaugugcagcaacaccauuuucacauuaacaguagcauggagaacagcaacccuaauauuagcggguaucucuuuacuuccgguuugucagucgaguucaaugagaaaaacagauuggcuccccaugaccguagcagcaaugggaguaccgccguuaccauuauucauauuuucacuaaaagauacucuaaaaaggagaucauggccucuuaacgaaggcguuauggccauuggcuuaguuuccauauuagcaagcagcuugcuacguaacgacguuccaauggcagggccauuaguagcuggagguuuauuaauugcaugcuacguaauuacagggacaagugcugacuugacagucgaaaaggcugcugauguaacuugggaagaagaggccgaacaaaccgggguuucucauaaucuaaugauaacaguugacgaugaugggacgaugcgaauaaaagaugacgaaacggagaauauuuugacuguacuucucaagacugcauuauuaauugucucuggaaucuucccguauagcaucccagcaacucuauuagucuggcacacauggcagaagcagacgcaaaggucugguguacugugggauguuccuucaccaccugagacgcaaaaagcugaauuagaagaaggaguguauagaaucaaacaacaaggaaucuuuggaaaaacacagguugguguaggaauacagaaagaaggcguguuccacacgauguggcaugugacuaggggcgcuguguugacgcauaaugguaagagauuagaaccaaauugggcuaguguaaagaaggauuuaauuucuuaugguggaggcuggagauuaagugcucaguggcaaaagggagaagagguccaagucauagcuguugagccuggcaaaaauccuaaaaacuuucaaacuaugccaggaauuuuucagacgacuacuggagaaauuggcgccauagcucuugacuuuaaaccagguacaagcggaucuccaauaauuaauagagaaggcaagguagucggauuauauggaaacggcguggucacuaagaauggaggauaugucucaggaauagcacagacaaaugcagagccagacggcccaacacccgagcuugaagaagagauguuuaagaaaagaaaucuaacaauuauggauuuacacccagggagcgggaaaacacggaaauauuugccgacaauaguucgggaagcgauaaagagacgacuaagaacacuuauacuagccccuacacgaguaguugcugccgaaauggaagaagccuuaaaaggguuaccaauaagauaccaaacaacggccacaaaaucugagcacacagggaaagaaauaguggaccucaugugccaugcuacauucacaaugcgcuuauuauccccaguaagaguacccaacuacaaccugaucaucauggaugaagcucauuucacagauccagcuucaaucgcagcuaggggauacauuucgacgcguguaggaaugggagaggcagcggcaauauuuaugacggcuaccccaccuggaaccgccgaugcuuucccacagagcaaugcacccauacaagaugaagagagagauauaccugaacguagcuggaauagcgguaaugaauggauuaccgauuucguggggaaaaccguuugguucgucccaucaaucaaagcaggaaacgauauagcaaauugcuuaaggaagaauggcaagaaaguaauccaacuaagucgaaagacauucgacacagaauaucagaagacaaaacucaaugacugggauuucguaguaacaacagauauaagugaaaugggagcgaauuucaaagcagacagaguaauugacccaagacgguguuuaaaaccaguaauauuaacggacggaccugaaagggugauauuggcaggcccgaugccaguuaccguagcuucagcagcucaaaggagaggccggguuggacggaauccacaaaaggagaacgaccaauauauuuuuaccggucaaccccuaaacaacgaugaggaucaugcacacuggacagaagcaaaaaugcucuuggauaauaucaacacacccgaagguauaauuccagcacuuuucgaaccggagcgcgagaaaucagccgccauugauggagaauauagguuaaagggagagucgagaaagaccuucguggaacucaugcgaagaggggacuuaccggucugguuagcacauaagguugcguccgaggguauaaaauauacagauagaaaaugguguuucgauggagaaaggaauaaucaaauacuagaagaaaauauggacguugagauauggacgaaagaaggagagaagaagaaauuaagaccacgauggcucgacgcccgcaccuacucagauccacucgcuuuaaaagaguuuaaagauuuugcugccggaagaaaaaguauagcgcuugauuugguaacggagauaggcagaguucccagccaucuugcauauaggacgaggucagcauuggauaauuuagucaugcugcauacaagcgaacauggugggagggcuuaucgacaugcaguggaggaauuaccagaaacaauggagacgcuauuauuacuagggcucaugauuuuauuaacgggaggugcuaugcuauuuuuaaucucagguaaaggcauaggaaaaacaucuaucgguuuaauuugcguaguagccaguagugguaugcuauggauggccgauguaccccuccaauggauagcaucagcuauaguguuggaguucuuuaugaugguucuucuuauaccagaaccagaaaagcaaagaacgccacaagauaaucaauuggcguacguugugauagguauucucacauuagcugcaauuguugccgccaacgaaaugggucuucuagaaacaacaaaaagagauuuagguaugaguaaagaacccggagucgugaguccuacaaguuacuuagacgucgaucugcauccagcaagcgcauggacacucuaugcugucgcuacaacaguaauaaccccaaugcuccgacacacgauagaaaauaguacggcaaacguaagccucgccgccauagcuaaccaggccguaguucugaugggucuagauaaagguuggccuauuucuaaaauggauuuggggguaccacucuuagcccucggauguuauucucaaguuaaccccuugacacucacagcugcuguuuuacuuuuggugacccacuaugcaauuauuggacccggccuacaagcaaaagcaacucgagaagcacaaaagaggacugcagccgguauuaugaagaauccaacgguagacgggauaaugacgauagauuuggaccccguaauuuacgacucaaaauucgagaagcaacuuggucaaguaaugcuguugguacuaugcgcuguccaacuguugcuuaugcggacaucuugggcauuuugcgaggcucuuacgcuagcaacggguccaauuacuacacugugggaagggaguccugguaaauuuuggaacaccaccauagccguuaguauggccaacauuuuccguggcaguuauuuagccggagcagguuuagcuuucuccauaaugaaaaguguuggcacuggaaaacggggcacaggaucacaaggagagacuuuaggagaaaaauggaagaagaaauuaaaucaauuguccagaaaagaauuugauuuguauaagaaaucggguauuaccgaaguggacagaacuaaagcaaaggagggacuaaaacgaggagagacaacgcaucacgcagucucaagaggaucggcgaaacuucaaugguuuguugagcgaaacauggugauccccgaaggaagaguuauugaucuuggcuguggccgaggcggauggucguauuauugcgccggucucaagaaaguaacagaaguuagaggguauacgaaaggaggaccagggcacgaagaaccagugcccaugucuacguaugguuggaauauaguaaaauugaugagugguaaagauguguucuaucugccuccagaaaaaugcgacacccuguuaugcgauauuggcgaaagcucaccaaguccaacggucgaagaaaguagaacaauaagaguacugaagaugguggaaccguggcuuaagaacaaucaauuuuguauaaaaguacucaauccguacaugccaacugugauagagcaucuugaaagacuucaacgaaagcaugguggaaugcuuguuagaaacccacuuucaagaaacucuacucaugaaauguauuggauaucaaacggaacuggaaauauagucuccagcguaaacauggucucaagacuuuuacuaaaccgguuuacaaugacacacaggcgcccaaccauagaaaaagacguggauuuaggugcugguacacgucacgucaacgccgaaccagaaacuccaaacauggacgugauaggggaaagaaucagaagaauaaaggaagaacacaguucaacguggcauuacgacgaugaaaauccguauaaaacaugggcauaucauggguccuaugaaguuaaagcuacaggaucagcuagcucuaugauaaacggaguaguuaaacuauuaacaaagccaugggauguaguaccaacaguaacgcagauggcuaugacagacacaacgccuuuugggcaacaacggguauuuaaagagaaaguugauacaagaacuccuagaccuaugccaggaacacgaaaaguaauggagaucacagccgaauggcuauggagaacuuuaggccgcaauaaacgaccacgcuuguguacucgggaagaguuuaccaagaaaguacguacgaaugcugcuaugggugcaguauuuacugaagaaaaccaaugggacagugcuagagcagcuguugaagacgaagaguucuggaaauuaguagaucgggaacgugaacuacacaaauuaggaaaaugcggcucgugcguauauaauaugauggggaaaagggagaagaaacuuggggaauuugguaaagcuaaaggaucgagagcaaucugguacauguggcugggagcaagguacuuagaguuugaggcauugggauuucuaaaugaagaucauugguucagccgggaaaacucauauucuggaguggagggagaggguuuacauaagcuaggguacauccucagagauauaaguaaaacuccaggcggagcuauguaugccgacgacacugcgggaugggacacgcgaauuaccgaggacgauuuacacaacgaggagaaaauuacucaacagauggaucccgaacauaggcaauuagcuaaugcuauuuuuaaauuaaccuaucaaaacaagguaguaaagguucagcguccuacaccaaagggaacgguuauggacauuauaagccgcaaagaccaaagagguagcggucaggucggcacuuauggucuuaacacguuuacaaauauggaggcacaacucauaagacagauggagggagaaggaguuuuaucaaaagcagaucuggaaaauccccauuuacccgagaagaaaaucacccaauggcuugagacuaagggcguggagcgacuuaaaagaauggccauuagcggcgaugacugcguggucaagccgauugaugauagguuugcgaaugcuuuauuagcauuaaacgauaugggaaagguaagaaaagauauaccucaauggcaaccgucaaagggauggcaugauuggcaacagguacccuucugcucucaucacuuccaugaacuuauaaugaaagauggccgaaaguugguagucccaugcagaccacaagacgaauuaaucggucgagcaaggauaucccaaggggcuggcuggucacuuaaagagacagccuguuugggcaaggcauaugcacaaauguggucauuaauguacuuccaucggagggaucugcgacuggcuucuaaugcaauuugcuccgcaguaccaguacacuggguuccgacgucgagaacgacuuggagcauacaugcccaccaccaguggaugacgacugaagauauguuaacuguauggaacagaguguggaucgaggacaauccauggauggaggacaaaacuccaguuacaacaugggaagacguaccauaucucggcaaacgggaagaccaaugguguggcagcuuaauaggacuuaccaguagagcgacaugggcacaaaauauuuuaaccgcaauucagcaaguuagaaguuugaucggaaacgaagaguuccuugauuacaugccauccaugaaacgauucagaaaagaagaagaaucggagggagcuauaugguaa

SEQ ID NO: 23570 - RNA, 9873 nt, Artificial Sequence
  derived and/or modified CDS sequence (opt6) from DENV-3__DQ675521__SS-prME
accucauuuugucugaugaugaugcuacccgcuacucuagcauuccaccuaacaucuagagauggagaaccaaggaugauuguaggcaaaaaugaaagggguaaaucgcuccuauuuaaaacggccucaggaaucaacauguguacguuaaucgcgauggaucuuggugaaaugugugacgauacaguuaccuauaaauguccacugauugcagagguugagccagaagacauagauugcugguguaaucuaacaucuacaugggugacuuacggaacauguaaucaagcuggcgaacaucgacgagacaaaaggucaguggcuuuggcaccucauguaggcaugggcuuggauacccggacacaaacuuggaugagugcagaaggugcuuggaggcaaguagagaaaguagaaaccugggcguugagacacccgggcuuuacaauucucgcgcuauuucuagcacauuacauaggaacuucacuuacgcaaaaagugguaauauuuauccuauugaugcuagugaccccgucuaugacaaugcguugugucgguguaggcaacagagauuucguugaaggucucucaggugcaaccuggguagacgugguacucgaacauggcggaugugugacuacaauggcaaaaaacaaaccaacguuagacauagaauuacagaaaacggaggccacccaacuagccacauuacgaaaauuaugcauagaagguaagauuaccaauauaacuacugauagucggugcccuacacaaggagaagcaauacuaccggaagagcaggaccaaaauuacguauguaaacauacguauguagauagaggcugggguaauggcuguggacuguuuggcaaagguaguuugguaacuugugcaaaauuccaaugucucgaaccuauagaagggaaggucguacaauacgaaaaucuaaaguauacaguuauuauaacaguucauacuggcgaucaacaucagguagguaacgauacgcaggggguaacgguagagauuacuccacaggccagcacuguagaagcaguacucccugaauacggaacauuaggccuagaaugcaguccaagaacaggauuagauuuuaaugagaugauauugcugacuaugaaaaacaaagcuuggaugguucauagacaaugguucuuugaccuaccauugccauggacgagcggcgcuacuacggaaaccccuacguggaacaggaaggaauuacuagugacauuuaagaaugcccacgcgaaaaaacaagagguaguggugcuuggcucgcaagaaggagcgaugcacacugcucuaacaggugcaacagagauacaaaauucaggaggaaccucgauauuugcgggacaucugaaaugccgacuuaagauggacaaacuggaguuaaaagguaugaguuacgcaaugugcuuaaacacauuuguauuaaaaaaagagguaucugaaacacaacacggaacaauuuuaauaaaagucgaauauaaaggugaggaugcacccuguaaaauaccauuuaguaccgaagaugggcaaggcaaagcgcauaauggucgauuaaucacagcaaauccaguagugacaaagaaagaagaacccguaaauauagaagcugaaccacccuuuggagagaguaacaucguaauaggaauaggugauaaggcuuuaaagaucaauugguauaagaaaggaagcagcauagguaaaauguucgaagcuacagcacgaggagcacgaaggauggcaauauugggggauacagcgugggauuuuggaucaguaggagggguacuuaacucacuaggaaaaaugguacaucaaauuuucggaucugccuacaccgccuuauuuucaggagucuccuggaucaugaaaauugguauaggcguguuauugaccuggauaggcuuaaacaguaaaaacacgucgaugaguuuuaguugcauaguaauaggaauaaucacuuuguauuuaggugcaguuguacaagccgacaugggauguguaaucaacuggaaagguaaagagcuaaaaugcggaucagggauauuugucacuaaugaaguacauacuuggacagaacaauauaaauuccaagcugauucgccaaaaagguuagcgacggcuaucgcaggagcaugggaaaacggagucugcggaauacggagcacaacaaggauggaaaacuuacuuuggaaacagauugcgaacgaacucaauuauauacuaugggaaaauaacauuaaacuaacaguaguggugggugauaucaucggcguguuagaacaaggaaaaagaacccuaacaccucaaccuauggaauuaaaauacaguuggaagacuuggggcaaagccaaaauugucacugccgaaauucaaaacucuagcuucauaauugauggacccaauacaccggaaugccccucagcuucccgcgcauggaauguaugggaagucgaagacuauggauuuggcguuuuuacaacaaauauaugguuaaagcuuagggaaauguauacacaaagcugcgaucauaggcuaaugagugcugcaauaaaagaugaacgugccgugcaugcugacauggguuauuggauagaaagccaaaaaaacgggaguuggaaacucgaaaaagcaucauucaucgaaguuaaaacauguacuuggccgaaaagccacacauuauggagcaaugggguauuagagagugauaugaucauuccuaaaucguuagcaggcccgauaucgcagcauaaucaccguccuggauaucauacucaaacggcaggacccuggcacuuagguaaauuggaacuagauuucaauuauugcgaaggaacaaccgucguaauuacugaaaauugcgguacucgugguccaucauugaggaccacaacaguaucgggcaaacuuauccacgaaugguguugcagaaguuguacauugcccccucugagguauaugggagaagauggcuguugguacggaauggaaauaaggcccauaaacgaaaaagaagaaaacauggucaaaaguuuggugagcgcggguucaggaaagguugacaauuucacaaugggaguauuaugucuugcgauucuguuugaagaaguaaugcgagguaaauuuggaaagaaacacaugauaguuggaguauuauuuacuuuugugcuucuccuaucuggacaaauuacguggagggauauggcacauacucuuauaaugaucggcucaaacgcaagugauaggaugggaaugggaguaacuuaccuggcuuuaauagcgaccuucaaaauccagccuuuuuuggcguuaggguucuuccucagaaaacuaacuucgcgagaaaaccugcugcucggagucggucuggcgauggcgacuacccuccaacuaccagaagauauugagcaaauggcgaacgggauagcuuuggguuugaugacauugaagcuuauaacgcaguucgaaacuuaucagcuauggacagcucugguaucacugaccugcucaaauaccauuuuuacuuugacagucgcauggagaacggcuacuuuaauauuagcugguguuagucuauuaccgcugugccagucgagcuccaugcggaaaaccgauuggcucccgaugacuguagcggcuaugggcgucccuccacucccacuauucauauuuucacuaaaagacacaccuaaaagaagaagcuggccgcuuaaugaggguguaauggcagucggucuagugucuauccuugcaucaucuuuguuacgaaacgacguuccgauggcaggccccuugguagcgggaggacuacuaauugcguguuaugucauaacaggaacuucagcggaccuuacaguagaaaaagcagccgaugugacaugggaggaagaggcggaacagacgggagugucacauaauuugaugauaacuguugacgacgaugggaccaugaggaucaaggaugacgagacugaaaauauuuuaacuguacucuugaaaacugcacucuuaaucguaagcggaauauuucccuauaguauaccggcaacucuccucguauggcauacauggcaaaaacagacccagagaaguggaguguuaugggacguaccaucgccgccugaaacacaaaaagcggaacuagaagaggggguguacagaaucaagcagcaggggauuuuuggaaaaacucaagucggcguggggguacaaaaggaggguguauuucauacaauguggcaugucacuagaggcgcaguauuaacccauaauggaaaaaggcuagaaccuaauugggcuuccguaaaaaaagaucuaaucagcuauggaggcggauggcgacuaagugcacaauggcagaaaggagaagaggugcaggugauugcgguggaaccggguaaaaaucccaaaaacuuucagacaaugccugguauauuccaaaccaccacuggugagauuggcgcuaucgcacuagacuucaaaccaggaacaucaggaucaccuaucauuaacagagaagggaaaguaguugguuuauaugguaauggagugguaacaaaaaacggaggguacguuagugggauagcgcaaacaaaugcugaaccagacggaccaacaccagaacuagaggaggagauguucaagaaaagaaaucugaccauaauggauuugcaccccggaagcgggaaaacucggaaguaucucccagcaauagucagggaagcgauaaagaggcgacugcgaacacuaauauuagcaccuacgagaguuguugcagcggaaauggaagaagcacuaaaaggcuuaccaauuagguaccaaacgacugcaacuaaaagcgagcauacagggagagaaauuguagauuugaugugucaugcaaccuucaccaugagacuauuaucaccuguacgaguucccaauuacaaccucauaauuauggacgaggcucacuuuacugacccagcuaguauugcggcaagaggcuauauaucgacaaggguggguaugggagaggcagccgcaaucuucaugacugcaacuccgccuggaaccgcugaagcauuuccgcaaucaaaugcuccaauccaagaugaagagcgagacauuccagaaaggucauggaauuccggaaaugaauggauuacagacuucguaggaaaaaccguuugguucgucccaucaauaaaagcagggaacgacauagcaaauuguuugcgaaaaaaugguaaaaaagugauccagcuaaguagaaaaacguuugauacugaauaucaaaagacucgacugaaugacugggauuucguuguaaccacggacauuuccgagaugggagcaaacuuuagagcagacagggugauagacccuaggcgaugcuuaaaacccguuauucuuacagauggccccgagagagucauuuuagcuggaccaaugccgguaacagcugcuucagcagcacaaagaagaggacgcguaggaagaaacccgcagaaagaaaacgaucaauacauuuucacgggacagccacucaauaaugaugaagaucacgcucauuggacugaagcaaagaugcuacuagauaauaucaauacuccagaagguauaauaccugcuuuauuugaaccagaacgugaaaaaagugccgcuauagacggugaauaccgcuuaaaaggggaaucgcggaagaccuuuguagaauuaaugagacguggagacuuaccaguauggcuagcgcacaaaguugcauccgaggggauaaaauacacugacaggaagugguguuuugauggagaacgaaacaaccaaauccuagaagaaaauauggauguggaaauuuggacuaaagaaggagaacgaaagaaauugaggccacggugguuagaugcacguacauauucagacccacuggcccuuaaagaguuuaaagauuuugcggcaggaaggaaauccauugcauuagaucuagucacagaaauugguagaguuccgagccacuuagcccacagaacacgaaaugcacuagauaauuuaguuaugcuacauacgucggaacauggcgguagagcguaucgucacgcaguagaagaacuaccagagaccauggaaacguuguuauuacuuggguuaaugauucugcuuacuggcggcgcaauguuauucuuaauaucaggcaagggaauaggcaagacaucgaucggcuuaauauguguuauaguaaguucaggaaugcuauggauggccgauguaccauuacaauggauagcgucagcgauaguacucgaauuuuucaugaugguacuccugauccccgaaccugaaaagcaaagaacuccucaggauaaccaacuggccuaugucguuauugguauuuugacucuagcugcaauagucgccgccaacgaaauggggcuccuggaaacuacgaaacgagaccuagguaugucuaaagaaccaggugucguaagcccuacaagcuaucuugaugucgaucugcauccagcgucagcauggacuuuauacgcgguagcaacgacagugaucacgccuauguuaagacauacuauagaaaacucuaccgccaacgugucccuagccgcaaucgccaaccaggccguaguuuugaugggauuggauaaaggauggccuauaagcaaaauggaccugggaguaccauuauuagccuuagguugcuauagucagguuaauccccucacacucacugcugcgguucucuuauuaguaacgcauuaugcuauaaucgggccaggauuacaagcaaaagcaacccgggaagcacagaaacggacugcagcggguaucaugaaaaauccaacugucgauggaauaaugacuauagaucuggauccgguaauauaugacucgaaauucgaaaaacaacuaggacaaguaauguuacuaguauuaugugcgguacaacucuuacucaugagaacgucuugggcacuaugugaagcauugacccuugccaccgguccaauaaccacgcucugggagggaagcccuggaaaauucuggaacacaacaauagccguuucaauggcgaauauauuucgcggaagcuaccuagcaggcgcuggacuugcuuuuucuauaaugaagagcguaggcacaggaagaagagguacgggaagccaaggagaaacccuaggcgaaaaauggaagaaaaaacuaaaucaauugaguagaaaagaauucgauuuauauaaaaaaagugguauuacagaagucgaccguacagaagccaaagaaggauugaaacguggugaaacaacacaucaugcgguguccagaggaagugcaaagcuucaaugguuuguagaacguaauaugguuaucccugaaggacgugucaucgauuuaggguguggacggggaggauggucauauuacugugcagguuuaaaaaaaguuacggaaguuagaggauauacaaaaggaggaccaggccaugaggaaccuguaccaaugagcaccuaugguuggaacauaguuaagcuaauguccggaaaagauguguuuuacuuaccacccgagaaaugugauacacuauuaugugauaucggugaauccucucccagcccaacaguggaagagaguaggacaauuagggucuugaaaaugguugagccauggcugaagaacaaccaguuuuguauaaaaguccuaaauccuuauaugccuacgguaauagagcaucuagaaagguuacaaagaaaauauggaggaaugcuagugagaaacccccuuucucgaaauagcacgcaugaaauguauuggauauccaacggaaccggaaauauaguuagcucaguaaauaugguaucucguuugcuucugaaucgauucacuaugacucaccgaaggccaacgaucgagaaggacguugacuuaggagcuggcacaaggcauguuaaugccgaaccagagacgccgaauauggacguaauaggggaaaggauaaaacgcaucaaagaagaacauucuucaacuuggcauuacgacgaugaaaauccuuacaagacaugggcuuaccauggauccuacgaagucaaagccacagguucagcuaguaguaugauuaacggggucgucaaauuguugacgaagccgugggauguagucccaaugguaacucaaauggcaaugacagauacuacuccuuucggacaacagagaguauucaaagagaaaguagauacuaggacaccacggccaaugccaggaacccgaaaaguuauggagauaaccgcggaauggcuguggagaacgcuggggagaaauaaaaaaccaagacuauguacgagggaagaauucacgaaaaaaguaagaacaaaugcugccaugggagcaguauuuacagaggagaaccagugggacucugcgagagcggcagucgaagaugaagaguuuuggaaacuaguagaccgagaaagggaacuacacaaacugggaaaaugugguucguguguuuauaauaugaugggcaaacgggaaaaaaaacuuggagaguucggaaaagcaaaaggaucucgcgcaaucugguauaugugguuaggugcuagauauuuagaauuugaggcacuaggauuucuaaacgaggaccacugguucucgcgugaaaauagcuauucaggaguagaaggugaaggucuacauaaguuggguuauauuuugcgugauaucaguaaaauaccagguggagccauguacgcagacgauacugccgggugggacacacgcauaacggaggaugauuuacauaaugaagagaaaauaacgcaacagauggacccagagcacaggcaauuggcaagcgcaauauucaaauugacuuaucagaacaaaguagucaaaguucaaaggccaacucccaaagggacaguuauggauaucauuuccagaaaagaccaaagaggaaguggucaaguagguaccuacggauuaaacacauuuacgaauauggaggcucaacucguacgacagauggaaggcgaaggaguauuauccaaagcagaccuugagaauccucauuuacuagaaaagaaaauuacccaaugguuagaaaccaaggguguagaacggcugaaaaggauggcuauaucaggagaugauuguguaguaaaaccaauagaugaccgauucgcuaaugcuuuacuagcuuuaaacgauaugggaaaaguucguaaagacauuccgcaguggcaacccucuaaaggauggcacgacuggcaacagguacccuuuugcucgcaccauuuucaugaauuaauuaugaaggauggacgcaaguuaguagucccaugcaggccccaagaugaacuaaucggcagagcccggauaagucagggugcagguuggagcuugaaagagacugcuugucuaggcaaggcguacgcucagaugugguccuuaauguauuuucaucggcgcgaccuaagacuugccaguaaugcgauaugcucagcugucccaguucacugggucccuacuagccguacaacguggaguauucacgcacaccaccaguggaugacuacugaagauaugcucacaguauggaauagaguauggauugaggauaauccauggauggaagacaagacaccuguaacuacuugggaagacguaccauacuugggcaaacgagaagaccaguggugcggcucucuaauuggccuuacaucaagggccacuugggcgcaaaacauacucacagccauccaacaggugagaucacugauaggagaugaggaauuucuagacuauaugccauccaugaagcgauuuagaaaagaagaagaaagcgaaggggcgauuugguaa

SEQ ID NO: 23571 - RNA, 9873 nt, Artificial Sequence
  derived and/or modified CDS sequence (opt6) from DENV-3__DQ675522__SS-prME
acgucauuuugucuaaugaugaugcugccggcaacucuugcguuccauuuaacaagcagagacggugaaccuaggaugaucguugggaaaaaugaaagggggaaaucucuacuguuuaaaacggcaucagggauaaauauguguaccuuaaucgcaauggaccuaggagaaaugugcgacgacaccgucacuuauaaaugcccuuuaauagcagagguugaacccgaggacauugauugcugguguaaccuaacaagcacauggguaacuuacggcacauguaaucaagcgggugagcaucgaagagauaaacguagcguggcgcuugcaccacauguaggaaugggcuuagauacuaggacucaaaccuggauguccgcggagggagcuuggagacaggucgaaaaaguagaaacaugggcucucaggcacccgggcuucacuauccuagcguuguuccuagcacauuauauagguaccucacuaacccaaaaaguaguaauauuuauauuacuaauguuaguaacccccucaaugacaaugcgauguguaggcguuggcaauagagacuucgucgaaggauugucaggagcaacauggguugacguaguauuagaacacgguggaugugugacgacuauggcuaaaaacaaaccuacacucgacauagaacuacagaaaaccgaagccacacaauuagcaacacuacgaaaauuaugcauagaagguaaaauaacuaauauuacaaccgacaguaggugcccuacacagggcgaagcuauuuuaccagaagaacaagaucagaauuacguaugcaaacacacauacguggaucgaggaugggggaacggaugcggacuauucggaaaaggaagccuaguuacaugugcuaaauuccaaugccuagagccgaucgaaggaaaaguuguccaauacgaaaacuuaaaauacacuguaauuauaacuguacacacaggagaccaacaucagguuggcaacgauacucagggagugacaguagaaauaacaccgcaagcaucuacaguugaagccguauuaccagaguaugguacauugggccucgaaugcaguccgagaaccggguuggacuuuaaugaaaugauuuuguuaacaaugaaaaauaaagccuggaugguacaucgacaaugguucuuugacuuacccuugcccuggacaaguggcgcaacaacugaaacacccacauggaacaggaaagaauuguuaguaacguucaaaaacgcccaugcaaagaaacaagaagucgucguccucgguagccaagaaggagccaugcacacugcucuuaccggagcaaccgaaauacaaaauucgggaggcacaaguaucuucgcgggucacuuaaaauguagacuaaaaauggauaaauuagaacuaaaaggcaugaguuaugcuauguguuuaaauaccuuuguuuugaagaaagaaguaagugagacgcaacaugguacaauccuaauaaaaguagaauacaaaggagaagaugcgccaugcaaaauuccauuuucgacugaagacgggcaaggaaaggcacacaacggacgcuuaauaaccgccaauccaguagugaccaagaaagaagaaccuguuaauauagaagccgaaccuccuuuuggugaaagcaacauaguaauaggcauaggagauaaggcguuaaagauaaauugguauaagaaagguucaucgauagguaagauguuugaagcaacugcccgaggcgcaagaagaauggccauuuuaggagauacagcuugggauuuugguagcgucggugggguuuuaaauagucuaggaaaaaugguucaucaaaucuuuggaagugcguacacggcccucuuuucaggaguaucguggauaaugaaaauugggauaggaguuuuauuaacauggaucggacuuaauagcaaaaauacaucgaugaguuucucuuguauuguuauugggaucauuaccuuguaucuaggcgcuguuguucaagccgacaugggaugugugauaaauuggaagggaaaagaacucaaauguggaagcggaauuuucguaacaaaugagguccacacguggacugaacaguacaaauuccaagcugacucgccaaaaagacuagcaacagcuauugcaggggcaugggaaaauggaguauguggcaucagaaguaccacgagaauggagaaucuguuguggaaacaaauagcuaaugagcuuaauuacauacuaugggagaauaacauuaaauugaccguagucgucggagauauaaucgggguucuugaacaggggaaaaggacgcuaacaccacagccgauggaguuaaaauauucauggaagaccuggggaaaagcaaaaauagugacagcggaaauacaaaacuccucauuuauaauugauggcccuaauacuccugaauguccuucagcaagcagggcuuggaaugucugggagguagaagauuauggauuuggagucuucacaacgaauauuugguugaagcuacgcgaaauguauacacaaucgugugaucaucgacuuauguccgccgcaauaaaagaugaaagagcuguucaugcagacaugggauauuggaucgagucucagaaaaacgguucauggaaacuagaaaaggcuucauucauagagguaaaaaccuguacauggccuaaaucacacacuuuauggucuaauggcgugcuugaaagugauaugauuauuccgaaaucacucgcaggaccuauaucucaacacaaccauagaccugguuaucauacucaaaccgcaggcccauggcacuuaggaaaacuagaauuagauuucaauuauugugaaggcaccacuguaguuauaaccgagaacugugguacuaggggcccuucacucagaacaacaacgguuaguggcaaauugauacaugaguggugcugucgauccugcacucuaccuccgcuucgauauaugggagaggacgguugcugguauggaauggaaauaagaccaaucaacgaaaaagaagaaaauaugguuaagagcuuaguuucagcaggaagcgguaaagucgacaacuuuacuaugggaguacucuguuuagcaauccuuuuugaagagguaaugcgagguaaauucggcaagaaacauaugauuguaggaguuuuguucacguucguguuauuauugagcggucaaauaacuuggcgagacauggcacacacgcuaauaaugauaggaaguaacgcuuccgaccguauggguaugggcgugaccuaucuugcacucauugcaacauucaaaauacaaccguucuuggcacucggauucuuccuaagaaaauuaacgucaagagaaaaucuucugcuagguguaggucuggcgauggcaacuacacuacaauugccagaagacaucgaacaaauggcgaauggaauagcacuaggcuugaugacauuaaaacucauaacacaauuugaaacuuaucaauuauggacagcguuaguaucucuuacguguucuaauacaaucuucacacucacaguugcauggagaacagcaacucuaaucuuagcuggaguuucacuucuuccccugugucaaagcucaagcaugcguaaaacugauuggcugccaaugaccguagcagccaugggaguacccccacuuccuuuauuuauauucagccuaaaagauacuccuaaaagaaggaguuggcccuuaaacgaaggcguuauggcuguaggcuuaguuucuauacucgcgagcagucuuuugcgcaaugauguaccuauggccgggccccuuguugccggaggucuacuaauagcguguuacgucauuacaggaacguccgcagaccucacugucgaaaaagcagcagaugucacuugggaagaggaagccgaacagacaggcguaucacacaaccuaaugaucaccguggacgaugacgguaccaugagaauaaaagacgaugaaacggagaauauacugaccguucuuuuaaaaacagcucucuuaauuguauccggaauuuuuccauauucgaucccugccacucuauuaguuuggcacaccuggcaaaagcaaacucaacgaucaggaguauugugggauguaccgagucccccugagacucaaaaagcugaacucgaggaaggaguguaucguauuaaacaacaagguauuuuuggaaaaacccaagucggagugggaguucaaaaagaagguguuuuccacacgauguggcauguuacgcguggcgcaguccucacccacaacgggaaacgccucgagccgaauugggcuagcgugaagaaagaccuaauaucauauggagguggcuggagauuaagugcucaguggcagaagggagaagaaguccaaguaaucgcgguagaacccggaaagaauccgaagaauuuccaaacaaugccaggcauuuuccaaacuaccacaggagaaauaggagcaauagcauuggauuuuaaaccaggaacuucugguaguccuauuauaaaucgcgaaggcaaaguaguaggauuguacgguaauggaguaguaacuaaaaauggaggauaugugucagggaucgcucaaacuaaugcagaaccagacggucccacuccggaauuggaggaagaaauguucaagaaaagaaacuugacaauuauggaccuucauccagguuccggcaaaaccagaaaauaccuuccagcuaucgucagagaagcgauaaaaagaagacugcgaacgcuaauauuggcucccacucgaguuguagccgcggaaauggaagaagcccuaaaagguuuaccgaucagauaccaaacuacugcuacaaaaucugaacauacagggagagagauaguagauuuaaugugucaugcaacauuuacaaugagguuauuaaguccuguucgcguaccuaauuacaaucuaauaaucauggaugaggcacauuuuacugauccugcgaguauagccgcucgaggguauauaaguacaagagucgguaugggagaagcagcagcgaucuuuaugacagcuaccccuccaggaacggcggaagcauucccgcaaagcaaugcaccgauccaagaugaagaaagagauauacccgaacgaucuuggaacuccggaaaugaauggauaaccgacuucguuggaaaaacaguaugguuuguuccgucgauuaaagcaggaaaugacauagcaaauugccuaaggaaaaacgguaagaaaguaauacaguuaucccguaaaacuuucgacacugaguaucagaaaacucgacuuaaugacugggauuuuguagugaccacugacauuagugaaaugggagcuaauuucaaagccgaccgugucauagauccuaggcgauguuuaaaaccggucauauugacggacgguccagagaggguaauacucgcaggaccaaugccgguaacagcagcuagugccgcacaaaggcgcgggcggguaggaagaaauccacaaaaagaaaaugaccaauacauauuuacgggucaaccccuuaacaaugaugaagaucacgcccauuggacugaagcuaaaaugcuauuagauaacauaaacacaccugaagguauuauucccgcucuauucgagccagaacgagagaaaagugcagcuauagauggggaguaccgcuuaaaaggagaaucgagaaaaacauucguagagcuuaugcggaggggugaucuaccuguguggcuggcacacaaaguagcuagugaagggauaaaguauacugauagaaaauggugcuucgauggugaaagaaacaaccagauacuagaagaaaauauggacguagaaauauggacaaaagaaggcgagagaaagaaauugagaccucgaugguuggacgcuagaacauacucagauccguuagcauugaaagaauuuaaagacuuugcagccggaagaaaaagcauagcacuugaccuuguaacagagauuggacgagucccuagccaucuugcccaucguacccgaaaugcucucgauaacuuaguaauguuacauacauccgaacauggagggagggcauacagacaugcaguggaagaauugccggaaacgauggaaacauuacuucuacuuggucuuaugauuuuauuaacugguggcgcgaugcuauuuuuaauaaguggaaaagguauuggcaaaacgaguaucggauuaauuugcguuauagucaguucggguaugcuauggauggcugauguuccuuugcaguggauugccagcgcuauuguacuagaguucuucaugaugguucuacugauaccggaaccggaaaaacaaagaacuccccaagacaaccaguuagcauacguagugauuggcauauugacucuagcggcuauaguagcugcgaacgaaaugggacuuuuagaaaccacgaaacgcgaccuggguauguccaaagagccugguguggugagcccaacuuccuauuuagaugucgauuuacacccugcgucugccuggacucuauacgcaguagccaccacgguaauaacaccaauguuacgacauacuauagaaaacucgacagccaaugugucacuggccgccauugcuaaucaggcagugguccucauggguuuagauaaggguuggccuauuuccaaaauggaucuaggcgucccucuccucgccuuggguuguuauucccaagucaauccauuaacacuaacggcugcaguacuucuccuagugacacauuacgccauuauuggaccgggguuacaagcgaaagccacuagagaagcccaaaagagaacggcagcggguauuaugaaaaauccaacaguugacggcauuaugacaauagauuuagauccaguaauauaugauucaaaguuugaaaaacagcucggacaaguaaugcuacuuguauuaugugcgguucaacuacuguuaaugcgaaccucgugggcacuaugugaggcuuuaacauuggcaacaggaccgauuacaacauuaugggaaggaaguccggggaaauuuuggaauacaacuauagccgugucuauggcuaacauuuucagaggaucauaucuagccggugcuggacuagcuuucucuauaaugaaaucgguagguacaggaagaagaggaacaggaucccaaggggaaaccuugggagagaaauggaagaagaaauuaaaucaauuaucaagaaaagaauuugaucuauacaagaaaucaggaauuacugaagucgaucguacagaggcaaaagaaggcuuaaagagaggggaaacuacgcaucacgccguaucuagggguucugcaaaauuacaaugguuuguugaaaggaacaugguuauuccggaaggucguguuauugaucucgguugcgguagaggugguuggucuuacuacugugcaggccuaaagaaaguuacagaaguacggggauacacaaaagggggaccgggucacgaggaaccaguacccaugagcaccuacgguuggaacauugucaaauuaaugucgggcaaagacguguucuaucucccuccagaaaagugugauacauuauugugcgauauaggagagucaaguccaagcccuacaguugaagaaucccgcacaauaagaguauuaaagaugguggaaccauggcucaaaaauaaccaauuuuguauuaaaguccuaaauccauacaugccuacuguuaucgaacaccuagagcgauuacaaagaaaauacggaggaaugcuaguucguaacccauuguccagaaauucaacacaugaaauguacuggauaagcaauggcacaggaaauauuguuucgucagugaauaugguuucccgacuauugcuuaacagauucacuaugacacaccguaggcccacuauugaaaaagauguagaccuuggugcaggaacccgccauguaaacgcagaaccugaaaccccuaauauggaugucaucggagaaaggauaaaaagaauaaaagaggaacauucaucaacauggcacuaugaugacgaaaacccauacaaaacaugggccuaucacggaucauacgaggucaaagcuacuggcagcgcuaguaguaugauaaauggcguuguaaaauuauuaacuaaaccaugggauguggucccuaugguaacacaaauggccaugacagauacaacaccguuuggccaacagcgaguuuuuaaagaaaaaguagauacacggacaccacguccaaugccgggaacacguaaaguuauggaaauuacugcagaaugguuauggaggacucucggacguaacaagaaacccagauuguguacacgggaggaguucacgaaaaagguccgcacaaaugcagcaaugggcgccguauuuacagaggaaaaccagugggacagugcacgagcagccguugaggacgaggaauuuuggaaacucguagauagagaaagagagcugcauaaguugggaaaguguggaucuugcgucuacaacaugauggggaaaagagaaaagaaauuaggagaguucgggaaggccaaaggcucgagagcuauuugguauauguggcuaggagccagguaccucgaauuugaagcacuaggauucuuaaaugaagaucacugguuuucucgagagaacucuuacucaggcgucgagggagaaggucugcauaaauuaggauauauucucagagauauuaguaaaauuccggguggugcaauguaugccgaugauaccgcuggaugggacacaaggauaacugaggaugauuugcauaaugaagagaaaaucacacaacaaauggaccccgagcauagacaacucgccucagcgauauuuaaauuaacguaucaaaauaaggucgugaaaguucagagaccaacuccuaagggcacggucauggacauaauuucgaggaaggaccaaagagguucaggccaaguaggcaccuauggauuaaacacuuucacgaauauggaagcgcaauuaguaagacaaauggagggagaaggagugcuuagcaaagcagaucuggagaauccucaucuguuagagaagaaaauuacacaauggcucgaaacgaaaggaguggagcggcugaagcgcauggcaauuucuggugacgauuguguaguuaaacccauagacgaucgcuuugcaaaugcacuacuagcucuaaacgacauggggaaagucagaaaggauauaccccaauggcaaccauccaagggauggcacgacuggcaacaagugccguucugcagccaucacuuucaugaauuaauaaugaaagaugguagaaaauuagucguaccaugucgcccucaagaugaguuaaucggacgggcgcgaauuucacaaggcgcaggauggucccugaaagaaacagcaugccucgguaaagcauaugcacaaauguggagucuaauguauuuucacaggcgagacuuaagacuugccucaaaugcaauaugcagugcaguacccguacauuggguccccacaagucguacgacauggaguauacaugcucaccaccaguggaugacgacugaagauaugcuuacgguguggaauagaguuuggauugaggauaauccuuggauggaggacaaaacuccaguaacgacaugggaggauguuccauacuugggaaagcgugaagaucaauggugcgggucacucauaggccugacuucgagggcaacaugggcccaaaacauucuuacagcuauccaacaaguuagaucguuaauaggagacgaagaguucuuagauuacaugccaucaaugaaaagauuuagaaaggaagaagaaagugaaggggcaauuugguga

SEQ ID NO: 23572 - RNA, 9873 nt, Artificial Sequence
  derived and/or modified CDS sequence (opt6) from DENV-3__DQ675527__SS-prME
acuagcuuuugccuaaugaugaugcuuccagcaacacucgcauuccacuugacuucgagggacggugaaccaaggaugauaguaggcaaaaacgaacgggguaaaucucuuuuguuuaaaacugccucaggaaucaauauguguacccuuauugcaauggaccugggagaaaugugugaugauacugucacuuacaaaugcccauuaauugccgaaguagagccagaagacaucgacugcugguguaacuuaaccucuacuuggguuacauauggcacaugcaaucaagcaggagaacaucggagagauaaaaggucuguagcacuagcgccacacguuggaaugggucuagacacaaggacacaaacguggaugagugccgaaggggcauggagacaaguugaaaaagucgaaacuugggcguuaaggcacccagguuuuacuauacucgcucuauuuuuggcacacuacaucgggacaagucucacacaaaaagucguaaucuuuauauuacuaaugcuuguuaccccaagcaugaccaugagauguguuggggugggaaaucgagauuuuguagaaggacucaguggggcgacguggguggauguagugcuagaacauggaggaugcguaacaacaauggcgaaaaacaaaccuacccuugauaucgaauuacagaaaacggaagcaacucaacuugcaacuuuaagaaaacuaugcauugaagggaaaauaaccaacauuacuaccgauagccgcugucccacacagggagaagcaauacuuccagaagaacaagaccagaauuauguguguaaacauacuuauguugaucgcggaugggguaauggauguggacuauucgguaaagguagccuugucacuugcgcuaaauuccagugccuagaacccauagaaggaaaagucguacaguaugaaaauuuaaaauacacggucaucauaacagugcacacaggugaccaacaucaggucggaaaugauacucagggaguaacugucgaaauaacaccucaggcaagcaccguggaagcgguauuaccugaauacgguacccucggacuagaaugcucaccaagaaccggauuggauuucaacgagaugauucuacuaacuaugaaaaauaaggcuuggaugguacaucgucagugguucuuugaucugccgcuuccauggacaaguggggcaacaaccgaaacaccuacuuggaauaggaaagaauuacucguuacauucaaaaaugcacacgccaaaaagcaagaaguuguaguauuaggcucacaagaaggagcaaugcacacggcacucacgggggcuacugaaauacaaaauucuggggguacaagcauuuuugcaggucauuugaagugucgauugaaaauggacaaacucgaguuaaagggaaugucauaugcaaugugucuaaacacauucguccuaaagaaggaaguuucugaaacucaacauggcacgauucucauaaaaguugaauacaaaggugaagaugcucccuguaaaaucccauucucuacagaagauggacaaggaaaagcgcacaauggaagacuaauuacagcuaauccaguagugacuaagaaggaagaaccaguaaauauagaagcagaaccucccuucggagaaucgaauauaguuauagguauaggagauaaagcucuaaaaauuaacugguauaagaaaggaagcaguauaggaaaaauguucgaagcaacagccagaggagcgagaagaauggccauuuuaggcgacacagcaugggauuuugggaguguaggaggaguucuaaacucgcuuggcaagaugguacaucagaucuucggcucagccuacacagccuuauucucuggaguaagcuggaucaugaaaauagguaucgguguauugcuaacauggauaggucuaaauucuaaaaauacuuccaugagcuucucauguauuguaaucgggaucauuacauuguaccucggugcgguuguacaagcugacaugggaugcguaauaaauuggaagggcaaggaacuaaaauguggcagcgguaucuucgugacaaacgaaguacacacauggacggaacaauauaaauuccaagcagacaguccaaaaaggcuggcaacagcaauagccggggccugggagaacgggguuuguggaauaagauccacuacuagaauggaaaacuuauuauggaaacagauagcuaaugaacugaauuauauccugugggaaaauaacauaaaacucacuguaguaguuggggauauaaucgggguccucgaacagggcaaacggacccuuacaccacagcccauggaacuuaaguacucuuggaaaaccugggguaaagcuaaaauaguuacagcugagauccagaauaguucguuuauaauagacgggccgaauacucccgaaugcccaucagcaucuagagcauggaaugucugggagguugaggacuacggauuuggaguguucacgacgaauaucugguuaaaacuaagagagauguauacccagaguugugaccacagguugaugucagcagccauaaaggaugaacgcgcaguacacgcagacaugggauacuggaucgagagccagaaaaauggcucguggaaacuagaaaaagccucguuuauugaaguaaagacguguacguggccaaaaagucauacauuauggagcaauggaguucucgaaagcgacaugaucauaccaaagagucuagccggacccauaucacaacauaaucauaggccagguuaucauacacaaacggcagguccguggcaucucgguaaauuagagcuagauuucaacuacugcgaaggcacaacagucgucauaacagaaaacuguggaacaagagguccuucucuacgaacaacgacgguguccggaaaauuaauacaugagugguguugucgaucauguacacuaccacccuuacgauauaugggggaagaugggugcugguacggaauggaaauucggccuauaaacgaaaaggaagaaaacauggugaaaaguuuaguuagcgccggaucaggaaaaguugacaauuuuaccauggguguacuaugccuugcaauacuuuuugaggaaguaaugaggggaaaauuuggcaagaaacauaugaucguaggaguccuauucacauuuguacuccuuuuaagcggucaaauaacuuggagggauauggcacacacacuaauuaugaucggaucuaaugcaucagacagaauggguaugggaguaacauacuuggcgcuuauugcaacauucaaaauucagccauuccuugcacugggcuucuuucuacgcaagcucaccaguagagaaaaucuuuugcucggggugggacuggccauggcuacgaccuuacaacuaccugaagacauagagcagauggcaaaugggaucgcuuuaggacuuaugacguuaaagcucauuacacaauucgaaacguaccaacuuuggaccgcucuaguaaguuuaaccugcucgaauacaauauucacucuaacaguggccuggaggaccgcaacauuaauucuagcaggcgugucucuauuaccacucugccaaucaucaucuaugcgaaaaaccgacuggcuaccgaugacugucgcagcgaugggagugccaccacuuccucuauucauuuucuccuuaaaggauacaccgaaaagaaggaguuggccacuaaaugagggagucauggcaguaggacucguaagcaucuuggcgaguucgcucuuaagaaacgacguaccuauggcuggacccuuaguugccgguggguuacuaauugcauguuaugucauaacaggaacgagcgcugauuugacgguagagaaagcagcugauguaacuugggaagaagaagccgaacaaacuggaguuagucauaaccuaaugauaacaguagaugacgacgguacuaugagaauaaaagaugaugaaacugaaaauauccugacagucuuacucaaaacugcacuguuaauugucaguggaauauuuccuuacaguauaccagcaacauuacuuguauggcacacguggcagaagcaaacacagagaucuggaguccucugggauguucccucucccccugagacacagaaagccgaauuggaagaaggaguuuaucggauuaaacagcaaggaaucuuuggcaaaacucaaguaggggugggcguacaaaaagaagggguuuuucacacuauguggcacgucacucgaggagcugucuugacgcauaacgguaaaagacuugaaccaaauugggcauccgucaagaaagaccuaauaucauacggggguggauggagacuuucagcccaguggcagaaaggggaagaaguucaagugaucgccguagaaccugguaaaaauccaaagaauuuucaaacaaugccgggaauauuccaaacaacaacaggagaaauaggagcuauugcguuagauuuuaaaccgggaacuagcggcucuccuaucauuaaucgggaaggaaaaguuguagggcucuaugguaacggaguaguuacgaaaaaugggggauauguaagugggauagcacaaacaaacgcagaaccagaugggccgaccccagaguuggaagaagaaauguuuaagaaaaggaaucuaacaauaauggaccuccauccaggaucaggcaaaaccaggaaauaccuaccugcuauagugcgcgaagcuauuaaaagaagauuacgaacgcuuauuuuagcaccuacaagaguuguagcagcagagauggaagaggcccuuaaaggacugccgauaagauaucaaacaacagcuaccaagucggaacauacuggucgcgaaaucguagaccuaaugugucaugcaaccuuuaccaugcgcuugcugucaccgguaagaguucccaauuauaaucugauaauaauggaugaagcucauuucacagauccugcaucuauugcagcucggggauauauaucaaccagaguaggaaugggagaagcagcugcaauauucaugacagcaaccccaccagguacagcggaagcauuuccgcagucuaaugcacccauccaagaugaagaacgagacauaccugaacgaucauggaacagugguaaugaauggauuacagauuucgucggcaaaaccguaugguuuguaccuucaauaaaagcuggaaacgacauugcaaacuguuuaaggaaaaauggcaagaaagugauucaacugucccgcaaaacauucgauacggaauaucaaaagacucgacuaaacgauugggauuuuguagucacaacagauauaucagaaaugggagcaaauuuuaaagcagaucgaguaaucgauccgcguaggugcuugaaaccaguuauacuaacagacgguccugagcgugugauacuugcugggccaaugccaguaaccgcagcuagugcggcucagaggagaggacgugugggaagaaauccacaaaaggaaaaugaccaauauaucuucaccggacagccauuaaauaacgaugaagaucacgcucacuggacagaagcuaagauguuauuggauaauaucaacaccccagaaggaauuaucccagcacuuuucgaaccagagagggaaaaauccgcagcaauagauggagaauacagacucaaaggugaaagucggaaaaccuuuguagaguuaaugcgaagaggagacuuaccaguuuggcucgcgcauaagguagcaucagaaggaauaaaguacacagaccgaaaaugguguuuugauggcgagagaauuaaccagauauuagaagagaauauggauguagagauauggacaaaggaaggugaacguaaaaacuugagaccgaggugguuggaugcucgcacguauagcgacccauuagcauuaaaagaauuuaaagauuucgccgccgguagaaaaucuauugcguuggaccucguaacggaaauagguagaguuccaagccaucuagcucaucggacuaggaacgcauuagacaaucucgucaugcugcauacaagugaacauggaggacgagcauaccggcaugcaguagaagaacuaccugaaacaauggaaacacuauuguuacuaggcuuaaugaucuugcuaacagguggugcaauguuauuccugauuucuggaaaaggaaucgggaaaacaaguauuggucuuauuuguguaauuguaaguagcggaaugcucuggauggcggauguuccacuacaguggauagccuccgcuaucguccuugaguucuuuaugaugguguugcuaauuccugaaccagaaaagcagagaacuccucaagauaaucaacuagcauauguuguuauuggaauccuaacgcucgcagcaauaguggcagcuaaugaaaugggguuacuugaaacgaccaagcgugaccuagguaugucuaaggaaccuggaguaguuucaccaacgucauauuuagauguugauuuacacccagcuagugcauggacuuuguacgcugucgccacgacagugaucacgccgaugcugcgacauacgauugaaaacagcacugcuaauguaucgcuagcggcaaucgccaaucaggcuguugugcucaugggacuagacaagggcuggccuauuaguaaaauggacuugggcguuccacugcuagcacuggggugcuauucacaagugaauccgcugacgcuuaccgcagccguccuacuuuuaguaacccauuacgcgaucaucggaccuggcuugcaagcuaaagcuacacgcgaagcgcagaaacgaacagcggcuggaauuaugaaaaauccaacuguagacgggauaaugacaauugaucuugacccugucauauacgacucaaaauucgagaaacaacucggccaaguuaugcuacucguucuuugugccguacaacuucuauuaaugagaacaagcugggcuuuaugugaagcacuuacucucgcuacugguccuauaacgacuuugugggagggaucgccaggcaaauuuuggaacacaacgauugcgguaagcauggcuaauauauucagagguagcuaucuggcuggugcgggccuagccuuuucaauaaugaaaaguguaggaacagguagacgagggaccggcucacagggggaaacucucggagaaaaauggaaaaagaaauugaaucaauuaucccguaaagaauuugacuuauauaaaaagucggggauaacggagguagaccgaacugaagcaaaggaagggcugaaacgaggggaaacuacucaucacgcagucaguagaggaucagcaaaacugcaaugguuuguugaaagaaauaugguuauuccagaaggccgaguaauugaucuaggguguggccggggugguuggagcuauuacugugcaggucuaaagaaaguaacggagguaagaggauacacgaaaggagggccggggcacgaggaaccuguaccaaugucuacuuauggcuggaacauagugaaauuaaugagcggcaaagaugucuuuuaucugccaccagaaaaaugcgacaccuuauuaugugauauuggugaaagcucuccuaguccuaccguagaagagucaagaacaauacgaguacuaaaaaugguagaaccaugguugaagaacaaucaauuuuguauaaaaguuuuaaaccccuauaugccaacaguuauugaacauuuagaaagacuucaacgaaaauauggagguaugcucgugagaaauccauuaagcagaaauucaacacaugaaauguauuggauaucuaaugggacuggcaacauaguaucaucaguaaauaugguauccaggcuccuauuaaaccgauucacaaugacucauaggcguccaacaauagaaaaggacguagaccuaggagcaggcaccagacaugugaaugccgaacccgaaacgccuaacauggaugucauaggggaacguauaaaaagaaucaaggaagaacauucaucgacauggcacuacgaugaugagaauccguacaaaacaugggccuaucacgguagcuaugaaguaaaagcaacuggaucagccaguucgaugauaaauggggugguaaagcugcuaacaaaaccgugggacguagucccuauggucacacaaauggcgaugacagacacuacaccauuugggcagcaaagaguuuucaaggaaaaaguagacaccaggacuccgcgaccaaugccaggcacgagaaagguaauggagaucacagcggaauggcuguggagaacauuaggaagaaauaaaaagccucgucuauguacccgagaagaauuuacuaagaaaguucguacgaaugcggcuaugggggcuguuuuuacggaagaaaaucaaugggacagcgcccgcgcagcaguggaagacgaagaauuuuggaaacuuguugaucgagagagggaauuacauaaguuggggaaauguggaucauguguauacaacaugaugggaaaacgagagaagaaauuaggagaauuugguaaggcgaaaggauccagagcaauuugguauauguggcuuggagcaagauauuuagaauuugaggccuugggauuccugaacgaagaucacugguuuucucgugagaacucauauaguggggucgagggggagggccuccacaaauuagguuacauccuccgugacauaucaaagauuccaggaggagcgauguacgcggaugauacagcagguugggauacaagaauaacugaagaugaucuccauaacgaagagaaaauuacgcagcaaauggacccagagcaccgacaauuggccagugcuauuuucaaacuuacauaucaaaauaaagucgugaaaguacaaaggccaacuccaaaaggaacuguuauggauauuaucucucgcaaagaucaacguggaaguggacaaguuggcaccuauggccuuaacaccuucacaaauauggaagcacaauuagucaggcagauggagggagaagggguccucucaaaggcagaucuggagaacccccacuuacuugagaagaaaauaacucagugguuagaaacuaagggugucgaacgauuaaaaaggauggcuauaagcggugacgacugcgugguuaaaccaauugaugaccguuuugcaaacgccuuguuagcccucaacgauaugggcaaaguaagaaaggauauaccgcaguggcaaccaagcaaaggauggcacgauuggcaacagguuccauuuuguagucaccauuuucaugaacucauaaugaaagacgggagaaaauuagucgugcccugucgaccucaagaugaacuaauaggcagagccagaaucagccaaggagcaggauggucuuugaaagaaacugcuugccucggaaaagcguacgcgcagauguggucacuuauguauuuccauagacgugaccucagacuagcaagcaaugcgauuugcuccgcagugccaguacacuggguaccaacaagccguacaacguggucaauacaugcgcaccaccaauggaugacaacagaagacauguugacaguauggaauagaguguggaucgaagauaauccuuggauggaagacaaaacuccuguuacgaccugggaagaugucccauauuuaggaaaacgagaagaucaauggugcgggucauuaaucggucuuacuucccgugcgacaugggcacaaaacauuuuaacugcgauccaacaaguuagaucucuuauaggagaugaggaguuccuagacuauaugccuagcaugaagagguuuagaaaagaggaagaaucggaaggagcaauuugguga

SEQ ID NO: 23573 - RNA, 9873 nt, Artificial Sequence
  derived and/or modified CDS sequence (opt6) from DENV-3__DQ675528__SS-prME
acauccuucuguuuaaugaugaugcuaccggcuacacuugcguuccauuuaacuucacgagauggagagccgagaaugauugugggcaagaaugaaaggggcaaaucgcuuuuauucaaaacagcaaguggaauuaacauguguacuuugauagcgauggauuuaggagagaugugugaugacacaguaaccuauaaaugucccuuaaucgccgagguugaaccagaagauaucgacugcugguguaacuuaacaaguacauggguaaccuaugggacaugcaaccaagcaggagaacauagacgagacaagcguuccguugcuuuagcaccccacguagggaugggcuuagauacaagaacucaaacguggaugagcgcagaaggggcuuggcgacaaguagaaaaaguugagacaugggcauugagacauccaggauuuacaauacucgcauuauuccuagcucacuauauuggaaccucucugacccaaaaaguaguaauuuuuauccuacuaaugcuaguaaccccuaguaugacaaugaggugcguaggaguaggcaaucgugauuucguagagggauuaucaggggccacuugggucgacgugguauuggagcauggcggcugugugacaaccauggcaaaaaacaaacccacucuagacauagagcuucaaaagacagaagcuacccaacuagcgacgcucagaaaguuguguauagaggguaaaauaacgaacaucacaacagauucaaggugucccacccaaggagaggccauucugcccgaagagcaagaucaaaauuauguauguaaacauaccuauguugaccgagguugggguaacgggugcggguuguuugggaaggggagucuagucacuugugcaaaguuucaaugucuugagcccauagaggggaaaguuguacaauaugaaaauuuaaaauacacuguaauuauaacuguucauaccggggaccaacaccaaguagguaacgauacccaagguguuacugucgaaauuacuccacaagccaguaccgucgaagcgguacuccccgaauacggaacacuggguuuagaaugcuccccgcgaacagguuuagacuuuaaugaaaugauacuucuaacaaugaaaaauaaggccuggaugguucaucgacagugguucuuugaucugccucuuccauggacaucuggagcaacaacugaaacuccaaccuggaaucgaaaggagcuacuggugacuuuuaaaaaugcgcacgcuaagaaacaagaaguagugguauuaggaucucaagaaggagccaugcacacaguauugaccggcgcuacagaaauucaaaauucgggggguaccagcauuuucgcuggucauuuaaagugucgauuaaaaauggacaaacuggaguuaaaaggaaugaguuaugcaauguguuuaaauacauucguacuaaagaaagaagucucugaaacucaacacggaacgauauuaaucaaagucgaauauaagggugaagaugccccauguaagauaccguucucaacugaggauggccaaggcaaagcacauaauggccgucucauuacugcaaauccaguagucacuaaaaaagaagaaccaguaaacaucgaggcugaaccuccuuuuggggaaucaaauaucguaauaggaaucggagacaaagcauuaaaaauaaacugguauaagaaaggaucauccauuggcaaaauguucgaagcgaccgcacggggagcuagaaggauggcaauacucggugauacugcaugggauuuugggaguguuggugggguacuaaauucuuuggguaaaaugguucaccaaauuuuuggaucugcuuacacagcgcucuuuaguggaguaaguuggaucaugaaaaucgggauaggaguacuauuaacguggauaggucugaacaguaaaaauacaucuauguccuuuucaugcauagucaucggcauaaucacuuuauaucugggagcuguaguacaagcugacauggguugcgucauaaacuggaaaggaaaagaguuaaagugcggcucggguauauucguaacuaaugaaguucauacauggacagaacaauacaaguuucaggcagacucuccaaaaagacuagcaacugccauagccggagcaugggaaaacggaguaugcggcauaagaaguacgacccgaauggaaaaucuauuguggaaacaaauugcaaaugaacuaaacuacauauuaugggaaaauaauaucaaacuaacaguaguaguuggugauauuauugguguguuagaacaagguaaacggacacuuacaccacaaccaauggaauugaaauacucguggaaaacguggggaaaagccaagaucguaaccgcugaaauacaaaauucuucuuucauaauagacgguccaaacacaccggagugucccagcgcaaguagagcauggaauguaugggaaguagaagauuacggcuucggaguuuuuacaaccaacaucuggcucaaauuacgugaaauguacacgcaauccugcgaucacagauuaaugagugccgcaauaaaggacgaacgagccguacaugccgacaugggguauuggauagaaagucaaaaaaacgguucguggaaacuagagaaggcuaguuuuauagaaguaaaaacauguacauggccuaaaagucacacucuauggucgaacgggguauuagaaagugauaugauaauaccuaaaucauuagcuggcccaauuagucagcauaaucauagaccaggcuaucauacccagaccgccggucccuggcacuuaggaaaauuggaacuggauuuuaacuacugcgagggcacuacgguugucauuacagagaauugcgguaccagaggacccucacuacggacuaccacuguaaguggaaaauuaauccacgagugguguuguagaucaugcacguugccaccucucagguacaugggggaagauggauguugguaugggauggaaauaagaccaauaaaugaaaaggaagaaaauaugguaaaaucccugguaagugcagguagcgguaaggucgauaacuucacaaugggaguacucuguuuggcuaucuuauucgaggaagucaugagagguaaauucggaaaaaaacauaugauaguaggaguccuauuuacguucguucucuuauuaucgggucaaauuacguggagagauauggcccauacguuaaucaugauuggaaguaaugcgagcgaccgaaugggaaugggaguaacuuaucuagcuuugauagcaacguuuaagauucaaccauuccuagccuuagguuucuuccuaagaaaguuaaccucacgggagaaucuacuauuagguguaggauuagcgauggcaaccacucuacagcuccccgaggauauagaacaaauggccaauggaaucgcuuuaggauuaaugacucuaaaauuaaucacacaauuugaaaccuaccaacuauggacugcuuuggucucccugacauguucuaauacaauauuuacccugacgguugcguggcgaacagccacauuaauacuagcaggaguauccuuauugccauuaugccaaucaaguucaaugagaaagacagacuggcucccgaugacaguagccgcuaugggaguuccgccauuaccacuauucauuuuuucgcugaaagacaccccgaaaagacgcucauggccauugaaugaaggaguuauggcaguaggacugguaaguauacuagcuuccagucuauugcggaacgacguaccuauggccggaccucuuguagccggaggguuacuaauagcaugcuauguaaucacaggaaccucagcggauuuaacuguugaaaaggcggcugauguuaccugggaggaagaggcugaacaaacuggaguuagucauaauuuaaugaucaccguagacgaugauggaacaaugagaauaaaagaugaugagacugagaauauacuaacuguauuauuaaaaaccgcguuauugauaguuagcggaaucuuuccuuacagcauuccagccacacuauuaguguggcacacauggcagaaacaaacacaaagaucgggcguacugugggacguacccagcccaccugagacacaaaaagcagaacucgaggaaggaguauaccgaauaaaacagcaaggaauuuucggaaaaacacaaguaggcguugguguucaaaaagaagguguuuuccauacuauguggcauguuacaagaggcgcagucuugacgcauaauggaaagagacuugagccaaacugggcaagugucaaaaaagaucucauaucauauggugguggguggagacuauccgcacaauggcaaaaaggagaagaaguacaaguuauugcggucgagccuggaaaaaauccuaagaacuuccagacaaugcccgguaucuuccaaacaacuacuggagaaauaggugcuauagcuuuagacuucaaaccaggcacaucgggcagcccuauuauuaauagagaaggaaaaguagucgggcuauauggaaacgguguagugacuaagaacgguggauacguuucaggaauugcgcaaacaaaugcagagccugaugguccaacaccagaacuugaagaagaaauguuuaaaaaaaggaaucuuaccauaauggaucuucauccuggaucuggaaaaacacgcaaguauuuacccgcuauuguucgcgaagcuauaaaacgcagauugcguacauuaauccucgcccccaccagaguuguggcagcagagauggaagaagcgcugaaaggauugccgauuagauaccaaacuacugcgacgaaaucagaacauacaggcagggaaauaguggaucuaaugugccacgcgaccuuuaccaugcgguuacugagccccguuagagugccuaauuauaaucuaauaauaauggacgaggcacauuuuacagauccugcuaguauugcugcacguggauauaucagcacacgaguaggcaugggugaagccgcggcgauuuuuaugacggcgacaccgccugguaccgcagaagccuucccucaaucuaacgccccaauucaagacgaagaaagagacaucccugaacgaucauggaacucaggaaaugaauggauuacggauuucguaggcaaaacuguuugguuuguaccuucgauaaaagcaggcaaugauaucgcaaacuguuuacgaaaaaacggcaagaaaguaauacaauuaagucgaaagacuuuugauacagaauaucaaaaaacaagacuaaacgacugggacuuugugguuacaaccgauaucucugaaaugggggcaaauuuuaaagcagaucguguaauugacccccgaaggugcuuaaaaccuguaauccugacagaugguccagaaagagucauacuggcaggucccaugccuguaacagcagcuuccgcggcacaaaggcguggccgaguagggaggaacccgcaaaaggaaaacgaccaguauaucuucacuggucaaccacuaaauaacgacgaagaccaugcacauuggacagaagcuaagaugcuucuagauaacauuaauacuccugaaggcauaaucccggcacuuuucgagcccgaacgagaaaaaucagcggcaauugacggcgaauaccgacuaaagggugaaucuagaaaaacauuuguugaguuaaugcggcgaggagaucuaccuguaugguuagcacauaaaguugcaucagaagggauaaaauauacugacaggaaaugguguuucgacggugaacgaaacaaccaaauauuggaagagaauauggaugucgaaaucuggaccaaggagggagaaagaaaaaaacuaagaccaaggugguuggaugcgaggacauauucugacccgcuagcucuaaaggaauuuaaggacuuugcagcgggaagaaaaucgauugcacucgaucuggugaccgaaaucgguaggguuccgucacaucuugcacaccggacccggaaugcacuagauaaucuuguuaugcuacauaccucggagcacggcggucgagcuuauaggcacgcuguagaagagcuacccgaaaccauggaaacccugcuucuacuaggacugaugauccugcugacugguggagcuaugcuauuccugauuucagggaaagggauagguaaaacgucaauuggauuaauaugcguaauuguaagcucgggcauguuguggauggccgaugugccuuugcaauggauagccucagcaauugucuuagaauuuuucaugaugguauuacuuauuccagagccagaaaaacaaagaacaccacaagauaaccaacuugccuauguaguaaucgguauacuaacacucgcagcuaucguagcagcaaacgaaaugggucuauuagaaacuacaaaaagggaucuugguauguccaaagaacccgguguugucucaccaacgaguuauuuagacguugaccuccauccggccucagcuuggacgcuguaugcgguugcgacaacagugauuacaccuauguugcggcacaccauagaaaauucaacagcuaacgucucacuugcggcaauagcuaaucaggcugugguccuaaugggucuagauaaaggauggccaaucucuaaaauggauuuagggguaccauugcuugcacuaggcuguuacagucaagucaauccccuaacacuaacugcugcaguauuacuacucguaacacauuacgccauaauaggcccagguuugcaagcuaaggcaaccagggaagcccaaaaacgaacagccgcggguauaaugaaaaauccuacaguagauggaauaaugaccauugaucuggauccaguuauauaugacagcaaauuugaaaagcaauuaggacaaguaaugcuacuaguguuaugcgcuguacaacuucuacuuaugagaacaucaugggcuuuaugugaggcacuuacccuugcgacggggccuauaacaacacuaugggaagggucuccaggaaaauuuuggaacaccacgauugcuguuucuauggcgaauauauuucguggaucauacuuggcaggagcaggcuuagcauucucuauuaugaaauccgugggaacugggcgaagagguacuggaucccagggugagacacuaggagaaaaauggaaaaaaaaguugaaccaacucaguaggaaagaguuugaccuauauaaaaagucugguauuacugaaguggauagaacagaagcaaaagaaggcuugaaacggggagaaacgacucaccacgcagucagcagaggaagcgcaaaacuacaaugguucguugagagaaacauggucauaccagaaggacgagugauagacuuagggugcgguagagguggguggagcuacuacugcgcgggucuaaagaaaguuacggagguucgugguuauacaaaaggaggucccggacaugaagagccugugccaaugucaacuuauggguggaauauaguaaaacuuaugucagggaaggacguauuuuaucucccgccagagaaaugcgacacacuacucugcgauauaggagagucgucacccucaccaaccgucgaagaaagccguacaauacgcguccuaaaaauggucgaaccguggcucaagaauaaccaauuuuguauuaaggucuuaaacccauacaugccaacugugauugaacauuuggagagacuucaaagaaaauauggaggaauguugguacgcaauccacucuccagaaacaguacgcacgaaauguauuggauuaguaauggaacaggcaacaucguuaguagcguaaauaugguaagccggcuauuauugaauagguucacaaugacacauagaagaccgaccauagaaaaagauguagauuuaggugcugguacucgccacgugaacgcagagccugaaacaccuaauauggauguuauaggugaaaggauaaaaagaauuaaggaagaacacaguucgacauggcauuaugaugaugaaaauccuuacaaaacaugggcuuaucacggaaguuaugaagugaaggcgacggguucagccaguucuaugauaaacggggugguaaaacuucuaacgaaaccaugggacguggugccgaugguaacucaaauggcaaugacugacacaacaccuuucggucaacaacgcguauucaaagagaaagucgauacaagaaccccgcgaccgaugcccgguacgagaaagguaauggaaauaacagcggaauggcuauggcggacguuaggucggaauaagaaaccgagauuaugcacacgugaggaauuuacuaaaaaagugagaacaaaugcagcaaugggagcgguauuuacagaagaaaaucagugggauagcgcaagggcugccguggaagaugaagaauucuggaaauuagucgauagagagagggagcuacauaaacucggaaaaugcgguucuugcguauacaacaugaugggcaaaagagaaaagaaguuaggugaguuuggaaaagcaaaaggaagucgagcuauuugguacauguggcuaggcgccagauaucuagaguuugaagcacuaggauuucuuaaugaagaucacugguucucgagggaaaacucuuacucaggcguggaaggagaaggauugcauaaguuagguuauauauuaagagauaucaguaaaauuccaggaggggcaauguacgcagacgauaccgcagguugggacacaaggauaacagaggaugauuuacacaacgaagaaaagauaacacaacagauggauccggaacaccgucaacuugcuucugcaauuuucaaacuaaccuaccaaaacaaaguuguuaaaguacaacguccaacuccaaagggaacaguaauggauauuauaucacgaaaagaccagagaggaucaggucaaguugguacauacggguuaaacacauucaccaacauggaggcacaacugguaagacaaauggaaggagaaggcguauuaucuaaagccgauuuagaaaacccacaucuucuagagaaaaagauaacccaguggcuagagacgaaaggaguagaacgacuaaagagaauggccauuucaggcgacgauuguguaguuaagccuauugacgaccgguuugcaaaugcuuuacuagcauuaaaugacaugggaaaaguaaggaaagauaucccucaauggcaaccauccaaaggauggcaugauuggcaacagguaccauuuuguucucaucacuuucaugaauuaauaaugaaggauggccgcaaauuaguggucccuugcaggccucaagacgaacuuaucggccgcgccagaauuagucaaggugcugguuggucccuuaaagaaacggcgugcuuaggcaaggcauacgcacaaauguggucgcuaauguauuuucauagaagggauuuacgauuagcgucaaaugcaauuuguagcgcgguaccaguccauugggugccaacaucacgaaccacauggucaauacaugcacaccaucaauggaugacaacggaagauaugcuuacuguuuggaacagaguauggauagaagauaaucccuggauggaagauaagacuccagugaccacaugggaagaugucccguaccucggaaaaagagaagaccaaugguguggcagucuaaucggauuaacaagcagggcuacaugggcgcaaaacauucuuacggcaauacaacaaguaagaucauuaauaggagaugaagaguuucucgacuacaugccaaguaugaaacgauuuaggaaagaagaagaguccgaaggugcuauaugguag

SEQ ID NO: 23574 - RNA, 9873 nt, Artificial Sequence
  derived and/or modified CDS sequence (opt6) from DENV-3__DQ675530__SS-prME
acaucuuuuugccuaaugaugauguuaccggcaacauuagcauuucauuuaaccucaagagauggagaaccaagaaugauuguugguaaaaaugaaagaggaaaaagucuacuauuuaaaaccgcaucuggcauaaauaugugcacauuaauagcuauggacuuaggggaaaugugcgacgacacaguaacguauaaaugcccgcuaauugcugaagucgaaccagaagauauagauugcuggugcaaucuaaccaguacgugggugacuuauggcacauguaaucaagcaggggaacaucggcgcgacaaaaggucgguagcguuagcaccucacguaggcaugggccuugacacuaggacacaaacuuggaugucggcggaaggggcauggcgucaagucgaaaaaguggaaacuugggcauugagacaccccggguuuacgauuuuagcucuauuucuagcucauuauauaggaacuucaccuacacaaaaaguagugauuuuuauuuuguugauguugguaacaccaucuaugacgaugaggugcgucggggucgggaacagagacuucguagaaggacucaguggcgcuacguggguagacguaguauuagaacaugguggaugcgucacgacaauggccaaaaauaaaccaaccuuagacauugaacuacagaaaacugaagcgacacaauuagcaacacuucgcaaauuaugcauagaagggaaaauaacaaacauaaccacugauucucgaugucccacgcaaggcgaggcuauccuuccugaagaacaagaucaaaacuacgugugcaaacacacguacguugauagaggcuggggcaauggcugcggauuguucgggaaaggaagccuuguaacgugcgcgaaauuucaaugucuagagcccauugaagguaaaguagugcaauaugaaaacuugaaauacacgguuaucauaacaguucauacuggagaccaacaccaaguagggaacgacacacaaggaguaacagucgaaauaaccccacaagcaaguaccguugaagccguucucccagaguauggcacuuuaggacuugaaugcaguccaagaacuggccuagacuucaaugaaaugauauuacuaacaaugaaaaacaaggcuuggaugguacauagacaaugguucuuugaucuuccacuaccauggacaaguggggcuaccacugaaacgccuaccuggaauagaaaagaauuacugguaacauuuaaaaacgcacacgccaagaaacaagaaguaguuguccucgguucucaagaaggagcaaugcacacagcacucacuggagccaccgaaauacaaaacaguggagggacaaguauauuugcgggccaucucaaaugcagacuaaaaauggacaaacucgagcuuaaaggaaugagcuacgcgaugugcuuaaauacuuuugugcucaagaaagagguaagugaaacccaacacgguacaauacuuauuaaagucgaauacaaaggugaagaugcaccaugcaaaauucccuucucaacagaagauggccagggaaaagcgcacaaugguagacucauuacagcuaacccuguaguaacaaagaaagaggaaccggugaauaucgaagccgaacccccuuuuggggaguccaauauagucauaggcauuggagauaaagcccuaaagauuaauugguacaaaaagggguccaguauugggaaaauguucgaagcaacagcgcguggcgcaagacgaauggcaauacuaggggauacugcaugggauuuuggaagugugggaggaguucuaaauagucuaggcaagauggugcaccaaauauuugggucagcauacacggcuuuauucagugggguaucauggauaaugaaaauagggaucgguguauuguugaccuggauuggauuaaacagcaaaaauacuuccaugucuuuuucauguauugugauagguauaauaacacuauauuugggcgcuguuguccaggcagauaugggaugcguuauaaacuggaaaggaaaggaauuaaaaugcggcagugggauuuucguaacuaacgaaguccauaccuggacagaacaauauaaauuccaagccgauagucccaaaagguuggcuacugccauugccggugcaugggaaaaugguguuugugguauacggucaacaacaaggauggaaaacuuauuauggaaacagauagcaaacgaauugaacuacauucuaugggagaacaauaucaaacuaacuguagucguuggggacaucauagggguccuugaacaggguaaaaggacauuaacuccccaacccauggaacuaaaauacucauggaaaacaugggggaaggcuaaaauuguaacugccgaaauacagaacaguucauucaucaucgaugguccaaauacgccagaauguccgagugcuucuagggccuggaaugucugggaaguagaggacuacggcuucggaguauuuacgacuaauaucuggcugaaauuaagggaaauguauacucagucgugugaccauagacugaugucagcugcaauuaaagaugaaagggccguucaugcugauauggguuacuggauagaaucacaaaagaacgggaguuggaaacucgaaaaagcuaguuucauugagguuaaaacuuguacuuggccuaaaagucauacauuauggucuaacgggguccuugaaucugauaugauaauuccuaagagucuugcgggaccaauaagucaacacaaccaucgaccaggcuaucauacucaaacagcaggaccuuggcaccuaggaaaacuugaguuggauuuuaacuacugugaagguacgacuguugugauuacugaaaauugcgguacucgagguccuucguuaaggaccacaacuguaagcggcaaauugauacacgaaugguguugccgaagcuguacacucccaccauugagauauaugggggaggauggauguugguacggaauggaaaucagaccuaucaaugaaaaagaagaaaauauggucaaaucacuuguaagcgccggaagugguaaggucgauaacuuuacuauggggguacuuuguuuagcuauccuuuuugaagaaguaaugagaggaaaauuugggaaaaagcauaugauaguaggcguguuauucaccuucguguuauugcugucaggacaaauuaccuggcgcgauauggcacauacauugauaaugauaggaucuaaugcauccgaccgaauggguauggguguaacauauuuagcauuaauugcuacguuuaagauucaaccguuccuagcccuaggauucuuccuacguaaauuaacaagucgggagaaucuuuugcucggagugggauuagccauggcaacaacauuacaacuaccggaagauauugaacaaauggcaaauggaauagcacuaggacuaaugacccuaaaacuaauuacacaauuugagacauaucaauuauggacugcgcuaguaucacuaaccuguucaaauacuauuuuuacauugaccguggcauggagaacagccacacuaauucuagcgggaguaucacuuuuaccauugugucaaucaagcucaaugcgaaaaacggauugguuaccaaugacgguagcggcaaugggagucccaccuuuaccauuguucauauuuucguuaaaagacacacccaagcgacgaagcuggccacuuaacgagggugugauggcaguagggcuaguaucaaucuuagcuucaagccuauuaagaaacgauguucccauggcugggccguuggucgcaggaggucuacuaauugcgugcuacgucauuacugguaccucggccgacuuaacagucgagaaggccgcugacguaacuugggaagaggaagcggaacaaacagguguuucacacaauuuaaugauaacaguagaugacgaugggaccaugcgaauaaaagacgacgagacagagaauaucuugacugucuuacucaagacagcccuauuaaucguaagcggaauauuuccuuauucgauuccagcaacauuauugguuuggcauacguggcagaaacaaacgcagagaaguggaguuuuaugggacgugcccucaccaccugagacucaaaaagcagaguuagaagaagguguguauagaauaaagcaacaaggaauuuucgggaaaacacaaguggguguuggaguacagaaggaggggguauuucauaccauguggcauguaacccgaggggcuguauuaacucauaaugguaaaagguuggaaccaaacugggcaagugucaagaaagauuuaauuucguauggagguggauggcgacuauccgcacaguggcaaaaaggagaggaaguucaaguaauagcggucgaaccaggcaaaaaucccaaaaauuuucaaacaaugccaggaauuuuccaaacuacgaccggagaaauaggagccauagcacucgacuuuaagccgggaacaucaggcucaccaaucauuaaccgggagggaaaagugguaggacuauauggaaaugguguuguaacuaaaaacggaggguacguaaguggaauagcacaaacuaaugcagaaccagacgggccaacuccugaauuagaagaagaaauguuuaagaaaagaaauuuaacaauaauggaccuucauccugggagcggaaagacccguaaguacuuaccugcaauugugcgugaagcgauaaaaagaagacuccgcacacuaauauuagcaccaacuagagucguugccgcggaaauggaagaggcuuuaaaaggucuucccauacgguaucaaaccacugcaacaaagagugaacauacugggcgagaaauaguugaccuaaugugucaugcgacuuuuacuaugcguuugcuuucuccugucaggguaccaaauuacaaccuaauuaucauggacgaggcucacuucacagauccugcaucaauugcugcaagagguuauauaagcaccagaguagguaugggugaagcagcugcgauuuucaugacggccacucccccggguacagccgaagcauucccacaaucgaacgccccaauacaggacgaagaacgugauauacccgaacgaaguuggaacucaggaaaugaauggauaacugauuuuguagggaaaaccguaugguucguaccauccaucaaagcugguaacgacauagcaaauugucugaggaaaaauggaaagaaaguuauacaauuaucuaggaaaacuuuugauacagaauaucagaaaacacgauuaaaugauugggacuuuguggugaccacugauaucucugaaaugggugcgaauuuuaaagcggacagagucauugauccucgcagaugcuuaaaaccggugauccuaacugaugggccugagagaguaauauuagccggcccuaugccgguaacagcagcaucugccgcucaaagaagaggcaggguugguagaaauccucagaaagagaaugaccaauauaucuucacaggccagccucuaaacaaugacgaggaucaugcgcauuggacugaagcaaaaaugcuacuugacaauaucaacacgccggaaggcauaauuccagcacucuucgaacccgaacgagagaaaagugcagcgauagauggugaguauagauuaaaaggugagagucggaaaacauuuguagaauuaaugcgccgaggagaccucccaguaugguuagcucauaagguagccucagaaggaauaaaauauacggauagaaaaugguguuuugacggcgaacgaaacaaucagauuuuggaagagaauauggaugucgaaauuuggacaaaggaaggggaacgaaagaaacuacgaccuagauggcucgacgcuaggaccuauagcgauccccuagcauuaaaagaguucaaagauuuugccgcuggucgaaaaucuauagcauuggaccucguuaccgaaauuggaagagugccgucucauuuagcucacagaacuagaaaugcuuuagacaauuuaguuaugcuacauacguccgaacauggagggagagcuuauagacacgcuguggaggaacucccugaaacaauggagacuuuauugcuauuaggccucaugauauugcuaacaggaggggcaaugcuuuuucuaauaagcggaaaagggauugggaaaaccucaauugguuugauauguguuauugucucuagcggaauguuguggauggcagauguuccacuacaauggauagcaucggcgaucguucuggaguucuuuaugaugguauuacuaauaccagagccugaaaagcaaagaacgccccaagauaaucaguuagcauaugucguaauagguauauugacguuagcagcaauuguugcugcgaacgaaaugggccuacuugaaacaacaaaacgugauuuaggaaugagcaaagagccaggugucguaucacccacuuccuaccuugacguagauuugcauccagcuucugcguggacuuuguaugcaguagccacuacugucauuacaccuauguuacgucauacaaucgaaaauucaacugcgaauguuucucucgcagcaauagcaaaucaagcuguaguauuaaugggguuagauaaggguuggccgauaagcaaaauggauuuaggcguaccucuucuagcucuugggugcuauagucagguuaacccuuuaacuuuaacggcugcaguuuugcuacuuguaacacacuaugcaauaauuggccccggacuccaggcaaaggcaacgcgcgaagcacagaaaagaacggcagcaggaauuaugaagaacccuacuguagacggcauuaugacaauugauuuagauccagugauauacgacaguaaauucgagaagcaauuaggacaggucaugcuacucguauugugcgcuguucaacuacucuuaaugaggacgagcugggccuuaugugaagcacuaacauuggcaacuggcccgauuacgacacuaugggaggguagcccagguaaguuuuggaauacuaccauagcgguuaguauggcgaauauuuuccgaggaaguuaccuugcaggcgcugguuuagccuucaguaucaugaaaaguguaggcacggguagacgaggcacaggaagucaaggcgaaacacuuggagagaaguggaagaagaaacuaaaucaauuaucucgaaaagaauuugaccuuuacaagaaaaguggaauaacggaaguagacagaacugaagcuaaagaaggguugaaacgcggggagacuacgcaccaugcaguaucuagaggguccgcgaaauuacaaugguucguagagaggaauauggugauccccgagggccgaguaauagaccuagguuguggacgggguggauggaguuacuacugugccggguugaagaaaguuacagaaguucguggauacacaaaaggaggaccuggacaugaagaaccagugcccaugagcacuuacggauggaauauugucaaauuaaugucaggcaaagauguauucuaucucccgccugaaaaaugugacacucuacucugugacauaggugagucgagcccaucaccaacugucgaagaaucaagaacuauaagaguguuaaaaaugguggaaccauggcucaaaaauaaucaguuuugcauuaaaguacuuaauccauacaugccgacggugauagaacaucuugaaagauuacagcgaaaauauggaggaaugcuuguaagaaauccauuaucacgcaacaguacccacgagauguauuggauuaguaacgguacaggcaacauaguaaguagcgugaacauggucagucggcuuuuacuaaacagguuuacaaugacgcauagaagaccaacuauagaaaaggacgucgaccugggagcuggcacaagacacguaaaugcugagccugaaacaccaaauauggacguuauaggagagcgcauuaagaggaucaaagaagaacacaguagcaccuggcauuaugacgaugagaacccuuacaaaacaugggcuuaucaugguaguuacgagguuaaagcuacugguagugccucgucuaugauuaacgggguaguuaaguuauuaacgaagccuugggauguaguuccaaugguuacgcaaauggcaaugacagauacuacaccauuuggacagcaaagaguauucaaagaaaagguggauacaagaacuccgcgacccaugccagggacgaggaaaguuauggagauaacagcagaguggcuauggcgaacauuaggucguaauaagaaaccuagacuuuguacaagggaagaauuuaccaagaaaguuagaacaaaugccgcuaugggagcaguuuuuacggaggaaaaucaaugggacagugcaagagcggcuguagaagaugaagaauuuuggaagcuaguugauagagagcgagaacuacauaaacuugguaagugugggaguuguguguauaauaugaugggaaaacgagagaagaaauuaggggaauuugguaaggcaaaagguucccgagcuauuugguauauguggcugggugcccgcuauuuagaauuugaagcccuaggauucuugaaugaagaccacugguucucacgagaaaauaguuacucuggagucgagggagaaggguuacauaaauuaggauauauacuucgugacaucucaaaaauacccgguggcgccauguaugcggaugacacugcaggcugggacacacguauaacggaggacgauuugcacaacgaagagaaaauuacacaacaaauggauccagaacaucgacaacuggccucagcuauauuuaaguuaacauaucagaauaaaguuguaaaaguacagcguccaacgcccaaagguacggucauggacauaauuucgagaaaagaucaacguggcagugggcaaguuggaacauauggccugaacacuuuuacaaauauggaagcucagcuaguacgacaaauggaaggggaagguguacuaucaaaagcagaucuagaaaauccgcaccuauuagaaaagaaaauuacucaaugguuggaaacaaaagggguugaaaggcucaaaaggauggcaauuucaggagaugacuguguagucaaaccaaucgacgauagauucgcuaaugcacugcuagcguuaaaugauaugggaaagguaaggaaagauauaccucaauggcagccaaguaaaggauggcacgacuggcaacaaguacccuucugcucgcaccauuuucaugaauugauaaugaaagaugggcggaaacuuguagucccaugccgaccgcaagacgaacuuauagguagagcuaggauuucgcagggugcuggcuggagccuuaaagaaacagcuuguuuggguaaggcuuacgcacaaauguggagucuaauguauuuccaccguagagacuuacgacuagcuucgaaugcuaucuguagugcuguaccuguacauuggguuccuacgucgagaacaacaugguccauacacgcacaucaucaauggaugacgacagaggauaugcugacaguauggaaccgaguguggauugaggauaauccuuggauggaggauaaaacuccaguaacuacuugggaagaugugccuuaccuuggcaaaagagaagaccaaugguguggaucacuuauagguuuaacaagccgagcuacaugggcucaaaacauuuugacugcgauucaacagguccguaguuuaauaggagacgaggaguucuuagauuacaugccaucuaugaaaagguucagaaaggaagaagagagcgagggggcuauaugguag

SEQ ID NO: 23575 - RNA, 9873 nt, Artificial Sequence
  derived and/or modified CDS sequence (opt6) from DENV-3__DQ675533__SS-prME
acuagccuaugcuuaaugaugauuuuaccagcagcauuagcuuuucauuuaacaucuagggauggugaaccccgaaugauuguagggaaaaacgaaagagggaaaaguuuauuauuuaaaaccgcaagcgggauuaauauguguacccugauugcaauggauuuaggggaaaugugcgaugacaccguaacuuauaaaugcccccauauaacggaaguugaacccgaagauauugauuguugguguaauuuaacuucuacuuggguaacuuauggaaccuguaaucaagcaggagaacaucgaagagauaaaagaagcguggcucuugcgccgcauguaggaaugggauuagauacacggacucaaacauggaugucugcagaaggggcuuggcggcaaguagagaaaguagaaacuugggccuuacgacauccagguuuuacuauccuagcuuuauuucuugcccacuauauugggacgucgcuuacacaaaaagucguaauauuuauacuuuuaaugcuagugacaccaagcaugaccaugcgcuguguagggguagggaauagagauuuuguagagggacucucgggcgcuacauggguagauguuguauuagaacaugggggaugugucacaacuauggccaaaaauaaaccuacucuugacauagaguugcagaaaacagaagccacacaacuagcaacucuucguaaacucuguauagaggguaaaaucacaaauauuacuacugacucaagauguccaacucagggugaagcuguuuuaccugaggaacaagaucaaaauuauguuugcaaacauaccuacguagaccgggguuggggaaacgguuguggucuuuuugguaaaggcucauuggucacaugcgcaaaauuccaaugucuagaaccuauagaagguaaaguaguccaauaugaaaaucuaaaauacacaguuauaauaaccguucacaccggugaucaacaccaaguuggcaaugaaacacaaggaguaacagcagaaauuacaccucaagcaucaacucacgaagcucuacugccggaauacggaacguuaggauuagaaugcucuccccgcacaggcuuggauuuuaacgaaaugauccuacuaaccaugaaaaacaaagcguggaugguucaucgacaaugguuuuucgaccugccgcuccccugggccuccggagcgacuaccgagacuccaacuuggaaucgaaaggaacuccuaguaacauuuaaaaacgcucaugccaagaaacaagagguagugguuuuggggucacaggaaggggcaaugcacacggcauuaaccggagcaacugagauccaaaauucugggggaaccucaauauuugcugggcauuuaaaguguagauugaaaauggacaaguuggaacuuaaaggaaugaguuacgccauguguacaaauacauuuguccugaaaaaggaagugucggagacgcagcacgguacaauacuuaucaaaguggaauauaaaggggaagaugcaccuuguaaaaucccauuuuccacagaagacggccaaggcaaggcucacaauggacgccuaauuacugcuaaccccguggugaccaagaaagaagaaccaguaaacauugaagcagaaccaccauucggcgaaucaaauaucguaauagguauuggggauaaugcucuaaaaauaaacugguacaagaaaggcucgucuauugggaaaauguucgaggcaacagccagaggggcacgaagaauggcuaucuugggagauacagcaugggacuucgguuccguuggaggaguuuuaaauaguuuagguaaaaugguacaccaaaucuucgggagugcauauacugcacucuucucugguguauccuggguaaugaaaaucggaauaggcgugcuauugacuuggauugguuuaaacucuaaaaauacaucaaugucauuuaguuguauugcuaucggaauuauaacacucuauuuaggggcuguaguccaggcggacaugggauguguaaucaauuggaaaggaaaagaauugaaaugcggauccgggaucuuugugacaaacgagguacauaccuggacggaacaauauaaauuucaagcugauuccccaaaaagacuggcgacagcaauagcuggugcaugggaaaauggcgugugcgggauaagaucgacuacuagaauggaaaauuuguuauggaagcaaaucgcaaaugaauuaaauuauauucuuugggaaaauaacauuaaacuaacuguuguagucggagacacguuaggaguacucgaacaaggaaaaagaacauuaaccccucaaccuauggaauugaaguauucuuggaagacuuggggaaaggcaaaaauugucaccgcugaaacacagaacucuaguuuuauaauagaugguccgaauacaccugaauguccaagugcgagucgugccuggaacguaugggaaguagaggauuauggauuuggcgucuuuacuacgaacauauggcugaaauuacgcgaaguauacacucaacugugugaucaccguuuaaugucugcugcagugaaagacgaacgagcaguccaugccgauaugggcuauuggauagaaagucaaaagaaugggucauggaaacuagaaaaggcuuccuuaauagagguaaaaacguguacuuggccuaaaucgcauacuuuguggucgaauggagucuuagaaagcgacaugauuauaccgaaaucgcuagcuggacccaucucacaacacaacuaccgcccgggcuaucauacucaaacugcagggccguggcaucuaggcaaacuagaauuagauuuuaauuacugugaagguacaacaguaguaaucacugaaaguuguggaacaagaggaccgucacugagaacaacaacugugucugggaagcuaauccaugaaugguguugucggucuugcacucuuccuccacucagauacaugggagaagacggauguugguacggcauggaaauacguccaaucagugaaaaagaagaaaauauggucaaaucucuuguaucggcgggaucgggaaaaguagauaauuucacgauggguguucuuugucuagcaauucuauuugaagaaguccuaagagguaaauuuggcaagaaacauaugauagcaggaguguucuuuacguuuguuuuacuacuuucaggccaaaucacuuggcgagauauggcucacacuuuaauuaugauugguucgaaugcaucggacaggauggguauggggguaacauaccucgcauuaaucgcaacuuucaaaauccagcccuuuuuagcauugggauucuuucucaggaaacuuacgaguagggaaaaucuccuccucggugugggacuagccauggcaaccaccuugcaacuaccugaagauaucgaacaaauggcgaacggcauagcgcuagguuuaauggcucuaaaguuaauaacgcaauucgagacauaucaacuuuggacagccuuaguuagccucacauguucuaauacaauuuucacacuuacaguggcauggaggacagcaacgcuaauauuagccggugucagcuuauuaccgguaugucaaagcagcaguaugcguaaaacugacuggcuaccuaugacaguugccgccaugggaguaccacccuuaccauuacuaaucuucucccuuaaagauacgcucaagcgaaggucuuggccauuaaaugaaggugugauggcagucgggcuaguaaguauuuuagcgaguucccuacuacgaaaugacguacccauggcuggaccuuuagucgccggggguuuauuaauugcuuguuauguaauuacagggacaucugcugaucucacgguagaaaaagcagcagacguuacaugggaggaagaagcagagcaaaccggaguaagccacaauuuaaugauaacaguagacgaugacggaaccaugagaauuaaagacgacgaaaccgaaaauauacuaaccguccuauuaaaaaccgcccuauugaucguaagugggauauuucccuacagcauaccugccacgcucuugguguggcauacuuggcaaaagcaaacgcaaagaagcgguguuuuaugggauguuccaucuccgccggaaacgcagaaagcagaauuagaagaagggguauauagaaucaaacaacaaggaaucuuugggaaaacccaaguagguguaggcguccaaaaagaaggaguauuccauacaauguggcauguuacucgcggugcuguacuaacacacaauggaaagcgccuagaaccaaacugggcgaguguaaagaaggaccuuauuucuuauggaggcggguggagauuaagugcgcaauggcaaaaaggugaagagguacagguaauagcuguagagccgggaaagaacccuaaaaauuuucaaacuaugccaggaacuuuccaaacuacgacuggagaaaucggagcuauagcauuagacuucaaaccgggcaccagcggcuccccuauuauuaauagagaagggaaaguugugggauuauacggcaacggaguuguaaccaaaaacgguggguaugugaguggaauagcucagacaaacgcagagccggauggaccaacuccagaacuggaagaggagauguucaagaaaaggaaucucacaauaauggaucuccacccaggaaguggaaagacacggaaauacuuaccagcuaucgucagagaagccauuaagcgacgacuacgaacucucauacuagcucccacgagaguuguugcagcagaaauggaggaagcauuaaaagggcucccaaucagauaccaaacgacggcaacuaaaucagaacauacaggaagagaaauugucgaucuaaugugccacgccacauuuacaaugcgacuuuuaucuccgguccgaguacccaauuauaauuuaauuauaauggacgaagcgcacuucaccgacccagccaguauagcggcgcgaggcuauauaagcacccgaguuggaaugggagaagcagcagccauauuuaugacggcaacgccaccuggcacugcggaugcuuucccucaauccaaugcgccaauccaggaugaagaacgagacauaccagaacguucauggaauagcggaaacgaauggauuacagacuucgcuggaaaaacugugugguucgucccuucaauuaaagccgggaaugauaucgcgaauugccuacguaaaaacgggaaaaagguaauacaacuuucgaggaaaacguuugacacugaguaccagaaaacaaagcuaaaugacugggacuucguagucacuacggauauaagugaaaugggcgcaaauuucaaagcugauagaguaauagacccaaggagauguuuaaaaccaguuauauuaacugacggaccggaaagaguaauauuagcaggaccgaugccugucaccgcagcgucagccgcgcaacgacgcggacgaguaggucggaacccacaaaaagagaacgaucaauacauuuuuacuggucaaccgcuaaacaacgaugaagaucacgcucacuggacagaagcuaaaaugcuacuugacaacaucaauaccccugaaggcauaauuccugcacucuucgagccagaaagagaaaagagcgcggcaauagacggugaguaucgauuaaaaggcgaaagccgaaaaacuuuugucgaacuuaugagaagaggggaccuuccuguuugguuagcucacaaaguugccagugagggaauaaaguauacugaccggaaauggugcuuugacggcgaaagaaacaaccaaaucuuagaggaaaauauggauguugaaauuuggacaaaggaaggagaacguaagaaauuacgaccgagguggcuagacgcucguacauacagugacccuuuagcccucaaagaguuuaaagacuuugcagccggacgaaaaucgauagcguuggaucugguaaccgaaauuggucgaguaccgucucacuuggcacauagaacuagaaacgcccuagacaacuuagugaugcugcacacaucagagcauggaggucgagcuuacagacaugcaguugaagaauuaccugaaacuauggaaacauuauugcugcucggguuaaugauauugcugacaggaggagcuauguuguucuuaauaucuggaaaaggaauagggaaaaccagcauaggauuaaucugcguaauugcaucuucugggauguuguggauggcugaagugccauuacaguggauagcaagugcuauaguguuggaguucuuuaugaugguccuucuuaucccagaaccagaaaaacaaaggacaccacaagauaaucaauuagcuuacguuguaauagguauauuaaccuuggcggccauaaucgcugcgaaugaaaugggacuucuagaaacaacgaaacgggauuuaggaaugagcaaagaaccaggcgugguaaguccaacgucauacuuggauguugauuugcaccccgccucagcguggacauuauacgccguugcaacaacugugauaacuccuauguuaaggcauaccauugaaaauucuaccgcuaacguaucauuggcugcaauagcuaaucaagcagugguacuuaugggguuagacaaaggauggccaauuuccaaaauggaucugggaguucccuuacuugcccuuggauguuacagccagguaaauccccuaacauuaacggcggcuguauugcuauugauuacccauuacgcuauaauaggcccaggcuugcaagcgaaagcaacuagagaagcgcagaaacggacggcagccggaaucaugaagaacccaacaguagacgguaucaugacuauagaucuagacccuguuauauacgacucaaaauuugaaaaacaguugggccaaguuauguuacucguauugugugcuguucaauuacuacuuaugcguacaaguugggcauuaugcgaagccuugacacucgcgacuggaccaauuacgacucuaugggaagguucuccuggaaaguucuggaauacaacgauugcaguaucuauggcuaauauuuucagaggaaguuaccuagccggugcaggacucgccuucucuauaaugaagucaguaggcaccggaaaaagaggaacagggucacaaggggaaacacuaggugaaaaauggaagaagaaauuaaaucaguuaagccgaaaggaguuugaucucuauaagaaaucaggaauuacugaaguagacaggacugaagccaaagaaggauugaaaagaggagagacaacucaucaugccguaagccgggguucugcuaaauuacaaugguucguugaacgcaacaugguuguuccggaaggucggguaauagaucuuggaugcggcaggggcggcuggagcuauuauugcgcaggacuuaaaaaggucaccgagguacgaggauauacgaaaggagggccagggcacgaagaaccuguaccaaugucaaccuacggcuggaacauagugaaauuaaugucgggaaaagauguauucuauuuaccaccagaaaaaugcgacacucuacuaugugacauuggagagagcaguccgagucccacaguagaggaauccagaacaauacgaguccuuaagaugguggaaccuuggcuuaaaaauaaucaauuuugcaucaaaguucugaauccguacaugcccacaguaauugaacaucuagaaagacugcaacguaagcauggagggauguuaguuagaaacccguugaguagaaauuccacgcaugagauguacuggauaucaaacgguacuggaaacauaguaucaagcgucaacaugguaucacgucuauugcucaauagauuuacaaugacucaccgcaggccuaccauagaaaaagaugucgacuuaggugcaggcacaagacacgucaaugcagaacccgaaacaccaaacauggauguaauuggggaaaggauaaagagaaucaaagaagaacacaauucaaccuggcacuacgaugacgaaaacccuuauaaaacuugggcuuaccauggcagcuacgaggucaaggcuacagguucagcaucuucuaugaucaauggaguaguaaaauugcuuacuaagccaugggacguaguaccaaugguaacgcaaauggcaaugacagauacaacuccauucggacaacaaaggguauuuaaagaaaaaguagacacuaggaccccucggccaaugccagggacucgaaaggucauggaaauaacagccgaaugguuauggagaacgcugggacgcaacaaaaggccaagauuauguacgagagaggaguucaccaaaaagguaaggacaaacgcugcgaugggcgcuguguucacugaagaaaaccaaugggauucagcaaaggcugcuguagaagacgaagaguucuggaaauugguagaucgcgaaagagaacugcauaaauuagguaaaugugguucgugcguuuacaacaugaugggaaaaagggaaaagaaacuuggcgaauuuggcaaagcuaaaggaaguagagcuauuugguauauguggcugggggccagauaucuagaguucgaagccuugggcuuuuuaaacgaagaccacugguucuccagagaaaacucguauucuggaguugaaggagaaggauugcauaaauuagguuauauauuaagggacauaagcaagaucccuggaggggcaauguacgcggacgauacugcgggaugggauacacguaucacagaagaugauuuacacaaugaagagaaaauuauucaacaaauggauccagaacaucggcaacuugcaaacgcuauauuuaagcucacuuaucaaaauaaaguaguuaaagugcagcgccccacaccgacaggaacagugauggauauuaucaguagaaaagaccaacgggguaguggccaagucggaacuuacggguuaaauacuuuuacaaauauggaggcgcaauuggugcgccaaauggaaggagaaggcguguuaacaaaggcugauuuagaaaacccacaucuccucgagaagaaaauaacacagugguuagaaacaaaagguguugaaaggcuaaaaagaauggccauuaguggagaugauuguguaguaaaaccaaucgaugacagauuugcaaacgcgcuucucgcacuaaaugauaugggaaaaguucggaaagacaucccccaauggcagccaucaaaagguuggcacgauuggcaacaaguucccuucuguucucaccacuuucaugagcuuaucaugaaagauggccgaaaguuaguugugccaugucguccgcaagaugagcuuauaggcagagcucgcauaagccaaggcgcaggguggagcuuaagagagacagcuuguuugggcaaagcauaugcgcaaauguggucgcuuauguauuuccaucggcgagauuuaagacuagcaucaaacgcaauauguucugcgguuccagugcacugggugccaacaaguagaacaacuugguccauacaugcacaucaccaauggaugacgacagaggauauguuaacagucuggaacagaguauggaucgaagaaaaccccuggauggaagauaagacgcccgugaccacaugggagaacguuccuuaucuaggaaagcgcgaagaucaauggugugggucacuuauagguuuaacgaguagagccacuugggcgcagaacaucccaacagcaauacaacaaguacgaagccugauaggcaaugaagaguuuuuagacuauaugccuaguaugaaaagauuuagaaaagaagaagagucagaaggcgcaauuugguaa

SEQ ID NO: 23576 - RNA, 9873 nt, Artificial Sequence
  derived and/or modified CDS sequence (opt6) from DENV-3__AY744677__SS-prME
acaagccuuugccuaaugaugauguuaccggcaacucuugcauuccaccuaacaagcagagauggggaacccaggaugauuguaggcaaaaaugaaagagguaaaaguuuauuauucaaaacugcuagcgggauaaauaugugcacauuaauagcaauggauuuaggggaaaugugugacgacacaguuaccuauaaaugcccacuuauuacggaaguugaacccgaagauauagauuguuggugcaauuugacuuccacaugggucacauacgguacauguaaucaagcaggagaacaucgcagggauaaaagaagcguagcucuagcaccgcauguagguauggggcuugauacaagaacacaaaccuggaugagugcugaaggagcuuggagacaaguagagaaaguagaaacuugggccuuccgacauccaggguuuacaauacuagccuuauucuuggcccacuauauagguacaucuuuaacacagaaaguaguaauauucauacuacuaauguuagucacucccaguaugacaaugcguugcguagguguuggaaauagggacuuuguagaggguuugaguggugcaacauggguggacgucgucuuagaacacggaggauguguaacuacaauggccaaaaacaaaccaacguuagauauagaacuucagaaaacagaagccacacaauuggcaaccuugaggaaacuaugcauugagggcaaaauaacaaacguuacaacugauucgagguguccuacucaaggagaggcuauccugccagaagaacaagaccagaauuauguauguaaacauacauacgucgacagagguuggggaaauggaugcgguuuguuuggaaaaggaucucuagucacgugugcuaaauuucaauguuuagaaucaaucgaagguaaagcaguucaacaugaaaaucuuaaauauaccgucauuauuacuguccacacuggagaucaacaccaaguaggcaaugaaacacaaggaguuacggcagaaaucaccccucaagcuagcacugucgaagcuauucuuccggaauacgguacgcuaggucuggaauguaguccacgaacugggcuagauuuuaacgaaaugaucuuauuaaccaugaaaaacaaggcuuggaugguacauaggcaaugguuuuucgauuugcccuuaccauggacaucgggagcaacaacagagacucccacguggaauaagaaagaacuauuaguaacauucaaaaacgcccaugcuaagaaacaagaagugguuguccugggaagccaagaaggcgcaaugcauacugccuuaacuggagcgaccgaaauacagacaagugguggaacgagcauauuugccggccauuugaaauguagauugaaaauggacaaauuggaauugaaaggaaugaguuaugcgaugugcuuaaacgcuuuuguuuugaagaaagaaguaagcgagacccagcacggcacuauacuaaucaaaguagaauauaaaggugaagaugcgccaugcaaaauacccuuuucgacugaagacggccaagggaaagcgcacaauggucgauuaauuaccgcaaacccaauaguaaccaagaaagaagaaccuguaaauauagaagcggaaccuccuuuuggugaaucaaacaucguuauagguauaggcgauaaagcucuaaaaauuaacugguauaaaaagggaucuucaauaggaaaaauguucgaagcgacagcucgaggcgcacgaagaauggcuauauuaggggacacagccugggacuuuggcucaguaggaggagugcuaaauucucuaggaaaaaugguacaucagauauucggaagugcguacacagcucuauucaguggaguaaguuggauuaugaaaaucggaauaggcguacuacuuacauggaucggguuaaauuccaaaaacacaaguaugucguuuaguuguauuguaauuggcaucauaacgcuuuaucuuggagcugucguacaagcggauauggguuguguuaucaacuggaagggaaaagaauuaaaaugcggcagcggaaucuuuguaacaaacgagguacacaccuggaccgaacaauacaaguuucaagcagauucgccaaaacgauuagcaacagcgauugcuggagcuugggaaaaugguguaugugguauacggaguacaacgagaauggagaaucuacuauggaaacaaauagcgaacgaauugaauuauauccuaugggagaauaauauuaaauugacgaucguuguuggagauguaauaggaguacuagaacaggguaagcgaacccugacuccacaaccaauggaauugaaauacucguggaaaacauggggcaaagcgaaaauagugacagccgaaacacaaaauagcucauuuauaauugauggaccaaauaccccagagugccccuccgcaucgagggccuggaauguuugggaaguggaagacuaugguuucggugucuuuaccacuaauauuuggcuaaaauuacgugaaauguacacacaacuaugugaccauagauuaaugucugcggcuguaaaagaugaacgagcgguccaugcagauaugggauauuggauagagucgcagaaaaacggaucguggaaauuagaaaaagcaagccugauagaaguaaagacauguacauggccgaaaucucacacauuauggaguaacggaguucuugaaucagacaugauuauaccaaaaucauuagccgguccaaucucccaacauaauuaucgcccaggauaucacacccaaacggcagguccuuggcaucucggaaaacuugaauuggacuuuaacuacugugaaggaacgacaguaguaauuacagaaaauuguggcacccgagguccaaguuuaagaacuaccacaguuucuggaaaacuuauacacgaaugguguugcaggucaugcacguuaccuccacuuagauacaugggagaagauggcugcugguaugguauggaaaucagaccgauuaacgaaaaagaagagaauaugguuaagagucugguauccgcagguaguggaaaagcagacaacuucacaaugggaguauugugucuugccauacuauuugaagaagucaugcgcgguaaauuuggcaagaaacauaugauagcuggugcacuauucacauuuguucuacuccuaucuggacaaauaacauggcgugacauggcccauacucuaauaaugaucggaucuaacgcaucagauaggaugggaaugggaguaacauaucucgcacugauagcaacauuuaaaauccaaccuuuucuugcauugggauucuuuuugcgcaaauuaacauccagagaaaauuuacuauuaggaguugguuuagcaauggcaacaacucuucaguugccagaagauaucgaacaaauggcuaaugguauagcauuggggcucauggcauuaaaacuuauaacacaauuugagaccuaccaacuguggacagcauuaguaagccucauguguagcaacacaauuuucacucuaacgguagcauggagaacggcaacucucauucucgcagugauaagccuucuacccguuugccaaucgucaaguaugagaaaaaccgacugguuacccaugacuguagcugccaugggggugccaccccuuccauuauucaucuuuucuuugaaggauacacuaaaacgccggucuuggccacuaaaugaagguguaauggcaguuggacucguuucgauacucgcaaguucauuuuugcggaaugauguaccaauggccggaccacuuguagccggcgguuuguuaauugccuguuauguaaucacagguacaagcgccgaucucaccguagagaaggcagcggauguaacuugggaggaagaggcggaacaaacuggaguaucacauaaccuaaugaucaccguugaugaugauggaacuaugagaauuaaggacgaugagacagagaauaucuugaccguucuacucaaaacagcucuacuaaucguaucuggaauauucccauacagcauuccagcaacucucuugguauggcauacauggcaaaaacaaacgcagaggucaggaguauugugggacguuccuaguccaccggagacccaaaaagcggaauuggaagaagguguauaucguauaaaacaacagggcaucuuugguaagacacaaguuggaguuggcguccagaaggaaggaguauuucacacaauguggcaugucacgcgaggggcuguguuaacccacaacgggaaacgucuagaaccaaauugggcuaauguuaaaaaggaccuuauaaguuauggaggaggguggaaacuauccgcucaauggcaaaaaggcgaggaaguacaagucauagcagucgagccagggaagaauccgaagaacuuucagacaaugccuggcauauuucagacuaccacuggagaaauaggagccaucgcacuugauuuuaaaccaggaacaucaggaucaccaauuauuaaucgcgagggcaaaguaguaggccucuaugguaacgggguugugaccaaaaaugggggauacgucucaggcaucgcacagacgaacgcugaaccagauggaccuacuccagaacuugaagaagaaauguucaagaaacgcaauuuaacaaucauggaccuacacccuggaaguggaaaaacacgaaaguacuuaccagcgauagugagagaagcaauuaaaagaagacuuaggacccuuauacuugcaccaacuagaguuguagcagcggaaauggaagaagcacuuaaagggcuaccaauacgguaccagacaacagcgacaaaaucagagcauacagguagagaaauuguagacuuaaugugucaugccaccuucacuaugcgacucuugaguccaguacgcguucccaacuauaaucuaauaguuauggaugaagcacacuuuacagauccagcaagcauugcggcaagagguuauauuucaacacgggucgguaugggugaggcagccgcaauuuuuaugacagcaaccccgccaggaacugcugaugcauuuccccaaaguaaugccccaauccaagaugaagaaagagacauaccggaaagguccuggaauaguggaaacgaguggauaacggauuuugcuggaaagacaguaugguuuguaccaagcaucaaagccggaaaugauauugccaauugucuacggaaaaaugguaagaaaguaauacagcucucuagaaagacauuugacacugaguaucagaagacgaaauugaaugauugggauuuuguagucacaaccgauauaucggaaaugggagcaaauuuuaaggcugauagaguuauagauccaagacgcugccuaaaaccgguaauacuaacagacggcccugaacguguaauauuagcaggacccaugccaguuacugucgcaucugccgcgcaaagacguggccgugucggacgaaauccccaaaaagaaaaugaucaauacauuuuuacagggcaaccacuuaacaaugacgaagaucaugcucacuggacagaggccaaaauguuacucgauaacauaaauacaccagagggaauuaucccggcccuauuugaaccagaaagagagaaaucagcagcaaucgacggugaguaccgacuuaaaggagaaaguaggaagacauucguugaauugaugcgaaggggugauuuaccgguuuggcuagcacauaaaguugcaucggaaggaauaaaauauacagaccgaaagugguguuuugacggagaaaggaacaaccaaauucuggaagaaaauauggacguagagauuuggacuaaagagggagagaagaagaaauugcgaccacgauggcuagaugcaaggacguacucagacccauuagcuuuaaaagaauuuaaagauuucgcugcagggaggaaauccaucgcgcuggauuuagucaccgagauaggacgaguaccaagccauuuggcacaccgaaccagaaacgcguuagauaaccuagugaugcuccauacgagugaacauggaggucgagcauauagacaugccguugaagaauugccagagaccauggaaacgcuauuguuauuagggcucaugauccuauuaaccggaggggcuauguuauuucuuauaagcggaaaaggaauaggaaaaaccaguauaggcuuaauauguguuguagccaguaguggaauguuauggauggcagaugucccacuucaauggauagcaucagcaauaguacuggaguucuuuaugaugguucuucuuauaccggaaccagagaagcaaagaacaccucaggacaaccaacucgcauacgucgucauaggaauauuaaccuuagcugcuaucguagcugcgaaugaaaugggguuacuggagaccacaaaaagagacuuagggaugagcaaagaaccuggcguaguaucucccacuagcuaccuugacgucgaucugcauccugccagcgccuggacauuauacgcaguugcaacgacugugauaaccccaauguuaagacauacgaucgaaaacagcacugcaaacgugucacuugcggcgauagcaaaucaagcgguaguguuaaugggguuggauaaagguuggccaaucucaaaaauggacuugggaguaccauuacuugcacuagggugcuauagucaagucaacccgcugacauugacggcagcuguucuacucuuaguuacccauuaugcgaucauaggaccaggguuacaagcgaaagcuacaagggaagcacaaaaacgaaccgcggcggguaucaugaagaacccuacuguugaugguauuaugacaauagaucucgacccuguaauauaugauagcaaauucgaaaagcagcucggccaggucaugcuauuaguauugugugcaguucaacuucugcuuaugcguaccucgugggcauuuugugaagcucucacauuagccacugguccgauaacgaccuugugggaagggucgccuggaaaauucuggaacacaacaauagcagugucaauggccaauauauuccgaggcucauauuuagccggcgcaggucuugcauuuucaauuaugaagaguguagggacuggaaaacgagguacaggaucacaaggugagacacugggagaaaaguggaaaaagcgauugaaccaacucuccaggaaagaauuugauuuauauaagaaaaguggaauaacagaaguagaucgcacggaagccaaagaggguuuaaaaagaggagaaauaacucaucaugccgugucgagaggcagcgcaaaacugcaaugguucguugaaaggaauauggugauaccugaagggcggguaauagaucuuggcugcggacguggagguuggaguuauuacugugcuggucucaagaaagugacagagguaagaggauacacuaaaggaggaccuggucacgaggaaccaguuccaaugagcacuuaugguuggaauaucguuaaacuaaugucggguaaggacguauuuuaucuacccccagaaaagugcgauacauuacuuugcgacauaggagaaagcagcccaagccccacaguagaggaauccagaacgauccgaguccuaaaaauggucgaaccuuggcucaaaaacaaccaauucuguauaaagguauuaaacccauauaugccaaccguaauagaacaucuggaaagacugcaaagaaaacaugggggcauguuaguucgcaauccacuuucgcgaaacuccacccaugaaauguauuggauauccaaugggacaggaaauauaguauccucaguaaacaugguuagucgucuccuccuaaaucgguucacaaugacacauagacgaccgacaauagaaaaggauguugacuugggagcuggcacacgacacgucaaugcugagcccgaaaccccaaauauggauguuauuggcgagagaauacgucggaucaaagaggagcauaguuccacguggcauuacgacgacgaaaaucccuauaaaacaugggcuuaccaugguucuuaugaagucaaggcaacuggaucagccucgagcaugauaaauggcguugugaaacugcucacgaaacccugggauguugucccaaugguuacacaaauggcuaugaccgauacgacuccuuucggccagcagaggguauucaaggagaaaguugauacacggacaccacgaccaaugccugguacacggaaggucauggagauuacagcagaauggcuguggaggacauuaggcaggaacaagagaccuaggcuauguacgagagaggaguuuauaaagaaaguaagaacaaacgccgcuaugggagcuguuuuuacagaagaaaaucaaugggacucugcaagagccgcagucgaggacgaggaguucuggaagcuaguagacagagaaagagagcuacauaaauugggcaaaugcggaaguuguguuuacaauaugauggguaaacgggagaagaaauuaggagaauuugggaaggcaaaaggauccagggcaaucugguacaugugguuaggggcaagguaccuagaauuugaagcauugggauuucuaaaugaagaucacugguucucccgagaaaauucauauucugguguugagggagagggucuucacaaacuagguuauauuuuaagggauauaagcaaaauaccagguggcgcgauguacgcagaugacacugcugggugggauacacgaauaacugaggaugauuuacauaaugaagagaaaauuacucaacaaauggaccccgaacaccgacaauuagcuaaugcgauuuucaaacucacauaucagaauaaaguaguaaaggugcaaagacccacaccuaaaggaaccgugauggacauuaucucucggaaagaucagagaggcucuggacagguaggaaccuauggguuaaauaccuucacuaauauggaagcacagcuaauacgacagauggagggagaaggagucuuaagcaaagccgacuuagaaaauccucaucuucuggaaaagaaggucacucaauggcucgaaacuaaaggugucgagcgcuuaaaaagaauggccauuucaggagacgacugugucgucaaaccgauagaugaccgauuugcaaaugcacuguuagcacuaaaugacauggguaaaguaagaaaagacauaccacaauggcaaccgaguaaaggauggcacgacuggcaacaaguaccauuuugcagucaucauuuccaugaauuaauuaugaaggauggacguaaguugguagugccuugccgaccacaggaugaguuaauaggacgagcacgaauaucacagggugcaggcuggagucucagagagacagcaugcuuaggaaaagcguacgcacaaaugugggcacucauguauuuccaccguagagaucugagauuagcuucuaacgcuauuuguagugcugucccugugcacugggugccuacauccagaacuacuuggucaauacaugcacaccaucaauggaugaccaccgaagauauguuaacuguuuggaacaggguguggauugaagacaauccuuggauggaagauaaaacaccaguuacaacaugggaagaugugccauaucucggaaaaagagaagaccaauggugcggaucgcuaaucggacugacuucccgagcaaccugggcccaaaauauauuaacugcgauacagcagguacguagucucauugggaaugaagaauuucuagauuauaugcccuccaugaaaagguuucguaaagaagaggaaucagaaggcgcuauaugguaa

SEQ ID NO: 23577 - RNA, 9873 nt, Artificial Sequence
  derived and/or modified CDS sequence (opt6) from DENV-3__AY744678__SS-prME
acgucuuuaugccucaugaugauguugccagcaacucuagcguuucaucucacgucacgagauggagaaccuagaaugauugugggcaaaaaugaaagaggaaaaaguuuacuauuuaaaacugcuagugguauuaauauguguacacucauagcaauggauuugggagaaaugugcgaugauacgguaaccuacaaauguccucucauaacagaaguggaaccagaagacaucgauugcugguguaaccuaacaagcacuuggguaacauauggaacauguaaucaagcgggagaacacaggagagacaaacgaagcguagcacuagcaccacauguagguaugggacuugauacuagaacacaaacauggaugagugccgaaggagcguggagacaaguggaaaaaguagaaacaugggcuuuuaggcacccuggcuuuacuauacucgcucucuuucuagcacacuauauaggcacaucacucacccaaaaaguaguaauauuuauacuucucaugcuaguaacuccauccaugacaaugcgauguguagguguugguaacagagauuuuguggaaggauuaagcggugcaaccuggguggacguaguucuagaacauggaggguguguuacuacgauggcuaaaaauaaaccaaccuuggauauagaacuacagaaaacugaagcaacgcaacuugcaacauuaagaaaacuauguauagaaggcaaaauaaccaacguaacuacugauagucguuguccaacacaaggggaagcaauacuucccgaagaacaagaccaaaacuauguguguaaacacacauauguagaccguggaugggggaauggguguggacuauuuggaaaaggaucacucgucacuugcgcaaaauuccaauguuuagaaaguauagaagggaaagcuguacaacacgaaaaccuuaaauacaccguaauaauuacaguccauacaggagaucagcaucagguaggaaaugagacacaaggcguuacugccgaaauaacaccccaggcuuccacaguagaagcaauauuacccgaauacgguacgcuugggcucgaguguaguccacguaccgggcuagauuuuaaugaaaugauacucuuaaccaugaaaaacaaagcauggaugguucauagacaaugguuuuucgaccuuccacuaccauggacaaguggugccacaacugagaccccaaccuggaacaagaaagaauuacucgucacauuuaaaaaugcccacgccaagaaacaagaaguaguaguguuagggucccaagagggggcuaugcauacugcuuuaacaggcgcaacugaaauccaaaccaguggaggaacaucaauauuugcagggcauuuaaaauguagacucaaaauggauaaacuagaacuaaaagguaugagcuaugcaaugugccuaaaugcauucguacuaaagaaagagguuagcgaaacacaacaugguacuauccuaauuaaaguagaauauaaaggugaagaugcgccuuguaaaauaccguuuagcaccgaagaugggcaagguaaagcacauaauggacgcuuaauaacugcaaacccuauagugacuaagaaagaagaaccagucaauauagaggcagaaccaccuuucggugagagcaauauugugauaggcauuggugacaaagcacugaaaauaaauugguauaagaaaggaucuucgaucgguaaaauguucgaggcuacggcccgcggugcacguagaauggcgauacuaggugauacggcaugggacuuuggcagcguaggaggugugcuaaauuccuugggaaaaauggugcaccaaauauucggaucagcguauacagcacuauuuaguggaguuucauggaucaugaaaauugggauugguguauuacugacguggauaggacucaacucgaaaaauaccucaaugucauuuagcuguaucgucaucggaauaauuacccuauaccuuggagcuguuguccaagcugacauggguuguguuauuaauuggaaaggaaaagaauugaaaugcgguagugggauauuuguaaccaaugaaguccacacguggacagaacaguauaaauuucaggccgauagucccaaaagauuagcaaccgcgaucgcaggagcaugggaaaauggcguaugcgggauucguagcaccacaagaauggaaaaucuucucuggaaacagauagcgaaugaacugaauuacauucucugggaaaacaacauaaaacugacaauugugguaggcgauguuaucgguguguuggaacaaggaaaaagaacauuaacgccacagccaauggaacuaaaauacucauggaaaacauggggaaaagcaaaaauaguaacagccgaaacacaaaauaguuccuucauuauagacggaccaaauacuccugaguguccuucagcaaguagagcauggaacgucugggagguagaagauuauggauuugguguauucacaacaaacauauggcuuaaacuaagagaaauguauacccaacuuugugaucauagacuaaugucugccgcaguuaaagaugaaagagcaguccacgcggauaugggauauuggauagaaagucagaaaaacggaagcuggaaacuggaaaaagccagcuugauagagguaaagaccuguacguggccuaaaagucauacguuauggucuaaugguguucuugaaagcgauaugauuaucccaaagucccucgcugggccaauaagccagcauaauuacagaccuggauaucauacccaaacagcaggaccauggcaucuaggaaaauuggaacuggacuuuaauuacugugagggaacaaccguaguaaucacagaaaauugcggcacacgcggaccuucuuuaaggaccacuacaguaucaggcaaacuuauacaugaguggugcugucguuccuguacgcugcccccgcugagguauaugggggaggacggaugcugguacggaauggaaauacgacccauuaacgagaaagaagaaaacaugguaaaaagccuggucucugcaggaagcggcaaagcagacaauuuuaccaugggcguguugugcuuggcaaucuuauuugaagaaguaaugcgcggaaaguucggcaagaaacacaugaucgcaggagcauuguuuaccuuuguccuacuauuaucgggacaaauuacauggcgcgacauggcccacacacuuauuaugauuggaucaaacgcuagcgauaggaugggaaugggcguuacuuaucucgccuuaauagcgacuuuuaaaauacaaccauuccuugcauuaggauucuucuuaagaaaacuaacaucucgagagaaccuacuacuaggaguaggccuugcaauggcaacgacuuuacaacuacccgaagauauugagcagauggcaaaugguaucgcucuuggucucauggcacuuaaauuaaucacccaauuugagacuuaccagcucuggacggcacucguuucguugauguguucaaauacgauauuuacucuaacuguagcguggaggacggccacucuaauacuugcuguaauuagucugcucccaguaugucaaucuucauccaugcgaaaaaccgauuggcuuccgaugacagucgcggcuaugggcgugccaccucugccguuauuuauauucucacuaaaagacacucucaagagacgaucauggccacuaaaugaagguguaauggcuguagguuuaguuagcauacuugcuucaaguuucuuacguaaugacguucccauggcugggccucuuguagcaggagguuuauuaaucgcgugcuacgugauuaccggaacuagcgcagaucuuacaguggaaaaagcugcagaugugacuugggaagaagaagccgaacagacugguguuagucauaauuuaaugauaacuguagacgaugauggcacuaugcgcauuaaagaugacgaaacugagaauauacuuacaguacuguuaaaaacggcauuauuaaucguuagcgguauauuuccuuacucaauaccggccacauuauuaguguggcacacguggcagaaacaaacucagagaucuggaguacucugggauguaccaagcccgccugaaacacagaaagcagaacucgaagagggggucuaccgcauuaagcaacaggguauauuuggcaagacucaaguagggguuggaguacaaaaggaggguguguuucauacuauguggcacguaacgaggggugcuguacuuacucacaacggaaagagacuagaaccuaacugggcaaaugucaagaaagaucugaucaguuacgguggaggauggaagcuaagcgcgcaauggcagaagggagaagaagugcagguaauagcggucgaaccugggaaaaaccccaaaaacuuucagacaaugccagguauuuuucagaccaccacgggagagauuggugccaucgcucuugacuucaaacccggaacaaguggcucacccauuauaaaucgagaggguaaaguggugggacuauauggcaaugguguuguaacgaagaacggagguuaugucagcgguauagcacaaacuaaugccgaacccgacggcccaacgcccgaacuagaagaagaaauguuuaagaaaagaaaccuaacuauuauggaccuacauccaggaucaggcaaaaccaggaaauaucuaccagcaauuguacgcgaagcaauaaagcgucgauuaagaacucucauacuagcuccaaccagaguggucgccgcagaaauggaagaggcauuaaaaggcuuacccauaagauaucaaaccacggcaaccaaaucagaacauacaggaagagaaaucguggauuuaaugugccacgcaacauucacaaugagacuucucucccccguccgcguccccaacuauaaccucaucgugauggaugaagcgcauuuuacggacccagccuccaucgccgccagggguuacauaucaacaagaguagguaugggcgaagcugcagcaaucuuuaugacggcaacaccaccaggaacagcugaugcauuuccacaaucaaaugcuccaauccaagacgaagaaagagacauuccagagagaaguuggaacucggguaacgaauggauaacagacuuugcaggcaagacagucugguucguacccaguauuaaagccggaaaugacauugccaauuguuuaaggaaaaacggaaagaaagugauacaacuaucaagaaaaacuuucgauacugaauaccagaaaacaaagcuaaacgauugggacuucguuguaacaaccgauauaagcgaaaugggugcuaacuucaaagccgaucgaguaauugauccacgucgauguuuaaagccuguaauuuugacugacgggccugaacgaguaauccuggcgggacccaugcccguaacagucgcgucggcggcucaacgaagagggcgaguaggaaggaacccucaaaaagaaaacgaccaauacauauucacaggccaaccauuaaacaacgaugaagaucacgcacacuggacugaggccaaaauguuauuagacaacauaaauacaccagaaggaauuaucccugcauuauuugaaccugagagggagaagagugccgcaaucgauggugaauauagauugaagggugagucaagaaaaacuuucguagaacuaaugcgaaggggagauuuaccagucuggcucgcacauaaaguugcaucugaaggaauuaaauauacugaccgaaaaugguguuuugacggugaacgaaacaaccaaauucuggaagaaaacauggauguugaaauauggacaaaagaaggcgagaagaagaaacugagaccuagaugguuagacgcucgaacuuauucggauccacuagcauugaaggaauuuaaagauuucgcagccggucgcaaaagcauagcuuuagauuuagucacugagauaggucgaguucccucacaccuagcucacagaacccgcaaugcauuagauaauuuggucaugcuccacacaucagaacaugggggacgggcauacagacacgcuguagaagaauuaccugaaacgauggaaacacuucuccuguugggucuuaugaucuugcuaacgggaggugcaauguuauuuuuaauaagugguaaaggaauuggaaaaacaucgauaggcuuaauaugugugguugcaucaaguggaauguuguggauggccgacguuccauuacaauggauugcuucagcaauaguuuuagaauuuuucaugaugguuuuauuaaucccugaaccugagaagcaaagaaccccucaggacaaucaauuagcauauguggugauagggauccugacucuggcagcuaucguggcugcaaacgaaaugggucuccucgaaacuacaaaaagggacuuaggaaugagcaaagagccaggaguuguuucaccuacaucuuaucuagaugucgauuuacauccugccagcgcauggacacuguaugcagucgcaacaacagugauuacuccuaugcuccgacacacuauagaaaacucgacagcaaacguuucgcuagcugcaauagcaaaucaagcaguaguauuaaugggacuagacaaagguuggccgaucucuaaaauggacuuggggguaccucuacuagccuuaggauguuauucacaagugaauccacucacguugaccgccgcgguacuacuucuaguuacacauuaugcaaucauaggcccgggucugcaagcuaaggcaacucgugaggcccaaaagagaacugcggccgggauaaugaaaaauccuacuguggauggaaucaugaccauagaccuggauccaguaaucuacgauucgaaauucgagaaacaacuaggucagguuaugcuauuaguauugugcgcuguacaacuacuauugaugagaacaucgugggcuuucugcgaagccuuaacguuggcaacuggacccaucacaacccuaugggaaggaucaccuggaaaauuuuggaacacuaccaucgccguuaguauggccaauaucuucagaggaucguaccuagcaggggccggguuagcauucaguauaaugaaauccgucggaaccggaaaacgggguacugggucacaaggagagacccuaggagaaaaauggaagaagaaauuaaaucaauuaagucguaaagaauuugaucuuuacaaaaagaguggcauuaccgaaguagauagaacagaggcgaaagagggucugaaaagaggagaaaucacacaucaugcuguaucacgaggaucugcaaaauugcaaugguucguggaacgcaauaugguuaucccugaaggacgcgugaucgacuuaggaugcggacgcggggguuggaguuacuacugcgcggguuuaaagaaagucacugaaguuagaggauauacuaaagggggaccagggcaugaggaaccaguaccaaugucaacuuauggcuggaauauugugaaguuaauguccggaaaggacguguuuuaucuuccuccagaaaaaugcgacacucuuuugugcgacauaggagagucaucaccaagccccacaguagaagaauccagaacaaucagaguauuaaagaugguugaaccguggcuuaaaaauaaucaauucugcauuaaaguacuaaauccauauaugccaaccguuauagaacaucuagaaagacuacaaagaaaacaugggggaaugcuaguuagaaacccgcuaucucguaauaguacgcaugagauguauuggauaucuaauggaacaggaaauauuguuucuucagucaauaugguaagccgauuauuacuaaacagauucacgaugacgcaucgcagaccuacuauagaaaaggacguagaucuaggcgcuggcacccggcauguaaacgcugaaccugaaacaccgaauauggauguaauuggugaacguauaaggagaauaaaagaggaacauucuagcacauggcacuaugaugaugaaaacccuuauaaaacaugggcauaccacgguucuuaugaggucaaagcaaccgguagugccaguaguaugauaaauggaguuguaaaacuucuaacuaaaccaugggacguugugccaauggugacccaaauggcuaugaccgauacuacgccauuuggacaacaacgaguuuuuaaggaaaaaguagauacccgcacgccacgaccuaugccugguacucguaagguuauggaaauuacugccgaauggcuguggagaacguuagggaggaauaaacgaccucgccuaugcacaagagaagaguucauaaagaaaguaagaacuaacgcagcgaugggcgcaguguucacggaagagaaccagugggacucagccagggcagcuguugaggacgaggaauuuuggaaauuaguugaucgagaaagagagcuacauaaacuaggcaaauguggcagcuguguuuacaacaugauggguaagcgugagaagaaacuaggagaguuugguaaagccaaagguucaagagcaauuugguauauguggcuaggugccagguaucuagaauuugaagcucucggauuuuuaaaugaagaucacugguuuucaagggagaacucauauucaggaguggagggagaaggacuacacaaauuaggauacauccuaagggauaucucuaaaauuccagguggggccauguaugcugaugauacagcagggugggauacgagaaucacggaggaugacuuacauaacgaggagaaaauaacacaacaaauggauccagaacauagacaacuagcaaaugcuauauucaaacugaccuaucaaaauaaaguuguaaaggugcagcgaccaacaccaaaaggaacgguaauggacauaaucucaagaaaagaucaacgagggucaggucaaguagggacauauggccuuaauaccuucacgaauauggaagcccaguuaaucagacaaauggaaggcgaaggaguacuaucuaaggcggaucuugaaaauccucaccuucuugagaagaaaguaacucaaugguuagaaacgaaaggaguggaaagauugaaacggauggcgauaucaggagacgauugcguaguaaagcccaucgaugaccgauuugcuucagcguugcuagcauuaaaugauaugggaaaaguccguaaagauaucccacaauggcaacccucaaaaggguggcacgacuggcaacaggucccguuuuguucgcaucacuuucacgagcuaauaaugaaggauggucggaaauuaguagugccaugcaggccacaagaugaauuaauagguagagcaaggauuagccaaggagcgggauggucccuacgagaaaccgcuugcuuagguaaggcuuacgcgcaaaugugggcacuaauguacuuccacagaagagauuugcgccucgcgucaaacgcuauauguuccgcagucccagugcauuggguacccacuucaaggacuacuuggaguauacaugcccaucaucaauggaugacaacagaagauauguugacuguguggaacagaguguggauugaagacaacccguggauggaagacaaaaccccagucaccaccugggaggauguaccauacuugggaaaaagagaagaccaaugguguggcucguugaucgggcugacauccagggcaacaugggcccaaaauauccuaacggcuauucaacaaguaagaucccuuauaggcaaugaagaauuucuagacuacaugccaaguaugaaacgguuccguaaagaagaggaaagugaaggugcuauaugguga

SEQ ID NO: 23578 - RNA, 9873 nt, Artificial Sequence
  derived and/or modified CDS sequence (opt6) from DENV-3__AY744679__SS-prME
acuagcuugugucuaaugaugaugcugccggcuacauuggcuuuucacuugaccagccgcgauggagaacccagaaugaucguggguaaaaaugaacgaggaaaaagucugcuuuuuaaaacagcaucgggaauaaauaugugcaccuuaauagcaauggaucuaggggaaaugugugacgauacaguaacauauaaaugcccguugauaacagaaguagaaccagaagauauugauuguugguguaacuuaacaagcacauggguuacauaugguacaugcaaccaagcgggugaacaucgaagagacaaacggucaguugcacuagcaccucauguaggaaugggauuggacacacgaacacaaaccuggaugucagcagaaggugcuuggagacaaguagagaaaguagaaacaugggcuuuccggcauccggguuuuacaauacuagcauuauuuuuagcacacuacauuggaaccucguuaacacaaaaaguuguuauauuuauacuauuaaugcuaguuacaccuagcaugacaaugcgaugcgucggaguaggaaaucgagacuucgucgaaggauugucaggugccaccuggguagacgucguauuagagcauggagggugcguuaccacuauggcuaaaaacaaaccaacacuagauauugaauuacagaaaacugaggcuacccaacuugcaacauuacguaaacucugcauugaagguaaaauaacgaaugucacaaccgauaguagguguccuacacaaggagaagcaauauugccagaagaacaagaucaaaauuauguguguaaacauaccuacgucgaucgagguugggguaauggcuguggucuguuugguaaagggucccugguaacaugugcuaaauuucaaugucuagaaucuaucgaaggaaaagugguacaacaugagaacuugaaauauacugucauaauaaccguacauaccggugaucaacaccaaguaggaaaugagacacaagguguuacagcagaaauaacgccucaggccaguacaguggaagcgauauuaccggaguaugguacauuaggccuugaauguagcccccguaccggguuagauuuuaacgaaaugauacuacuuacaaugaaaaacaaagccuggaugguucauagacaaugguucuuugaccuuccacuccccuggacuucuggggccacgacugagacgccuacuuggaauaagaaagaauuacuggucacguucaaaaacgcacacgcgaagaaacaagaaguuguuguacuaggaucucaagaaggugcaaugcacacugcuuuaacuggagccaccgaaauucagacauccggugguacaucaauauuugcuggucaccuuaagugccgauugaaaauggacaaacuggaacugaaaggcaugucauaugcaaugugccuaaacgcuuucguacugaagaaagaaguaucggaaacacaacauggaaccauacuuauaaagguggaauauaaaggagaagacgcaccaugcaaaauuccuuucagcaccgaagaugggcaaggaaaggcucacaacggcagacuaauuacugccaauccuauaguuaccaagaaagaagaaccagugaacauagaagcugaaccaccuuucggagaaaguaauauaguaaucggaauuggagauaaagcauuaaaaauaaauugguauaagaaagggucuaguauagguaaaauguuugaagccacagcucggggagcacgacgcauggcuauauugggggacacggcuugggacuuuggauccguuggaggaguccuuaacucccucgggaaaaugguucaucaaauauucggcagcgccuauaccgcacucuucucaggaguaucguggauuaugaaaaucgguauaggaguacuguuaaccuggauaggacuaaacagcaaaaauacaucgaugaguuucagcuguauuguaaucggcauaauaacacuuuacuugggagcuguaguucaagcagauauggguuguguuaucaauuggaaagggcaagagcuuaagugcgggagugggauauucguuaccaaugagguucacacauggacugaacaauacaaauuccaagccgauagcccuaagagacuagcgaccgcaauugccggugcuugggaaaacggaguuugugggauuaggucuacaacgcguauggagaacuuacuauggaaacaaauagccaaugaauuaaacuacauauuaugggagaacaauaucaaacuuaccguaguagucggcgauguaauaggcguuuuagaacagggaaaaagaacguuaacuccccaaccgauggaauuaaaguauucauggaaaacguggggaaaggcgaaaauaguaacagcggaaacucaaaauagcaguuuuauuauugaugguccaaauacuccugagugucccagcgccagucgagccuggaauguaugggaaguagaagacuacgguuuugguguauucacaacaaacaucugguuaaaacuaagggaaauguacacccaauugugugaccaucguuugaugagugcagcaguaaaggacgagcgagcaguacaugcagacaugggauauuggaucgaaucucagaaaaaugguucauggaaacuugaaaaggcuucuuuaauagaagugaagacaugcaccuggccuaagagccauacgcuuuggucgaauggaguauuagaaucagacaugaucauaccuaaaagucuagccgguccuauaagccaacacaauuaucgacccggcuaccauacacagacagcgggcccauggcaucucggaaaauuagagcuagacuucaauuauugugaaggcacaaccguuguaauaacugaaaauuguggcacucgaggaccaagucuuagaacgaccacgguuagugguaaacuaauucaugaaugguguuguagaagcuguacucuaccuccacuaagauacaugggugaagacggauguugguaugggauggaaauccgccccauaaaugagaaggaggagaauaugguaaagagcuuaguguccgcaggcagcgguaaagcggauaacuuuacgaugggaguuuuaugccuggcuauacuuuuugaggaagucaugcgagggaaauuuggcaagaaacacaugauugcaggagcguuguucaccuucguauugcuacuauccggacagaucacauggagagauauggcucauacuuuaauaaugauuggaucaaacgcaagugacagaaugggaauggguguaacuuacuuagcacugaucgcuacauucaagauccaaccguuuuuagcacuuggauucuuucucagaaaauuaacaagccgagaaaaccuauuguuggggguaggccuugcaauggcaacgacacuccaauuaccagaagauaucgagcagauggcaaacgggaucgcacuuggacuuauggcccuuaaauuaauaacacaauuugaaacuuaucaacuuuggacagcgcuaguaucauuaauguguucaaauacaauauuuacacuaacuguggccuggcgcacagcuacacuuauuuuagcuguaauuucucuauuaccugugugccaaaguaguucaaugcgcaagacugacuggcuuccuaugacaguagcugccauggguguuccaccacuaccauuauucauuuucaguuuaaaggacacauuaaaaagacguaguuggccucuuaaugagggggucauggcugucggcuuaguaucuaucuuagcgaguagcuuccuucguaacgacguacccauggccgguccauugguugcaggcggccugcuuaucgcauguuauguaauuacagggacaucugcagaucugacggucgaaaaagcagcagacguuacgugggaagaagaagcagaacagacaggugucucgcauaauuugaugauuacaguugaugacgauggaacgaugcguauuaaagacgaugagacugaaaauauauuaacaguauuacuaaaaacugcgcuuuugaucguaagcggaauauuuccauauucaauaccagcuaccuuguugguguggcauacauggcaaaaacaaacccaaagaucugguguauuaugggauguacccucuccaccagaaacacagaaagcggaacuagaagaaggcguauacagaauuaaacagcagggaaucuuuggaaaaacacaaguaggaguuggcguccagaaagaagggguuuuccauacaauguggcauguaacuagaggugcaguuuuaacgcacaauggaaaacggcuagaaccaaacugggcaaaugugaagaaagaccuaaucaguuacgguggcggcuggaaacuaucugcacaauggcagaagggugaagaaguucaagugauugcaguugagccaggcaaaaaccccaagaacuuccagacaaugccaggcaucuuucaaaccacuacuggcgagauuggagcaauagcauuagauuuuaaaccgggaaccucagggaguccuauuauuaaccgagaaggaaaaguaguaggauuauaugguaacggggucguaacuaagaacggcgguuauguaaguggaaucgcucaaacuaaugcugaaccugacggacccacgccggaauuagaggaagaaauguuuaaaaagaggaaucuaacaaucauggacuugcaucccggcucaggaaaaacuagaaaauacuuacccgcaauuguacgagaggccaucaaaagaagacuacgaacacugauacuugcaccuacccgcgucgucgcagcggaaauggaagaagcacugaaaggauuaccaauuagguaucaaacuacugcaacaaagucagagcauacgggacgcgaaauagucgaccuaaugugccacgcaacauuuacuaugagguuacuuaguccaguuaggguaccaaauuauaacuugauagucauggaugaagcgcacuucacagacccagcuuccauagcggcacgaggauauauaaguacgagagucggaaugggcgaggcagcugccaucuucaugacggccacaccuccaggaacugccgacgcauucccacaaucaaaugcgccuauacaagacgaagaaagagauauccccgaaagauccuggaauagcgguaaugaauggaucacagauuucgcuggaaaaacugucugguucgucccaucaauaaaagcagguaaugauauagcaaacugucuacguaaaaaugguaagaaagugauacaguuaagcagaaagacauuugauaccgaauaucagaaaaccaaacuaaaugauugggauuuuguaguaacaacugauauaagcgaaaugggagcaaacuuuaaggcggaucggguaaucgacccucgcagaugucuuaaaccaguaauccuuacugacggucccgaaaggguaauauuagcagguccaaugccaguuacuguagcaagugcagcucaaaggagaggcagaguuggcagaaauccgcaaaaagaaaaugaucaauacauuuucacuggccaacccuuaaauaaugaugaagaccaugcacacuggacagaggcaaaaaugcuacucgacaacauaaacacccccgaaggaauaauuccagcauuauuugaaccagaaagagaaaaauccgcggccaucgauggugaauaucgcuuaaaaggggaaagcagaaaaacauucguagagcuaaugagaaggggcgaucuaccuguauggcuggcacauaaaguugcaagugagggcauaaaauacacagacagaaaguggugcuucgacggagaacgaaacaaucagauauuggaagaaaauauggauguugagauuuggacaaaagaaggagagaaaaagaaauuaagaccgcguuggcuugaugcacgcaccuacucggauccccucgcucucaaagaguucaaagacuuugccgcggguaggaaaucaauugcuuuagaucuuguuacugaaauaggacgcguaccaagucaccuugcacaccggacacguaacgcauuggacaauuuaguaaugcuacacacauccgaacacggcgguagagcguacagacacgcaguagaggaauuaccagaaacaauggagacauuacuacuacuaggacuuaugauauuauuaacagguggggcaauguuauucuuaauuaguggcaaaggaauagguaaaacgucuauaggcuuaauuugcguaguagcaucaagcggaauguuguggauggcggauguacccuuacaauggauugcauccgcaauagugcucgaguucuuuaugaugguccuacuaauuccugaacccgagaaacaacgcacgccacaagauaaucaauuagcuuacguaguuauuggcauucuuacucuagcagcuaucguagcggcaaaugaaauggggcuguuagagaccacaaaaagagaucuggggaugucaaaagaaccggggguuguuucgccaacuucauaccuagauguugaucuccauccugccucugcauggacauuauaugcgguugccacaacaguaaucacuccuaugcugaggcauacuauugaaaauuccacagccaaugucucucuggcugccauagccaaccaagcuguaguuuuaaugggauuagacaaaggauggccaauuaguaaaauggaccuuggggugccauuauuagcacuaggcuguuauagccaaguuaauccuuugacacuaacugcggcagugcucuugcucguaacacauuacgcgauaauaggucccggucuacaggcuaaagcuaccagggaggcacagaaaagaacagcagcuggcauuaugaaaaauccgacaguagauggaauaaugaccauagacuuagaucccguuauuuacgacagcaaguucgagaaacaauuaggucaaguaaugcuccuaguucuaugugcaguacaacuucuauugaugcgaacguccugggcauuuugugaggccuugacuuuagcgacggguccuauuacaacuuuaugggaagguucuccgggcaaguuuuggaacacaacgauagcaguuaguauggccaacauuuuccguggaucauaccucgcgggcgcaggacuggcuuuuaguauaaugaaaagugugggaacaggaaaacgaggaaccgggagccaaggugaaacacucggggaaaaauggaagaagaaauuaaaucaacuaucacgcaaggaauuugaccuuuauaaaaagucagguauuaccgaggucgaccgaacggaagcaaaagaaggacuaaaacgaggugaaauaacucaccacgcggucucaagagguucagcaaagcuacagugguuugucgaacgaaauaugguuauuccugaaggcagaguaauugacuuaggauguggucgaggcggguggaguuauuauugcgcuggucuuaagaaaguaaccgaaguucggggauacacuaaaggcggaccaggacacgaagaacccgugccaaugucaacuuacgguuggaauaucguaaaacuaaugucgggaaaagauguauuuuacuuaccucccgaaaaaugugacacacuauuaugugauauaggggaaucuagcccaucgccuacggucgaagaaaguagaaccauuagaguacuaaaaaugguagaaccuuggcugaaaaauaaucaauuuugcauuaaagugcucaaccccuacaugccaacgguaauugagcaccuggagagguuacagcgaaagcaugguggaaugcuaguaaggaacccucugaguagaaauucaacacacgaaauguacuggauaucuaacgguacuggaaacauaguaucaucugucaacaugguaucucguuuauuacuaaaucgguuuacuaugacccacagaaggccaacaauugagaaagauguugaucuaggugcaggaacgcgacacguaaaugcugagccugaaacaccaaacauggauauuauaggcgaacgaauacguagaauaaaagaagaacauuccucaacguggcacuaugaugacgaaaauccauauaagacuugggcauaucauggauccuacgaaguaaaagcgaccgguucugcauccucaaugaucaacggaguaguuaaacucuuaacaaaacccugggauguaguaccaaugguaacccaaauggcuaugacagauacgacuccguucggucaacaacguguauuuaaagaaaaaguagauacaaggacaccaaggcccaugcccggaacaagaaaagucauggagauaacggcugaauggcuauggaggacauuaggacguaacaaacgaccacguuuaugcacuagagaagaguucaugaaaaagguuagaacaaacgcggcaaugggagcaguauuuacagaagaaaaucaaugggauucggcacgugcagcuguugaagaugaagaguucuggaagcuaguggauagggaacgggaacuucacaagcucgguaaaugcggaagcugcguauacaacaugauggguaaacgugaaaagaaguuaggggaguucgggaaagcgaaagguucgagagcaauaugguacauguggcuuggagcccgguaucucgaauuugaggcuuuaggauuuuuaaacgaagaucauugguuuucaagagaaaacucauacucagguguugagggcgaaggccugcauaaacuuggauauauacuuagagauaucaguaaaaucccaggcggugccauguaugcggaugauacagccggaugggauaccaggauuaccgaagaugaucuacauaaugaagagaaaauaacacaacaaauggauccagaacauaggcaauuagcuaaugcaauauucaaacugacauaucagaauaaagucguaaagguccaaaggccuacgccaaaagguaccgugauggacauuaucucacgaaaagaucagagagguaguggacaagucggaacuuauggacuuaauacuuuuacuaauauggaagcacaacuuauuagacaaauggagggagaaggaguauuaucuaaagcagacuuagaaaauccccaucuacuagagaagaaaguuacgcaaugguuagaaacuaaagguguggaacggcugaaacgaauggccauaucuggagaugauugugugguaaaaccaauagaugauagauucgcaaaugcucuauuggcacuaaacgauaugggaaaaguucggaaagauaucccacaauggcaacccagcaaagguuggcacgauuggcagcaagugcccuucugcagucaccauuuucacgaauuaauuaugaaagauggccguaaauuagucgugccuuguagaccacaagaugagcuaauuggcagagcaaggauaucacaaggagcaggauggucacucagagagacggcaugucuuggaaaagcauacgcgcaaaugugggcguugauguacuuccauagaagagauuuacguuuagccucgaacgcuaucugcucugcuguaccaguucacuggguuccgacuuccaggacgacuuggucuauucaugcucaccaucaguggaugacuacagaagacaugcucacuguuuggaacagaguauggauugaggauaacccuuggauggaagauaagaccccggucuccacuugggaagaugugccguauuugggaaaaagagaagaucaaugguguggauccuugauuggguuaaccagucgagcaacaugggcacagaauauauuaacggcaauucagcaaguaaggagucucauuggaaaugaagaauuucuagauuacaugccuagcaugaagcgcuuucguaaggaagaagaaucugagggagcaauaugguag

SEQ ID NO: 23579 - RNA, 9873 nt, Artificial Sequence
  derived and/or modified CDS sequence (opt6) from DENV-3__AY744680__SS-prME
acaagccuauguuugaugaugauguuacccgccacucuagcauuucaccugaccaguagagacggagaacccagaaugauugucggcaaaaaugaacguggaaaaucauuauuauuuaaaacugcguccgggauuaauauguguacgcuuauugcuauggauuuaggagaaaugugcgacgauaccguaacauauaaaugcccacuuauuacagaagucgaacccgaagauauagauuguuggugcaaucucacaucuacuuggguaacauauggaaccugcaaucaagcuggagaacaccgaagggacaaacgcucaguugcauuagcuccacauguugguaugggacucgauaccaggacacaaacuuggaugagugcagaaggagcuuggagacaaguagaaaaaguagagacaugggcguuucgccaucccggauucacuauacuugcgcuauucuuggcucauuauauagguacaagccucacacagaaaguaguuauauuuauucucuuaauguugguaacacccucaaugacaaugagauguguaggggugggcaauagagauuuuguagagggacucucuggugcuacauggguggacguggugcuagaacacggcgguugcgugacgacgauggcgaaaaauaaaccaacguuagacauugagcuucagaaaacugaagcaacacaacuugcaacauuaagaaaauuauguauugaaggaaaaauaaccaaugucacaacagauucuaggugccccacacaaggagaagcuauacugccagaagaacaggaccaaaauuauguaugcaaacauacauauguugacagaggcuggggaaauggcuguggcuuguucggaaaaggaucacugguaacgugcgcaaaauuucaaugcuuggagucaauugaaggaaaagcaguacaacacgaaaauuuaaaauauacgguaaucauuacuguucauacuggggaucagcaccaaguggggaaugagacacaaggagucacagcggaaauaacaccacaagcaucaacaguagaggcaaucuuaccugaauauggaaccuuaggacuugagugcucacccaggacugguuuagauuucaaugagaugauacuacuuacaaugaaaaauaaagccuggaugguucacagacagugguucuuugaucuaccacuaccauggacguccggggccacaacugaaacaccaacauggaacaagaaagaacuuuuagucacauucaaaaacgcacaugcgaagaaacaagaaguagucguucucggaagucaggaaggugcaaugcauacugcauuaacgggagcgaccgaaauacaaacaaguggugguacaaguauuuucgccggacaccuuaagugcagauuaaagauggauaaacuagaacuaaaaggaauguccuacgcuaugugcuugaacgcuuuuguguugaagaaagaagucucagagacucagcauggaaccauauuaaucaaaguagaauauaaaggggaagaugcaccuuguaaaauaccauuuucaacugaagauggacaaggaaaggcgcacaaugggcgauuaauuacugcaaaucccauuguuacuaagaaagaagaaccaguaaauauagaagcugaaccgccguuuggugaauccaacauagugauugggauaggggacaaagcacuaaaaauuaauugguauaagaaaggaaguucuauuggcaaaauguuugaagcuacagcucgcggggcaagaaggauggcgauuuuaggugacacugcaugggauuuugguucggucggagguguccuaaauucuuuagguaagaugguacaucaaauuuucggaucagcguauaccgcucuauucagugguguuucuuggauaaugaagauugggauaggaguccuguuaacauggaucggacuuaauucuaaaaacacuucuaugagcuucaguugcauagugauuggaauaauuacgcucuauuuaggagcaguaguacaagcagacaugggaugcguuauuaauuggaaagggaaagaacugaaaugcggaaguggaaucuuuguaacaaaugagguccauacuuggaccgaacaauacaaauuucaggcagacagccccaaacgacucgccacugccauugccggcgcuugggagaaugggguaugcgguauccgaucaacgaccaggauggaaaauuuacuuuggaaacagauagcgaacgagcugaauuauauauugugggaaaauaauauuaaacuaacuaucgucgucggugacgugauuggaguccuagagcaggggaagaggacauuaacaccacaacccauggaauuaaaguauuccuggaagacaugggguaaagcuaaaauaguuaccgcggaaacucaaaauagcucguuuauaauagaugggccaaacacuccggaauguccuucggcgucucgugcauggaaugucugggaagucgaagauuacggauuuggaguauucacaacgaacauauggcuaaaacuacgagagauguauacucaauugugugaucaucgauuaaugagcgcggcgguuaaagacgagcgugcagugcaugcggauaugggauacuggauagaaagccagaaaaacggaaguuggaaauuagaaaaggcaucauugauugaggugaaaacauguacauggcccaaaagucacacgcuauggucuaaugguguacuagaaagugauaugaucauaccuaaaucucuagccggaccaauaucacaacauaauuaucgaccaggauaucacacacagaccgcgggaccguggcauuuaggcaaauuagaguuagacuuuaacuacugcgaaggaaccaccguaguuauuacagagaauugcggaacacgggguccaaguuugagaacuacaacaguuagcgguaaacuaauacacgaaugguguugccguagcuguacccuaccgccauuaagauauaugggugaggacggauguugguauggaauggaaauuagaccaauuaaugaaaaagaagagaauauggucaaaucguuaguauccgcaggcagugggaaagcugacaauuuuacgaugggagugcuuuguuuggcaauacuauuugaagaaguuaugcgaggaaaauuuggcaagaaacacaugauagcaggagcacucuuuaccuuuguguuguuguuaucaggucagauuaccuggcgagauauggcacacacauuaauuaugauaggcucuaacgccucugacagaaugggaaugggggucacauacuuagcucuuauagcgacauuuaaaauucaaccguucuuagcucuaggauucuuuuugagaaaguugacaucacgagaaaaucuacugcucggugucggguuagcaauggcuacuacauuacaguuacccgaagacauagagcagauggcuaauggaauugcguuggggcucauggcccugaaacuuaucacucaguuugagaccuaccaguuguggacagcucuaguuucccuuaugugcucgaauacuauauucacacuaacaguagcuuggagaaccgcuacacuaauauuggcaguuauaucuuuacuacccguuugucaaagcucuagcaugaggaaaacagacugguuacccaugacaguggcagcaaugggugugccaccccuuccauuguucauauuuucucuaaaagacacacucaaaagaagaaguuggccauugaaugaagguguuauggcgguggggcuggucaguauauuggcuucaucuuuccucagaaaugaugucccuauggcuggaccauuagucgcugguggacuacuuauagcaugcuauguaauuacagguacaagcgcagauuugaccguagaaaaggcugcagacguaacaugggaagaagaagcggaacagacgggcguaucacauaauuuaaugauuacuguggaugaugaugguaccaugagaauaaaagacgaugaaaccgagaauauuuuaacgguucuucuaaaaacggcccuacuaaucgucaguggcaucuuuccauacucaauuccagcaaccuuguugguguggcacacguggcagaaacaaacacagagaaguggaguacuuugggacguuccaaguccaccugaaacgcaaaaggccgaauuagaagagggagucuaucgaaucaaacaacaagguaucuucggaaaaacacagguagggguuggaguucaaaaagaaggaguauuccacaccauguggcauguuacaagaggggcaguacuaacccauaaugguaaacgguuagagccgaacugggcaaacgugaagaaagaccuuauaucguacgguggcggcuggaaacuuucagcccaauggcaaaaaggugaagagguacaagucaucgcagucgaaccgggcaaaaauccuaaaaauuuccaaacgaugccaggaauauuucaaacgacuacaggagaaauaggagcaaucgcacuugauuuuaaaccagguacaaguggaucuccaauaauaaaccgagaagguaaaguuguuggacucuacgguaacggaguaguuacaaagaacggcgguuacgucucuggcauugcucaaacaaacgcggaaccagacgggccaaccccugaauuagaggaggaaauguuuaagaaaaggaauuuaacuauaauggauuuacauccuggaaguggaaagacacgcaaguaucuccccgccauaguaagagaagccauuaaaagaagguugcgcacuuuaauuuuagcuccaacucgagucguugccgcagaaauggaggaagcacuaaaaggauuaccgauacgguaucaaacgacggcgacuaaaagugaacauacgggaagggaaauuguggaucugaugugucacgcuaccuucacgaugagauugcucucaccaguacgaguccccaauuauaaucuaauaguaauggacgaagcucauuuuacagacccagcgucgauugcagccaggggcuacauaaguacaagaguaggaaugggugaagcagcugccauauucaugacugcgacaccacccgggaccgccgaugccuuuccgcaauccaacgcccccauccaagacgaggagagagacauuccagaaagaagcuggaacucgggcaacgaauggauuaccgauuuugcaggcaaaacggucugguuuguaccuucuauaaaagcaggcaaugauaucgcaaacugccugaggaaaaaugggaaaaagguaauacaguuaaguagaaaaacuuucgauaccgaguaccagaaaacaaagcugaaugauugggauuucgugguaaccacugauauaucugaaaugggcgcaaauuuuaaagcggaccgcgugauugacccccgaaggugccuaaaaccuguaauauuaacggaugguccagaaaggguaauacuagcagggccgaugccagugacgguagcgucagcagcucagagacgaggccgaguuggacgaaauccccaaaaagaaaaugaucaauauaucuuuacaggucaaccauugaacaacgaugaagaccaugcccauuggacugaggcaaaaaugcuacuagacaacaucaauacuccggaagguauaauuccagcgcuuuuugagcccgaacgagagaaaagugcggcaauagacggagaauaccggcuaaagggagaaucucgcaagacuuuuguagaacuuaugaggaggggagaccuaccaguuuggcuagcacacaagguagcuucagaagguauaaaguauacugauaggaaauggugcuuugauggagaacgcaauaaucaaauacucgaggaaaauauggacguagaaauauggacuaaagagggagagaagaagaaacuacguccacguugguuggacgcacgaacauacagugauccuuuagcucuaaaagaauuuaaagauuucgcggcgggaagaaaaucuauagcauuagaucuugucacugaaauugguagaguaccgucacaucuggcacaucgaacaagaaaugccuuagacaaccuagugaugcuacauacaucugagcauggagguagggccuacagacacgccguagaagaauuaccagagacgauggaaacacuacuguuauuagggcuaaugauccugcuuacaggaggggccauguuauuucugauauccggaaagggcauuggaaaaacgucaauuggccuuauaugugugguugcuagcucugggaugcucuggauggccgaugugccauuacaauggauugcaagugcaauugugcuagaguucuuuaugaugguccuauuaauaccagaaccagaaaaacaacgaacaccacaagacaaucaacuagcuuacguuguaauagguauauuaacauuagcagcgauuguagcagcaaacgaaaugggacuauuggaaacaacgaaaagagaccuaggaaugagcaaagaaccaggagucguuuccccuacgagcuaucucgauguagacuugcaucccgcaagcgcguggacuuuauaugcaguagcuaccacugugaucacgccaauguuaaggcacacaauagaaaauaguacagcaaauguaucgcuagcugcaauagcaaaccaagccgugguuuugaugggauuggauaaaggauggccuauaagcaaaauggauuuaggaguuccgcuacucgcauuggguugcuacucucaaguaaacccuuuaacgcuaacagcagccguacuacuccuaguaacccacuacgcgauuauaggacccggauugcaagccaaggccacgagagaggcacagaagcgaaccgcggcaggaauaaugaagaacccgaccguugacggaaucaugacuauagaucuagauccgguaauuuaugauagcaaauucgaaaaacaauuaggccagguaauguuacugguacuaugugcaguacaauuacuacuaaugaggaccucuugggcauuuugugaggcguuaacccuugcaaccggaccaaucaccacguugugggaaggaagcccgggcaaauucuggaauacuacaaucgcagucaguauggccaauaucuuuagaggaucauauuuagcuggagcagggcuugcauuuaguauuaugaaauccguggguaccgguaaaagggggacagggucccagggagaaacauuaggugaaaaauggaaaaagaaacucaaccagcuuaguaggaaggaauuugauuuguacaagaaaagugguauaacagaaguagaucgaacugaagcuaaggaagguuuaaaacgaggggaaauaacacaucaugcagucucucggggguccgcaaaauuacaaugguuuguagaaagaaacauggucaucccagaggggcgaguuaucgaccuaggauguggaagaggcggguggaguuauuauugugcaggauugaaaaagguaacggagguacgcggauacacaaaaggagggccaggacacgaagaaccggugccgaugucuacauacggauggaacauagugaaacuaaugucgggcaaagauguuuucuauuuacccccugaaaagugcgacacgcuacuuugugacauuggagagaguucaccaagcccuacaguagaggagucaagaaccauucgaguauuaaaaaugguagaaccguggcuaaagaauaaccaguuuugcauaaaaguacuuaauccguauaugccaacaguaauagaacauuuagaacggcugcaaaggaaacacggaggaaugcuaguaagaaaccccuuaagucgaaauucuacgcaugaaauguacuggauuagcaaugggacuggaaauauuguaucgagcguuaauauggugucuagacuuuuacuaaacagauuuacuaugacacauagacgacccacaauugaaaaagauguugacuugggagcuggaacaagacauguaaaugcagaaccagaaacaccaaauauggauguuaucggagagcguauccgccgcauaaaagaagaacacagcucuaccuggcauuacgacgaugaaaauccauauaaaacaugggcauaucaugggucauacgagguaaaggcaaccggguccgcuaguaguaugauaaacggaguggucaagcuguugacaaaaccaugggauguagugccaaugguuacccaaauggcaaugacagauacaacuccauucggucaacaaagaguauucaaagagaagguagauacccgaacuccaaggccaaugccagggacaagaaaggucauggagauaacagcagaauggcuuuggcgaacacuaggacgcaauaagcgaccaagguuaugcacgagagaagaauuuaucaagaaagugcggacuaacgcagccaugggugccguauuuaccgaagaaaaucaaugggauuccgcgcgagcugcaguagaagaugaagaauuuuggaaauuaguugauagagaaagggaguuacauaaauuagguaaaugcggcagcuguguuuauaauaugauggggaaaagagagaagaaauuaggagaauuugggaaagcaaaaggauccagagcuauaugguacaugugguuaggugcgagauacuuagaauuugaagcacuuggguuucucaacgaagaucauugguuuucccgagagaauaguuacaguggggucgaaggcgaagguuuacauaagcucggauacauucuuagagauauuucaaaaauuccgggcggcgccauguacgcugaugacaccgcgggcugggauacaagaauaacagaagaugauuuacacaacgaagaaaagaucacucaacaaauggauccagagcaucgacagcuugcaaaugcuaucuuuaaauugaccuaucaaaauaaaguaguaaagguucaacggccgacuccaaaggguacagugauggauauaaucucacguaaagaucaacgcgguagcggucaaguaggaaccuaugguuuaaauaccuuuaccaacauggaagcacaguuaaucaggcagauggaaggagaaggagucuuaagcaaggcggacuuagaaaauccgcauuuacuugagaagaaaguaacucaaugguuagagaccaaaggcguagaaagguugaaacgcauggcaaucucaggcgacgauugcgucguaaaaccaauagacgauagauuugcgaaugcuuuauuagcguuaaacgauauggggaaaguuagaaaagacauuccacaauggcagccuucaaaaggguggcaugacuggcaacagguuccuuuuuguucucaccauuuccaugaauuaauuaugaaagacggcagaaaacugguggugccaugccgaccccaggacgaguugauuggacgagcccgaauaucacagggcgcagguuggagucucagagaaacagcaugucuagguaaagcauaugcgcaaaugugggcacugauguauuuucauaggcgugaucuacgacuggcaaguaaugcuauuuguucggcgguuccagugcauuggguuccaacaagucggacgacauggucaauucaugcacaccaucaguggaugacgacggaggacauguuaacuguguggaaccgaguuuggaucgaagauaacccguggauggaagacaaaacaccagucacaacuugggaagacguuccauauuuggggaaaagggaagaucaauggugcggcagcuugauaggguugacaagcagggccaccugggcucaaaauauacucacugcuauucagcagguucgaucgcuaauagguaacgaagaguucuuagauuauaugcccucaaugaaaagauuuagaaaagaagaggaaagugaaggagccauaugguaa

SEQ ID NO: 23580 - RNA, 9873 nt, Artificial Sequence
  derived and/or modified CDS sequence (opt6) from DENV-3__AY744681__SS-prME
acuucauuaugcuugaugaugaugcuuccagcaacucucgcuuuccaccuuacuucaagagauggugaaccacggaugaucguaggcaaaaaugaaagaggaaaaucucuuuuauucaaaacugcaucaggaauaaacaugugcacauuaaucgcaauggaucucggugaaaugugcgaugauacuguaacauacaaauguccauuaauuacugaaguugaaccagaagacauugauuguugguguaaccuaacaucgacgugggugacauauggaaccuguaaucaagcgggagagcauaggcgugacaaaagaucaguagcauuagcuccacacgugggaauggguuuagauacucggacacagacguggaugagugcagaaggggcauggaggcagguugaaaaagucgaaaccugggcguucagacaucccggauuuacaauacuugcauuauuuuuagcccauuacauaggaaccucacuaacccaaaaaguagucauuuuuauauuguuaaugcuuguuaccccaucuaugaccaugaggugcguaggagucggaaauagagacuuuguagaaggauuaagcggugcgacuuggguagauguuguacuugaacacggugguuguguaacuacuauggcuaaaaacaaaccaacgcuugauauagaauugcagaaaacugaagccacgcaacucgcaacacuuagaaaauuaugcaucgaaggacguauaacaaaugugacgacugauucucguuguccaacucagggugaagcuauucugccggaggaacaagaccagaacuacguauguaaacauaccuauguugauagaggaugggggaauggauguggauuauucggaaaaggcagcuuaguuaccugugccaaauuccaaugccuagaaucgauagaaggaaaagcgguacaacaugagaaucucaaauauacagucauaauuacaguucacacaggggaccaacaucaaguugguucggagacgcaaggaguaacggcagaaaucacgccacaagcaaguacuguggaagcgauauuacccgaauacggaacguuaggauuagaauguagcccacgaacagguuuagauuucaaugaaaugauccuucuuacaaugaaaaauaaagcauggaugguacaucggcaaugguucuuugaucuuccacugccauggacuucgggcgcaacaacugagacaccaacauggaauaagaaagaacuauuaguaacuuucaaaaaugcgcacgccaagaaacaagaagugguaguguuagggucacaagagggugcaaugcacaccgcacucacuggcgcaaccgaaauacaaacaucgggcggaacaaguauauuugcaggacauuuaaaaugucggcuaaaaauggauaaauuagaauugaaaggaaugucauaugcaaugugccuuaaugcuuuuguacucaagaaagaagucucugaaacccaacacggaacuauauugauuaaaguggaguacaaaggcgaagacgcuccauguaaaauuccauuuucaacugaagauggucaaggcaaagcucauaaugggcggcuuauuacagcgaauccaauaguaacuaagaaagaggaaccagugaauauugaagcagaaccaccuuuuggagaaucgaacauagucauuggcauuggcgacaaagcacucaaaauuaacugguacaagaaagggaguucaauaggaaaaauguuugaagcuacagcuagaggcgcucgccgaauggccauacugggcgacacagcaugggauuuuggaaguguugggggagucuuaaauagucuugguaaaaugguacaccaaauuuuuggaagugccuacacagccuuguuuucuggcguuucauggauaaugaaaaucgggauaggaguccuauuaaccuggaucggucuaaauuccaaaaacacaaguaugucuuucagcuguaucguuauaggaauaauuacauuauauuugggcgccgucguacaggcagauauggggugcgucaucaacuggaaagggaaagaacucaaaugugggucugguaucuuugucacgaaugaaguccauacauggaccgaacaauauaaauuccaagcugauucaccgaagcgauuggccacggcuauagcuggcgcaugggaaaaugguguaugcggcauuagaagcacaacaaggauggaaaaccuacuguggaaacaaauugccaaugaauuaaauuacauauuaugggaaaacaacauaaaguugacuaucguaguuggcgacguaauaggaguuuuagaacaaggaaaaaggacauugacaccccaaccaauggaguuaaaguacucuuggaaaacauggggaaaggccaaaauagugaccgcugagacccaaaauaguagcuuuauaauagauggaccuaauacacccgaauguccgagugcgucacgagcauggaacguaugggagguugaagauuauggauucggcguauuuacaacuaacauuuggcuuaaauuacgagagauguacacgcaacugugcgaucaucgucucaugucugcagcugucaaagaugaacgugcaguccacgcugauaugggguauuggauugagucucaaaagaacgggaguuggaaacucgaaaaagccucguugauagaagucaaaacguguaccuggccaaaaagccauacgcuuugguccaacggaguguuagagagcgauaugauaaucccaaaaaguuuagcgggcccgauaagucaacauaacuacagaccaggauaucacacacaaaccgcgggcccuuggcaccuagguaaguuagaauuagacuucaacuauugcgaggggacaacaguuguaauuacagagaauuguggaacaaggggaccgucacuucgaacuacaacagucucaggaaaacuaauucacgaaugguguugucgaucgugcacucucccaccucuacguuacaugggugaagacgggugcugguaugggauggaaauccggccaauaaacgaaaaagaggaaaauaugguaaaaucauuaguuagcgcuggaucaggcaaggcagauaauuuuaccaugggaguguuguguuuagcaaucuuguuugaagaagugaugagagguaaauucgguaagaaacauaugauagccggugcacuguuuacauuuguuuuguuacuuuccggucagauaaccuggagagauauggcgcacacacuuauaaugauugguaguaaugcaagcgaccgaaugggaaugggcguuacuuauuuagcccuaauagccacauucaaaauccaaccauuucuggcacuuggauuuuucuuacgaaaacugacaucgagagagaaucuauuguuagguguuggauuagccauggcaacgacauuacaguuacccgaagauauugagcagauggcuaacgggauagcauuaggucuuauggcucuaaaacuaauaacacaauuugagacuuaucaacucuggacugcucucguaucucuuauguguucaaacacuauauuuacgcugaccguagcauggagaacagccacuuugauuuuagccgugauuucccuuuuacccguuugucaaucaucaucuaugagaaaaacagacuggcuaccuaugacaguggcggcaaugggugugccgccacuuccacuauuuauauucucccuuaaagacacccuuaaaagaagaaguuggccccuuaacgagggugugauggcuguaggcuuagugucgauccuagcauccaguuuucugagaaacgacguaccuauggcagggccuuugguagccgguggauugcuuaucgcuuguuauguaauaaccggcacaagcgcggaccucacaguagaaaaagccgcugacguuacuugggaggaggaggcagaacaaacuggcguaagccauaauuuaaugauaacaguagacgaugacggaacuaugcgaauuaaagacgacgaaacagaaaacauuuugacaguccuacuaaaaaccgcgcuccugauaguuagcggcauuuuuccuuauaguauuccagcaacauuacuuguauggcauacuuggcaaaaacaaacccaaaggagugguguauuaugggacguaccgagcccaccagaaacucaaaaagccgaacuagaggaagguguuuaucgcauuaaacaacaagguauuuuugggaaaacacaaguuggagucggcguacaaaaagaaggaguuuuccauacaauguggcauguaacccgaggggcaguacucacgcacaacgguaaaagguuagaacccaacugggcgaauguuaagaaggauuugauaucuuauggugggggauggaaacucucagcucaauggcaaaagggggaggaaguacaggucaucgcuguggagccgggcaaaaaccccaaaaauuuucaaacaaugccagguauauuucaaacgacaacgggggaaauaggcgcaaucgcauuggauuucaaaccuggcacaagugggucacccaucauuaacagggaagguaaaguuguuggccuauauggcaacggaguuguuaccaagaauggaggauauguaaguggaauugcgcaaacaaacgccgaacccgaugggccuacaccagaauuagaagaagaaauguucaagaaacgaaaucugacaauuauggacuugcauccaggcucgggaaagacaagaaaguaccucccugcuauagucagagaagcaauuaagcgcagacuuagaacauuaauucuugcgccuacacgaguaguggcugccgaaauggaagaagcguuaaagggcuuaccuauaagauaucagacgacagcuacaaaaagcgaacauaccgguagagaaauaguugaccuaaugugccacgcgacauuuaccaugcgucuguuauccccaguacgcguuccgaacuacaacuuaauaguaauggacgaagcacauuuuacugauccagcaaguaucgcagcacgaggguauauuucaacaaggguaggaaugggggaagcugcugccauauucaugacugcuacaccuccagguacagcagaugcguuuccacaguccaaugcgccaauccaagacgaagaaagagacauuccggaacgcagcuggaacucggggaaugaauggauaaccgacuuugcgggaaaaaccguaugguuugucccgaguaucaaagcgggcaacgacauagcuaacugcuuaaggaagaacgguaagaaggucauucagcuuuccaggaagacuuucgauaccgaguaucagaaaaccaaacuuaaugauugggacuucguagucaccacggacaucagcgaaaugggagcgaauuuuaaagcugaucguguaauugacccacguagaugucuuaaaccagugauauuaacugauggaccugagagaguuaucuuggcaggcccaaugcccguaacagucgcaagugcugcacaaagacgagggcguguagguagaaauccacaaaaggagaaugaucaauauauauuuacuggucagccguuaaacaacgaugaggaucacgcacauuggacagaggcgaaaaugcuauuagacaauauuaauacucccgagggaauaauuccagcucuuuucgaaccagaaagagagaaaagcgcagcaauagauggagaauauagacuaaagggagaaucucguaaaacauuuguggaacucaugagaagaggcgaucuuccaguuuggcuugcacauaaagucgcaucagaaggaauuaaauauacagacagaaaauggugcuucgauggcgaaagaaauaaccagauacucgaagaaaauauggauguagaaauauggacgaaagaaggagagaagaagaaacugcggccgcguugguuggaugcuaggaccuauagcgauccacuagcgcugaaagaauuuaaggacuuugcggcuggucguaaaucaauugcucucgaucucguaacugaaauuggcagagugcccagccauuuagcacacaggacaagaaaugcccuggacaaccuuguuaugcuacauaccucagaacauggaggacgugcauacagacacgcugucgaagaauuacccgaaaccauggaaacucuacuuuugcuuggacuaaugauauugcuaacaggcggugcuaugcuauuuuuaauuaguggaaaaggaaucgggaaaacaucaauaggucuuauauguguagucgcgagcaguggaaugcuuuggauggcagauguuccauuacaauggauugccagugccaucguauuggaguucuuuaugauggucuuacugauacccgagcccgagaagcaaagaacgccgcaagauaaccaguuagcuuacguagugauaggaauauuaacgcuugcagccauugucgcagcuaacgaaaugggucugcuggaaacuacaaagagggaccuuggaaugagcaaggagccuggaguggucucaccgaccuccuauuuggacguggaucuacacccagcuucagcauggacgcuauacgcuguagccacgacaguuaucaccccuauguugcgacauacaauugaaaauucaacagcuaacgugucguuagccgcaauagcaaaucaagcuguuguguuaaugggacuagacaagggguggccuaucucuaaaauggacuuggguguuccguugcuagcacuuggaugcuauagccaagucaauccauuaacgcuuacagcugcggucuuacuauuaguaacacacuacgccauaauaggucccggccuccaggcuaaagcgacacgagaagcccaaaagaggacggccgcuggaauaaugaaaaaucccacaguagaugggauaaugaccauagaccuugauccugucauauaugacucuaaguucgagaaacaacucggucaaguaauguuauuaguccugugcgcaguccagcuccuccugaugagaacaucgugggcauucugugaggccuuaacccuugcaaccggcccaauaacaacguuaugggaagggaguccuggaaaguucuggaauacaacuauugcuguaaguauggcaaacauauucagggguaguuaccuagcgggugcaggauuagcguuuucgauaaugaagucuguaggaacagguaagcgcggcaccggaagucaaggggaaacgcuaggugaaaaauggaagaagaaacugaaucagcuuucacguaaagaauuugaucucuauaaaaagagugguauaacugaaguagacagaaccgaagcaaaagaaggccuaaaaagaggugagauuacacaucaugcaguauccagaggguccgcaaaauuacaaugguuuguugagagaaauaugguuauucccgaggguagggucaucgaccuuggcugcggaagaggugguuggucguacuacugugccggacuaaagaaaguaacagaaguaagaggauauacaaagggcggacccggccacgaagaaccaguccccaugagcacuuauggauggaauauagucaaauuaaugaguggaaaggacguauuuuauuuaccacccgagaaaugugacaccuuguuaugcgacauaggugaauccucuccaucaccaacggucgaagaaucuaggacgauaaggguguugaaaaugguugaaccauggcucaaaaacaaucaauuuugcaucaaaguucuaaauccauauaugccuacugugaucgaacaccuugaaagauuacaaagaaaacacggggguaugcuuguacggaauccccuuucuagaaacucgacccacgaaauguacuggauaagcaaugguaccggcaauauuguuucgagugucaauauggucucgagacugcuuuugaacagauucaccaugacccaucgucguccaaccauugaaaaagacguagacuugggggcgggaacaagacauguaaaugcugaaccugaaacgccaaauauggaugugauaggggaacggauucguagaaucaaagaagaacauagcucaacguggcacuaugacgaugaaaaccccuauaagacaugggcuuaucauggaagcuaugagguaaaagcaacugguagugcaucuaguaugauuaacggagucgugaaguuacucacaaaaccaugggacgucgugcccaugguaacucaaauggcuaugacagacacaacgcccuuuggacaacaacggguauucaaagagaaaguagauacuagaacgccgagaccaaugccaggcaccagaaaggucauggagauaacagcagagugguuauggcggacuuugggcagaaacaaaagaccuagguuauguaccagagaagaguucauuaagaaaguacguacgaaugcggcgaugggggcagucuucacagaagaaaaucaaugggacuccgcgagggccgcuguggaagaugaggaguucuggaaguugguagauagagaaagagaauuacacaaacuaggaaaauguggaaguuguguguauaauaugauggggaaacgagagaagaaauuaggugaguucggaaaagccaaaggaagcagggcaauaugguauauguggcucggagcaagauauuuagaguucgaagcguuagguuuucucaaugaggaucacugguucucaagggaaaacaguuauucgggaguugaaggagaaggauuacacaaacucggauauauacuuagagacauuucaaagauuccggguggggcgauguaugcggaugauacagcugguugggacacaagaauuaccgaggaugaucuucauaaugaagagaaaauaacucaacagauggacccagaacaccgucgucuugccaaugcaauuuuuaaauuaaccuaccaaaauaaagucguuaaagugcaacgaccaacaccgaaagggacagugauggauauaauuucaagaaaagaucaaagaggguccgggcaagugggaacguacgggcuuaauacauucacaaauauggaggcacaacuaauaagacaaauggaaggcgagggaguauuauccaaagcagaucuagaaaauccucacuuguuagaaaagaaagugacucaguggcuugaaacgaaaggaguggaacgauugaaaagaauggcgauaucuggcgacgauugcguaguuaagccuauagacgaucgauucgcaaacgcacuccuagcuuugaaugacaugggcaagguucgaaaggauauaccgcaauggcaaccaaguaaaggcuggcaugauuggcaacaagugccauuuuguucucaccauuuccaugaauuaauaaugaaagaugggcgcaaauuaguaguaccuugcagaccgcaggaugaguuaaucggacgugcacguauaucacaaggagcuggauggagcuuaagagaaacagcaugccuagggaaggccuacgcgcaaaugugggcauugauguauuuucaucgaagggaucugagguuggccuccaacgcaauauguuccgcaguuccaguucauuggguaccuacuucgcguacaacguggagcauacacgcucaccaucaguggaugacgaccgaggacauguuaacuguuuggaacaggguauggauagaagacaauccauggauggaggauaaaacccccguaacaacgugggaagauguuccguaccuagggaaacgcgaagaucaauggugugggucacuuauuggauuaacaaguagggccacuugggcucaaaacauucuaacggcuauacaacaaguuagaagccuaauuggcaacgaagaauuuuuagauuauaugccaucuaugaagagauuucgaaaagaagaagaaagugagggagcaauaugguaa

SEQ ID NO: 23581 - RNA, 9873 nt, Artificial Sequence
  derived and/or modified CDS sequence (opt6) from DENV-3__AY744682__SS-prME
acgaguuuaugucuaaugaugaugcuaccagcgacucuggcguuucaccuuacaagcagagauggcgaaccucgaaugaucguaggcaaaaaugaaagagguaaaagucuguuauuuaagaccgcauccggcauaaacauguguacacuaauagcaauggauuuaggggaaaugugugaugauacagugacguauaaauguccauuaauaacagaagucgaaccagaagauauugacuguugguguaaucuaacaaguacaugggugacauauggcacaugcaaccaagcaggagaacaucggcgggauaaacguaguguggcucuugcaccccauguugguaugggacuagacacacguacgcaaacauggaugagcgcagaaggugcauggcgccaaguugaaaaaguagaaacaugggcguucagacaccccggcuuuacuauauuggcauuauuccuugcccacuauauaggaacaagucucacucaaaaaguaguuauauucauucuacugaugcuaguaacaccgagcaugacgaugcggugcgugggcgugggaaauagagacuucgucgaagguuuaucgggcgccaccuggguugacguagucuuagagcauggaggguguguuacaacaauggccaaaaauaaaccaacucuagauauagaauuacagaaaacggaggcaacccaauuagcuacacuaagaaaacucuguaucgaaggaaaaauaacaaauguaacgaccgauucccguugccccacacaaggagaagccauucuaccagaagaacaagaucagaauuacguuugcaaacauacuuauguugaccgaggauggggcaacggcugcgguuuauuugguaaaggaucacuggugacgugcgcaaaguuucaaugucuagaaucaauugaaggaaaagcaguccaacaugaaaaccucaaauauacagucaccauaacuguacacaccggcgaccagcaccaagucgggaacgaaacacaaggagugacagcggagauuacuccgcaagcaucaaccguggaagcaauccuaccugaguaugguaccuuggguuuggaauguagcccaaggacaggcuuagacuucaaugaaaugauacuguuaaccaugaagaauaaagccuggaugguucaccggcagugguucuuugauuuaccguugccauggacuagcggcgcaaccacggagacaccgacuuggaauaagaaagagcuccuuguaacuuucaaaaacgcucaugcgaagaagcaggaaguggugguauuagggagucaagagggugcaaugcacacagcauuaacaggagcaacagaaauacaaacgucgggcgguacaaguauuuuugccggccaccuaaagugcagauugaagauggauaaacuagaguugaaggguaugagcuacgcuauguguuuaaacgcauucguccugaagaaagagguaucagaaacgcagcauggaacaauuuuaauaaaaguugaguacaaaggcgaagaugcuccguguaagauuccguuuaguacagaggauggacaggguaaagcacauaacggacgucuaauaacagcuaauccgauugugacuaagaaagaagaaccagucaacauagaagccgaaccuccauucggugaaucuaauauuguaauuggcauaggugacaaagcucuaaaaauaaauugguacaagaaaggauccucaauugggaaaauguuugaggcaacggcacgaggugcccgccgaauggccauacucggagauacagcaugggauuucgguaguguaggugggguauuaaauucccucgguaaaaugguucaccaaauauuuggaagugccuauacugcccuauuuucgggagucagcuggaucaugaaaauaggaaucgguguucugcuuaccuggauagggcuaaauagcaaaaacaccucaaugucuuuuucauguauaguuauagggauaauaacuuuauauuuaggcgcuguaguucaagcggacaugggauguguuauaaauuggaaagguaaggaacuaaaaugugguagcggaaucuucgugaccaaugaaguacacaccuggacagagcaauacaaauuucaagccgacucaccaaaaagacuagcaacugcaauagcgggugcuugggaaaauggaguaugugguauuagaucgacuacgcgaauggaaaaucuacuauggaagcaaauagcaaaugaacuuaacuacauauuaugggaaaacaauaucaaguuaacgauagucguuggggauguaauaggaguucuagaacaagggaaaagaacucuuaccccgcagcccauggagcuaaaauauucauggaaaacuuggggaaaagcgaaaauaguuacugcagaaacucaaaauucuucauuuauuauagacgggccuaacacuccagagugcccuucagcaucucgugcguggaauguuugggagguagaagacuaugguuuuggggucuuuacaacaaauauauggcugaaauuaagggaaguauauacucaacugugugaucaucggcuaauguccgcugcuguaaaagaugaacgagccguacacgcagauaugggguauuggaucgaaagucagaaaaacgggucauggaaacuagaaaaagccucacuaaucgaaguaaaaacguguacguggccuaagucgcacacacuuuggucaaacggagugcuugaaucugauaugauaauaccaaaguccuuagcuggcccuauaucgcagcauaacuaucgaccaggcuaucacacccagacagccggaccauggcaucuagguaaacuggaacuagauuucaauuauugcgaagggacaacaguagucaucacagagaacugugguacacgcggaccaagccuacggacuacgacagucuccgggaaguuaauacacgagugguguugucguaguuguacacugccaccguuaagguacaugggugaagacgguuguugguaugguauggaaauaagaccaauaaacgagaaagaagaaaacauggucaaauccuuaguaagugcaggaagcggcaaagcggacaauuuuacuaugggcgugcucugucuggcaauccuauuugaagaagucaugagaggcaaauuuggcaagaaacauaugauuagcggugcgcuguuuaccuucguauuacuacuaucagggcaaaucaccuggcgggacauggcgcacacacuaauaaugauugggucuaaugccagugauagaauggggaugggaguaacauauuuagcauuaauagcaacauucaaaauacaaccauuccuagcacuugguuucuuuuugagaaaauuaacaucuagggaaaauuuacuuuuagguguugguuuagcaauggcuacaacacugcaacuuccagaagauaucgaacaaauggcaaauggcaucgcucuaggucucauggcgcuaaaacuaauaacgcaauuugaaacguaucagcuauggacagcacuuguaucacugaugugcaguaacacuauauuuacucugacaguugcauggcggacugcaacacucauacucgcugucaucucucuuuugcccguaugucaaucuucuuccaugaggaaaacggacuggcuccccaugacugucgcagcgaugggaguaccaccucugccccuauucaucuuuagccuaaaagauacacuaaaacgcagaaguuggccguugaacgaaggagucauggcuguuggauuagucucgauccuugcaucaucauucuuaagaaaugacguaccgauggcgggaccuuugguagcggguggccuauugauagccuguuaugugauaacugggacaucugcugaucugacuguugaaaaggcagcggauguaacuugggaagaggaagcggaacaaacaggaguuucucacaaucuaaugaucacuguagacgacgaugggacgaugcgcauuaaagacgaugaaacagaaaauaucuuaacaguacuacuaaaaacagcacuacuaauuguauccggaauauucccauauucaaucccugcaacguuguuaguuuggcauacauggcagaagcaaacacaacgaucuggcguacugugggaugugccgagucccccugaaacgcaaaaagcagaauuagaagaggguguauaccggauaaagcaacaagguauauucgguaaaacacaaguuggcgucggaguccaaaaagaaggaguguuccauacuauguggcauguuacacgaggcgcgguacuaacacauaacggcaaacgcuuagaaccaaacugggcgaacguuaagaaagauuugauuucauauggagguggguggaaacuuucugcucaguggcaaaagggagaggaaguacaaguaauagcggucgagcccggaaagaauccgaaaaacuuucagaccaugccagguauauuucaaaccaccacuggagaaaucggagcgauagcucuugauuucaaaccuggaacgucagguucccccaucauaaaucgugaaggaaaagucguaggccuauacgggaauggagucguaaccaaaaacgggggauacguaaguggaauugcacaaaccaacgcagaaccagaugggccaaccccagaacuagaagaagaaauguuuaagaaacgaaacuuaacaauaauggaccuucauccagguucugguaaaacucgaaaauaccuuccggcuauaguccgcgaggcaauaaaacgaagguuaaggacucugauucuagcacccacgcgaguaguugccgcugaaauggaagaggcccuuaaaggacuaccgauuagguaucaaacuaccgccacaaaaucggaacauacaggucgugaaauuguugaucuaaugugccaugccacauucacaaugaggcuacuaucgccuguaagagucccgaauuacaauuuaauugucauggaugaagcacacuuuaccgauccagcuucuaucgcggcgaggggguauauaagcacacgaguaggcaugggggaagcagcagcuauauucaugacugccacuccuccaggaacugcagaugcauuuccacagucaaaugcaccaauucaagaugaagaaagagacauuccugaaagaucauggaauaguggcaacgaauggauaacagauuucgcaggcaaaacaguaugguucguuccaaguauaaaagcaggaaacgauaucgcgaauugucuuaggaaaaacggcaagaaaguuauacaacuaaguagaaaaacguucgacacugaguaccagaaaacuaaauugaacgauugggacuucguaguaacgaccgauaucucagaaaugggagcaaacuucaaagcagaucggguaauagacccuagaaggugccuaaaaccugucauacugacugauggucccgaacguguaauuuuggcaggcccaaugcccguaacaguugcgucagcagcgcagcggcgcggucgcguggguagaaacccacaaaaagagaacgaucaauacaucuucacuggacaaccacuaaacaaugaugaagaccaugcucauuggacagaagcuaaaauguuauuagauaauaucaacacgccagagggcaucauaccagcauuguuugaaccagaacgcgagaaaagugcggcuauagacggggaauaucgguuaaaaggcgaaagucgaaaaacauuuguagaacuaaugagacggggagacuuaccuguuuggcuggcacacaagguagcaucggaaggaaucaaauauacagacagaaaaugguguuuugauggagagaggaauaaucaaauuuuagaagaaaauauggauguugaaauauggacaaaagaaggggagaagaagaaauuacguccgagauggcuagacgcucgcaccuacuccgauccacuugccuugaaagaguucaaggauuucgcugcugguagaaaaaguauugcauuagacuugguaacagaaaucgguagagucccuucacauuuggcucaccgaacgcguaacgccuuagauaacuugguuauguuacauacgagugagcacggggguagagcguaccgucacgcuguagaagaguugccugaaacaauggaaacguuauuacuucuuggguuaaugauauuacuuacgggaggcgcaaugcuauuuuugauuagugguaaagggaucggcaaaaccucaauagguuuaauuuguguaguggcaagcaguggaauguuguggauggcagacguuccauuacaauggauugcuucggcaauaguccuugaguucuuuaugaugguguuauuaaucccagaaccagaaaagcagcgaacuccucaagacaaccaauuagcauauguagucauagggauccucacccuagcugcaauaguggcugcgaaugaaauggguuuauuggaaaccacaaaaagagacuuaggcauguccaaagaaccggguguaguuucaccuacuucuuaucuagauguggauuuacaucccgcgagugcauggacgcuuuaugcuguugccacuaccgucauaaccccuaugcuacgccacacaauagaaaacucuacugcaaacguuagucuagcagcaaucgcgaaccaagcggugguacuaaugggauuagauaaagguuggccaauuucgaaaauggauuugggcguaccguuacuagcguuaggaugcuauagucagguuaacccauuaacuuuaacugcagcuguucuauuacuuguaacacauuaugcaauuauuggaccuggcuugcaggccaaggcuacacgcgaagcacaaaaacgcacagcagcugggaucaugaaaaauccaaccguggacggaauaaugacgauugacuuagauccgguuauuuaugacaguaaauuugaaaaacaacucggacaaguaaugcuacuggucuuaugcgccguacaauuacuucucaugaggacgucaugggcuuucugcgaagcgcucacauuggcaacaggaccuauuacuacuuuaugggaagguaguccagguaaauucuggaacacuacgauugcaguuucaauggcuaauauauuuagggggucauacuuagcaggagcaggucucgcauucaguauaaugaaauccguuggaacgggaaaaagagggacaggaucacaaggggagacucuaggcgaaaaguggaagaagaaacuaaaucaacuaucaagaaaagaauuugauuuauacaagaaaucuggaauaacugagguugauagaacugaagcuaaagaaggacuaaaaagaggagaaauaacacaccaugccguaagucgaggaagugccaaacuucaaugguuugucgagaggaacaugguuauaccggaagggaggguaaucgaccugggauguggaagaggagguuggucguacuauugcgccggauuaaagaaaguaacggaaguuaggggauauacuaaaggcgguccugggcaugaagaaccagugccaaugagcaccuaugguuggaauaucguuaaauuaaugucugguaaagauguauuuuauuuacccccugaaaagugugauacacuucuaugcgauaucggugaaucuucaccaucuccgacaguugaagaaaguaggacaauaagaguacugaaaaugguggaaccuugguuaaagaacaaucaguucuguauaaaagugcuaaacccauauaugcccacagucauagaacaucuagaaaggcuacaaaggaagcacggaggcaugcugguaagaaacccacuuucacgaaauuccacacacgagauguacuggauaucuaauggaaccgguaacauuguaucuagcgucaacaugguuucgcggcuacugcucaauagguuuacaaugacccauagacgaccgacaauagaaaaggaugucgacuuaggcgcagguaccagacauguaaaugcggaacccgagacaccgaacauggaugugaucggagaaaggauucguagaauuaaggaagaacacucaucaacuuggcacuaugacgaugagaauccuuauaaaaccugggcguaccaugggucuuaugaagugaaagccacaggaucugcaucuagcaugauaaacgggguagugaaauugcucacaaaaccuugggauguagugccgaugguaacacaaauggcaaugacagauacaaccccuuuuggccaacaacgaguguuuaaggagaaagucgauaccaggacuccaagaccgaugccuggaacgaggaaagugauggaaauaacagcugaauggcuauggcgaacgcuaggucgaaauaaacguccuagacugugcacacgagaagaguuuauaaagaaaguucgcacuaaugcugcuaugggagcaguguucacagaggagaaccagugggacagugcacgagcagccguugaagaugaggaauuuuggaaacugguugauagagaaagggaacuucacaaauuaggaaagugcggaucaugcguauacaauaugaugggaaaacgugagaagaaacuaggugaguucggaaaagcgaaagguagcagggcuauaugguauauguggcuuggcgcucgauauuuagaguucgaagcccuaggauuucuuaaugaagaccauugguuuucuagagaaaauucauauucgggaguugagggcgaaggacuacauaaacuuggauauauauuaagagauaucucaaaaauuccgggaggugcuauguacgcagacgauacugcaggaugggauacccgaauuacagaagaugaccugcacaaugaagagaaaauaacucagcaaauggauccugaacacagacaacuugcaaaugccauauuuaaauugaccuaucagaacaaaguuguuaaaguccaacgacccacuccuaaaggaacugucauggacauaauaagucgaaaagaucaacgugggucuggucaagugggcacuuauggccucaauacuuuuacuaacauggaagcacaacuaauaaggcaaauggaaggagaaggggugcuaucaaaagcugauuuagaaaacccuuaucugcuagaaaagaaaguuacucaaugguuagaaacuaaaggagucgaaaggcuuaaacgcauggcaauuagcggcgacgacugcguaguuaaaccaauagacgacagauucgcuaacgcacuuuuagcauuaaaugauaugggaaaggucaggaaagauauuccgcaguggcaaccgaguaaaggauggcaugauuggcaacagguaccuuuuuguucacaccauuuucaugaauuaaucaugaaagauggaagaaaguuagucgugccuuguagaccacaagaugaacuaauagggagagcccguauuucucaaggugccggcuggagccuaagagaaacagcuugccuaggaaaagcauaugcacaaaugugggcgcugauguauuuucacagacgagacuuaagacuagcaagcaaugcaauuuguagcgcugucccgguacauuggguaccuacgagccgaacuacgugguccauacacgcucaucaccaauggaugaccacugaggauaugcuuacagucuggaauagaguuuggauagaagauaacccuuggauggaggauaaaacgccaguaaccacaugggaggacgugcccuaccucggaaaaagagaagaccaauggugcggaagccuuauaggccuuaccaguagggcuaccugggcucaaaauauauuaacugccauacaacaaguaaggaguuugauuggaaaugaggaauuucucgauuacaugccaaguaugaagagauuuagaaaagaggaagaaucggagggcgcaauuugguaa

SEQ ID NO: 23582 - RNA, 9873 nt, Artificial Sequence
  derived and/or modified CDS sequence (opt6) from DENV-3__AY744683__SS-prME
acuucgcuaugucuaaugaugauguuacccgcuaccuuagcauuucauuugacgucacgagauggugaaccucgaaugauaguaggcaaaaacgaacguggaaaaaguuuguuauuuaaaacugcaucagguauuaacauguguacguuaauagcaauggauuugggagaaaugugcgaugauacugucacguauaaaugucccuuaauaaccgaaguggagcccgaagacauugacuguugguguaaccuuacuagcacauggguuacuuaugguaccuguaaucaagcaggggaacaucggagagacaaacgcagcguagcccuagcaccgcacgugggaaugggucuugauacaagaacgcaaacguggaugagugcagaaggagcuuggcgacaaguugaaaaagucgagacgugggcuuuuagacaccccgguuuuacuauacuagcacuauuucuggcacauuauauuggcaccucauugacacaaaaaguaguuauuuuuauuuuacuaaugcugguaaccccgaguaugacaaugcgcuguguagguguagggaacagagacuucguugaagguuuauccggcgcaacuuggguagauguaguacuugaacauggugguuguguaaccacaauggcuaaaaacaaaccgacacuugacaucgaauugcagaaaacggaagcaacacaauuagccacauuacgcaaauugugcauagagggaaaaauuacuaaugugacgacagauucgcguugcccaacucaaggggaagcgauacucccggaagaacaagaucaaaauuauguguguaaacacacguacguagaucgaggcuggggaaauggaugcggauuauuugggaaaggaagucuagucacuugugcaaaauuucaauguuuagaaucaauugaaggaaaagccguacaacaugagaaucuaaaauacaccgugaucauaacuguccacacuggagaucaacaucaaguaggaaaugagacacagggaguuaccgcagaaaucacuccacaggcuucaacuguagaggcgauacuaccugaauacgggacgcucggucuugaauguagcccgaggacgggccuagacuuuaaugagaugauucuuuuaacuaugaaaaauaaagccuggauggugcaucgacaaugguuuuucgauuuaccacugccguggacaucaggggcgacuacagaaaccccaacuuggaauaagaaagaauuguuaguuacauuuaaaaaugcgcaugccaagaaacaagaaguaguaguauuagguagucaagaaggagcaaugcacacagcucuuaccggggcaacagagauacaaaccuccgguggaaccagcaucuucgccggacaucugaaaugucgauuaaaaauggacaaauuagaguugaaaggaaugaguuaugcuauguguuuaaaugcuuucguguuaaagaaagaaguaagcgaaacacaacaugguacgauauuaauuaaaguagaguauaaaggggaggacgcaccauguaaaauucccuuuucgaccgaggauggacagggcaaagcgcauaauggacgucucauaacagccaacccuaucguaacaaagaaagaagaacccguaaacauugaggcggaaccuccuuuuggcgaaaguaacauaguuauaggaauaggggauaaagcauugaaaaucaacugguacaagaaagggucaucaauuggaaaaauguuugaagcaacagccaggggcgcacgaaggauggcuauucucggugacaccgcgugggacuucggaagcguaggaggaguacuaaauucauuagggaaaaugguacaucagauauuuggaucugcauacacugcacuuuucagcggcguaucguggauaaugaaaaucggaauaggcguacuacuaacauggauaggacugaacagcaaaaauacaucgaugagcuucucuuguauagugauagggauaauaacgcuauacuuaggagcaguagugcaagcagacaugggauguguaauuaacuggaaaggcaaagaacuuaaauguggauccggaauauuuguuacaaacgaaguucacacauggacugaacaauauaaauuccaagcagacagcccuaaacggcuugcuaccgcaaucgccggugcaugggagaaugggguaugcggcauacgauccacaaccaggauggagaauuuacuauggaaacaaauagcaaacgaacuaaacuacauauuaugggaaaauaauauaaaacuaacuaucgucguaggggauguaauaggagugcuugaacaggggaaacggacuuuaacgccacaaccuauggaacuaaaauauucuuggaaaacaugggguaaagcuaaaauuguuacugcggaaacacaaaauucuucauucauuauagaugguccaaacacgccugaaugccccucugccagccgugcauggaauguuugggagguagaagacuauggauuuggagucuuuaccacaaauauauggcuaaaacuaagggaaauguacacacaacucugugaucaccgcuuaaugucagcugcuguaaaagaugagagagcaguacaugcagacaugggcuauuggauagagucacagaaaaaugguaguuggaaauuggaaaaagcuaguuuaauagaagucaaaacauguacuuggccaaaaagucauacgcuauggagcaauggcguauuagagucggauaugauaauaccuaaaucuuuggcggggccuauaucacagcacaauuacagaccuggauaucacacucaaacagcggguccuuggcaucucgggaaauuggaacuagacuucaauuauugcgaaggcacaacaguuguaauuacggaaaacuguggcacaagaggcccgagucuucgaacuacuaccguaucagguaaauuaauacacgaaugguguuguaggaguugcacacuaccaccacugcgauauaugggcgaagauggguguugguacggaauggaaauuaggccuaucaacgaaaaagaagagaacaugguaaaaucgcuaguaucggcaggaucagggaaagcagacaauuucacaaugggaguuuuaugccuugcuaucuuguuugaggagguuaugagaggaaaauucggcaagaaacauaugaucgccggugcacuauuuaccuucguacuacuuuuauccggacaaaucacuuggagagauauggcccauaccuuaaucaugauaggcucuaacgcuucagaucgaauggguaugggcguuaccuauuuggcacuaauugcuacauuuaaaauucaaccauuucuugcucuuggauuuuuccuacgaaaauugacgucucgagaaaaccuacuucuaggagucggucuugcgauggcuacgacccuacaacugccagaggauauagagcaaauggcaaauggaaucgcacuaggucucauggccuuaaaacucauaacacaauucgaaaccuaccaacuguggaccgcauugguguccuugauguguuccaauacaaucuuuacacucacaguagcauggaggacagcgacacuaauauuagccguuauaucccuauugcccgugugccagaguagcaguaugagaaaaacggauuggcuaccaaugaccguggcugcgaugggagugccaccguugccccucuuuauauuuucucucaaagacacacuuaaacggcgcaguuggccguugaacgaaggaguaauggcaguaggccucguauccaucuuagccagcaguuuucuucgcaaugaugucccaauggccggaccccuuguugcuggagguuuguuaauagccuguuacguaauaacaggcacgucagccgauuuaaccgucgaaaaagcagcagacguaacuugggaggaagaagcggaacaaacaggaguuucucacaauuuaaugauaacuguggaugacgauggcaccaugagaauuaaagacgacgaaacagaaaauauacuaacuguucuacuuaaaaccgcacuauuaaucgucucugguauauuuccauacucgauaccggccacccuacugguuuggcacacuuggcaaaaacaaacgcaacgcaguggaguacucugggaugucccuaguccacccgaaacacaaaaagcggaauuagaagaaggaguuuauagaauaaagcaacaagggauuuucggaaaaacucaaguaggcgucgggguucaaaaggaagggguauuccauaccauguggcacguaacaagaggagcagucuuaacacacaaugggaaaagacuagaaccgaauugggcaaacgucaagaaagaccuuauuagcuacggaggcggcuggaaauuaagugcacaauggcaaaaaggagaagaaguacaaguuauugcaguggaaccagggaagaacccgaaaaauuuucaaacaaugccgggaauauuucaaacgacgacaggcgaaauuggugcuauagcguuagauuuuaaaccagguacuagcgggaguccgauuauaaaucgugaaggaaaaguuguaggacuauacgggaauggggucguaacaaagaacggcgguuacguuagcggaauugcucagacuaaugcugaaccagacggaccaaccccugaauuggaagaagaaauguuuaaaaagagaaaucuaacaaucauggaccuucacccagguucugggaaaacgaggaaauaucugccagcaaucguaagagaagcaauaaaacgaagacuucgcacacugauauuagcuccuacuagaguagucgcagcagaaauggaagaggcuuuaaaaggacucccuauaagguaccaaacaacagcuacaaaaagugaacauaccggucgagaaauaguugaucuuaugugccacgcuacauuuacaaugaggcuucuaaguccaguccgagucccuaauuauaaccucauaguuauggacgaggcccacuuuacugaucccgcaagcauagcugcacgagguuauauuagcaccagaguaggaaugggugaagcagccgccauauucaugacggcaacaccacccgguacagcugacgcuuuuccacagagcaaugcaccaauccaagacgaagaaagagauauaccggaaagguccuggaacucuggaaacgaauggauaacggauuucgccggaaaaaccgugugguuuguccccucuauaaaagcaggcaacgacauagcaaauugucugcguaaaaacggaaagaaggugauacaauuaagcagaaaaacauuugauacggaauaucagaagacaaaauuaaaugauugggauuuuguaguaacaacagauauaucagaaaugggagcaaacuuuaaagcagacagagucauugauccgaggaggugcuuaaaaccagugauauuaacagaugggcccgagagaguuauacuugcugguccaaugccuguuaccguugccagugcugcgcaaaggaggggaagaguaggaagaaacccccagaaagaaaacgaucaauauauauucaccggccagccucuuaacaaugacgaggaccacgcacauuggaccgaagcaaaaaugcuuuuagauaauauaaauacuccugaagguauuauacccgcccuguucgagccggagcgugagaagagugcagcuauugauggugaguaucgacugaaaggcgaaagucgaaagacauucgucgaauuaaugcguagaggagauuuaccgguauggcucgcucacaagguagcgucggaggguauuaaauauacagaucgcaaaugguguuucgacggugaacguaauaaucaaauucucgaagaaaauauggacguugaaauauggacuaaagaaggagagaagaagaaacuucgcccgcggugguuagaugcaagaacauauuccgacccgcuagcuuugaaggaauuuaaagacuuugcggcagggcguaaaucgauugcucuggaucugguaacugagauugguaggguaccuucucaucuugcacaccgaaccaggaacgcacucgacaaucuagucaugcuucauaccucagagcauggugggcgggcauaucgucaugcagucgaagaacuuccggaaacuauggaaacucuuuugcuauuaggguuaaugauacucuuaaccgguggagcuauguuauuuuugaucaguggcaaaggaauaggaaaaacaaguaucggauuaauaugcguaguagccagcucaggaaugcuauggauggcggauguaccgcuccaguggauagcgucagccauaguauuggaguucuuuaugaugguauuacuaauaccugaaccggaaaagcaaagaacuccucaagauaaccaacuagcauauguuguaauaggcauauugacacuggcagcuauaguagcagcaaaugaaaugggucuacuugagacgacaaaaagagacuuaggcaugagcaaggaaccagggguaguuagccccacaagcuauuuagacguagaccuucauccugcaucugcauggacucuuuaugcugucgcaacgacgguuauaacucccauguuacgucauacaaucgagaauagcacugcaaauguaagucuggcagcuaucgcaaaccaagcuguaguucuaauggggcuagacaaaggguggccuauuucgaaaauggaucuaggggugccauuguuagcguuaggaugcuauucucaaguaaauccgcuaacucuaacugcugccguauugcuucugguaacgcauuaugcgauuauagguccgggucuacaggcaaaggcaaccagggaagcacagaaaagaacggcagccggaauuaugaagaaccccaccguggauggaaucaugacgauagacuuagacccggugauuuacgauaguaaauuugaaaaacaacugggucagguuaugcucuuaguauuaugugcaguccaauuauuacucaugcguacaagcugggccuuuugcgaagcauuaacccuagcuacaggcccuaucacgacauugugggaaggauccccaggcaaauucuggaauacgacaauugcugucuccauggcaaacauuuuuagaggaucuuaccuagccggagcaggucuugcguucucgaucaugaaaagcgucggaaccggcaaacgaggaacuggaagccaaggugaaacauugggcgaaaaguggaagaagaaacuuaaccaacuaucgcguaaagaauuugaccuauacaagaaaucggggauuacagaagucgauagaacggaagcgaaagaaggguuaaaacguggagaaauuacacaccaugcggugaguagaggaagugcaaaauugcaaugguucguugaaaggaauauggugauaccggaggggagaguaauagacuuagguuguggacguggagguuggaguuacuacugugcuggucugaaaaagguuacggagguucgaggauauacuaaagggggaccaggccaugaagaacccguaccuaugucgacuuacgguuggaauauaguuaaacucaugucagggaaagaugucuucuacuuaccacccgaaaaaugugauacccuucuaugugauauuggugaauccucaccaaguccaacggucgaggaaagccgaacaauccgaguguuaaaaaugguugaaccgugguugaaaaauaaucaauuuuguauuaagguacuaaacccauauaugccgacuguaauagaacaccuagaacgauugcaaagaaagcacggggguaugcuuguaagaaauccauuaaguagaaauucgacacaugaaauguauuggauuucgaauggaaccggcaacauagugucgucuguaaauauggugucaagguuacuauuaaauagauuuacuaugacccauagaagaccaacuauugagaaggauguugauuuaggagcuggaacuagacaugugaacgcagaaccagaaacaccaaauauggacguaauuggagaacguaucagacggauuaaagaggaacacagcucaacguggcauuacgaugacgaaaauccauacaaaacaugggcauaccauggaaguuaugaaguuaaagcuacggggagugccucgucaaugauaaacgguguaguuaaguuguugacaaagccuugggaugucgugccgaugguuacacagauggcgaugacagauacaaccccuuuuggccagcaaagaguauucaaagagaaaguagauacacgaacuccgaggcccaugccagguacuagaaaaguuauggaaauuacugcagaguggcuauggagaacccuagggagaaacaagaggcccagauugugcacgcgcgaagaauuuaucaagaaaguuagaacuaaugcugcaaugggugcaguuuucacagaagaaaaucaaugggauuccgcaagggcagccguugaagacgaggaauuuuggaaacuggucgacagagaaagagaauuacauaaacuaggaaagugcggauccuguguauacaacaugaugggaaaaagagagaagaaauuaggugaauuuggaaaggccaaaggcagucgagcgauaugguacauguggcuaggugcaagauuuuuagaguuugaagcacucggauuuuuaaacgaagaccacugguucucaagggaaaacucauauaguggaguagaaggcgagggauuacauaagcuagguuacauauuaagggacauaucaaaaauaccaggaggagcuauguacgcagaugauacagcugguugggauacuagaauuacagaggacgauuuacacaacgaggaaaagaucacccaacagauggaucccgaacauagacagcuagcaaaugcuauauucaaacuaacauaucaaaauaaaguuguaaaaguccaaagaccaacaccaaaggguacagugauggacaucauauccagaaaagaccagcgcggaaguggacaaguugguacguauggguuaaacacuuuuacuaauauggaagcucagcuuauacgacaaauggaaggagaaggcguccugucgaaagcugauuuggaaaauccacaccuauuagagaagaaaguaacucaauggcuagaaacaaaaggaguagagagguuaaagcgaauggcuauuagcggggaugauuguguuguaaaaccgauagaugauagauuugccaacgcauuacuggcacucaacgacaugggaaaaguuagaaaagauauaccccaauggcagcccagcaaaggauggcaugauuggcaacagguuccguuuuguucgcaccacuuucaugaguugaucaugaaagacggacgaaagcuaguaguucccuguagaccucaagaugaauugaucggucgugcgagaauaagucagggcgccggguggucucucagggaaacugccuguuuagguaaagccuaugcucaaaugugggcguugauguauuuccacagaagagaucuaagacucgccagcaacgcgauuugcagugcgguaccaguucauuggguacccacgaguaggacuacuuggucgauccaugcccaccaccaauggaugacaacugaagacaugcuuaccguuuggaacagaguuuggauagaggacaacccauggauggaagacaaaacgccaguuacuacaugggaggauguaccuuacuuaggaaagcgagaggaccaguggugugggucacuuaucggcuuaacguccagagcaacuugggcucaaaacauauuaacugcgauacagcaaguaagaagccuaauuggaaacgaagaauuucuugacuauaugccuaguaugaaaagguuucgcaaggaagaagaaucggagggugcuauaugguaa

SEQ ID NO: 23583 - RNA, 9873 nt, Artificial Sequence
  derived and/or modified CDS sequence (opt6) from DENV-3__AY744684__SS-prME
acuucguugugucuaaugaugaugcuaccggcaacucuagcauuccaccuaacuucucgugacggugaaccgcguaugauaguugguaaaaaugaaagggguaaaucuuuacuauucaaaacagcgaguggaauaaauauguguacuuuaauugcaauggacuuaggcgaaaugugugacgauacuguuacuuacaaauguccauugauaacugaaguggaacccgaagacauagacuguuggugcaaccuuaccucuaccuggguuacauaugguacaugcaaccaagcaggggaacaccgaagagacaaaagauccguugcacuugcaccacauguaggaauggggcuagauacgaggacccaaacuuggaugucugcagaaggagcauggcgacaaguagaaaaaguagaaacgugggcauucagacaccccggguucacgauccuggcacuguuuuuagcgcauuacauugggacgucacuaacccaaaaaguugugaucuuuauauuauuaaugcuaguaacuccuaguaugacgaugcguuguguaggugugggcaaucgagacuuuguugaaggguuaaguggagcaacauggguggacguagugcuagaacauggaggguguguuacuacaauggcuaaaaauaaaccuacucuugacauagaauugcagaaaacugaagcgacacaauuagcuacguuacgaaaacuauguauagaaggcaaaaucacaaauguuacaacugauucuagaugccccacgcaaggcgaagcuauuuuaccugaagaacaagaccaaaauuacgucugcaaacacaccuaugucgaccgaggauggggaaaugguuguggucuauucggcaaaggcagucucgucacuugugccaaauuccaaugccuugaaucaauugaagguaaagcaguccaacaugaaaaucuuaaauauaccguaauaauaaccguacacacaggugaccagcaucaaguuggaaaugaaacacaagguguaaccgcugaaauaacuccacaggcuuccacaguagaagcgauacuaccagaguacggcacuuuagguuuagaguguucacccaggacuggauuagauuuuaaugaaaugauacuuuugacgaugaaaaauaaggcuuggaugguacaccgucaaugguucuuugauuuacccuuaccauggacaagcggagcaacuacugaaacaccaacguggaauaagaaagaacuauuagucacauuuaaaaacgcucaugccaagaaacaagaagugguuguucugggaagucaagagggggcuaugcauacagcacuaacuggugcuacggaaauacaaacuuccggaggaaccaguauuuuugcaggucauuuaaaaugccgacucaaaauggauaaacuugaacugaaaggaaugucuuaugcuaugugccuuaacgcauuuguucuuaagaaagaggugucugagacacagcauggaacaauacuaaucaaaguagaguacaaaggagaagaugcuccgugcaaaauaccauuuuccacagaagacggccaaggcaaagcacacaauggaaggcuuauuacggcaaaucccauugucaccaagaaagaagaaccagugaauauagaagcagagccuccuuuuggcgaaaguaacauaguuauaggaauuggggauaaagcucugaaaaucaauugguauaagaaagggucaaguauagguaaaauguucgaagcuacagcuaggggagcucgaagaauggccauuuuaggagauacugcgugggacuucgggaguguagguggaguucuaaauucacuagguaaaauggugcaucagaucuucgggucugcguacacugcacuauuuuccggaguaucauggauaaugaaaaucgggauaggaguauuauugacuuggauagguuuaaauagcaaaaauacaaguaugaguuucucaugcauaguuaucggaauuauaacgcuauauuuaggcgcaguuguccaagccgacauggggugugugauaaauuggaaagguaaagagcuaaaaugugguagugguaucuuugucacaaaugaaguacacaccuggaccgaacaauacaaauuccaagccgacaguccaaaaagguuggccacugcaauagcaggagcuugggaaaacgguguuuguggcauaagauccacaacgagaauggagaacuuacuguggaaacagauugcaaacgaguuaaacuacaucuuaugggagaacaauauuaaauuaacaauaguagucggugaugucauagggguucuugaacaaggcaaacguacacucacgccacagccaauggaacuaaaguauucuuggaaaacaugggguaaagccaaaauuguaacagcagagacccaaaauagcucauuuaucauagauggaccaaacacgccagaauguccaucugcaagccgagcguggaaugucugggagguugaagacuacgguuucggcguuuucacaacuaacauauggcuuaaacuaagagaaauguacacccaauuaugcgaccacaggcuuaugagugcagcaguaaaagaugaacgggcugugcaugcugauaugggauacuggaucgaaucucagaaaaaugggagcuggaagcuagagaaagcaucguuaauagagguuaaaacuuguaccuggcccaaaagccauacucuuugguccaauggaguguuggaaucagauaugauuauaccuaaaagccuagcugguccgauaucucaacauaacuacagaccaggauaccauacucaaacggcagguccauggcaucuagguaaauuagaauuagacuucaauuacugugaaggcaccaccguaguaauuacagaaaauuguggaacacgagggccaucacuuagaaccacaaccgugucagguaaauuaauucaugaaugguguugccguucauguacauuaccaccauuaagauauaugggagaggauggaugcugguaugguauggaaauccgcccaauaaaugaaaaagaagaaaacaugguaaaaagccucguaucagcaggauccggaaaagcagauaauuucacgaugggaguguuaugucuagcaauacuauucgaagaagugaugagaggaaaguuuggcaagaaacauaugaucgcgggagcgcucuuuaccuucguuuuauuacucagcggucaaauuacguggcgagacauggcacacacauugauaaugaucggaaguaacgcgucagaucggauggggauggguguaacuuaucuggcucuuauagcuacauuuaaaauucagccauuccuagcuuuggguuucuuucugagaaaguuaacaucucgcgaaaauuuacuguuagguguaggcuuagcaauggcaaccaccuuacaauuaccagaggauaucgaacaaauggccaaugguauagcccuuggacucauggcuuuaaaacuuauaacacaauucgaaaccuaucaauuauggacugccuuaguuuccuuaauguguucuaacaccaucucuacacuuacuguugcauggaggacagcaacacucauccuagcaguaauuucguuacuaccuguuugucagucaaguucgaugcguaagacagauuggcugccgaugacagucgcugcaauggggguaccaccccuaccgcuguuuaucuuuucccuuaaggacacguuaaaaaggagaucauggccacuaaaugaagggguaauggcuguagggcuaguaaguauacucgcaucaucuuucuuacgcaaugacgugcccauggcgggaccccugguagcuggaggauugcuuauagcguguuaugugauaacuggaacuagcgcggaucuaacaguugagaaagcagcugauguaacuugggaagaagaagcagaacaaacuggugucucacacaaucuuaugauaacugucgaugacgacgggacuaugcguaucaaagaugaugaaacggagaauauacuaacagugcuccuaaaaacagccuuacuuauuguuagcggaauauuuccauacucaauuccagcaacuuuacuugucuggcacaccuggcaaaaacagacccaaaggaguggaguguugugggacgucccaucaccuccagagacacaaaaagcggaacuagaagaaggcgucuauagaauaaaacaacaagguauauuuggcaaaacacaaguggggguuggaguucagaaggaaggaguuuuucacaccauguggcacgucacacgaggggcaguacucacgcacaauggaaaacgucuugaaccuaauugggcaaaugugaagaaagaccuaauauccuaugggggaggauggaaauuaagcgcacaauggcaaaaaggggaggaaguacaagugauagccgucgaacccgguaaaaaccccaaaaauuuucaaacaaugccugguauauuucagacuacaacgggugaaaucggugcaaucgcauuagauuuuaaaccagguacaagugguucacccauaauuaauagagaggggaagguagugggucuuuaugggaacgguguaguuacuaaaaaugguggauacgucucaggcauagcucaaacaaaugcggaaccagaugguccaacgccagaacuagaggaagaaauguuuaaaaagcgaaaucugaccaucauggaucuacauccuggcagcggaaagacaaggaaauauuuaccggcaauaguaagagaagccauuaaaaggcgauugcggacguuaauauuagcacccacaaggguaguagcggcggaaauggaagaggcuuugaaagggcuuccaauuagauaccaaacaacagccacaaaaucagaacauaccggucgggaaauaguagaucuuaugugucaugccacuuuuacaaugcgauuguugaguccagugagggucccuaauuauaaccuuaucguuauggaugaagcacacuuuacagauccggcaaguauagcugcaagaggauacauaucgacacgaguaggcaugggugaggcggcugcuauauuuaugacugcgacgccacccggaacagcggacgcauuuccccaaucaaaugcuccaauacaagaugaggagagagacauaccagagaggaguuggaacucagguaaugaguggaucaccgauuuugcaggaaaaaccguaugguuuguaccuagcauaaaggcugguaacgacauagccaauugucuaaggaaaaauggaaagaaagugauccaacuguccagaaagacauuugacacggaauaucagaaaacuaaacucaacgauugggauuucguugugacaacagacauaucugagaugggagcuaauuuuaaagcggacagaguaauagacccucgccgaugcuuaaagccgguuauacuuaccgauggacccgaacguguuauucuugcagggccaaugccaguuaccguugcaagcgcugcacaaagacggggacgaguugggagaaacccacaaaaagaaaaugaucaauauaucuucacaggacagccccugaauaaugacgaagaccacgcacauuggaccgaagccaagauguugcuggauaauaucaauacaccugaggggauuauuccagcacuauucgaaccagaaagagagaaauccgcugcaauugauggcgaguaccggcuaaaaggagaauccagaaaaacauucguggaacuaaugaggagaggugaccuaccaguaugguuagcucauaaaguagcuucggaaggcauaaaauauacugauagaaaaugguguuuugauggagaaagaaacaaucagauuuuagaagagaacauggaugucgaaaucuggacaaaagaaggagagaagaagaaacuaagaccacggugguuggaugcuagaacuuauucagacccucuugcucucaaagaguucaaagauuucgcagcaggaagaaaaaguauagcauuagauuuagugacagaaauaggccgaguaccuucgcaccuugcacauaggacuagaaaugcauuggauaaucucguaauguuacauacaucggaacacggcggacgggcauaccgacacgcaguugaggaacuuccagaaacaauggaaacccuacuccuauuaggccuuaugauccuacugaccggcggagcuauguuauuucuaauuucgggcaaaggcauaggaaaaacgucaaucggacucauaugugugguggcgaguagcggaauguuguggauggcggacgugccacuacaauggauagccagugcaaucguauuagaguucuucaugaugguguuguuaaucccugaacccgaaaaacaacggacgccacaagacaaucaacucgcauauguaguaauagggauuuugacacuagcagcuaucgucgcagcgaacgagaugggccucuuggaaaccacuaaaagagaccucggaaugucuaaggaacccggcguaguaucaccaaccucauaccucgaugucgaccuacacccagcaucagcauggacacucuaugcaguugcuacaacaguaauaacuccaauguuacggcacacaaucgaaaacaguacugcuaauguuucacuggcagcuauagcaaaccaagcugucguauuaaugggucuagacaaagguuggccaauuaguaaaauggauuuaggcguaccgcuauuagcacuagguuguuauagucaaguuaauccccuaacucuuacagcugcagugcuauuauuggucacccacuaugcaaucauugggccagggcuacaagcuaaagcuacucgugaagcacagaaacgaacagcggcaggcauuaugaaaaacccuacaguugauggaaucaugacaauugaucuagauccaguaauauaugauucaaaauuugaaaaacaacucggccaaguaaugcuacuuguucucugugcuguacaauuauuacuaaugcgaacuucuugggcauuuugcgaagcccucacauuggcuacuggaccaauaacuacgcugugggaagguucaccaggaaaguuuuggaacacuacaaucgcuguuaguauggccaacauauuccgaggcaguuaucuugcuggggccggauuagcauuuagcauuaugaaaucuguggggaccggcaaacguggaacaggcucacagggugagacauugggugaaaaguggaagaagaaacugaaccaacuaucuaggaaagaguucgaucuauauaagaaaucgggcauaacagaaguagaccgcacggaagcaaaggaaggacuuaaaagaggugagauaacgcaucaugcaguaaguagaggcucggccaaauuacagugguuuguagagcgaaauaugguuauaccggaagggagagucaucgauuuagguuguggcagaggugguuggaguuacuauugcgcaggucucaagaaaguuacagaagugcgaggcuacacuaagggagguccaggacaugaagaaccaguuccgaugucaacauaugguuggaacauuguaaaacuuaugaguggaaaggauguauuuuauuugccaccugaaaagugcgauacccuauuaugugauauaggggaaucgagucccaguccaacugucgaggaaagcagaacgauacgcguauuaaagaugguugagccguggcuuaaaaacaaucaguuuugcauuaaagucuuaaauccauauaugcccacuguaaucgaacacuuggaacgguuacaaaggaaacaugggggaauguuagucagaaauccauuaucaaggaacucuacacaugagauguacuggaucucuaaugguacuggaaauaucgucuccucagucaauaugguguccagacuauuacuaaaccgauucacaaugacucauaggcggccaaccauugaaaaagaugucgaccuaggugccggcacccgucacguuaaugcagaaccagaaacaccgaacauggacgugauaggugagcgcauacguagaauaaaagaggagcacucuagcacguggcauuaugacgaugaaaauccauauaaaacaugggccuaucaugggaguuaugaaguuaaagccacuggauccgcgaguucuaugaucaauggaguagugaagcuguugacgaagccaugggacguggugccuauggugacacagauggccaugaccgacacuacaccauuuggacaacaaagagucuuuaaagaaaaaguugauacgagaaccccgagaccaaugccaggaacacgaaaaguuauggaaauaacagcugagugguuguggagaacguuaggacgaaacaaaagaccccgcuugugcacaagagaagaguucaucaagaaaguaagaacaaaugcagcuaugggugcggucuucaccgaagaaaaucaaugggauucagccagagccgcaguagaagaugaagaauuuuggaagcuagucgaccgugaacgcgaacuacauaaacugggcaaaugcgguaguugcguguauaacaugaugggaaaaagagagaagaaacuaggagaguucgguaaagccaaagguucgagagcuauuugguauaugugguuaggagcuagauaccuggaauuugaagcucugggauuccuuaaugaagaccauugguuuucccgugaaaacagcuauucgggagucgaaggggaaggauuacauaaauuaggauacauauuaagagauaucucuaaaauacccggcggugcgauguacgccgaugacacugcuggaugggauacccgcauaaccgaggaugaucuacacaaugaagagaaaauuacucaacagauggauccagaacauagacagcuugcaaaugcuauuuuuaaacuuacauaucaaaacaaaguugugaaaguacagaggccgacaccgaagggcacaguuauggacaucauuucaaggaaagaucagagaggaagcggacaaguaggaacauacggucugaauacauucacaaauauggaagcacaguuaauucgacagauggagggugagggaguucuaagcaaagcagaccuugagaauccacaucuuuuagaaaagaaagucacucaaugguuagagaccaaaggcguugaacgccuaaaacgcauggcaauuucaggagaugauuguguaguuaaacccauugaugauagguuugccaacgcucuuuuggcauuaaaugauaugggaaaagugaggaaggacauuccucaauggcaaccuucgaaagguuggcacgauuggcaacaaguuccauucugcagccaucauuuucaugaauuaauaaugaaagacggccgaaaauuagugguuccgugcagaccgcaagaugaacuuauuggacgggcgagaauaucacaaggugcaggcuggucauuaagggaaacagccugucuagggaaagcauaugcacagaugugggcucucauguauuuucauagacgugaucuccguuuagccaguaacgcaauuuguuccgcagugccaguucacuggguccccacaucuaggacaacguggucaauacaugcccaccaucaauggaugacaacugaagacaugcucacaguauggaaucgaguguggauugaagauaauccauggauggaagacaaaacaccaguuacaacgugggaagauguaccuuaucuuggcaaaagagaagaucaauggugcggcaguuuaauuggccugacuucgagagcuacaugggcacaaaacauacuuacugcgauccaacaaguaagaucauugauaggaaacgaggaguuccuugacuauaugccaucaaugaaaagguuuaggaaagaagaggaaagcgaaggcgccauaugguaa

SEQ ID NO: 23584 - RNA, 9873 nt, Artificial Sequence
  derived and/or modified CDS sequence (opt6) from DENV-3__AY744685__SS-prME
accagucuaugcuuaaugaugaugcuuccagcgacucuugcauuucaucuuacuucccgcgacggagaaccacgaaugaucgugggcaaaaacgaacgagguaaaucuuugcuuuuuaaaacggcgucagguauaaauaugugcacccuaaucgcaauggaccuaggagaaaugugugaugacacaguaacuuauaaauguccauugauaacagaaguugaacccgaagacauugauugcugguguaaucuuaccuccacaugggucacauacgggacauguaaccaggcuggagaacacagaagggacaaacguaguguagcauuagccccacauguagguauggggcuugauaccaggacccaaacguggauguccgcagaaggggcauggcgucaggucgaaaaaguagagacgugggcauuuagacauccagguuuuacaauacuggcacuguuucuggcucacuauauagggacgucgcuaacgcaaaaagucguaauauuuauacugcuaaugcuaguaacaccaaguaugacuaugagauguguagggguaggaaaccgugauuuuguagaaggacuaucgggugcaacauggguagacgugguacuugagcaugguggguguguaacuacaauggcuaaaaauaaaccaacucuggauauugaacugcagaaaaccgaagcuacucaacuagcuacgcuacguaaauugugcauugaaggaaaaauaacaaacgugacaaccgacucgcgcuguccaacucaaggagaagcuauacuaccagaagaacaagaccaaaacuauguauguaaacacacuuacguugauagaggauggggaaauggaugcgggcuuuuuggcaaagggagucuaguaacaugugcgaaauuucaaugucuugaaagcauagaaggaaaagcuguacaacaugaaaaucuaaaauauacaguaauaauaacgguccacacgggagaccaacaucaaguagggaacgagaugcagggagucacagcagaaauaacuccgcaggccucuacaguugaagcuauucuacccgaauauggaacacuaggcuuagaauguagcccacgcaccggacuagauuucaaugaaaugauucuauuaacuaugaaaaacaaagcauggaugguacauaggcaaugguuuuucgacuuaccccuuccguggacuucuggagcuacuacagaaacaccaaccuggaacaagaaagaauuauuaguaaccuuuaaaaacgcacaugcgaagaaacaagagguugugguguuaggaucgcaagaaggugccaugcauacagcacuaacgggggcaacagaaauucaaacuuccggaggaacaagcaucuucgcaggacacuugaaaugccgacuaaaaauggacaaauuggaacuaaaaggcaugucguaugccaugugucucaacgcauuuguccucaagaaagaaguuuccgagacgcagcacgguacuauauuaauaaaaguugaauacaaaggugaagacgcaccuuguaaaauaccauucucaaccgaagacggucaaggaaaagcacacaacgggcgucuaauuacugcgaaucccauaguuacuaagaaagaagaacccgugaauaucgaagcagaacccccauuuggagaaucuaauaucguuauuggaauuggcgacaaggcuuuaaagauaaauugguauaagaaaggaaguucaauaggaaagauguucgaggcgacagccagaggugcacgacggauggcgauauuaggagacacugcaugggauuucggaucagugggcggaguauuaaauucacuaggaaaaaugguccaccagauuuuuggaagugcguauacagcucuauuuucaggcgugaguuggauaaugaaaauaggaauaggaguacuccucacauggauaggauuaaauucuaaaaacgcgucuaugaguuucagcuguauuguaaucggaaucauaacguuauaucugggagcuguggugcaagcagauauggguugcguaauaaauuggaagggcaaagaacuaaagugugggucugggauauuugucacaaaugagguacacacguggacagaacaguauaaauuccaggcugauucaccuaaaagguuagccacagcaaucgccggggcaugggagaacggagugugcgguauaagaucuacaacgcggauggaaaaucuguuauggaaacaaauugccaacgagcuaaauuauauuuuaugggaaaacaauauaaagcugacaauuguaguuggugauguaaucggagucuuggaacaagguaaaagaacauugacgccucagccaauggaacuaaaauauucauggaaaacauggggaaaagcaaaaauaguaacagccgaaacacaaaauagcucauuuaucauugacgggccaaauacgcccgaaugcccuagugcucuccgcgcauggaauguaugggaaguagaggauuauggauucggaguauuuacaaccaauaucugguugaaguuaagagaaaaauauacacaacuuugugaucaucgacuaaugucugcagcaguaaaagaugaaagagccguacaugcagauaugggcuauuggauagaaucgcagaaaaaugguuccuggaaauuagaaaaggcgucacuuauagaaguaaaaacuuguacauggccaaaaagccacacguuauggagcaauggaguguuagaaucagauaugaucauaccgaagagucuagcgggaccaaucucccaacauaacuaucgucccggauaccauacacaaacagccggaccguggcaucuuggaaaauuggaacuagauuuuaauuauugcgaggguacaacagugguaauaaccgaaaacugugguauucgaggacccagccugaggacaacuacuguaucagguaaacuuauacacgaaugguguugcaggagcuguacccuaccaccacuucgcuacaugggugaagauggauguugguaugguauggaaauucgaccaauaaaugaaaaagaagaaaauaugguaaaaagucucgucagugcaggaucgggcaaaacugauaacuucacaauggguguccuuugcuuagcgauuuuauuugaagaaguaaugagaggcaaauuuggcaagaaacacaugauagccggugcacuauuuacguuugugcucuuacuaagcgggcaaauaacuuggcgcgauauggcccauacguuaauaaugauuggcaguaaugcuucagaucguaugggaauggggguaacauauuuagcacuaauugcgacauuuaaaauacaaccuuucuuagcauuaggcuucuuuuuaagaaaacuaacuucgcgagaaaaucucuuauuaggaguaggucucgcaauggcaacaacguuacaacuuccagaggauauugaacaaauggcgaauggcauagcauuaggucuaauggcacugaaauuaauaacacaauuugagacauaucaguuguggacugcauugauuagcuuaauguguucuaacacuaucuuuacgcuuacagucgcauggcgaacggcaacgcugauucuggcgguaauuucacuguugccugucugucagucuucaucaaugcguaaaacugacuggcuucccaugaccgucgccgccauggguguuccuccccugccucuauucaucuuuucucuaaaagauacguuaaaacgcagaagcuggccguuaaaugagggggugauggcaguuggcuuaguaucaauuuuagcaucuucauuccucagaaaugauguaccaauggcggggccgcuuguagcaggcggucuucuaauugcuuguuacgugauaacagguacauccgcagaucuaacagucgaaaaagcugccgacgugacaugggaggaagaggcggagcaaaccggugugucacauaaucucaugauuacagucgacgaugauggcacaaugagaauuaaagaugacgaaaccgaaaacaucuuaacaguguuguugaaaaccgcacuucucauuguuagcgguauuuuuccauauaguauaccugcgacacuccuuguuuggcacacauggcagaaacaaacacaaagauccggaguacucugggacguuccaucuccacccgaaacacagaaagcagagcuagaagaagggguauauagaauuaaacaacagggaauuuuuggcaaaacacaagucgguguugggguacaaaaagaaggaguauuccauacaauguggcauguaacaaggggagccguccuaacacauaaugggaaacgccucgaacccaacugggccaacgucaagaaagauuuaauuaguuacggaggcggguggaaacuuucugcccaauggcaaaaaggugaggaaguccaaguuauugcaguugaaccaggcaaaaaccccaaaaauuuucaaacgaugccgggaauuuuucagaccaccacaggagaaauaggagcaauagcgcuggacuuuaaaccagguacaucgggaaguccaaucauuaacagagaagggaaaguugucgggcuuuacgguaacggugucgucacgaaaaauggugguuacguaagcggcauagcucaaacaaacgcggaaccagacggaccaacuccggaguuagaagaggagauguuuaagaaacgaaauuuaaccauuauggaucuacacccuggauccgggaaaacaagaaaauaucuaccagcuauuguucgugaagcuauuaaaagacgccugagaacgcuaauauuagcaccuacuagaguaguagcagccgaaauggaggaagcacugaaagggcuaccaauacgauaccaaacuaccgcgacuaaaagugaacacacggggagagaaauaguugaccugaugugucaugcaaccuuuacaaugcgacuauuaaguccaguucgaguaccgaacuauaaucuuauaguaauggacgaagcucacuuuacagacccugcaagcauagcagcccgcggauauaucaguacucggguugguaugggggaagcggcagcaauuuucaugacagcuacgccuccuggaacagccgacgcauuuccucagaguaaugcaccuauucaggacgaggaacgagauauaccagaaagauccuggaauagcggaaacgaauggaucacagauuucgcugguaaaacagugugguucguuccgaguauaaaggccgguaaugauaucgcaaauugucuuaggaaaaauggaaagaaaguaauccagcuuaguagaaaaaccuuugacacagaguaucagaaaacgaaguuaaaugauugggacuucguggugaccacugacauaucugaaaugggugcuaacuucaaagcagaucguguaauugauccacgaagaugccugaaaccaguaauucuaaccgacgggccugaaaggguaauccucgccggaccaaugccaguuacaguagcuuccgcagcacagcggagagggaggguuggacgaaacucacaaaaagaaaacgaucaauacauuuucacgggucaaccauugaacaacgaugaagaucaugcacacuggaccgaggccaaaauguuauuagacaauauaaacacuccugaaggcauaaucccagcacuauucgaaccggaacgugagaagagugccgccauagauggagaauaucgccuuaagggagagucgcgaaaaacauucguagagcuaaugcggagaggcgaucuuccggucuggcuugcgcauaaagucgcuuccgaagggauaaaauauaccgacagaaaauggugcuuugauggggaacguaacaaccagauucuugaggagaauauggauguugaaauuuggacuaaagaaggcgagaagaagaaauuaaggccuagauggcuugaugcaaggacauauuccgauccucuagcacuaaaggaauuuaaagauuucgcugcaggucgaaaaucaauugcucuggauuuaguaacagaaauuggacgaguccccagccaccuagcucacaggacccgaaacgcccuggauaauuuaguuauguuacacacaagugaacacggaggacgagcauauagacaugcuguugaagaacuucccgaaacaauggaaacauugcuucuuuuaggccuaaugauacugcuaaccgggggugccaugcucuuucucauaaguggcaaaggaaucgggaaaacaucuauuggccuaaucugcguuguagcaucgagugguaugcuuuggauggcggauguaccacuacaauggauagcaucugcuauaguccuagaguucuucaugaugguauuacuuauaccagaaccugaaaaacagcguacaccccaagacaaucaauuagcauacguagugauaggcauacuaacguuagcagcaauaguugcagcaaaugaaaugggacuucuugaaaccacuaaaagagaucuagguaugagcaaagagccaggagucguauccccuacgaguuauuuagaugucgacuuacacccugcuucagcauggacacucuaugcgguugcuacuaccguaauuacgccuauguuaagacauacaauagagaauagcacagcaaacgucucacucgcagcgaucgcuaaucaggccguugugcuuaugggucuugacaagggauggccaauuucaaaaauggacuuagguguuccacuguuagcucuaggaugcuauucacaaguaaauccucuuacauuaacagcagcugucuuguugcucgugacacacuaugcuauaauugggccuggccuccaggcuaaagcuacgagagaagcacaaaagagaacagcugcuggcauaaugaaaaaucccacugucgauggcauuaugacaaucgaucuugacccaguaaucuaugauucgaaguuugaaaaacaacugggucaggugaugcuucuuguacucugugcagugcaauuacuucucaugagaaccaguugggcuuuuugcgaagcacuaacgcucgcaacaggcccuaucacgacuuuaugggaagggucaccaggcaaguucuggaauaccacaaucgcagucagcauggcuaacauauuucgaggaucuuaucuagccggugcugguuuagcuuucucuaucaugaaaucugucgguacaggcaaacgaggaaccgggagccagggggaaacgcucggagagaaauggaaaaagaaauugaaucagcuuagucguaaagaauuugaucuauauaagaaaucugggauaaccgaagucgaccguacagaggccaaagaagggcugaaaagaggugaaauaacucaccaugcuguuaguagaggaagcgcaaaauuacaaugguuuguagagagaaacaugguaauaccggaagggagaguaauagaccuaggcugugggaggggugguuggucuuauuauugcgccgggcucaagaaaguaaccgagguaagaggauauaccaaaggggguccaggucaugaagaaccuguaccaauguccaccuauggauggaacauuguaaaauugaugucggggaaggaugucuuuuaccuuccaccugagaagugugauacauuacugugcgacauaggcgagucgucacccuccccuaccguugaagagucaagaaccaucagaguacucaaaauggucgagccuuggcucaaaaauaaucaguuuugcauuaaggucuugaauccguauaugccaacuguaauugaacaucuggaaagacuacagcgaaaacauggggguauguuaguaagaaauccucuuucucguaacaguacacaugaaauguauuggauaucgaaugguacaggaaacauuguaucaagcgugaacauggugagucgacucuuauuaaauagguucaccaugacccaccgaagaccgacgauagaaaaagacguagaucuaggugcaggaacgcgucacguuaaugcagaaccagagacaccuaauauggacguuauaggagaacgaauacgcagaauuaaggaggaacauucaucaacauggcacuaugacgacgaaaacccauauaagacaugggcuuaucauggaucguaugagguaaaggcaacuggaagugcaagcaguaugauuaacggagucgugaaacugcugacaaaaccaugggaugugguuccaaugguaacacaaauggcuaugacggauacuaccccauuuggccaacagcggguauuuaaggaaaaagucgauacaaggacccccaggccuaugccggguacccgaaaaguuauggaaauaaccgcagaauggcuauggagaacguuaggaagaaacaaaagacccagacuauguacccgugaagaauuuauaaagaagguacgcacuaaugcugcuaugggcgcuguauucacagaagagaaucagugggauagcgcacgggcugcgguagaagacgaagaguuuuggaaauuaguggacagggagcgugaacuacauaaacuaggcaagugcggguccuguguauacaacaugauggggaagagagagaagaaacuaggagaguucggaaaagcaaaagggagcagggcaauaugguauauguggcuaggugcaagguaucuugaguucgaggcacuaggauucuuaaacgaagaucauugguucucuagggaaaacagucauagcggcguagagggggaaggauuacacaaacucggcuauauauuacgcgauauuucaaaaaucccagggggugcaauguaugcggaugauaccgcggggugggacacaagaauaacagaagaugacuugcacaaugaagagaaaauuacucaacaaauggauccugagcauaggcaacuugcaaacgcuaucuuuaaacuuaccuaucagaauaaggucguaaaaguucaacgaccaacaccgaagggaaccguuauggauauaauaagcaggaaggaucagcguggaagcggucagguugguacuuacggacuuaauaccuucacuaacauggaagcacaguuaaucaggcagauggagggugaggguguccuuucgaaagcggaucuagaaaacccucaucuacucgagaagaaaguaacacaauggcuagagaccaaaggaguggaaagacuaaagaggauggcuauaaguggugaugacugcguggugaaaccuauugacgaucguuucgcuaacgcacugcuagcauuaaaugauauggggaagguacgcaaagauauuccgcaguggcagccaucaaagggauggcacgauuggcaacagguuccauucuguucgcaccauuuucaugaauuaauuaugaaagaugggagaaaacuuguuguuccauguaggccccaagaugaacucauagggagagcccguauuucacaaggcgccggcuggucacucagagaaaccgccuguuuaggaaaggcuuaugcccaaaugugggcgcuaauguauuuucauaggagagauuuaagauuagcaucuaacgcuaucuguucagcagugccaguucacugggugccaacaaguagaacuacuuggagcauccacgcacaccaccaauggaugaccacagaggauaugcuaacuguguggaacagaguguggaucgaagauaauccuuggauggaagacaaaacacccguaacuacaugggaagacguaccguaucucggaaaaagggaagaccaaugguguggaucucugauaggucucacaucacgagcaacgugggcacagaauauacuaacagcaauacaacaaguuagaagccuaauaggaaaugaggaauuuuuagauuacaugccgagcaugaaaagguuuagaaaagaggaagaaucagaaggagcuauuugguaa

SEQ ID NO: 23585 - RNA, 9873 nt, Artificial Sequence
  derived and/or modified CDS sequence (opt6) from DENV-3__AY876494__SS-prME
acaucuuuaugcuuaaugaugauguuaccggcaacguuagcuuuucacuuaacaaguagagacggagaacccagaaugauugucgccaaaaacgaacgaggaaaaucuuugcucuuuaaaacugcaagcggcauaaacauguguacacuaauugcaauggaucuuggagaaaugugugacgacacaguaacauacaaaugcccauugauugcagaaguugaaccagaagacauagacuguugguguaaccuuacaucaacuuggguaacguaugggaccuguaaucaagcgggugagcacagaagagauaaacgcuccguagcacuugcuccacacgugggcauggguuuagauacgagaacucaaaccuggaugucagcugaaggggcauggagacccgucgaaaaaguagaaaccugggcuuuacggcauccuggguucacgauauuagcguuguuccuggcgcacuauauuggaacaucucucacacaaaaaguuguaauauuuauacuuuuaauguuaguuacaccuucaaugacuaugcgaugugucggagugggaaaucgugauuuuguagaaggacucucuggugcaacauggguagacguaguuuuggagcauggaggaugcgucacuacaauggccaaaaacaaaccaacauuggauauagaauugcagaaaacugaagcaacucaacucgcuacacuacggaaacuaugcauagaaggaaaaauaaccaaugugacaacggauucacgauguccaacccaaggugaagcuauccuuccggaggaacaagaccaaaauuauguuugcaaacacaccuauguagacaggggguggggaaauggauguggcuuauucgguaaagggucguuaguaacaugugcaaaauuucaaugucuagagcccauugagggaaaaguuguacaacacgaaaauuuaaaauacaccgugauuaucacgguccauacaggugaccaacaucaggugggaaacgacacgcaagguguaacuguggagauuacuccgcaggcaagcacagcagaagcuauacugccagaauacggaacucuaguguuagaauguucgccaagaacaggucuagacuuuaacgaaaugauucuccucacaaugaaaaauaaggcauggaugguccauagacaaugguucuuugacuuaccucuaccguggacgucaggugcaacaacugagaccccaacuuggaaucguaaagaauuacuggugacguuuaaaaaugcacaugccaagaaacaggaagugguagugcuaggcucccaagaaggugcuaugcauacggcacucacaggcgcuacagaaauccaaaauaguggagguacgaguauuuucgcuggacauuuaaaaugccguuuaaaaauggacaaacucgagcuaaaagguauguccuaugcuaugugucucaauacauuuguccuaaagaaagagguaucggaaacacaacaugguacuauauugauuaagguggaguauaaaggagaagaugcaccauguaaaauaccauuuaguacagaagauggacaagguaaagcacauaauggacgacuuauuacagcuaauccaguaguuacuaagaaagaagaaccagucaauauugaagcagaaccaccuuucggugaauccaauauaguaauugggauaggggacaaagcucuuaagauaaacugguauaagaaaggcagcucgaucggcaaaauguuugaagcuacggcuagaggugcgaggagaauggcgauuuuaggugacaccgcaugggauuucggcucggucgguggagucuuaaacucacuaggaaaaaugguccaccaaauuuuuggauccgcuuauacggcuuuguuuucuggaguaucguggauuaugaagauagguauagguguguuauuaacguggauaggacuuaauucuaaaaauacuagcaugaguuucuccuguaucguaaucggaauuauaacauuguauuuaggagcagucguacaagcugauaugggauguguuauaaacuggaaagguaaagaacugaaauguggaucaggaauauuuguaacaaaugaaguacacacuuggaccgagcaauacaaguuccaggcggacagucccaaaaggcuagcaacagcgauagcuggugcaugggagaacgguguaugugguauaagaucaacuacuaggauggaaaauuuauuauggaaacaaauagcaaacgaacuaaacuacauccuaugggaaaacaauaucaaauugacuguggucguuggagacauaauuggaguuuuagaacaaggaaaaaggacuuuaacgccccagccgauggaacugaaguauaguuggaaaacaugggggaaagcaaaaauagugacagccgagacacaaaauucaaguuuuauaaucgacggaccgaauacuccggaaugucccucugcaucaagggcguggaauguaugggaaguagaagauuacggcuucgggguguuuacuacaaacauauggcucaaacuucgugaaguuuauacucaaucgugugaccaucgcuuaaugucugcagccauuaaggacgagcgagcaguacaugccgauauggguuacuggauugaaagucagaaaaacggcaguuggaaguuagaaaaagcgagcuuuauagagguaaaaacauguacauggccaaaaagucauacucuuugguccaacgguguucuagaaucagauaugauaauacccaagaguuuagcaggacccauuagccaacauaaucaccgcccaggauauuauacucaaacagccggaccauggcauuuaggcaaacuagaauuggacuuuaauuauugugaagguacgacgguuguaauaacagaaaauugugguacacgaggaccaagccuuagaacaacaacagucucaggaaagcuaauacaugaaugguguuguagaucaugcacguuaccaccccuuagauauaugggagaagauggcuguugguacggaauggaaauucguccaauaaaugaaaaagaagagaauaugguaaaaucuuuagugucugcaggaucgggaaaaguggacaauuucaccauggggguauuguguuuagcgauccucuucgaggaggugaugcgaggaaaauuugguaagaaacauaugaucgccgguguucuuuuuacguucguucuauuauuaaguggacaaauaacauggcgugauauggcacacacacugauaaugauagguucuaacgcuucugaucgcacugggaugggaguaacauauuuggcauuaauugccaccuuuaaaauucaacccuuccuggcacugggcuucuuucugaggaaauuaacuucgcgugagaauuugcuucucgguguaggucuagcaauggcaacuacacuccaauugccugaagauauagagcagauggcaaauggaauagcguuagggcuaaugacccuaaaauuaauaacucaauucgaaacauaucaacuauggacagcauuaguaucacuaacauguucaaauacuauuuucacauugacaguagcauggcgaacggcaacccugauauuagcuggcguaucauuauuaccacuuugucagaguucuagcaugagaaaaacagacugguugccuaugacgguagcugcaaugggcguaccuccgcuaccuuuauuuauauuuucauugaaggauacaccaaagagaagaaguuggccauuaaacgaaggaguuauggccguggguuugguuagcauacuagcaucaucacuccugagaaaugaugugcccauggcggggccucuagucgcaggaggacuccugauugcauguuauguaauaacuggaacgucagcagauuuaacgguugagaaagcugcagauguaacaugggaagaagaagccgagcaaacaggaguaagucacaacuuaaugaucacaguagacgaugauggaacgaugagaauaaaagaugaugaaaccgaaaacauacccaccguacuacuuaaaacugcacuacucaucguuucaggaauuuuuccauacagcaucccagcaacguugcucguauggcacacauggcaaaagcaaacucaacgcucgggaguguuaugggaugugccaaguccacccgagacacaaaaagccgaacuugaggagggaguauaucgaauaaaacagcaggggauauuugguaaaacucagguggggguaggaguucaaaaagaaggaguauuucauacaauguggcacgugacuaggggugcagugcucacucauaacgggaagaggcuugaaccgaacugggccuccguaaagaaggaucucaucucguacgggggaggauggcgacuaucggcucaauggcaaaaaggagaggagguccaagugauugcuguggagccugguaagaaucccaaaaauuuccagacuaugcccggaauauuccaaaccacuaccggagagaucggugcuauugcucuugacuuuaaaccgggcacaaguggcucuccaauuauaaaucgggaaggaaaagugguagguuuauacggcaacggcguagugacgaaaaacggcggcuaugucucuggcauagcucaaacgaaugcggaaccagacgggccuaccccugagcuugaagaggaaauguucaaaaagcguaacuuaacuauuauggaccuacacccaggcucaggcaaaacuaggaaauaucuuccugccauuguuagggaggcgauuaaaagacgguuaaggaccuuaauucuugcaccaacgcgagugguggcggcggagauggaagaagcauuaaaagggcuccccauuagguaccaaacaaccgccacgaaaucagagcauacaggacgagagauagucgaucuuaugugccacgcaacauucacgaugcgucuauuaagcccagugaggguaccuaauuauaaucuaauaauuauggaugaagcgcauuucacggacccugcuaguauugcggccagaggauacauaucaacuaggguugguaugggagaggcagccgcuauauucaugacagcaacuccaccuggaacagcagaagcguuuccacaaagcaacgcgcccauacaagaugaagaacgcgacaucccugaaagaucuuggaacucggggaaugaauggauuacugauuuuguagggaaaacuguaugguuuguccccaguauaaaagcggguaacgauauugcgaauugucuacguaaaaauggcaagaagguuauucagcuuucacgcaaaacauucgauacagaauaucagaaaacaagacucaaugauugggauuucgugguuacgacagauauaucagagaugggagccaauuucaaggcagauagggugauugacccacgaaggugccugaaaccgguaauuuuaacugauggucccgaaaggguaauccuugcaggaccuaugcccguaacagcagcuagugcugcacaacguagaggcagaguugguagaaauccucaaaaagaaaacgaccaauauauuuuuaccggacagcccuugaacaacgacgaagaucacgcacacuggacagaagccaaaauguuguuggauaacauaaacacacccgaggguauaauuccagcacucuucgagcccgagagagaaaaaucugcagcuaucgacggugaguauagguuaaaaggugagucacgcaaaacuuuuguagaauuaaugagacguggagauuuaccgguuugguuagcacacaaagucgcaucagagggaauuaaauacaccgacagaaaaugguguuuugauggugaaagaaauaaucaaauacucgaggaaaauauggacguugaaaucuggacaaaagagggugaacguaagaaauugagaccacguuggcuagaugcucgaacguacagugacccgcuagcucuaaaagaauuuaaggauuucgcagcaggacguaagucuauagccuuagacuuggugacugaaauuggacgagucccgucacauuuagcacacagaacucgcaacgcacuugauaaucuugucauguuacacacguccgaacaugguggucgagccuaucgacacgcaguugaggagcuuccagaaacuauggagacucuauuacuauugggacucaugauacuuuugacagggggagcaauguuauuucuaauauccggaaagggaaucggaaaaacaucaauaggauugaucugcgucauuguaucaagugguaugcuguggauggcugaugucccccugcaauggauugcaucagcaaucguacuagaguucuucaugaugguccuacuaauaccugaaccagaaaaacaacguacaccacaagauaaucaauuagcuuauguaguaauaggaauccuaacacuugcagcuauaguagcugcuaaugagauggggcuacuagaaacaacaaaaagggaucuaggaaugucaaaggaaccgggugugguaucaccuacaagcuaccuagauguugaucuccaucccgcuagcgccuggacauuauacgccguugcaacgacaguaauaaccccaauguuaagacacacgauugaaaauucaacagcaaauguuaguuuggcggcaauagcgaaucaagcaguuguuuuaaugggacuagacaaggguuggccuauuucaaaaauggauuuaggcgucccacuuuuagcauuagguuguuacagucaaguaaacccuuuaacacuaaccgccgcaguacucuuguuaguuacgcacuaugccauaauuggcccuggcuuacaagcuaaggcaacucgagaggcgcagaaaagaaccgcagcuggcaucaugaagaacccuacaguagacggaauuaugacgauugauuuggacccaguaauauacgauucaaaguucgaaaaacaauuggggcagguuaugcuauuaguccuaugcgcugugcaacuucuacuuaugaggacaucgugggcauuaugugaagcccuuacacuugcuacaggacccauaacaaccuuaugggagggaucuccuggaaaauucuggaacacuaccaucgcagucuccauggcuaauauauuccguggauccuauuuggccggugcaggauuagcauuuaguauaaugaaauccgucgguacgggcaagagaggaacagguagucagggugaaacacuaggcgaaaaauggaaaaagaaacuaaaucaacucagccguaaagaguucgaccucuauaagaaaucuggcauuacagaaguagaucguaccgaggcaaaagaaggacugaagaggggcgagacuacucaucaugcuguaagucguggaagugcuaaauuacaaugguucgucgagcgaaacaugguuauaccagagggacgcgucauagacuuaggauguggacgcggcggcugguccuauuacugugcgggccuaaagaaaguaacagaaguuagaggauauaccaagggagguccaggccaugaagaacccguacccaugucuacuuauggguggaauauaguuaaauuaauguccggcaaagauguauucuaucuacccccagagaagugugacacacuuuugugcgacauaggugagaguucgccaaguccgacaguggaggaauccagaaccauuagaguacuaaagauggucgaaccaugguugaaaaacaaucaguuuuguaucaaaguucuuaaccccuacaugccaacaguuaucgaacauuuagaacgucugcaaagaaaguacggaggaaugcuaguuagaaacccauugagcagaaauagcacacaugagauguacuggauuucaaauggaacagggaacauagucucaaguguaaauauggugucuaggcugcuauuaaacagauucacaaugacacaccgcaggcccacaauagaaaaagauguugaccuaggcgcugggacgcgucauguuaaugcugagccugagacaccaaacauggacgugaucggugaaaggauaaaacgaaucaaagaggaacauucguccacuuggcauuacgacgacgaaaacccauacaagacgugggcauaucaugggagcuaugaagugaaagcaaccggcucagcuucaucaaugaucaaugggguaguaaaacuacucacaaaacccugggaugucguuccaaugguaacacaaauggcuaugacagauacaacgccauuuggacagcaaaggguguuuaaagaaaaaguugauacuagaacaccaagaccgaugccagguacaagaaaaguuauggagauaacugcagaguggcuuuggcggacuuuaggacgaaacaaacgcccaagauuguguacccgugaagaauuuaccaagaaaguacguacaaaugcagcgaugggugcaguauucacggaagaaaaucaaugggacagugcgagagccgcggucgaggacgaagaauuuuggaacuuaugggaccgagaacgugaauugcauaaauuaggaaagugcggcucuuguguuuacaauaugauggguaaaagggaaaagaaguugggagaguucggaaaagcaaaaggaagcagagcaauaugguauaugugguuaggagcacguuaucuggaauuugaagcccuaggauuuuugaacgaggaucacugguuuucgagagaaaauucguauucuggugucgaaggagagggacuccacaaauuaggauauauauuaagagauaucagcaaaauuccugguggagcuauguaugcagaugauacggcugguugggauacucgaauaacggaggaugaccuacauaaugaggagaaaauaacacaacaaauggacccggaacaccgacaguuagcaaacgcaauuuucaaguuaacguaccaaaauaaaguaguaaagguccaacggccaacacccaaagggacuguuauggacauaauuagccguaaagaucaaaggggaucaggacaaguugguacauauggucuaaauacguucacaaauauggaggcacaauuaguucgccaaauggaaggagaaggcguguuaucaaaagcagaucucgaaaauccccaucuucuugagaagaaaauaaccccaugguuggaaccaaagggaguagaacguuugaagagaauggcgauaucaggcgaugacugcguugucaaaccuauagaugacagauucgcuaacgcacucuuggcauugaacgacauggggaaggugaggaaggacaucccucaauggcaaccuucgaaaggauggcaugauuggcaacaagucccguucugcagccaucacuuccacgaauuaauuaugaaagauggccggaagcuaguggugccuuguagaccacaagacgaacuaauagggagagcucguauuucacaaggcgcgggguggucgcuaaaggagacugcaugcuuaggcaaggcuuaugcucaaauguggagccuaauguacuuccaccgucgagacuugagauuggcaucaaacgcuaucugcucagcaguaccuguucauugggucccaacuucaagaacaacauggucaauacacgcgcaucaccaauggaugacuacagaagauaugcuaacaguguggaaucgaguauggauagaagacaauccuuggauggaagauaaaacaccugugacgacuugggaagacgugccguaccuuggcaaacgugaagaucaauggugugggucacuaauagggcuaacaagccguagcacgugggcacagaauauuuuaacugcuauacaacaaguucgcucuuuaauaggagaugaagaauuuuuggauuauaugccaucaaugaagcgguuucgcaaagaagaagaaagugaaggugcaauaugguga

SEQ ID NO: 23586 - RNA, 9873 nt, Artificial Sequence
  derived and/or modified CDS sequence (opt6) from DENV-3__AY923865__SS-prME
accucacuguguuuaaugaugauguuaccagcgacacuugcuuuucaucugacaaguagagauggagaaccacguaugauaguuggcaaaaacgaacggggaaagagcuuauuauuuaaaacugcgucaggaauaaacauguguacccucauugcgauggauuuaggagaaaugugugaugacacgguuaccuauaaauguccacuuaucgcugaaguagaaccagaagauauugacugcuggugcaacuuaacaaguacauggguuacuuauggaacauguaaccaagcuggagaacauaggcgugacaaacguucagucgcucuggccccacauguugggaugggacuugauacacgcacacaaacauggaugucggcagaaggugcuuggcgacaaguugaaaaaguugaaacgugggcacugagacacccugguuucacaauccuugcauuauuucuagcacacuacaucggaacgucuuuaacgcagaaagucguaauauucauucuucugauguuagugacaccgucaaugacuaugagaugugucggaguagguaauagggauuuuguagaaggguuauccggagcuacauggguagacguaguauuagaacauggaggguguguaaccacuauggccaaaaauaaaccgacguuagacauagagcuucagaaaacugaagcuacgcaacuagcaacacuucgaaaacucugcauugaaggcaaaauaacuaauauuaccacagggagucguugcccaacacagggugaagcaauauuaccagaggagcaagaccaaaauuauguuugcaaacauacuuauguggaucgcggauggggaaaugguugcggauuguuugguaaagguagccuggucacaugugcgaaauuccaauguuuagaacccauagaagggaaaguuguacaauaugaaaaucuuaaauauacgguuaucauaacggugcauacaggggaccaaccacaaguuggcaacgauacucaagguguaacaguugaaauaaccccacaagcgaguacaguagaagcaguccuccuugaauacgguacacuuggauugaaaugcucaccaaggacggggcucgauuuuaaugagaugauccuacuuaccaugaaaacuaaagcauggaugguucacaggcagugguucuucgaucuacccuuacccuggacaagcggcgcuacgacagaaacgcccacauggaaccguaaagaacuauuagucaccuucaagaacgcacaugccaagaaacaagaaguggucguguuaggaagucaagaaggugcgaugcauacugcacucacuggggcaacugaaauucaaaauucgggaggcacuagcauauuugcaggacaucugaaaugccggcuaaaaauggauaaauuagaacugaaagggaugagcuaugcaaugugccuuaauacguuuguucuaaagaaagaaguauccgaaacccaacacggaacuauacucauaaaaguggaguauaaaggcgaagaugcaccuuguaaaauacccuucucuacugaggacggccaaggcaaggcgcauaacggaagguuaauaacagcaaauccuguuguuaccaaaaaggaagaaccuguuaacauagaagcagagccaccauucggggaaucuaauauagucauugggauaggugacaaggcauuaaagauaaauugguauaagaaagggaguagcaucggaaaaauguucgaggcgacagcccgaggugcccguagaauggccauacuaggugauaccgcaugggauuuugguucuguaggcggaguucuuaacagucuuggaaaaaugguucaucagauauucggaagcgcuuauaccgcacuguuuuccggaguuagcuggauuaugaaaauaggcauaggaguacuguugacauggauagggcuaaauaguaaaaauacaucaaugagcuuuuccuguaucgucauaggaauaauaaccuuauaucuaggugccgucguucaagcagacaugggauguguaauaaauuggaaaggaaaagaacuuaagugugguucuggaauauuugugacuaaugaaguucauacauggacugaacaauauaaguuucaagccgacucaccgaaacgauuggcgacggcgauugcaggagcaugggaaaaugggguaugcgguauacgcucaacaacaaggauggaaaauuuacuauggaaacaaauagccaaugagcuuaauuauaucuuaugggagaauaauauaaaauuaacuguaguuguaggagacauaauugguguguuagaacaaggcaaaagaacacuaacaccccaaccgauggaauugaaauacucauggaagacauggggaaaggcuaaaauaguaacugcagagacacaaaauagcucauuuauaauagaugggccuaauacucccgaauguccuucagcaucgcgugcuuggaauguaugggaaguugaagacuauggcuucggaguauuuacaaccaacauuugguuaaaauuacgggaaguauauacucaaagcugugaccauagguuaaugucagccgccaucaaagacgaaagagccguacaugcagacauggguuauuggauagaaucacagaaaaauggcucuuggaaguuggaaaaggcaucauucauagaaguaaagacguguacuuggccaaaaagccauacgcuaugguccaacgggguacuagaaagugauaugauaauucccaaauccuuagcggggccuauaucgcagcacaaucauagaccaggauaccacacccagaccgcagguccauggcauuuaggaaaacucgagcuagauuucaauuauugugaagguacaacuguagugauuacugaaaacugcgguacaaggggaccaucccugagaacuaccacagugagcgggaaauuaauucacgaaugguguugucggucuugcacacuaccuccgcucagauauaugggagaagauggaugcugguauggaauggaaauuagaccuaucaaugaaaaggaagagaauaugguaaaaucgcugguaucagcggguagcggaaaaguagacaacuuuaccaugggcguacuauguuuagcuauucuauucgaagaaguaaugagggguaaguuuggcaagaaacacaugauagcgggaguccuauuuacuuucguauuacuguuaagcggacagauuacuuggagggauauggcgcauacuuuaauuaugauagggucgaaugcaagcgaucgcauggggauggggguaaccuauuuagcucuaauugcuacauuuaaaauacaaccauuucuagcacuaggguucuuccugcgaaaauuaaccucgagggagaauuuauugcuugggguaggauuagcuauggcuacaacauuacaacuuccggaagacauugaacaaauggcaaacgggauagcguuaggucucaugacccuaaaauuaaucacccaauuugaaacauaccagcuguggaccgcucugguaucauuaacuuguaguaauacuauuuuuacucuaacagucgcauggcgcaccgcgacucuuauucuggcaggcgugucacuacugccucuaugccaaagcucaaguaugcguaaaacagauugguugccaaugacuguagcugcuaugggggugccaccacuacccuuauuuauauucagucuuaaggauaccccaaaaagacgaaguuggccuuugaacgaaggaguaauggcgguggguuuaguaucaauacuugcaucgucacuguuaagaaaugauguucccauggcuggaccuuuaguugcugggggauuauugauugccugcuauguuaucacgggaacaucggcugaucuaacaguggaaaaagcagcagauguaacaugggaggaagaagcagaacaaacuggagucagccacaauuuaaugauuacaguugacgaugauggaacgaugaggauaaaagaugacgaaacugaaaauauuuuaacgguuuuacuuaagacugcauuacugauaguauccggcauuuuuccauacucgauuccagcaacgcuccuugucuggcacacuuggcaaaagcaaacucaacgcaguggaguacuaugggacguaccuagcccaccagaaacccagaaagcagaacuugaagaaggaguguauagaaucaaacaacaaggcauuuucggaaaaacacaaguaggaguaggcguacaaaaggagggcguguuccacacuauguggcaugugacgaggggugccguccugacccauaaugggaaaagauuagaaccaaauugggcaucuguaaagaaggaccucauuaguuacgguggcggauggcgccuaucagcacaauggcaaaaaggugaagaaguccagguaaucgccguggagccuggcaagaauccaaagaauuuucaaacuaugccgggaauuuuucaaaccaccacaggagaaauuggugcaauagcgcuagauuuuaaaccggguacuucggguucaccaaucauaaauagagagggaaaaguaguaggacuuuauggaaauggggucguuacuaaaaauggaggauauguguccgguauugcacagacgaaugcggaaccagauggaccuacaccagaacuagaagaggaaauguuuaaaaagcgcaaucuuacaauuauggaccuucauccugguagcggaaaaacgagaaaguacuuaccggcgauaguacgagaagcgauaaaaagaagacuaagaacauuaauacuagcaccaacaagggucguagccgcggaaauggaagaagcgcuaaagggccuuccuauuagauaucaaacgacugcuacuaaaucagagcauacugguagggaaauugucgaccuaaugugucacgccacuuuuacuaugagacuucugaguccuguaagaguccccaauuacaauuugauuauaauggaugaagcacacuuuaccgacccugcaucuauagcggcaagaggauacauaaguacuagaguugguaugggcgaagcugcggcaauuuuuaugacagcaacgccgccagguacagcugaggcguuuccacaaaguaacgcuccuauacaagaugaggaaagggauauaccagaacgaucuuggaacucagggaacgaauggauaacagacuuuguaggaaaaacagucugguucgucccaagcauuaaagcuggaaaugauauagccaacugucuacgcaaaaauggcaagaaaguaauacaacuauccagaaaaaccuucgauaccgaauaccagaaaacaagacuuaaugauugggacuuuuuagugacuacagacaucagugaaaugggagccaacuuuaaagcagauagagucauugauccaagaagguguuuaaaaccaguaauccuaacggacggaccugaacgaguaauuuuagccggaccaaugccuguaacagcugcaucggccgcucagcgccgggguaggguagguaggaacccgcaaaaggagaaugaccaguauauauuuaccggucaacccuugaauaaugaugaggaucaugcacauuggacggaagcuaaaauguuacuugauaauaucaauacuccagaaggaauuauacccgcgcuuuuugaaccugaaagagagaaaagcgcggcgauagauggagaguaucgucuuaaaggugaaucaaggaagacauuuguugaacugaugaggcgcggagauuuaccuguguggcuagcacauaagguugccucugaggguaucaaauauacugacagaaaauggugcuuugacggugaaaggaacaaucaaauuuuagaggaaaacauggaugucgaaaucuggacaaaagaaggagaaaggaagaaauuacgaccacgcugguuggacgccagaaccuacuccgauccucuagcuuugaaagaguucaaagauuucgcagcaggucggaaaucuaucgccuuggauuuaguaacggaaauaggaagaguuccuagucaccuagcacaucguacaaggaacgcuuuagacaacuuaguaaugcuacauacaagugaacauggagggagagcuuaucgacaugcaguugaggaauuaccagagaccauggaaacacuucuucuccucggcuugaugauucuacuaaccggcggagcaaugcuguuucugauuucaggaaagggaaucgggaagacaucuauagggcuaauuuguguaaucguauccucgggcaugcuguggauggcggacgugccccuacaguggauagccagcgcaauaguucuagaguucuuuaugaugguucuacucauuccugaaccugaaaaacaacgaacuccacaggauaaccaauuagcauacguuguaauugguauucuuacuuuagcggcuauaguggcagcuaacgaaaugggccucuuagaaaccacaaagagggacuuggguaugagcaaagaaccgggaguaguuucucccacgaguuaucuagacguugaccuucauccugcaagugccuggacauuguaugcaguugcuacuacugugaucacuccaauguuaagacauacaauagaaaacucaacagcuaacgugucccuagcagcgauugcgaaucaggcugucguacucauggguuuagacaagggguggcccaucucuaaaauggaucuuggagugccucuacuugcuuuagguuguuacagccaaguaaacccauuaacccuuacugcagccguccuucuuuuaguaacacauuaugcuauaauuggucccggcuuacaagcuaaggcgacccgcgaggcgcagaagagaaccgcggcggguauaaugaagaauccgaccguugacggcauaaugacuauugauuuggacccagucaucuaugacucuaaauuugaaaagcaauuaggucaagugaugcuauugguucuuugcgccguacaguuacuacuaaugaggacaaguugggccuuaugcgaggcuuugacccuggcaaccggaccaauaacuacuuuaugggaagguagcccgggcaaguucuggaauacgaccauagccguaucaauggcgaacauauuucgagguagcuauuuagcaggaaccggccuugcauuuuccauuaugaaguccgucgguacaggucgccgaggaacgggcagccaaggagaaacauugggagaaaaauggaagaagaaacucaaucaacuaagccgaaaagaauuugauuuauauaagaaaucagggauuacggaaguggauagaacagaagcaaaagaagggcucaaacguggcgaaacuacccaccaugcaguuagcaggggaagugcgaaauuacaaugguuuguagaaagaaacaugguaauacccgaaggaaggguaauagaucuagguuguggaaggggcggcuggucguacuacugcgcaggacuaaagaaaguuacugagguaaggggguauacuaaaggaggcccggggcaugaagaaccugucccuaugaguacauacggauggaacauagugaaacuuaugucaggaaaggauguauuuuaccugcccccagaaaaaugcgauacucuacucugcgauauaggagaaagcucaccaagcccuacagucgaagagucaagaacaauacgcgugcuaaagaugguggagccgugguuaaagaacaaccaauuuugcauaaaagugcuaaauccauacaugccaacaguaauagaacaucuagagagacuucagagaaaauacggaggaauguuagugagaaacccucuaucuaggaacagcacucacgaaauguauuggauaagcaacggcacugguaauauugugagcagcguaaauauggucagccguuugcuacuaaacagguucacuaugacucaucgaagaccuacaauagaaaaagacguagaucuuggggcugguacuagacacguuaaugccgaaccagaaacaccaaauauggacguuauaggugaacgaauaaaaagaauuaaggaggaacauucaaguacuuggcauuaugaugaugaaaauccauauaagacuugggcauaccacggaucguacgaaguaaaagcaacgggaucugcgaguagcaugauaaauggaguaguuaaauuacuaacgaaaccaugggacguggucccuaugguuacacaaauggcaaugacagauacuacuccauuugggcaacaaaggguauucaaagagaaaguagauacccguacgccgaggccuaugcccgguacaagaaaagugauggaaaucacugccgagugguuauggcggacguugggaagaaauaagaaaccucggcuuuguacacgagaggaguucaccaagaaaguucguaccaacgcagcaaugggagcggucuuuaccgaagaaaaucaaugggauagugcgcgagcggcagucgaagaugaagaguucuggaaauuaguugaucgugaaagagaacuacacaaacuuggaaaauguggaaguugugucuacaauaugauggguaaaagagagaagaaacuuggggaguucggcaaagcaaaaggaagucgugcaaucugguauaugugguuaggagcgagguaucuagaauuugaagcucuuggauuucuuaacgaagaccauugguuuucucgugagaacucauauagcggggucgaaggugaagguuuacacaaauuaggcuacauauuaagggauauaucuaagauuccagguggagcuauguaugcugacgauacagcuggaugggacacgcguauaacggaagacgauuugcauaaugaggagaaaauaacacaacaaauggauccagagcauaggcaacuagcaaaugcaauuuuuaaauuaacguaucaaaacaaagugguaaaaguccaacguccaacgccuaaaggaacuguaauggauauaauaaguagaaaagaucaaagagggagcggccaggucgguacuuaugguuuaaauacguuuacaaauauggaagcucaguuaguuagacaaauggaaggcgaaggggugcuuucaaaggcagauuuagaaaacccucaucuauuagagaagaaaaucacucaaugguuagaaaccaaaggaguugaaagauugaagcgaauggcgauauccggagacgacuguguagucaagccaauagaugacagguucgcaaacgcgcucuuagcucuaaaugauaugggcaaaguccgaaaggacauuccucaauggcagccgaguaaaggcuggcaugauuggcaacaagugccauucuguagccaucacuuucacgaauuaauaaugaaagauggucgaaaacuuguggugccuuguaggccgcaagaugagcuuauagggcgugcaaggauuucccagggagcgggauggucuuuaaaggaaaccgcuuguuuaggcaaagcauaugcacaaauguggagccucauguacuuucacagacgagaucuucggcuugcuucaaaugcgauaugcucagcgguacccgugcauugggucccaacuagcaggacgaccuggucaauucacgcgcaccaccaauggaugacuacagaagauauguuaacuguguggaacagaguauggauagaagauaaccccuggauggaggacaaaacccccguaacgacaugggaagacguuccauaccuagguaaaagagaagaccaauggugcggcucucuuaucggacugacgucgcgugcaacaugggcgcaaaacauucugaccgcaauacagcaaguuaggucacugauaggagaugaagaguuuuuagauuacaugccaucuaugaaacguuuuagaaaagaagaagaaucagaaggcgccauaugguaa

SEQ ID NO: 23587 - RNA, 9867 nt, Artificial Sequence
  derived and/or modified CDS sequence (opt6) from DENV-4__KR922405__SS-prME
ucaacgauaacucuuuuaugcuugauaccaacgguuauggcuuuccacuuaagcacaagggacggggaaccccuaaugauaguagcaaaacacgaacgcggacgaccccuuuuauucaaaacuacugaaggaauaaauaaaugcacauuaauugcaauggaucuaggugaaaugugcgaagacacuguaacauauaaaugcccucuucuuguuaacacugaacccgaagacauagauugcuggugcaauuugaccagugccugggucauguaugguacgugcacacaaucgggggaacgucgaagggaaaaacgaucuguggcauugacaccccacaguggaaugggauuagaaacacgagccgaaacuuggaugucaucugaaggagcguggaaacaugcacaacgcguugaaaguuggauacuaaggaauccagguuuugcacuauuagcaggauuuauggcuuauaugauaggacaaacuggaauccaaaggacaguauucuuuauacucaugaugcuuguagcgccauccuacgguaugcgauguguuggaguuggaaacagggacuuuguagaagguguaaguggaggagcuuggguggaccucguacuggaacauggaggguguguuacgacuauggcacagggaaaaccaacucucgacuuugaauuaaucaaaaccacagcgaaagaaguugccuugcuaaggacauauugcauagaagccucaauaucaaauauaacaacagcaacccgauguccgacacaaggggaaccauaucuaaaagaagaacaggaucagcaauauauuuguaggcgcgauaugguagauaggggauggggaaauggcuguggucuauucggcaaaggaggaguuguuacaugcgcgaaguucaguugucuuggaaaaauaacgggaaaucucguucaaauugaaaaccuggaauauacaguuguagucacagugcauaauggagauacccacgcaguaggaaaugauacaaguaaucauggugucacagcgacaauaacuccacguucaccaucaguagaaguaaaguuaccagacuauggagaauuaacuuuggacugugaaccgagaagugggaucgauuuuaacgaaaugauacugaugaaaaugaagacaaaaacuuggcucguacauaaacaaugguuuuuagaucuaccacuucccuggacaacaggugccgauaccuuagaaguacauuggaaucacaaagagcggauggucacuuucaaaguaccacaugcuaagaggcaagauguuacaguuuuagggucucaggagggggcaaugcauucugcucuggcaggcgcuacggaaguagacuccggugacggaaaccacauguuugcuggacaucuuaaauguaaggugagaauggagaaguuaagaaucaaaggaaugaguuacaccaugugcagcggaaaguucagcauugauaaagaaauggcugaaacccaacacggaacaacaguaguaaaaguaaaauaugaaggaacaggugcaccuuguaaaguaccgauugaaauucgagacguaaacaaggaaaaaguaguugguagaauaaucucuucgacaccuuucgccgaaaauaccaauucagugaccaauauugaacucgaaccgccauuuggcgauagcuacauagugaucggaguaggagacucugcacugacguuacacugguuuaggaaagggucuaguauaggaaaaauguuugaaagcacauacagaggggcaaaacgaauggcaauacuaggugaaacugccugggauuucgggaguguaggagguuuauuaacaucacuagguaaagcuguacaccaaguguucggcucuguauauacgacgauguuugguggugucucuuggaugguacgaauuuuaauuggacuacucguucuauggauaggaaccaacucgagaaacacaucaauggcuaugucauguauagcuguuggcggcauaacauuauuuuuagguuuuacuguccacgcggacaugggcugcguuguuucuuggucugggaaggaacuuaaaugcgguucggguauauuuguuauagacaauguccacacuuggacugaacaguauaaauuucagccugaaagcccagcaagacuugcuucagcgauacuuaaugcacacaaggaaggcguuuguggcauucguuccacaacucgauuagagaaugucauguggaaacagauuacgaaugaguuaaauuacguccuaugggaaggaggucaugaucuaacaguaguagcaggagauguaaaaggaguacuuuccaaaggaaagcgugcguuagcaccacccgugaaugauuuaaaguauucauggaagacauggggcaaagcgaaaauauuuacucccgaaacucgaaauucaacuuuccugguugauggaccagauacaagcgaaugccccaaugaaagacgcgcauggaacuuuuuggaaguagaagauuauggauucgguauguuuacaaccaauauauggaugaaauuuagggaggguucaucugaaguuugugaucaccgccuaaugucggcggcuauaaaggaucaaaaagcagugcaugccgauauggguuacuggauagaaaguucuaagaaccaaacuuggcagauugagaaagccucgcucauagaagucaaaacuugccucuggccuaaaacccacacucuauggucaaacgguguacuugaaucacaaauguuaaucccuaaagcauaugcagggccaauuucacagcauaacuacagacaaggauaugcaacgcaaacggcaggucccuggcaucucggaaagcuggaaauugauuuuggggaaugucccgguacgaccguuaccauacaagaagauugcgaucauagaggcccgucucucagaacgacuacugcuucagguaaguuaguaacacaaugguguugcagaagcuguaccaugccgccucuucgguuucuuggagaagacggaugcugguaugggauggaaauaagaccuuuaaaugagaaggaagaaaauaugguaaaaucacaaguaagugccggucaagguacuucagaaaccuucuccaugggauugcuuugccuuacuuuguuuguugaggaaugccuucggcgacgaguaacuagaaaacacaugauacuugucguaguaaccacucuuugugccaucauacuagguggguuaacuuggauggaccuacucagagcacugauaaugcuaggcgauacaaugucaggucguaugggcggucaaauacacuuagcaauaauggcaguuuuuaaaaugucaccgggauauguccuugguaucuuucugagaaaguuaacaaguagagaaaccgcacuaauggugauagggauggccaugaccacgguccuuaguaucccacaugacuugauggaguuuauagacgggauaaguuuaggucugauauuauuaaaaaugguaacacauuuugauaauacucaagucggaacauuagcauuagcgcuaacauucauuaaaaguacuaugccuuuggugauggcuuggcgaacgauaauggcaguauuguucguggucacgcugauuccacuuugccguacauccugcuuacaaaaacaaagucauuggguggaaauuacagcauuaauucuaggcgcccaggcacuuccuguguaccuuaugacgcugaugaaaggagcgucaaagcgaucauggccacuaaaugaaggcauuauggcaguaggccuggucucgcuacuagguagugcauugcuuaaaaaugauguuccacuagccggaccgauggucgcuggugggcuauuauuagcagcauauguuaugucagguaguucugcagacuuaucguuagagaaagcugcuaauguccaaugggaugaaauggcugacauaaccggaucuucacccaucauagaggugaaacaagaugaggauggcagcuuuucuauacgugacguagaggaaacaaacaugaucacacuguugguuaaauuagcacuuauuacaguaaguggccuauauccguuagcaauaccuguuacaaugacauugugguacauguggcaaguuaaaacacaacguucuggagccuuaugggauguaccgucacccgcugcagcacaaaaggcaacucuaaccgaaggaguauauagaauaaugcaacgaggacucuucggaaagacacaagugggagucggcauucauacugaaggcguuuuccacacuauguggcaugugaccaggggaagcgugauaugccacgaaucaggucgccuagagccuuccugggcagauguuaggaaugacaugauuucuuacgggggaggauggagacuaggugacaaaugggauaaagaagaagacguucaaguuuuagcgauagaaccaggaaagaauccaaagcauguacagacuaaaccaggcuuauucaagacauuaacuggagaaauaggagcagucaccuuagauuucaaaccagggacgagugguucaccaaucauaaaucgaaaaggaaaagugauuggauuauauggcaacggaguuguaacaaaaucgggggacuauguuagugcaauaacccaagcagaacgaaucggcgaaccagauuacgaggucgaugaggacauuuuucguaaaaagaggcugacgauaauggauuuacacccuggagcaggaaaaacaaaacgaauauuaccgaguauagugagagaagcauugaaacggagacugaggacgcuaauauuagcaccgacgagaguaguagcugcugaaauggaagaagcucuccguggauuaccaauaagauaucagaccccugcaguuaagucagaacacacagguagagaaauaguagaucuuaugugccaugcaacauuuacuacaagauuauuaaguaguacucgaguaccaaacuacaaccuaauagucauggacgaagcucauuucaccgacccuaguaguguagcugcacggggcuauaucucuacgagaguagaaaugggcgaagccgcugcaauuuuuaugacggccacaccgccgggaacaacagacccguuuccacaaucaaauuccccaauagaagacauugaaagggaaauaccugaacggucauggaacaccggauuugauuggauuacagacuaccaaggaaaaacggucugguuuguaccgaguauaaaggcagguaaugacauagcaaauugccuaagaaaauccggcaaaaagguaauccaauuaagccgaaaaacauuugacacggaauauccuaagacaaaacuaacugauugggauuuuguaguaacaacugacauaagugaaaugggggcaaauuucagagcagggcgaguaauagacccgcgaagaugcuugaagccaguaauucugacugauggcccagaaagaguaaucuuggcuggucccauaccagucaccccugcaucagcagcacagagaagaggacggaucgggagaaauccagcucaagaagaugaccaguacguuuucuccggugauccucugaggaacgaugaagaccaugcucauuggacagaagcaaagaugcugcuagauaauauuuauaccccugaaggcauaaucccaacauuauucggaccagaacgagaaaagacucaggcaauagauggagaguuccgccuaagaggagaacagaggaaaacuuuugucgaauuaaugaggcgaggagacuuaccuguauggcuuaguuauaaaguggcaucagcagguauauccuauaaagacagagaguggugcuuuacgggagaaaggaauaaucaaauucuagaagaaaacauggaaguugaaauauggacgagagaaggagagaagaagaaacucagaccaaagugguuagacgcacgcguguaugcagaucccauggcucuuaaagauuuuaaagaauuugcaucagggagaaaaucaauuacauuggauauuuugacagaaauugcuucucuaccaauguaucuuagcagucgagcgaaauuagcacuagacaacaucguuauguugcauacgaccgaacgagguggaaaagccuaucaacaugcgcuuaaugagcucccggaaaguuuagaaacucugaugcuaguugcguuacugggagccaugacagcugguauauuuuuauucuuuaugcaaggaaaaggaauaggcaagcuaaguaugggacuuaucgcaaucgcuguagcaaguggacuauuaugggucgcagagauacaaccacaguggauugcggccagcauuauacuugaguuuuucuugaugguccucuuaguuccugaaccugaaaaacaacggaccccgcaagacaaccaguuaauauacgugauccucacgauuuuaacaauaauagcucucgucgcagcaaaugagaugggguuaaucgagaaaacuaaaacugauuucggauucuaccaaguaaaagcagagacgacgauacuagacguagaucuaagaccagcaagugccuggacguuauacgcaguagcaaccacaauauuaacuccgaugcuuaggcacacaauagaaaauacaagugcaaaucuaucucuagcugcaauagccaaucaggcagcaguucuuauggguuuaggaaaaggauggccauuacacagaauggacuuaggcguuccccuccuagccaugggauguuacagucaagugaacccaaccacgcugacagcuaguuuggugauguugcuaguccacuaugcaauuaucgggccaggccuacaggcaaaagcaacacgugaagcucagaaacggacagcagcaggaauaaugaagaaucccacuguugaugggauaacggucauugaccuagagcccaucaguuacgacccuaaguuugaaaaacaguuaggacaagugaugcugcuaguucuaugcgcaggucagcuacugcuuaugcguacuacgugggccuuuugugagguauugacccuagccacaggaccaauauuaacguuaugggaaggaaauccuggaagauuuuggaauaccacaaucgcggugaguacagccaauauauuccgcgggucauaccuagccggugcagggcuggccuuuucgcuaaucaaaaaugcucagaccccaagacgcgguacugggacgacuggagaaacacuuggagaaaaguggaagagacaacuaaauagucuugauaggaaagaguucgaggaauauaagagaucggggauucuagaaguagacagaacagaagcgaaaagcgcacuaaaagauggaucaaaaauaaaauucgccguaucaagaggcacuucaaaaauaagauggaucguugagcgggggaugguuaagccgaaaggcaaggugguggauuuagguuguggacgaggggguuggagcuauuauauggcaacauuaaagaaugucacagaaguuaaagguuacacaaaagggggaccgggacaugaggaaccgguucccauggcaacuuauggauggaacuuagugaaauuacauaguggcguagauguauuuuacaagcccacagaacaaguagacacucucuuaugcgauauaggcgaauccaguucuaacccaacaauugaggaagggcguacucuuagaguauuaaaaaugguggaaccauggcuaucaucaaaaccagaauuuugcauuaaaguacucaauccuuauaugccaacaguaauagaagaacuggagaaauugcaaaggagacacggcggaucacuuguucguuguccguuaucgagaaauucgacccacgaaauguauuggguaucgggaguuucaggcaauauuguaagcucgguaaauacgacaucaaaaauguuauuaaauagguuuacaacuagacauaggaaaccgacauaugagaaagaugcugacuugggagcuggaacacguucgguuaguacagaaacagagaaaccagauaugacaauaauuggaaggcggcugcaaagauuacaagaggaacauaaagagacuuggcauuacgaccacgaaaacccguauagaacgugggccuaucacgguucauaugaggcgccuaguacaggaagcgcuaguaguauggucaauggaguaguuaagcuguuaacaaaaccaugggauguagugcccaugguuacacaacuagcaaugacagauacaacacccuuuggucaacaaagaguauuuaaagaaaaaguugauacacggacaccucaaccuaaaccaggcacaagagucauaaugacaacgacagcuaacugguuauggacauuguugggacguaagaaaaacccccgucuuuguacacgugaggaguuuauaucgaagguuagaaguaacgccgccauaggagcgguauuccaagaggaacaaggcuggaccagcgcuagcgaagcaguuaacgauagucgcuucugggagcugguagauaaagaaagagcacuacaucaagaaggaaaaugugaaucauguguuuacaacaugaugggaaagcgggagaaaaagcuaggugaguucgguagagcaaaaggcucaagggcaauuugguacauguggcugggagcacgguuucuagaauuugaggcgcuagguuuucugaacgaagaucauugguuuggaagagagaauaguuggagcggaguggaaggagagggccuucacaggcuagguuacauuuuggaagauaucgauaagaaagacggugauuuaaucuacgcugaugauacagccgguugggauacccggaucaccgaagaugaucuucugaaugaagaauuaaucacagagcaaauggcaccucaucacaaaauuuuggcaaaggcaauauucaaguugaccuaucagaauaaaguaguaaagguccucagaccgaccccgaaaggagcuguaauggauauaauuaguaggaaagaucagcgcggcaguggccaaguugguacguauggguugaauaccuucacaaacauggaaguacaauuaauucgacaaauggaggcagaaggaguuauaacacaagacgauaugcacaauccgaaaggguuaaaggaaaggguagaaaaauggcuaaaagaaugcgguguagacagacuaaaacgcauggcgauaucgggagacgacuguguaguuaaaccgcuggacgagcguuuuuccacaucgcuuuuauuucuaaacgauaugggcaaagucagaaaagauauaccacaaugggaaccuucaaaaggauggaaaaauuggcaagaggugccauucuguucucaucacuuucacaaaauauucaugaaagacgguagaucucugguuguacccugccggaaucaagacgaacuuauugguagagcgcguauaagucaaggggcuggcuggucacuaagggagacagcauguuuggguaaagcguaugcgcaaauguggucauuaauguauuuccauaggcgagacuugcgucuugcaagcauggccaucuguagugccgugccgacagaaugguuuccgacgucucguaccacauggucgauacaugcgcaucaucaauggaugacuacagaagauauguuaaaaguuuggaaccgcguauggaucgaagauaauccuaauaugauagauaaaacgcccgugcauucaugggaggauauaccuuaucuagguaaacgagaggaucugugguguggaagccuaaucggauuaagcucccgugccacaugggccaaaaauauacacacagcaauaacccaaguacgaaaucugauuggaaaggaagaauacguugauuauaugccugcaaugagacguuauagugcacacuucgagucugaaggcguguuguaa

SEQ ID NO: 23588 - RNA, 9867 nt, Artificial Sequence
  derived and/or modified CDS sequence (opt6) from DENV-4__KP188557__SS-prME
aguacuauaacauuacucugcuuaauaccaacugucauggcauuucaccucucgacccgugacggggaaccacucaugauugucgcaaaacacgaaagaggacgaccauuauuauuuaaaacaacagaagguauaaauaaauguacccugauugcaauggauuuaggagaaaugugcgaagauacagugacguauaaaugucccuugcucguaaacacagaaccagaagauaucgauugcugguguaaccuuacaucuacauggguaauguauggaacauguacccaaucuggugaacgaaggagagaaaaacguaguguggcuuuaacaccucacucuggaaugggccuugaaacucgggcagagacguggaugaguucugaaggugcauggaaacaugcacagagagucgaaucauggauccuaaggaauccgggcuucgcgcuuuuggccggguuuauggcuuacaugauuggucaaacaggaauccagaggacaguguucuuugucuuaaugaugcuagucgcgcccuccuacgguaugcgaugcgugggugugggaaacagagauuucguagagggaguaucggguggagccuggguugaucuuguuuuagaacaugguggaugcgugacgacaauggcccaaggaaaaccgacucuugauuucgaacugacaaaaaccacggcaaaagaaguugcuuuacuaagaacauacuguauagaagcacuuaucaguaacaucacaacugcuacgcgguguccaacucaaggugaacccuauuuaaaagaagaacaggaucagcaguauaucuguagacgagauguuguagaucgugguugggggaacgguuguggucuauucggaaaagguggagucguaacaugcgccaaauucucuugcucaggaaaaauaacagggaauuugguucagauagaaaauuuagaguacaccguaguagucacaguacacaacggcgauacgcaugcagucggaaaugauacaaguaaucacggcguaacagcuaccauuacaccaagauccccgucaguagaagugaaacugcccgauuauggagaacuaacccuagauugugagccucgauccggaauagacuuuaaugaaaugauccuaaugaaaaugaagaagaaaaccugguuagugcacaagcaaugguuucuagaccuaccacucccuuggacaacaggcgcagauacaagugaaguucauuggaauuacaaagaaagaaugguaacauuuaagguuccucaugcuaagcgacaagacguaacaguauuaggaagccaagagggagcaaugcacuccgcguuagcaggggcuaccgaaguagauucuggggaugggaaccauauguuugcaggucaccuaaaauguaaaguucgaauggaaaaauugagaaucaaaggaaugagcuacacaauguguuccggaaaauuuagcaucgauaaagaaauggcugaaacacagcacggcacaacaguugucaagguaaaauacgaaggcgccggagcacccuguaaaguaccgauagaaauucgggaugucaacaaagagaagguuguaggaagagucaucucagcuaccccucuagcagaaaauacuaauucagugacaaauaucgaauuagagccaccauuuggagauucauauauuguaauaggcgucggaaauucggccuuaacacuccacugguuucgaaaagguucgucaauugguaagauguuugaaagcacuuauagaggugcgaaaaggauggcgauacucggagagacugcuugggacuuuggcuccguagguggucuauucacuucucuaggaaaagcuguacaucaaguuuucggaucaguuuauacaacuauguuuggcgggguuaguuggaugauaagaauccugauaggauuucuugucuuauggauaggaaccaauaguaggaacacaaguauggcuaugacauguauagcgguaggugggauaacauuauucuuaggguuuacagugcaggccgacaugggaugugucgugucauggagcggacgcgaauuaaaguguggaagcggaauuuuuguaguagauaauguucauacauggacagaacaauauaaguuccaaccugaaucuccggcccgguuagcaagcgcgaucuuaaacgcgcacaaagacggugucuguggaauaagaucgacaacacgcuuagaaaacguuauguggaaacaaauaacuaacgagcucaacuauguguuaugggaagggggucacgacuugacaguuguagcgggugauguaaaagggguucuuacaaaggggaagagagcucuaacucccccggcaagcgaucuuaaauacaguuggaaaacgugggguaaggcacggauauuuacuccagaagcccgaaauaauacuuuucugaucgauggacccgacacgucugaguguccaaaugagagacgagcuuggaacucauuugaaguugaagauuauggauucgguauguuuacaaccaacauauggaugaaauuucgugaaggcagcagcgaaguuugugaucauagauuaauguccgcugccaucaaagaucagaaagcugugcacgcugauaugggcuauuggauagaaagcagcaaaaaucagacauggcaaauagaaagagcaagccucaucgaggucaaaaccuguuuauggccuaagacucauacguuaugguccaacggugugcuggaaucgcaaauguuaauaccgaaaucauacgcuggaccauuuagccaacauaacuaucgucaggguuacgcgacccaaacuguuggacccuggcauuuggguaaacuugaaauagauuucggugaauguccaggcacaacuguaacuauacaagagaacugcgaucauagaggacccagucucagaacgacaacggcaagcggcaaauugguaacccaauggugcuguaggaguuguacaaugccaccauuacguuuucuaggggaggauggguguugguaugguauggaaauuagaccgcuaagcgaaaaggaagaaaauaugguaaagucacaggugacugcaggacaggguaccucagagacuuuuucaaugggucuacuaugucuaacguuguucguggaagaauguuuacgaagacguguaaccaggaagcauaugauuuuagcaguaguaauaacauuaugcgccauuauauuaggaggacuaacuuggauggaucuacucagagcuuugaucaugcuaggagacacuaugagugggaggauaggcgggcaaacacaccuagcuauaauggcugucuuuaaaaugaguccaggcuacgucuugggggucuuccuaagaaaacuuacaucgcgugaaacagcguuaauggucauagguauggcaaugacgaccacucuuaguauaccucaugauuuaauggaacuuauugacggaauaagccuaggucuaauucuauuaaagauagucacgcaguuugacaacacgcaagucggaacauuggcguuaucauugacauuuauucggaguacaaugucgcuagugauggcguggagaacaauaauggccguacucuucguugucacgcuaaucccacuuuguagaacaagcuguuuacaaaagcaaucgcauugggucgaaaucacugcuuuaauucuuggagcgcaagccuuacccgucuaccucaugacuuuaaugaaaggcgcgaguagaaggaguuggccauugaacgaaggaauuauggccguaggauuagugagucuacuagguagugcucuauugaaaaaugacguaccguuggcaggaccuaugguugcaggaggucuccuauuggcagcauacguaaugucugguagcucagcggaccuaagucuggagaaagcggcaaacguccggugggaugagauggcugauaucaccgguuccagcccaauaauagaaguuaaacaagacgaagaugguagcuucagcauucgcgacguagaagaaacaaacaugaucacuuuacuggucaaauuagcauuaaucacagucucgggccuauaccccuuagcaauaccaauuacaaugacguuaugguauauguggcaaguaaaaacgcaacgauccggugcauuaugggauguaccaaguccggcagcaacucaaaaggcagcucuaucagaagggguuuaccgaauaaugcagagaggauuguuugguaaaacacaaguaggagugggaauacauauggaaggcguauuccauaccauguggcaugucacacgcgguucggucaucugccacgaaacugggcgacuugagccuagcugggcagauguuagaaaugauaugaucagcuacgguggaggauggagauugggcgauaagugggauaaggaagaagaugugcaagugcuagcaauagagccuggaaagaacccaaaacacguacagacaaaacccggauuauuuaaaacacuuacaggagaaauaggagcagugacacuagauuuuaaaccaggcaccucaggcaguccuaucauuaauagaaaaggaaaaguuauaggucuauacggcaacggugugguaacuaaaucuggagauuaugugucggcaauaacucaggcugaaagaauaggagaaccggacuaugaaguugacgaggauauauuuagaaagaaacgacuuacaauaauggaucuccauccuggagcaggaaagacgaaacggauauuaccuaguauuguacgcgaggcauugaagcgcagacuuagaacccuaauauuggcgccuacgagaguagucgcugcugaaauggaggaagcucuaagaggcuuacccauaagguaccagacacccgccgugaaaucagaacacacgggacgggaaauuguggacuuaaugugccaugccacuuuuacaacacggcuuuugaguaguacaagaguaccuaauuacaaccuuauaguuauggaugaagcccauuuuacagauccaagcagcguggcagcaagaggcuauaucucuacaagaguggaaaugggcgaagcugcagccaucuucaugacugcaacaccacccggagcaacagauccguuuccgcaauccaauagcccuauugaagauauagaacgagaaaucccggaaaggaguuggaacacuggguucgacuggauaacggacuaucaaggaaaaacugucugguucguaccuucaauaaaggccgggaacgauauagcaaacuguuugagaaaaagcgggaagaaaguaauucaacucagucgaaagaccuuugacacggaauacccgaaaacuaaauuaacagauugggacuuuguaguuaccacggauauaucagaaaugggagcaaacuuccgagccggacgaguuaucgacccaagaagaugccuuaagccaguaauacuaacugaugcgccagaaagaguaauauuggcaggacccaucccaguaacaccagcuucugcagcgcaacguagaggcagaauaggcagaaacccagcacaagaggacgaccaauacgucuuuaguggggacccacugaagaacgacgaagaccacgcacauuggacugaagccaaaaugcuccucgacaauauuuauacuccugaaggaauaauaccaacccuauuugguccggaaagagaaaagacacaagcaauugauggggaguucagacuaagaggagaacaacggaagaccuuugucgaauuaaugaggcguggagacuuaccaguguggcuuaguuacaagguagcaagugcgggcaucucauauaaagaucgagagugguguuuuacuggagagcguaacaaucaaaucuuagaggaaaacauggaaguugaaauuuggacuagagaaggugagaaaaagaaacuacgaccaaaauggcuagaugcacguguauacgcagauccaauggcguuaaaggacuucaaagaguucgcgucaggcagaaaauccauaacucuagauauauuaacagaaauagccagcuuaccaacuuacuugagcucaagagcaaaauuagcccuagacaacaucguaauguuacauacuacagaaagaggagggcgagcuuaucaacacgcauugaaugaauuaccugaaucuuuagagacacuaauguuagucgcucuacucggcgccaugaccgcaggcaucuuucuauucuuuaugcaagggaaagggauagguaaauuaagcaugggacucauaacgauugcaguugcuuccggucuuuuguggguagcagaaauccaaccgcaauggauugcggcaucgauaauauuagaguuuuuccuaaugguuuugcuaauuccagaaccagaaaaacaaaggaccccacaagauaaccaauuaauauacguaauacuaacaauacuaacaaucauugguuuaauugcagcaaacgagaugggacucauugaaaagacaaaaacggauuucggcuuuuaucaaguaaaaacggaaacuacuauacuugacguagauuuaaggccagcuagcgcauggacacuuuaugccguagcaaccacgauccuaacuccaaugcuucgucacacaaucgaaaacacaucagcuaaccucagccucgccgcuauugcuaaccaagcagcuguauuaaugggacuagguaaaggauggccacuccaucgaauggacuuaggcgucccccuacuggcaaugggaugcuacagucaaguuaacccaacuacuuugacugcaaguuuagugauguuacugguucauuacgcaauaauuggacccgggcuucaagccaaagcaacaagggaagcacagaagcgaaccgccgcugggauuaugaaaaauccaacuguugaugguauuaccgucaucgauuuagaaccuaucucguacgauccgaaauuugaaaaacaacuaggccagguaaugcuucuaguucuaugugcuggucaauugcugcugaugcgaacaacaugggcuuuuugcgaaguuuuaacucuggcaacuggaccuauacugacucuaugggaaggaaacccgggaagguuuuggaauacaacaauugcugugagcacagcaaauaucuuucgcggaucauaucucgccggugcaggccuggcuuucaguuuaauaaagaacgcacaaacaccacgaagaggaaccggcaccgcaggagagacgcuaggggagaaauggaagcgucaacucaacucuuuagaucgaaaagaguucgaagaauauaaaaggagcggaauuuuagaaguagaucguacugaggcaaaaagcgcuuugaaagauggaagcaaaauaaaacaugccguuucgagggggucguccaagauacgcuggauuguugaaagaggcaugguuaaaccuaaggguaaaguaguagaucuagggugcggccgaggaggauggucuuacuauauggccacacugaaaaauguaacagagguaaaaggauacaccaaaggcgguccuggucacgaagaaccaauacccauggcaacuuauggauggaaccuaguaaagcuccauagcggaguugauguauucuacaagccaacggagcaaguagauacccuccugugugauaucggugaaagcucgucaaauccaacuauugaggaagggcggacucucagaguacuaaaaauggucgagccauggcuuucaaguaaaccagaauuuugcauuaaaguacucaaucccuauaugccuacaguuauugaagaauuagagaaacuacaaagaaaacaugggggaaaucuugugcguuguccauuaaguagaaauucaacacaugagauguauuggguguccggagcaucaggaaauauaguuucgucagucaauacuacuucaaaaaugcuauuaaauagauucacuacacggcaucgaaaaccuacauaugaaaaagauguugaucuuggugcagggacccgaaguguaucuacagaaacugaaaaacccgauaugaccauuauaggccgccgacuacagaggcugcaagaggaacauaaggaaaccuggcacuacgaucaagagaauccuuacagaacaugggcauaucacgguaguuaugaagcaccaagcacggguucagcauccagcaugguuaauggagucguaaaacuuuuaacaaagccaugggacguuauaccaauggucacccaacucgccaugacagacacaacuccguuuggacaacaacguguauucaaggagaagguggacacaagaaccccucaaccuaagccggguacaagaaugguaaugaccaccacagcaaauuggcuuugggcauuauuagguaagaagaaaaacccacggcuauguacucgagaagaguucaucucaaaaguaaggaguaacgcugcuaucggcgcaguuuuccaagaagaacaaggcuggacuuccgcuagugaggccgucaaugacucgagauuuugggaacucgucgacaaagaaagagcguuacaccaagaagggaaaugugagucguguguuuacaauaugauggggaagagggagaagaaacuaggugaguucggcagagcaaaagggucucgcgcaauaugguacauguggcuaggagcgcguuuucuggaauuugaggcuuuaggauuuuugaacgaagaccauugguucgguagagaaaacagcuggagcggcguggaaggcgaaggauugcacagguuagguuauauacucgaagaaauagauaagaaagacggcgauuugauguaugcagacgauaccgcaggaugggauaccaggauaacugaggaugaucuccaaaaugaagaacugauaacagaacaaauggcaccacaucacaagauucuugccaaagcgaucuucaagcuaacuuaccagaacaaaguugucaaaguacugagacccacaccgcgaggagcuguuauggacauuaucucaaggaaagaucaacguggcucaggacaaguagggacguauggauugaacaccuuuacaaauauggaaguucaacugauaagacaaauggaagccgaaggaguaauaacccaagaugacaugcaaaacccgaaaggacuaaaggagagaguugagaaaugguugagagaauguggcguagaucggcuaaagagaauggcuauuucaggggaugauuguguagucaaaccacuugacgaaagauuugguacaucauugcuauuucuuaaugauauggggaagguaagaaaagauaucccacaaugggaaccaaguaaagguuggaaaaacuggcaagaggucccguuuuguagccaccauuuucauaaaauauucaugaaagacggucguagccugguaguacccugucgaaaccaagaugaguuaauaggcagagcaagaauaucgcaaggagcuggcuggucauuaagagaaacagccugccuggggaaggcuuaugcucaaauguggagccuaauguauuuccauagaagagauuuaaggcuggccagcauggcaauuugcucagcuguacccacugagugguucccaacaaguagaaccaccuggucaauucaugcucaucaccaauggaugaccacggaagauaugcuuaaaguuuggaauagaguauggauagaagauaacccuaauaugauagacaagacuccaguucauucaugggaggacaucccauacuuagguaaacgugaggaucuauggugcggaucucuaaucggucucaguucaagagcaaccugggccaaaaauauucauacagcgauuacacaaguuagaaaucuaauugguaaggaagaauacguagacuauaugccuguuaugaaacgauauagugcaccgucagaaagugagggcguuuuguga

SEQ ID NO: 23589 - RNA, 9867 nt, Artificial Sequence
  derived and/or modified CDS sequence (opt6) from DENV-4__KP188558__SS-prME
ucuacaauuacucuucuaugccugauucccacaguuauggcuuuucauuuauccacaagggacggugaacccuuaaugaucguugcuaaacaugaacgcgguagaccacuauuguuuaaaacuacagaagguauaaacaaaugcacauuaauugcaauggaucugggggaaaugugugaggacaccgugacuuauaaauguccuuuauugguuaauaccgaaccagaagauauugauuguugguguaaucuuacaaguacauggguuauguacggaacgugcacccaaucaggagagaggaggcgagagaaaagaucagucgcacuuacaccacacaguggcaugggauuagaaacgagagccgagacauggaugucgagcgagggagccuggaaacacgcccaacgaguagagaguuggauuuuaaggaacccaggauucgcuuuguuagcuggauuuauggcuuauaugauaggacaaacuggcauucaaaggacgguauucuuugugcuaaugaugcuuguggcuccaagcuauggcaugcgcuguguagggguagggaaccgggauuucguagaggguguuagcggaggagcguggguggauuuaguguuagaacaugguggcuguguuacaaccauggcacaaggcaaaccuacacuagauuuugaguuaacgaagacaacugcaaaagagguagcccugcuaaggaccuacugcauugaggcauuaauaaguaacauaaccacagcuaccagauguccaacccaaggugaaccauacuugaaagaagaacaagaucaacaauacauuugucgaagagaugucgucgacagaggauggggcaaugguuguggacuguucgguaaaggaggaguuguaacaugcgcaaaguuuucuuguucgggaaaaauuacaggaaaucuaguacagauagagaaucuagaauauaccguuguaguuaccguccaugauggugauacgcacgccguaggaaaugacacaucaaaucacggagucacugccacaauuacuccuaggagucccagcguagaagucaaacuucccgacuauggagaauuaacucuggacugugaaccuagaaguggaauagacuuuaaugaaaugauccuuaugaaaaugaagaagaaaacuuggcuugugcauaaacaaugguuuuuagaucuuccacuacccuggacaaccggugcagacaccagugaaguacauuggaauuauaaggaaagaaugguaacauuuaaggugccucaugcuaaacgacaagacgugacuguauuaggaagucaagagggugcaaugcacagugcacuagcuggcgcuacugaaguugauaguggagacggaaaccauauguuugcaggccauuuaaagugcaaaguacgcauggaaaaacucagaauaaagggaaugagcuauaccauguguuccggaaaguucagcauugauaaagaaauggccgaaacacaacauggcaccacaguuguaaaaguaaaauacgaaggcgcgggagcccccuguaaaguaccaaucgagauaagggauguuaacaaggaaaaagucguaggacguguuaucucugcuaccccauuggcagaaaauacaaauagcgugacaaacauagaauuagaacccccauuuggcgauagcuauaucgucauagguguaggaaauuccgcgcuaacccuacauugguuucggaaaggaucgucaauagguaagauguucgaaucgacauacagaggcgcaaaacgaauggccauccuuggggagacugcaugggauuuuggauccgucgguggccuuuuuacaucauuagguaaagcuguucaccaaguauucggcuccguguacaccacuauguucggcgguguuucuuggaugauuagaauacuuauuggauuucucguucucuggauaggcacgaacagcagaaauacuucgauggcaaugacuugcauagcggucgguggcauaacauuauuucuugguuucacgguccaagcagacaugggaugcguagugaguuggagcggcagagaacuuaagugcggaucuggaauuuucgucguagacaauguccauacguggaccgaacaauauaaauuucaaccugaaucuccugcuaggcuugcuucggcgauuuuaaaugcgcauaaagacgguguaugcggaauacguucaacgacaagacuugaaaauguaauguggaaacagauaacuaacgaacucaauuauguauugugggagggaggccaugaccuuaccguuguagcuggugaugugaaagggguauuaacaaaaggaaagagagcucucacacccccugcaucagacuugaaauauucauggaagacgugggggaaagccaaaauuuucacacccgaagcgcgaaauucgacuuucuuaauugauggcccagauaccuccgaauguccuaaugaaaggcgagccuggaacagcuuugaaguagaggauuacgguuucggcauguucacaacgaauauuuggaugaaauuucgugaagguaguagugaaguaugcgaucauaggcuaaugucagccgcaaucaaagaccagaaagcgguacacgcggacaugggauacuggauagaaaguagcaaaaaccaaacuuggcaaauagaaagggcuagucugaucgaaguuaagacaugcuuauggccgaagacucacacucucuggucaaacgggguuuuagaaucacaaaugcuuauuccuaaaucguaugcuggcccguuuucgcaacauaauuaccggcaaggauaugcgacgcagacagucggaccuuggcacuuaggaaaacuugaaauagacuuuggagaaugccccgggacaacuguuacuauacaagaaaauugugaccaccggggaccuaguuuaagaaccaccaccgcaucgggaaagcuagucacacaaugguguugccguagcugcacaaugccuccauugcgauucuugggugaggauggauguugguacggaauggaaauaagaccauuaagcgaaaaagaggaaaauauggucaaaucacagguuaccgcagggcaaggaacaucugagacuuucucaaugggacucuuauguuuaacacuauucguugaggaaugcuugcgccgucgcgucacacguaaacacaugauucucgcaguaguaauaacuuugugugccaucauacuaggaggacuaacuuggauggaccuacucagagcauuaauuauguuaggugauacaaugagugggagaauagguggucaaacgcaucuagccaucauggcaguauucaaaaugaguccuggauauguguuaggcgucuuccuaaggaagcuaacuucccgagaaaccgccuuaaugguuaucggcauggcaaugacuacgacucucuccaucccgcaugaccuaauggaacuuauagacggcauuagcuuggguuuaauauuacuaaaaauagucacucaauucgacaauacucagguagguacacuugccuuaagucuaacguuuauccgaucaacaauuagcuugguaauggcauggagaacuauaauggcagucuuauuuguagucaccuugauuccacuuugccgcacuucaugccuucaaaaacaaucgcacuggguugaaauuacagcauuaauacuaggggcucaagcacucccaguuuaccuaaugacucuaaugaaaggugcaagucgacgcagcuggccacugaaugaagguaucauggccguaggucucguuagccugcuggguucugcauuacucaaaaaugauguaccgcuagcuggaccaaugguggccgguggacuacugcuggccgcguacguuaugucagguuccucggcagaucuuagccuagaaaaagcugcaaauguacagugggaugaaauggccgauauuacaggaucaagcccuauuauagaaguuaaacaagacgaagauggaucuuuuuccauacgugacguagaagagacgaacaugaucaccuuacucguaaaacuagcauugauaacuguuuccggucuuuauccauuagcaauaccaauaaccaugacgcuuugguauauguggcaagugaaaacgcaaagaucuggagcucuuugggacguaccgucuccugcagcaacacaaaaagcugcauugucggaagggguguacaggauaaugcagagaggccuguucggaaaaacgcaaguuggcguaggcauacauauggaaggaguuuuucacacuauguggcauguaacacgcgggucugugauuugucaugaaacaggacggcuugagccaucuugggcagacguaagaaaugauaugaucuccuacggaggaggcuggcggcucggagauaagugggauaaagaggaggacguucaaguuuuggcaauagaaccagguaaaaauccaaaacacguccaaacaaagcccggccucuuuaagacccuaacaggggaaauaggcgcgguaacgcuagacuuuaaacccggcacgagugggucgccaauaauaaauagaaagggaaaggugauagguuuguacggcaaugguguaguaacaaaaaguggagauuaugugagcgcuauaacucaagcagaaagaaucggagaacccgauuacgaagucgacgaagauaucuuucgaaagaaaagauuaacuaucauggauuuacauccuggagccggaaaaacaaagagaauauuaccuucuauuguccgcgaggcauuaaaaaggcgucuaagaacacucauuuuagcucccacgcgagucguggcagcugaaauggaagaagccuuacgaggacugccaaucagauaucagacaccggcuguaaaauccgaacauaccggaagagaaauagucgaccuaaugugccacgcaacauuuaccacuagacuuuuaaguucaacccgggugccaaacuauaaccucauaguaauggacgaagcucauuucacagauccgagcaguguggcggcgagaggcuauaucagcacucgagucgagaugggagaagcagcagccauuuucaugacagcgacaccaccaggugcuaccgauccguuuccucagagcaauucgccaauagaggacauagaaagagagauuccagaaagaucauggaauacuggauuugacuggauuacagauuaucaaggcaagacaguaugguuuguuccguccaucaaggcugguaacgauauagcgaauugucuaagaaaaucagguaaaaagguuauucaguuaucucgaaaaacauucgacacugaauauccuaagacgaaacucacggauugggacuucgucguaacaaccgauaucucagaaaugggagcaaacuuuagagcgggcagaguaaucgauccaagacgguguuuaaaaccaguaauuuuaacagaugguccagaacgcgucauauuagcagguccaauuccaguaaccccugcaucggccgcucagcggagaggaagaauuggcaggaauccugcacaagaagacgaccaauaugucuuuucuggagauccccucaaaaaugaugaagaucaugcucauuggacagaagcaaaaauguuacuagauaauauauauacaccagaagguaucauaccuacacucuuuggaccggaacgugagaaaacccaagcgaucgauggugaauuucgauuacgaggagaacagagaaaaacuuuuguugaauuaaugcgucgaggagaucugcccguaugguugagcuauaaaguagcuucggccgguauuuccuauaaagaucgcgaauggugcuuuacgggagaaagaaauaaccaaauacucgaggaaaacauggagguugaaauauggacucgugaaggcgagaagaagaaauuaaggcccaaaugguuagacgcucgaguuuacgccgauccuauggccuuaaaggauuucaaagaauuugcaucagggcggaagaguauaacucuagauauacuaacugaaauagcaagccuaccaaccuaucuaucuagucgcgcuaaauuagcucucgacaacauaguaaugcugcacacaacagaacgcggagguagagcauaccaacacgcuuugaacgaacugcccgagucguuagaaacucuuaugcuagucgcuuuauuaggagcuaugacugcuggaauauuuuuauuuuucaugcagggaaagggaaucggaaaguuaaguaugggucuaauaacaauagcuguagccucaggacuucuauggguggcugaaauacaaccgcaguggaucgcggcuucgauaauccuagaguucuuuuuaaugguuuuauuaauaccggaaccugaaaaacaaagaacgccucaggauaaucaguuaauuuacguaauucuuacaauauugacuauaauuggauugauugcggccaaugaaaugggucuaauugaaaagacaaaaacugauuuuggguuuuaucaaguaaaaacugaaacaacuauauuagauguagaccuuaggccagcgucugcauggacauuguacgcaguugcgacaacgauuuuaacaccaauguugcgacacacaaucgaaaauacuagcgcuaaccucagucuagcagcaauugcuaaucaggcagcuguuuuaaugggacucggaaaaggauggccucuacauaggauggauuugggagugccucuucuagccaugggguguuacucgcaagugaacccaaccaccuuaacagcaucacugguaaugcugcugguacauuaugcgauaauagggccaggauuacaagcuaaagccacacgagaagcucaaaaacguacugccgccggaauaaugaagaauccaacgguugaugggauuaccguaauugaucuagaaccaauaucuuacgaucccaaguucgaaaaacaacuugggcaagugaugcuucuaguucuaugugcaggucaacuauuacuuaugagaacgacuugggccuuuugugaaguucuuacucuggcaaccggaccaaucuuaacauuaugggaaggcaauccaggucgauucuggaauacaacaauagcggugucgacagcaaauauuuucagagguucguacuuggccggagcaggauuggcauucuccuuaauuaaaaacgcacaaacuccacgccgagggaccggaaccgccggugaaacccucggagaaaaauggaaaagacaauuaaauagcuuagauaggaaggaauuugaggaguauaagcgaagcggcauccuugaggucgauagaacagaagcgaaaucagcgcugaaagaugguucaaaaauaaaacacgcuguaaguagaggaucauccaaaauacgguggauuguugaacgugguauggugaagccaaaggggaaaguaguggauuuaggcugcggacggggcgguuggaguuacuacauggcgacccucaaaaacguaaccgaagugaagggauauacaaaagggggucccgggcaugaagaaccaauaccaauggcaacauacggguggaacuuaguaaaauuacauucgggaguagacguauuuuacaaacccacggaacaaguagauacccugcuaugugauauaggagaaaguucaagcaauccaacuauugaagaaggcagaacccugagggugcuuaaaauggucgagcccugguuaaguucaaaaccagaguucuguaucaagguacucaauccauauaugcccaccgugauagaagaacucgaaaaauugcaacguaagcacgguggaaaucuaguaagaugcccauugagccgaaacucaacacacgaaauguacuggguaucuggcgcuucagguaacauagugaguucaguaaacacgaccucaaaaaugcuacucaaucgauuuaccacaagacauagaaaaccgacguaugaaaaagauguagauuuaggggcagguacuagaucagugucgacagagacugaaaaaccugauaugacgauaauaggcaggcgucugcaacgauugcaagaggaacauaaagagacuuggcauuaugaucaggaaaaucccuaucggacuugggcauaucacggaucguaugaagcuccgucgacuggaagugcgucaucuaugguaaauggcgucgugaaacuacugacuaaaccaugggacguaauaccgaugguaacucaguuagccaugacagauacgacccccuucggucaacaaagagucuucaaagagaaaguagauacuagaacaccucaaccuaaaccaggaacccgaaugguaaugacuaccacagcaaauuggcucugggcuuuacucgguaaaaagaagaacccacgcuuauguacaagggaagaguucauuaguaaaguuagaaguaacgccgcaauaggagcggucuuccaagaagaacagggcuggacgagugcgucggaagcuguaaaugacucgcgcuuuugggaacucgucgacaaggaacgugcacuucaccaagaagggaaaugcgagaguugugucuacaacaugaugggaaaacgggagaagaaauuaggcgaguuugggagagcaaaagguucaagagcaaucugguauaugugguugggugcaagauuuuuggaauuugaggcgcugggguuucucaaugaggaucauugguuugggagagaaaauucauggaguggaguagagggugaaggucuccauagacuaggauauauuuuagaagaaaucgauaagaaagacggggacuuaauguaugcagaugacaccgcggguugggacaccagaauaaccgaagaugaccuacagaacgaagaguuaaucacugaacaaauggcuccgcaccacaagauacuugcaaaggccauuuuuaagcuaacuuaccaaaauaaaguaguaaaagugcuaagaccuaccccacgaggagcugucauggauaucauuuccaggaaagaucaacgcggaagcggacaaguugguacguacgguuugaauacauucacgaacauggaaguacaacucauaagacagauggaagcggaaggcguaauaacucaagaugacaugcaaaaucccaagggcuuaaaagaaaggguggagaaaugguuaagagaguguggaguagauaggcugaaaagaauggccaucucgggagacgacugugucgugaaaccccuugaugaaagguuuggaacaagucuucucuuccuuaaugauauggggaaaguaaggaaggauauaccacaaugggagccuaguaaaggauggaagaacuggcaagagguaccguuuugcucucaucauuuucacaaaauauucaugaaagacggaagaucauugguuguaccauguagaaaucaagaugaacuaauuggacgagccaggauuagccaaggagcagguuggucacucagagagaccgcaugccuuggaaaagcauaugcacaaauguggucccugauguauuuucauagaagggaucugagacuagcuucuauggccauuuguucugccguuccaacagaaugguuuccuacgucgcguacuacauggaguauacacgcgcaccaucaguggaugacaacugaggacauguuaaaggucuggaaucguguuuggauagaagauaauccuaauaugauagacaaaaccccaguucacaguugggaggauauaccauaccucggaaaacgcgaagaccuuuggugugguagccucauaggucucucuucuagagccacgugggccaaaaacauccacacggcuauaacgcaaguaagaaauuuaauaggcaaagaggaguauguagauuauaugccgguaaugaaaagauacagugcgccgucagagucggaggggguauuauag

SEQ ID NO: 23590 - RNA, 9867 nt, Artificial Sequence
  derived and/or modified CDS sequence (opt6) from DENV-4__KP188563__SS-prME
ucaacuauaacccuuuuaugucucauacccaccguaauggccuuucauuuaucaacaagagacggagaaccccugaugauuguagcuaaacaugaacgcggaagaccucuacuguucaaaaccaccgagggaauaaauaaaugcacgcuuauagcaauggaccuuggggagaugugcgaagauacgguaacauauaaaugucccuuacuuguaaacaccgaaccagaagauauugauuguugguguaaccucacgaguaccuggguaauguauggaacauguacacaauccggagaaaggcgaagagaaaaacgcaguguugcacuuaccccacacucaggaaugggacuggaaacgagagcagagacauggaugucaucagagggagcauggaaacaugcucaacggguugaaagcuggauuuuacgaaaucccggguucgcacuucuagcggguuuuauggcuuacaugauaggacaaacagguauacaacggacaguauuuuucguacuaaugauguuaguugcaccaagcuacggaaugcguuguguagguguuggaaaccgcgacuuuguggaggguguuucaggaggagcauggguagauuuagugcuugaacacgggggcugcgugacuacgauggcccagggaaaaccaacgcuugauuuugaacuuacaaaaacuacagcaaaagaaguugcucuauugaggacguacugcauugaggcauuaaucucaaacauaaccacagcuacacgaugcccaacucagggagaaccauaccuuaaagaggaacaggaucaacaauauauaugcagaagagacguaguagacagagggugggguaaugguugugggcuuuucggaaaaggaggugucgucaccugugcaaaauucaguuguucuggaaaaauuacuggaaaccucguacagauugaaaaccuagaguacacaguaguugucacuguucauaacggagauacucaugcggucggaaaugauacuucaaaucacgggguuacggcaacaauuaccccgaggaguccaucgguagaagucaaacuuccagauuauggagaacuaacgcuggacugugagccaaggaguggcauugauuucaacgaaaugauucuuaugaaaaugaagaagaaaacuuggcuaguacauaaacaaugguuucuggaucucccuuugccauggacuacaggagcugacacaucagaaguucauuggaacuauaaagaacgcaugguaacauucaaaguuccucaugcaaaacgacaagauguuaccguacuagguucucaagaaggugcaaugcauagugcacuugcuggagcaaccgaagucgauucaggcgauggcaaucauauguucgcgggacacuuaaaauguaaagucagaauggaaaaacuaagaauaaaagguaugucauauacaauguguuccgggaaauuuucaauugacaaagaaauggcggaaacucaacauggaacaacuguagucaaaguuaaauaugaaggugcaggggcaccuugcaaaguuccaauagaaauccgugacgucaacaaagaaaaagucguaggacgggucauuagugcaacaccgcuggcggaaaacacaaauucugugacaaauauugaauuggaaccaccuuucggugauucauacauugugauaggagugggaaauucagcacucacauuacauugguuuagaaaaggauccuccaucggaaaaauguucgaaucaacguaccguggagcaaaaagaauggcuaucuugggcgaaacugcaugggauuuuggcagugucggagggcuguuuacaucccuaggaaaggcgguucaucaaguuuuugggagcguguauaccacgauguucggaggcguuucguggaugauucggauauuaauuggguuucuaguguuguggaucgguacaaauagucggaauacaucaauggcaaugaccugcaucgcuguaggaggcauuacacuauuccuaggauuuacaguccaagcagauauggguugugugguaaguuggucgggacgggaauugaaaugugggagugggauuuuuguuguugauaauguacauacauggacagaacaguauaaauuucaacccgaaagcccugcuagauuagcgagcgcaauucuaaacgcgcauaaggacgguguauguggaauuagaucuacuacccgucuggagaaugucauguggaaacaaaucacaaaugaacugaauuauguauuaugggaaggcgggcaugaucuuacuguaguagcaggggaugucaaggguguauuaacgaaggguaagcgugcacuuacaccacccgcauccgaccugaaauauucauggaaaacauggggaaaagcaaagauauucacuccugaagcgcggaacucaacauuucuaauagacggcccagauacguccgaauguccuaaugagagacgugcauggaauagcuuugaaguagaggauuauggauuugggauguuuacaacaaacauuuggaugaaauuccgagaaggcucuagcgaaguaugugaucaccgguuaaugucggcugccauaaaagaucaaaaagcaguucaugcagauauggguuacuggauagaaaguucaaagaaucaaacguggcagaucgaacgugcaucacugauagaggugaaaacauguuuauggccuaaaacucacacguuauggaguaacgguguauuagaaucacagauguuaauaccaaaaucauaugcuggcccauuuucgcaacauaauuaucgucagggguacgcuacgcaaaccguaggaccuuggcauuugggcaaguuagaaauugacuuuggcgaauguccuggcacaacugucacaauccaggaaaacugcgaucacagagguccgucccuucguaccacaacggcaucugggaagcuaguuacacaauggugcugucgaucaugcaccaugccaccacuaagauuuuugggugaagacgguugcugguacgguauggaaauaaggccuuuaagugagaaggaggaaaacaugguaaaaagccaaguaacugccggccaaggaacguccgagacguucaguaugggguuacuuugccuuacacucuuuguagaagagugucuacggcgacguguuacccggaaacacaugaucuuagcagugguuauaacccuaugcgcgaucauauuaggugggcuuacguggauggaccuacuacgagcguuaauaauguuaggagauaccaugagugggcgaauagggggccaaacacaucuagcaaucaucgccgucuuuaagaugucgccaggcuacguucuggguguauuucuacguaaacucaccagccgcgaaacagcacugaugguaauaggcauggcaaugaccacuacucuaucaauuccacacgaccugauggaacuaauagacgguauaagucuuggucucauuuuauugaaaauaguaacacaauucgauaacacgcaagugggaacauuggccuuaagucucacguucauuagaagcacuaugucauuggucauggcuuggcgaacuauaauggcaguuuuauuuguaguuaccuuaauaccauugugucguacuucauguuuacaaaaacagagucauuggguggaaauaacagcguugauucuaggagcucaagcauugcccgucuacuuaaugacauuaaugaaaggugcaucuagacgcucauggccuuuaaaugaaggaauuauggcugucgggcuaguuagucuucugggaagugcauuauuaaagaacgacguuccucucgcggguccaaugguggcuggcggauuacuuuuagccgcauaugucaugagcggaagcucugcggacuugucuuuggaaaaagccgccaauguccaaugggacgaaauggcagauauaacggguagcaguccaauaaucgaaguuaaacaggaugaagaugggucuuuuucaauacgagauguggaggagacaaacaugaucaccuuguuagugaaauuggcauuaauuacggucucggggcuauauccacuugccauuccaauaacuaugacacucugguauauguggcagguaaagacacagagaucaggagcguugugggaugugccuuccccugcagcaacacagaaggcggcacuauccgaaggaguuuauagaauaaugcagagagggcuauucggcaagacacaagucggaguaggcauucacauggaggguguguuucacacaauguggcauguaacaagaggcucgguaauuugucacgagacagggcgauuagagccaucuugggcugacguuagaaaugacaugaucucuuauggaggcggauggcgauuaggagacaagugggaucgagaggaggauguucaaguacuggcgauugaaccaggcaaaaauccaaaacauguacaaacuaagcccgguuuauuuaagacuuuaaccggugaaauaggagcaguaacgcuugauuucaaaccagggacuucugguagcccaauaauaaaccgaaagggaaaaguaauaggacuauauggaaaugguguagugacaaaaucaggugacuaugucagcgcgauaacccaggcggaaaggaucggugagcccgauuaugaagucgaugaagauauauucagaaagaaacgauuaacgauaauggauuuacauccuggugcggguaaaacaaaacguauauuaccaucaauaguuagagaagccuuaaaacgacgacucagaacacuaauauuagcaccaacgaggguagucgccgcugagauggaagaggcucugaggggcuuaccaauacguuaucaaacaccagcuguuaaaagugaacacacuggacgagaaauugucgaccuaaugugucaugccacauucacaaccagauuacugucauccacucgcgucccuaacuacaauuuaauugugauggacgaggcucauuucacugauccuuccagcguagcagcucgagguuauauuuccacacguguugagaugggggaagcugcggcuauauucaugacagcaacacccccaggggcgacagauccauuuccgcaaagcaauucaccaauugaagauauugaacgggagauaccagaacguaguuggaacacaggauuugacuggauaacggauuaccaaggaaagacgguaugguucguuccuucaauaaaagcaggaaaugauauugcaaauugcuugcggaaaagcggaaagaaaguaauacaauuaaguagaaaaacguuugacacagaauacccaaaaacaaaauuaaccgauugggauuuuguagucaccacagacauuagugaaaugggugcaaauuuucgagcuggccgagugauagacccacggcguugcuuaaaaccaguaauauugaccgaugggccagagagaguuaucuuagcuggaccaauaccuguaacaccagcuucugcggcucagaggcgaggacggauagggcgaaacccggcacaagaagacgaccaauauguauuuagcggugacccacucaagaacgaugaagaucacgcucauuggacagaggcuaagaugcuacuugauaauaucuauacaccagaagguauuauuccgacacuauuuggacccgaaagagagaaaacgcaagcuauagauggcgaguucagacucagaggagaacaaagaaagacguucguugaacuuaugaggagaggagauuuaccgguaugguugucauauaagguugcgagcgcggggauuucuuauaaagacagagaaugguguuucacaggggaaagaaauaaccaaauacuagaagaaaauauggaagucgaaauauggacuagagagggcgagaagaagaaauugaggccaaaaugguuggacgccagaguguaugcugacccgauggcccuuaaagacuucaaggaauuugcuaguggucguaaaucuauaacacucgauauacuaacagaaaucgcaucucuaccaaccuacuuaucaucuagagcgaaacuggcguuggauaauauuguaaugcuucacaccacagagagagguggacgcgcauaccagcaugcauuaaacgaacuaccagagucgcuggagacguuaauguugguggcccucuuaggugcgaugaccgcuggaaucuucuuauucuuuaugcaaggaaaaggaaucgggaaauuaucuaugggacugauaacgauugcggucgcaucugggcuucuauggguagcggaaauucaaccacaauggauagcagccagcauaaucuuagaguucuuuuugaugguacuacuuauaccugaaccugaaaagcaacguacaccacaagauaaucaacuuauuuacguuauacugacaauccuaacaauuauuggacuaauagcugcaaaugaaaugggacuaauugagaaaacaaaaacagauuuugguuucuaucagguuaaaacugaaacaacgauacuggauguagauuuaaggccagcuucggcauggaccuuguaugcgguagcaacuacaauauuaacgccgaugcuccgucacaccauugaaaauacuagcgcaaacuuaucuuuagcagcgauugcuaaucaagcugcaguacucauggggcuuggaaaggguuggccacuacaucgaauggaucuaggaguaccguugcuagcaauggguuguuacagccagguaaauccaacgaccuuaacagcuagucuaguuauguuauuagugcacuacgcaauuauaggcccaggucuucaagcgaaagccacacgagaagcacagaagcgcaccgcagccggaauaaugaagaauccuacaguugacggaaucacuguaauagacuuggaaccaaucucguaugaucccaaauucgaaaagcaauuggggcaaguaaugcuauuaguguugugugcaggacaauuacuuuuaaugagaacuacgugggcuuuuugcgaaguccuaacguuggcaacagguccaauccugacguuaugggaaggcaaccccgggagguuuuggaauacaacgauugcgguuuccacagccaauauauuuagaggauccuaccuugcaggagcgggacuagcuuucucguuaaucaaaaaugcacaaacacccagaaggggaaccggaacagcuggugaaacauugggcgagaaguggaaaagacaacuuaacagucuugacagaaaagaauuugaggaauacaaaagaucagguauauuagaaguagaucguaccgaagcaaagucagcauuaaaggaugguucgaagauaaaacaugccguaagccgcggaucuucgaaaauacguuggaucguggaaagggguaugguaaaaccgaaaggaaagguaguugacuuggggugcgguagagguggguggagcuacuauauggcaacccuuaagaaugugacugaaguuaaaggguauacaaaaggagggcccggccacgaagaaccgauuccaauggcaacauacggauggaaccuuguaaaacuucauucaggugucgacguguucuauaaaccuacugagcaagucgauacacuucugugcgacauaggagaguccucaucgaauccgaccauagaagagggacguacuuuaaggguacuaaaaauggucgaaccguggcugaguaguaaaccagaauuuuguauaaaaguccuaaauccguauaugccaacaguaauugaagaacuagaaaaacuacaaaggaaacauggagguaaccuaguccgguguccucuaucgagaaacagcacucaugaaauguacuggguaaguggggcuaguggaaauaucgugagcucuguaaacacaacaucaaaaauguuauuaaaucgauuuacuacaaggcaucgaaaaccgacauaugaaaaggacguggaucucggugcagggaccagaucaguuaguacagaaauagaaaaaccagacaugaccauuauagguagacgacuucaacgacuucaggaagaacacaaagaaacauggcauuaugaucaagaaaauccauaccguacaugggcuuaucauggaaguuaugaggcucccagcacugguagugcaucaaguauggucaaugggguagugaaacuucuaacaaagccaugggaugucauaccgaugguaacgcaguuagcuaugaccgauacuacaccuuuugggcaacagcggguguuuaaagaaaaagucgauacaagaacaccucagccgaaaccggggacaagaauggucaugaccacgacggcgaacugguugugggccuuauuaggcaagaagaaaaauccaagauuaugcacaagagaagaguuuaucagcaaaguacgaucaaaugcugcuauuggggcuguuuuucaggaggaacaaggauggacaagugccucagaagcgguaaacgauucuagguucugggaauugguagacaaggaaagagcguuacaccaagaagguaaaugugaaaguugugucuacaauaugauggggaaaagagaaaagaaauugggugaauuuggccgugcuaaagggucuagagcaauaugguacaugugguugggcgcgagguuccuugaguucgaagcauuaggguuucuaaaugaggaucauugguucggacgugaaaauucguggucaggaguggaaggagaagggcugcauagauugggguacauacuagaggagauugacaagaaagacggcgaucucauguaugcagaugacaccgcggggugggauacgcggauaaccgaagaugacuugcaaaaugaggagcuaaucacggagcaaauggcaccccaucauaaaaucuuagcaaaagcgaucuuuaaauuaacuuaucaaaauaaggucguaaaaguuuuaaggccaacucccaggggagcagucauggauauaauuagucgaaaagaccaaagggguagcggacaaguggguaccuauggauuaaacaccuuuaccaauauggaaguucagcuaauucgucagauggaagcggaagggguaauaacgcaagaugauaugcaaaacccgaaaggucuaaaggaacgagucgaaaaauggcuucgagaaugugguguggacagacuuaagagaauggcgauaaguggagaugauugcguagugaagccguuagacgagagguucggcacgagccuauuauucuugaaugauaugggaaaagugagaaaagauaucccacagugggaacccucaaaaggauggaagaauuggcaagaaguccccuuuugcagccaucauuuccauaagauauuuaugaaagacggucguaguuugguaguaccauguaggaaucaagaugaguuaauagggcgcgcaagaauaagccagggagccggguggucauuaagagaaacugcaugcuugggaaaggcuuaugcacaaauguggagccuaauguacuuccauaggagagaucuaagguuagccucgauggcaauuuguuccgcuguuccgaccgagugguuuccaacaagucggacgacauggucaauacacgcccaucaucaguggaugacaaccgaagauaugcucaaaguauggaacagagucuggaucgaagauaauccgaauaugauagauaaaacacccguccauucuugggaagauauaccauauuuaggaaagcgagaggaccuauggugcgguagccugaucggguugaguuccagagcuacuugggccaaaaauauacauaccgcgauuacucaaguacgaaaucuaaucggaaaagaagaauauguagauuacaugucagugaugaaaagguacucugcccccucagagagcgaaggaguuuuauaa

SEQ ID NO: 23591 - RNA, 9867 nt, Artificial Sequence
  derived and/or modified CDS sequence (opt6) from DENV-4__KP188564__SS-prME
ucaacuauaacacugcuaugucuaauuccaacaguuauggcauuucaucuaagcaccagagauggagaacccuuaaugaucguugcaaagcaugaacgaggucgucccuuauuauuuaaaacaaccgagggaauuaauaaaugcacauuaaucgcaauggaucuaggcgaaaugugugaagacacaguuacauacaaguguccauuacuuguuaacacugagccagaagacaucgauugcugguguaacuugacuagcacauggguuauguacggaacguguacucaaucaggcgaaagacgucgagagaaacgaaguguugcacuaacaccacauucaggaaugggauuagagacuagagcagaaacauggaugagcagugaaggagcuuggaagcacgcgcaaagagucgaaaguuggauacuaagaaaucccgguuuugccuugcuagcuggcuuuauggcauacaugauuggacaaacagguauccaaaggacaguauucuuugugcugaugaugcuaguggccccaucguauggaaugcgcuguguggggguaggcaaccgugacuuuguugaagguguaaguggaggugcuuggguugauuuaguucuugagcauggggguuguguuacaacgauagcccaaggaaaaccaacuuuagauuuugagcucaccaaaacaacugcaaaggaaguagcauuacucagaacauauuguauugaagcccucauaaguaacaucaccaccgcuacucgauguccaacacaaggcgaacccuauuuaaaagaagaacaagaccaacaauauauauguagaagagacguaguugauagaggguggggaaauggauguggucuauucgguaaaggaggggugguuacgugugccaaguuuucaugcucugggaaaauaacaggaaauuuagugcagauagaaaaccuugaauauacuguaguaguaacaguccauaacggggacacucacgcgguuggaaaugacacaaguaaccacggugucacugcaacgauaacgccaaggaguccuaguguagaagugaaacuacccgauuauggugaguuaacguuagauugugagccacgaagcgguaucgauuuuaaugagaugauuuugaugaaaaugaagaagaaaacuuggcuaguccacaagcaaugguuccuugacuuaccuuuaccauggacgacaggugccgauaccucugaaguccauuggaacuauaaagaacgaauggucacauucaaaguaccacacgcgaaaagacaagacgucacaguauuggguagucaagaaggggcaaugcauuccgcacuagcuggagcuacugaaguagauucuggcgacggaaaucacauguuugcuggacaucuuaaguguaaaguacgaauggaaaaacuuagaauaaagggaaugagcuacaccaugugcucagguaaauucucuaucgauaaggaaauggcagaaacucaacacggaacaacgguuguaaaaaucaaauacgaaggagcaggagcaccauguaaaguuccaaucgaaauaagggaugugaauaaagaaaaaguaguaggucgaguaaucagcgcaacuccuuuagcugagaacacaaacaguguaacuaacauugaauuagaacccccauuuggagauucguacauuguaauaggggucggaaauagugcucuaacauuacauugguuuagaaagggaagcucgauaggaaaaauguucgagucaacauaccgaggagcuaaaagaauggccauacucggagagacagcaugggacuuuggcaguguaggcggacuuuucacgucucuuggcaaagcaguacaucaaguguuugguucaguauauacgacaauguuuggaggcguaaguuggaugauuagaauccuuaucggauuucugguuuuguggaucgguacuaacucaagaaauacaaguauggcuaugacauguauagcgguaggagguauaacauuguuucuaggcuuuaccguccaagcagacaugggcugcguagugucaugguccggacgagaacucaaaugugggaguggaauauucgucguugauaauguacacacguggacugagcaauacaaauuucaaccugaaagcccagcgcgauuagcgagcgcaauuuuaaaugcgcauaaagacggcguauguggcauaagguccacgacgagacuagaaaauguuauguggaagcagaucacuaaugaauugaacuacguacuaugggaaggaggacaugauuuaacaguagucgcaggggaugugaaaggaguauuaacaaaggggaaaagagcauuaaccccaccagcuucugauuuaaaauauaguuggaaaacuugggguaaagcaaagaucuucacuccggaggcacguaacaguacauucuuaauagauggaccagauacaagcgaauguccaaaugaaagaagggccuggaacagcuuugagguugaagauuaugguuucggaauguuuaccacgaacauuuggaugaaauuuagagagggaucuucagaggugugugaccauagacucaugagcgcagcuauaaaagaucaaaaagcaguacacgcggauaugggauacuggauagaaaguagcaaaaaucaaacguggcaaaucgaaagagcaucacugauagaaguuaagacauguuuguggccuaaaacacauacauuauggucuaauggagucuuggagagucaaauguuaauuccuaaaucuuaugcgggcccuuucucacagcauaauuaccgccaaggcuaugcaacgcaaaccgugggaccauggcacuuaggaaaguuagaaauagauuucggggaaugcccuggaacaaccgucacgauacaagaaaacugugaccauaggggcccgaguuuaagaacgacaacagcuucaggcaaguuaguaacacaaugguguugucggucauguacaaugccaccguuaagauuucuaggcgaggauggaugcugguacggcauggaaauucguccauuaucagaaaaagaggaaaacaugguuaaaucacaagucaccgcaggucaagguacuucagaaacauuuucaaugggacuuuuaugucuuacacuuuucguugaggagugucuaaggcgaagaguaacacguaagcauaugauuuuagcuguaguuauaacauuaugugcuauaauacuuggcggucuaacauggauggaccuccugcgagcacuaaucauguuaggugauacgaugucaggaaggaucgguggacaaacccaucuugccaucauggcgguguuuaagaugucaccugguuauguccucggcguauucuuaagaaaacucacgucaagagagaccgcucugaugguaauaggaauggccaugacaaccacucugaguauuccacacgaucucauggaauuaauugaugguaucagucugggauuaauauuauuaaagauagugacacaguuugacaauacacagguaggcaccuuagcauuaucacuaaccuuuaucagaucgaccaugucgcuugugauggcguggagaacaauaauggcaguauuguuugugguaacgcuaauuccauugugccgaaccucuugucuccagaaacaaagccauuggguagaaauaacggcacuaauauuaggagcacaagcccugccaguauauuuaaugacacucaugaaaggugccucacgaagaucauggccgcuuaaugaagguauuauggcugugggccuagucucgcugcugggaucugcacuauugaaaaaugacgugccucuagccggacccaugguugcaggcggacugcuguuggcggccuacguaaugaguggaagcagugccgaccuuucacuagaaaaagcugcaaauguccaaugggacgagauggcggacaucacgggcaguaguccaauaauugaggugaaacaagacgaggacggaaguuucaguauacgagauguggaagaaacaaauaugauaacauuacucguaaaacuugcuuuaaucacugucuccggacuguauccauuggcaauuccaauaacaaugacuuuaugguauauguggcaaguaaaaacacaaaggagcggagcucucugggauguacccucgccugcagcaacacaaaaagcggcuuuaucggaaggaguauaucgaaucaugcagagaggcuuauuuggaaaaacgcaggucggcguaggaauacauauggaaggaguuuuccauacuauguggcacgucacccgcgguucagugauaugucaugaaaccggacgacuagaaccuagcugggcugacguuagaaacgacaugauuucauauggcggaggauggagacugggcgacaaaugggauaaagaggaagacguacagguauuggcaauugagccagguaagaauccaaaacauguccaaacaaaacccggucuauuuaaaacuuuaacuggugagauuggggcagugacuuuagacuucaaaccaggcacuagcggaagcccuaucauuaauagaaaaggaaaagugaucggacuuuacggaaacgggguuguaacaaaaucuggagauuacgucagcgccauuacucaagcugaaagaauaggggaaccagauuacgaaguagaugaagacauuuuucgcaagaaacggcuaacaauaauggaucuacauccaggcgcgggaaaaacaaaaagaauacuacccucaauugucagagaagcauuaaagagaagauuacggacuuuaaucuuagcgcccacaagggugguagcagccgaaauggaggaagcguuaagagguuuaccuauaagauaucagacucccgccguuaagucggaacacaccggucgagaaaucguagauuugaugugccacgcaacauuuacaacacgacuauugucauccacucgcguuccgaauuauaacuuaauuguaauggaugaagcccauuuuacugacccauccaguguagcggcuaggggcuauaucucuacgagagucgaaaugggcgaagcugcggccauuuuuaugaccgccacgcccccgggugcgacagacccauucccacaaucuaauagucccauugaagauaucgaacgcgaaauaccugaacgaucauggaauacugguuucgacuggauaacagauuaucagggaaagacagugugguucguuccuucgauaaaagccggaaacgauauagccaauugccuaagaaagagcgguaaaaaggucauacaacuaucuagaaagacauuugacacagaauauccuaaaacaaaguuaaccgacugggauuuuguuguuacaacagacauuuccgaaaugggagcaaauuucagggcuggaagggugauagauccacgacgcugcuuaaagccugucaucuuaacagauggcccggagcguguuauacucgcaggaccaaucccaguuacgcccgcuagcgcagcacagcgcagaggacggaucggcaggaauccagcccaagaagacgaucaguauguauuuagcggggauccauugaaaaaugacgaagaucacgcccauuggaccgaagccaaaaugcucuuagauaacauauacacuccagaaggaauuauuccgacauuauucgguccggaacgcgaaaagacacaagcuauugauggugaauuucgacucagaggugaacaaagaaagacguucguagaguuaaugcgacgcggcgaccuuccagucuggcuaucuuacaaaguagcgucugcuggcauuucuuacaaagauagagaguggugcuucacaggugaaagaaacaaucaaauacuagaagaaaauauggaaguggaaauuuggacacgugaaggggagaaaaagaaacugaggccuaaauggcuagaugcucgcguguaugcagaucccauggcauugaaagauuuuaaagaauuugcaucugggagaaaaaguauaacucuggauaucuuaaccgagaucgcuagucuaccuacuuauuuaagcagucgcgcaaaguuagcacuagacaacauaguuauguuacauaccacggagcgaggcgguagggcauaccaacaugcauuaaaugagcuaccagaaagccuggaaaccuugauguuaguugcccuauuaggcgcaaugacggcuggaauuuuccuauucuuuaugcagggaaaagguauugguaaacuuucuaugggcuuaauaacaaucgcagucgccucggggcugcuuuggguggccgaaauacaaccccaauggauagcugcgaguaucauauuggaauuuuuccuaauggucuuacuuaucccugaacccgaaaagcaacguacuccacaagacaaucaacuuauuuauguuaucuugaccauuuuaacaaucaucggauuaauagccgccaaugaaauggguuugauagagaaaacuaaaacagauuucggguuuuaucaaguaaaaaccgaaacaacaauucuagacguagaccuucguccagccucagcuuggacccucuaugcaguagcaacuaccaucuuaaccccgauguugcgucauacgauagagaacacuagcgcgaacuuaaguuuagcugcuaucgcaaaccaagccgcuguauuaaugggucuggggaagggguggccuuuacaccggauggaucucgguguuccacuacuugccaugggcugcuacucgcagguuaacccuacaacgcuuaccgccucgcucguuaugcugcugguucauuaugccauaauaggaccagggcuacaagcaaaggcgaccagagaagcgcagaaaagaacugccgcagggauuaugaaaaauccgacuguagacggaauaacuguaauagaucuagaaccgauaaguuacgacccgaaauuugagaaacagcuaggucaaguuaugcuccuaguuuuaugugcaggacaacuucuauuaaugagaacuacuugggcauuuugugaaguccuaacuuuagcuacugguccuacauuaacacuaugggaaggcaaccccgggcgauuuuggaauacuacaauugccguaaguacagcuaacauauuuagaggaucuuaucuggcgggugcaggccuugcauucaguuuaaucaaaaacgcacaaacaccuagacgugguacugggacugcaggcgaaacauuaggugagaaauggaagcgucaauuaaauucgcuggacagaaaagaauuugaagaauacaaacgaaguggcauauuggagguagaccgaacugaagcgaagucagcgcuuaaagacgggaguaaaauaaaacaugccguuucacgaggaucaagcaagauccgauggauuguggaacgaggaaugguaaaaccuaagggcaaaguuguugaucuaggguguggucgcggaggcuggaguuauuauauggccacacucaaaaacguaacagagguuaaaggcuacacaaagggcggaccaggucaugaagaaccuaucccaauggcaacauacggauggaaccuagucaagcuacacucaggagucgauguauuuuauaaaccaacugagcaagucgacacucuacuaugugauauaggcgaaucauccucuaauccaacgauugaggagggucggacacuccguguguuaaagaugguagaacccuggcuaaguucaaaacccgaauuuuguaucaaaguacuuaauccauacaugccaaccguaauugaggaacuagaaaaacuucaaaggaaacauggcgggaaccuaguucggugcccauuaucucgcaauucaacacacgaaauguauuggguaucuggcgcaucagggaacauaguaucaaguguaaauacaacuuccaaaauguuauuaaacagauuuacaacacgacaucgaaagccaacuuaugagaaagauguugaucucggagcgggaacaagaucaguguccaccgagacugaaaaacccgauaugacgauaauugguagacgccuacaaagacuccaagaagaacauaaagaaacauggcauuaugaccaagaaaauccauaucgaacuugggccuaucacgguucauaugaagcgcccagcacagggagugcaaguucuauggugaacgguguuguaaagcuacucacgaaaccaugggacguuauaccaaugguaacacaauuagccaugacugauacuacaccauuuggucaacaaagaguguuuaaagagaaaguugauacccgaacgccacagccaaagcccggaacaagaaugguuaugacgacgacugcgaauuggcuuugggcucuauuaggaaagaagaaaaauccacgucuguguacgagagaagaauuuauaucgaaaguaagauccaaugcagcuauuggcgcuguauuucaggaagaacaaggauggacaucugcaaacgaagcggucaaugauucuagauuuugggaauuagucgauaaagaaagagcacuacaccaggaaggcaaaugcgaaaguuguguuuauaauaugaugggcaaacgugagaagaaacuuggagaauuuggcagagcuaaaggcagccgggcgauuugguacaugugguuaggcgcuagguuucuagaauuugaggcacuuggauuuuuaaaugaagaucacugguuuggaagggagaacucauggagcgguguagaaggagaaggauuacaucgcuugggcuacauuuuggaagaaaucgacaagaaagacggcgaucucauguacgccgacgauacagcagguugggauacacguauuacugaagaugauuuacaaaacgaggaguugauaacagaacaaauggcaccccaucauaagauucucgcgaaagcaaucuuuaaauuaaccuaccaaaacaagguaguuaagguguuaagaccaacccccagaggagccgucauggauauaauuucaagaaaagaccaaagagguuccggccaggucgguacguacggguugaauacuuuuacaaauauggaaguucaacugauacgacaaauggaggcagaaggagucauuacgcaagacgauaugcagaaucccaaaggacugaaagaaagaguggaaaaaugguugagagaaugcggaguugaucgacuaaaacgaauggcgauuucaggggaugacugcgucguaaaaccauuagaugaaagguucgguacaucgcuucucuuucucaacgauaugggcaaggucagaaaagauauaccgcaaugggaaccgagcaaaggguggaaaaacuggcaagaaguaccguucuguagucaccacuuccauaaaauuuucaugaaagaugguagaagucuaguagugccaugucguaaccaagaugagcuaaucggacgcgcaagaauaucgcagggggcaggguggucguugcgugaaacugccuguuuagggaaggccuacgcacagauguggucccugauguauuuucacaggagagauuuaagauuagcgucgauggcaauuuguagcgcagucccaacugaaugguuucccacgucgaggacaaccuggucgauccaugcacaucaccaguggaugacgacagaggacauguuaaaaguauggaauagaguauggauugaagacaauccuaacaugauugauaaaacuccuguacacucaugggaagauauaccguaucugggcaaaagagaagauuugugguguggauccuuaauuggccucaguagucgugcgaccugggccaaaaauauucauacagcuauaacacaaguacgcaaucuaauagguaaagaggaguacgucgauuauaugccagugaugaaaagguauucggcgccgagcgaaagugaagguguucuuuaa

SEQ ID NO: 23592 - RNA, 9867 nt, Artificial Sequence
  derived and/or modified CDS sequence (opt6) from DENV-4__JN983813__SS-prME
agcacaauuaccuuguuaugcuuaauaccuacagugauggcuuuccaucuaucaacacgugauggagaaccauuaaugaucguugcuaagcaugaaagaggacgaccgcuucuauucaaaacuacugaaggcauuaacaaaugcacacugauagcaauggacuuaggagaaaugugugaagacacaguaacguauaaguguccguuguuaguaaauacggaaccugaagauauugacugcugguguaacuuaaccaguacguggguuauguaugguacaugcacucagagcggugaacgaagaagagaaaagaggucaguugccuugacgccacacucaggcauggggcucgaaacacgugcagaaacauggaugucuucugaaggggcauggaaacaugcccaacgaguugaaucuuggauacugagaaacccuggguuugccuuacuagcaggauucauggcuuacaugauaggacaaacgggcauucaaaggacuguguucuuuguuuugaugauguuagucgcaccaaguuauggaaugaggugugucggcguagguaaccgugacuucguggaaggcgugucaggaggagcauggguggauuuaguucuugaacauggagggugugugaccacaauggcacaaggaaaaccgacauuggauuuugaauuaacaaagacaacugccaaagaaguugcauuguuaagaacguauugcauugaagcgcuaaucagcaacauaaccacugccacuagguguccaacgcaaggagaaccuuaucugaaggaagaacaagaucaacaguauaucugcagaagggauguugucgauagaggguggggaaaugguuguggucuauuugggaaaggaggcgugguuacuugcgcgaaauuuucuugcucagguaaaauaacaggaaaccucguacaaauagaaaacuuggaguauacagugguaguaaccgugcacaauggagauacgcaugcagucgguaaugacacauccaaucacggaguuacugcaacaauuaccccgcggucuccaagcgucgaaguaaaauuaccagauuauggagaguuaaccuuagauugcgagccaagaagugggauugauuucaacgaaaugauuuugaugaaaaugaaaaagaagacguggcugguccacaaacagugguucuuagaucucccguuaccuuggacuacaggagcagauacuucagaggugcacuggaauuauaaagaacgaaugguuacauucaaaguaccgcaugcaaaacgucaggacgucacaguacuaggcucacaagaaggggccaugcauagcgcuuuagcaggggcaacagaaguugacagcggcgacggaaaucauauguuugcuggacacuuaaaaugcaaagugaggauggaaaaauuaagaauuaaggggaugaguuacacaauguguucaggaaaauuuucgauagacaaagaaauggcagagacacaacauggaacaaccguuguaaagguaaaguaugaaggggccggcgcaccuuguaagguaccgauagagauaagggacguuaauaaagaaaagguaguuggaagaguaauuagcgcaacuccucuugcggagaauaccaauucaguaacuaacaucgaauuagaaccaccauuuggagauucuuauaucguaaucggugucggcaacucagcauuaacauuacacugguuucggaaagguucaaguaucgguaaaauguuugagaguacauacaggggagccaaacgaauggcaaucuuaggcgaaacagcaugggacuucggguccgucggcgggcuauucacaagucuagggaaagcuguacaccaaguauuuggaucuguauacacuacuauguucgguggaguuucguggaugauucgaauuuuaauaggguucuuggugcuauggauaggaaccaacaguaggaacacuucaauggccaugaccugcauagcagucggaggaauaaccuuguuccugggguucacuguacaggcagacaugggaugcgucguaucguggaguggacgcgaauuaaaauguggaucugggauauuuguuguagauaacguucauacauggaccgaacaauacaaauuccaaccagaaucaccagccagauuagcgagugcuauacugaaugcucauaaagauggcgugugugggauacgcucaacgacacgucuagagaauguaauguggaaacagauaacaaaugagcuuaauuacguacuaugggaagguggucaugacuuaacuguaguagcuggagacguuaagggugugcuuacuaaagguaaacgugccuuaacacccccugcaucagauuugaaguauaguuggaaaaccugggguaaggccaaaauuuuuacacccgaagcaaggaauaguacauucuuaauugauggaccagacaccagcgaauguccuaaugaacgacgagcauggaacucauucgaggucgaagacuauggauucggaauguucacgacaaauauauggaugaaauuuagagaagguucuagugaggugugugaccauagacuuaugagugcugcaauaaaagaccagaaggcaguucacgccgauaugggauauuggauagaaucauccaaaaaucagacauggcaaaucgaaagggccucacuaauagaaguuaaaacuugcuuauggccuaagacacacacgcuuuggucuaauggaguuuuggagucacaaauguugauaccgaaaucauacgcugguccuuucagucaacacaacuacaggcaagguuaugcaacacaaacaguaggaccauggcaucuagguaaauuggagauagauuuuggcgagugcccggggacgacuguaacaauccaggaaaauugugaucaccgaggaccgagcuuacguacuaccacugcuucaggaaaguuaguaacacaaugguguuguagaucguguacgaugccaccacuccgauuccucggagaggacggauguugguaugggauggaaauacgacccuuaagugaaaaagaagaaaauaugguaaagucacaagucaccgcagggcaaggaaccucagaaaccuuuaguaugggacugcucugucuaacgcucuuuguggaagaaugcuugaggcgaagaguaacacgaaaacauaugauacucgcaguagugaucacucuuugcgcuaucauuuuaggaggauuaacguggauggauuuguuacgggcauuaauuauguuaggagacacaaugucaggaaggauuggagggcaaacucaucuagcuauaauggcaguguuuaagauguccccaggcuacguauuagguguguucuuaaggaaauuaacuuccagagagacagcucuaaugguuaucggaauggcuaugacaacuacgcuuagcauaccucaugaucugauggagcuuauagaugggauuaguuuaggacuuauauuacuaaaaauugugacacaauucgacaauacucaaguaggaacacuugcccuaucauuaacuuuuaucagaaguacuaugagcuuagucauggcguggagaacaauaauggcaguacuauuuguuguaacccucauuccccuaugccggacguccuguuugcaaaaacaaagucacuggguugagauaacagcguuaauacugggcgcucaggcuuugccgguauacuugaugacccuuaugaaaggagccucaagacgaucauggcccuuaaacgaggggauaauggcaguaggucuugucagccuauugggaucugcacuucuaaagaaugaugugccguuagcuggaccaaugguagcagggggcuuacuucuugccgcuuauguuaugucggguagcagcgcagauuugucucuagagaaagccgccaacguucaaugggaugaaauggcagacauaacggguagcaguccaauuauugaaguaaaacaagaugaagacgggagcuuuagcauacgugauguugaagagacaaauaugauuacuuuacucguaaaacucgcacuuauuaccguaucagguuuauauccauuagccauuccaauaacaaugacauugugguauauguggcaaguuaagacacaacggagcggcgcuuugugggaugucccaucaccggccgcgacacaaaaagcagcuuuaucagaagggguauauagaauaaugcaacgaggauuauucgggaaaacucagguaggugugggaauccauauggagggaguuuuccauacuauguggcauguuacaagaggcucgguaauaugucacgaaacggggagauuagaaccauccugggcugauguaagaaaugacaugauaucauacggaggaggauggagacuaggagauaaaugggauaaggaagaggauguacaaguccuggccaucgaaccggguaaaaaccccaaacauguacaaaccaaaccaggauuauuuaaaacacuaacuggcgagaucggggcaguuacauuagauuuuaaaccagggaccucuggcagccccaucauuaacagaaaaggaaaaguaauuggguuauacggaaauggaguuguaaccaaguccggugauuauauaucugccauuacucaagcagaaagaauaggggaaccugauuaugaaguugacgaggauauauucagaaagaaacgauugaccaucauggauuuacacccgggagccgguaaaacuaaaagaauacuuccgaguauugugcgcgaggcucuaaaacgaaggcugcgaacucuaauuuuagcacccacuaggguuguagcagcagaaauggaagaagcacuacgaggguuaccgauuagauaucagacgcccgcugugaaaucagagcacacaggacgagagauugucgacuuaaugugucaugccacguuuacaacucgacuauuaucaaguacuaggguaccgaacuacaauuugaucgugauggaugaagcgcauuucaccgacccaucgucaguagcugccagagguuacauuuccacaagaguagaaaugggggaagcggccgcuauuuuuaugacugcaacaccuccuggggcuacggauccuuuuccucaaaguaauucaccuauagaagacauugaaagagagauucccgaacguagcuggaauacaggauuugacuggauaacagauuaucaagguaaaaccgucugguuuguaccuucaauuaaagcggggaaugacauugcgaacuguuuaaggaaaucagguaagaaaguuauucaguuaagccgcaaaacguuugauacagaguacccaaaaaccaaacucaccgacugggauuuuguaguuacaacugacauuucugaaaugggggcaaauuuuagagccggaaggguaauagacccacgaagaugucugaaaccaguaauccugacagacggaccugagagagugauacuagccggaccaauuccaguaacuccagcuucugcagcgcagagacgaggccgcauugguagaaaccccgcccaggaagacgaucaauacguauuuagcggugauccuuugaagaaugacgaagaccaugcacauuggacagaagcaaaaauguuacuagacaacauuuacacccccgaggggaucaucccgacuuuauucggcccagagcgagagaaaacucaagcaaucgacggagaauuuaggcuccguggcgaacaacgaaaaacuuuugucgaacucaugcggcggggagaucuuccuguuuggcuaaguuauaaggucgcgucugcuggaauaaguuacaaggauagagaaugguguuucaccggagaaagaaauaaucaaauacuugaggaaaauauggaaguagaaauauggacaagggaaggagagaagaagaaauuaagaccaaaaugguuagaugcacgcguguaugccgauccaauggcauugaaggacuuuaaagaauuugcuuccggacggaagucgaucacgcuagacauucuaacugagauugcuucacuaccaacauaccugucaucaagagccaaacuugcacucgauaacauaguaaugcuccacaccacggaacgcggagggcgagccuaccaacaugcuuuaaacgaauugccggaaucucuagaaacucuaaugcucguagcucuacuaggagcuaugacagcagguaucuuucuguuuuucaugcaaggaaaaggaaucgguaaacuuuccaugggguuaauaaccauagcuguagccucgggacuucuauggguugcugagauacaaccacaguggauagcggcgagcauaauacuagaauuuuuccucauggucuuacuaaucccagaaccagagaaacaacgaacaccacaagacaaucaauugauauacguaauucuuacuauccucacuauuaucggguuaauagcugcuaacgaaaugggucucauagaaaagacaaaaacggauuucgguuucuaucaagugaagacagaaacaacgauacuagaugucgaucuaagaccugcuucagccuggacauuguaugcaguugcaacgacaauucuaacgccgaugcuacgacauacuauagaaaacacaagugcaaaucuuucauuagcagccauugcaaaucaggcagccgugcuaaugggacugggaaaaggguggccguuacauagaauggaccucggcguuccauuauuggcaauggguuguuacagccaaguaaauccuacuacuuuaaccgcaaguuuaguaaugcuauuaguucauuacgcuaucauaggaccagggcuucaagcuaaggcgacccgcgaagcacaaaagagaacugcugcuggcauaaugaaaaauccuacaguagauggaauaacggugauugaccuugaaccaauuuccuacgauccuaaauuugagaaacagcuuggucaagucaugcuauuaguucuaugugccggucaauugcuguugaugcgcaccacuugggcauuuugcgagguucuuacauuggcgacuggaccuauacuuacguuaugggaagguaaucccgguagauuuuggaauacaacgauugcuguaagcacugcuaauauauucagggguagcuaucuagcuggagcaggauuagcuuuuagucuaauuaaaaaugcccaaacaccuaggagaggaacugggacagcuggcgaaacauuaggagaaaaauggaaaaggcaauugaacucuuuggauaggaaagaauuugaagaguauaagagaucaggcauacuugaaguagaucguacugaagcaaaaagcgcucuuaaggauggaucuaagauuaaacaugcuguaucaagagguagcaguaaaauaagguggauagucgagagaggaauggucaaaccuaaaggcaaaguuguugauuuagguugcgggcggggagggugguccuauuauauggcuacccuaaagaauguuacagaagucaaaggguauacaaaaggaggaccgggacacgaggaaccuauuccaauggccacguauggcuggaacuuaguaaaacuucauagcgguguagacguauuuuauaaaccaacagagcaaguggauacauuauuaugugauaucggcgaaagcuccucaaacccgaccauagaagaagggaggacgcuucgcguguuaaaaaugguagaaccauggcuuaguucgaaacccgaguucuguaucaaaguauugaauccguacaugccuacaguaauagaggaacuagagaaauuacaaaggaaacaugggggaaaucucgucagaugcccauuaucuagaaauucgacucaugaaauguauuggguaucaggagcaucaggcaauauagucucaucugugaauacaaccaguaaaaugcuucuaaaccgauuuacaacaagacacaggaaaccaacuuaugaaaaagacgucgauuugggagcagguacgagaucagucagcacugaaacagaaaaaccggauaugacuauaauaggaagaagacugcaaagauugcaagaagaacauaaagagacauggcacuaugaucaagagaacccauacagaaccugggccuaccaugguaguuacgaggccccuucgacggguuccgcaucaucaaugguuaauggaguaguaaaacuguuaacgaagccaugggacguaauaccuaugguuacacaacuagcgaugacagauacuacuccauuuggacagcaaagagucuuuaaggaaaaaguagacacgcgaaccccacaaccaaaaccugguacacgaaugguuaugacaaccaccgcaaauuggcucugggcacuucuuggcaaaaagaagaauccacgauuaugcacacgcgaagaguucauuucaaaaguccgaucaaacgcugcaaucggagccguauuccaagaggagcaaggauggacauccgccuccgaagcgguaaaugauagcagauucugggaguuaguugacaaagaaagggcauugcaccaagaaggaaagugcgaaucuuguguauacaauaugaugggcaaaagagagaagaaacuuggagaguucggacgagcaaaaggcucucgcgcuaucugguacauguggcuaggggcgcgguuuuuagaguucgaagcccugggcuucuugaaugaagaucacugguuuggacgggagaauaguuggagugggguagaaggggaggguuuacaccgacuagguuauauuuuagaagaaauagauaagaaagacggagaccucauguaugcagacgacacagcagggugggacacaagaauaaccgaagaugacuugcaaaaugaggaacucaucaccgaacaaauggccccacaucacaagauauuagccaaggcaauuuucaaacuaacuuaucaaaauaaaguugucaaaguacuucgaccaacaccgagaggugcaguaauggacauuauaaguagaaaagaucaaaggggaucuggacaaguaggaacuuaugggcugaauacauuuacuaacauggaaguacaguuaauucggcaaauggaagcagaagguguaauuacccaggaugacaugcagaacccuaaaggacugaaagagaggguagaaaaguggcuaagagaauguggugucgacaggcugaagagaauggcaauuagcggagaugacuguguagucaagccauuagaugaacgguuugggacaucacuccuuuuccuaaaugauauggggaaagugagaaaagauauaccacagugggagccgagcaaggguuggaagaacuggcaggaaguuccauuuugcucacaccauuuucauaaaauauuuaugaaagauggaaggagcuugguuguaccgugucgcaaccaagacgaauuaauuggucgagcaagaauuucucaaggugcaggguggucauugagagaaacugcuugucugggaaaggcauacgcacagauguggucucuuauguacuuucacagaagagaccuaagauuggcaagcauggccauuuguagcgcaguaccgacagaaugguuuccuacaagccgaaccacuuggucgauucacgcccaccaucaauggaugacuacggaagacauguuaaaaguauggaauagagucuggauugaagauaacccuaacaugauugauaaaacaccagugcauuccugggaagacauuccauauuuaggaaagagagaggaucuaugguguggcagucucaucggauugucgucucgggcuacaugggcuaaaaauauucauacugcaauuacacaaguucgcaauuugauuggcaaggaagaguauguugauuauaugccagucaugaagagauacagugcccccagugaaucagaagguguauuguaa

SEQ ID NO: 23593 - RNA, 9867 nt, Artificial Sequence
  derived and/or modified CDS sequence (opt6) from DENV-4__KF041260__SS-prME
ucaacuauaacacuuuugugccuuauaccaaccguuauggcuuuucaucugaguacucgagauggugaaccauugaugauuguagcgaaacaugaacgaggaagaccacuacuauuuaaaacgacugaagguaucaacaaauguacacuaauagccauggaccuuggagaaaugugugaagacacaguaacauacaaauguccauuguuagugaauacugaaccggaagauauugauugcuggugcaauuugacuuccgcuuggguaauguaugguaccuguacacaaucaggggaaagacguagggaaaaacgaucgguagcuuugacgccucauucuggaaugggccuugaaacaagagccgaaacguggauguccucagaaggcgccuggaaacacgcccaacgcguagaaucauggauacuaaggaauccaggauuugcccuuuuagcgggcuucauggcauauaugaucgggcagacuggaauccaaaggacaguauucuucauuuuaaugauguugguagccccuucauacgguaugcgaugcguagggguugguaacagggacuuuguugagggaguaaguggaggagcauggguagacuuaguuuuagagcacggcgguuguguuacuacuauggcccaagggaaaccgacacucgacuuugaguugauaaaaaccacagcuaaagaaguugcucugcuacgaacauauuguauagaagcuaguauuucuaauauaacaaccgcaacgcgaugcccaacacagggagaaccauaccugaaagaagaacaagaucaacaauacauaugucgaagagauguaguagauagaggaugggguaaugggugugguuuauucggaaaagguggcguaguuacaugugcaaaauuuucauguucaggaaaaauaacuggaaaucuuauacagauagaaaacuuagaauauacuguaguaguuaccguccacaauggcgauacgcacgccgugggcaacgauacgaguaaccacggcguuacagcuacaguuacaccaaggucaccaucaguggaagucgaauuaccagauuacggagaacugacacuagacugcgaaccaagaagcggaauagauuucaaugaaaugauacuuaugaaaaugaauaagaagacauggcuaguccacaaacagugguuucuugaucuaccacucccauggacugccggagccgauacaagugaaguacauuggaaccauaaagagcgaauggugacauucaaagugccacaugcaaaaagacaggauguaacuguucuaggaagucaagaaggugcuaugcauagcgcgcugacaggagcaaccgaaguggacucgggggauggcaaccauauguucgcuggacauuuaaagugcaaaguaagaauggaaaaauuacguauaaaggggaugaguuauacuaugugcagcgguaaguucuccauagauaaagaaauggcugaaacucaacacgggacgacgguaguaaagguaaaauaugaaggagcaggcgcuccguguaaaguucccauagagauuagggacguuaacaaagaaaaaguaguaggucguauaaucagcucgacuccauucgccgaaaacacuaauagcguaacgaauauagaauuagaaccuccauucggagacucauauauagucaucggaguaggggacagugcauuaacucuucacugguuccgcaaagggucgucuauaggaaaaauguuugagaguacuuauagaggcgccaaaagaauggcuauacuaggagagacggcaugggacuucggaucggugggcggauuauuaacuucuuugggcaaggcuguucaccagguguuugguucgguguauacgacgauguucggaggaguauccuggaugguccguauacuaauuggauuucucguacuauggaucgggacaaauagccguaauacgucaauggccauguccugcauagcgguagguggaauaacgcuauuuuuaggauucacuguacacgcggauauggguugugcuguaucauggagcgguaaagaacugaagugcggcagcggcaucuucauaaucgauaacguucauacauggacagagcaguacaaguuccaaccagaaucuccggccagguuggcgucagccauccucaaugcgcauaaagaugggguaugcgguauucguucuacgacuagacuugaaaacguaauguggaagcagauuaccaacgaacucaacuauguguuaugggaaggaggacaugaucuaacuguagucgcaggagacgucaaaggcguuuugucaaaaggcaaaagagcgcuugcgccaccuguaaacgaucuuaaauacaguuggaaaaccuggggaaaggcaaaaauauucacccccgaaacgagaaacucaacguuccugaucgacggaccagacacgagugaauguccuaacgaaagacgagcguggaacuuucuagaaguagaggauuaugguuucgguauguuuacaaccaacauuuggaugaaguuuagggaaggaaguagugaaguaugugaccauagguuaaugucugcugcaauaaaagaccaaaaggcaguccaugcugacauggguuauuggauugaaucaaguaagaaccagacguggcagauagaaaaagcaaguuuaaucgaggucaagacuugucuguggccuaagacacauacgcuauggucgaauggaguauuagaaagccaaaugcuaauccccaaagccuacgccgggccauuuucacagcacaacuaucgucagggauacgccacacagaccaugggcccauggcaucuuggcaaguuagaaauagacuucggagaaugccccggaacaacuguaaccauccaggaggacugcgaccauaggggacccagcuuaaggacaacuaccgcuucaggcaaguuagucacucaauggugcuguagaagcugcacaaugccaccgcuaagauuuuuaggagaagaugggugcugguacggaauggaaauacguccauuaagcgaaaaagaagaaaauaugguaaaaucucaaguaagcgcgggucaggguaccucagagacauucuccaugggcuuauuaugccucacacucuucguugaggagugccuaagacgcagaguaacacgaaaacauaugauccuagugguagucacaacccuaugugccauaauauuaggagguuuaaccuggauggaucugcuuagggcucuaauaauguuagggaauacgaugucaagucguaugggcggacaaacgcauuuagcuaucauggcaguauuuaaaaugucgccaggauacguacugggcauauuccugagaaaauuaacuucaagagaaacagcuuuaauggucauaggaauggcuaugacaacaguguuguccauuccgcaugaucucauggaauuuauugauggaauuucauuaggacuaauucugcuaaaaauggucacgcacuucgauaacacacaaguagggacuuuagccuuaucacucacauuuaucaaaucaacaaugccgcuaguaauggcauggcggacaauaauggcuguacuauuuguugucacauugauaccauuauguaggacaucaugcuuacaaaaacagagucauuggguagaaaucacagcguuaauacuuggugcucaagcacuaccuguuuaucuuaugacacuaaugaagggagcuucaaagcgcucauggccucugaaugagggaauaauggcaguaggacucguaucauuauuggguuccgcacuucucaaaaaugacgugcccuuggcuggaccuaugguagcuggagguuuguugcucgcugcauauguaaugucgggcucgucagcugacuuaagccuagaaaaagcggcuacaguucaaugggacgaaauggcagauaucacgggaagcucuccaaucauagaaguuaaacaagaugaagauggaucauuuucgauaagagacguagaagaaacuaauaugauaacauuauugguaaaauuggcauuaauaacaguaagugggcuguauccccuugcaauaccagucacuaugacgcugugguauauguggcaaguaaagacucaacggucuggugcccuaugggauguaccaaguccggcggcaacacaaaaagccacacucacggaaggaguauacagaauaaugcagaggggcuuauucgggaaaacgcaaguuggaguuggaauacauauggaaggaguauuucauacuauguggcauguuacacggggaucggucauuugucacgaaaguggacgacuugagcccucaugggcagaugugaaaaaugauaugauaaguuauggugggggauggcgacuuggggauaaaugggacaaagaagaagacguccaaguauuagcaguugagccagguaaaaacccgaaacacguucaaacgaaaccuggcuuauuuaaaacguugacuggcgaaauaggggcgguuacacuagauuucaagccagggacuuccgguucuccaauuauuaaccguaaaggaaaggucauugggcucuaugguaaugggguagugacaaaaucgggugacuacgugucagcaaucacucaagcagaaaggaucggggaaccggauuaugagguagaugaagacauuuuuaggaagaaacgauugacuauuauggaucuucauccgggagcagguaaaacaaaacgaauauugccuucaauuguacgugaggcuuuaaaaaggcgucuacguacucugauucuagccccuacuagaguuguagcggcagagauggaagaggcuuugcgcggcuuacccauaagauaucaaacacccgcaguuaaaacagagcauacaggacgagaaauagucgauuuaaugugucaugcaacauucacgacacgcuuacuaucgucuacaagggucccgaacuauaaccuaauaguuauggaugaagcgcacuuuacggauccaucuagcguugccgcaagagguuacauaucaacgagggucgaaaugggugaggcggcagcuauauuuaugacagcgacuccuccaggaacaacggauccauucccccagucgaauagccccaucgaagauauagaacgggagauuccggaaaggucauggaacacgggauucgacuggauaacagauuaucagggcaagacagugugguuugugccaaguauaaaagcuggaaacgacaucgcaaacuguuuacguaagucuggcaagaaaguuguccaacucucgagaaaaaccuuugacacugaauauccaaaaacuaaacuaacugacugggacuuuguagugacuacggauauuagcgaaaugggagcuaauuucagagcugggagggucauugacccacguaggugucuaaaacccguaauuaucacagauggucccgaacggguaauacuugcagguccuauuccgguuacaccagcuagcgcagcacaacgacgagguagaaucgggaggaaucccgcccaggaagaugaucaguauguauucucuggagacccuuugagaaaugacgaagaucacgcacauuggacagaagcuaaaaugcuucuggauaacauacauaccccagaaggaaucauuccuacacuuuuuggaccagaaagagaaaagacacaggcgauagacggagaauuuagacuuagaggugaacagaggaaaacguucguagagcuaaugagacgaggagacuuaccagucugguuaucuuacaaaguagcgucagcgggcauauccuacaaagaucgugaaugguguuuuacuggcgaaaggaacaaccagauuuuagaagagaauauggaaguugaaauauggacaagagaaggagagaagaagaaacuuagaccuaaauggcuugaugccagaguauaugcugacccaguugcgcuaaaagauuuuaaagaauuugcauccggaaggaagaguauuacccucgacauacuaaccgaaauagccucauuaccaacauacuuaucuucacgugcaaaguuagcucuggauaacauagucauguuacacaccaccgaaagagggggaaaagcguaccaacacgcguugaacgaauuaccugaaaguuuagaaacauuaaugcucgucgcccuucuaggugcuaugacagcagguaucuuuuuauucuucaugcaaggcaaggguaugggaaaauuguccaugggucugauagcuauagcgguggccucuggucugcugugggucgcggaaauucaaccacaauggauagcagcaucaauaauauuagaguuuuuccuaauggcacugcuaauaccagaaccagagaaacagcggacaccacaggauaaucaauuaauuuacguaaucuugacaauacugacuaucaucggacuugucgcugcaaaugagaugggcuuaauagagaaaacuaagacggacuuuggguuuuaccagguaaaaacagaaacaaccauuuuagauguagaccuccggccugcaucugcauggacauuauaugcagucgcaacuacgauucuuacaccaaugcugagacacacaaucgaaaacaccucagcuaauuuaucauuagcagccauagcaaaucaagcugcaguucuaaugggucuagggaaagguuggccauuacaccguauggaccuaggugucccgcuacuugcaauggggugcuacucucaaguaaauccaaccaccuuaacggcgucucucguaauguuauugguacauuaugcgauaauuggaccaggucuacaggccaaggcaacaagggaagcgcagaaaaggacagcagcagggauaaugaaaaacccaacuguugacgguaucacuguaauagauuuagaaccuauaaguuacgauccgaaguuugaaaagcaauuaggucagguaaugcuauuaguacuuugcgccgggcaacuucuucuaaugagaacaacaugggcuuucugcgaaguccucacuuuagcaacaggaccaauuuugacuuuaugggaagguaacccuggaagauuuuggaauaccacgauagcugucucaacugcgaauauauuccgaggaaguuaucuggccggagcaggguuagcguuuaguuugaucaaaaauacacaaacgccuagaagggguaccgguacaacaggagaaacauugggagaaaaauggaaaagacaauuaaauaguuuagauaggaaggaguucgaagaauauaaaagaagugguauucuugaaguagaccgaacagaagcuaaaucugcucucaaagacggaaguaaaauaaaauaugcuguuagcagaggaacaagcaaaauaagguggauagucgaaagaggaaugguuaagccaaaaggaaaggucguugaccuagggugcggacgaggaggauggucauauuacauggccacacuaaagaaugucacggaggucaaaggauauacaaagggaggaccagggcaugaagaaccgaucccaauggccacauauggauggaauuuagucaaauugcacagcggaguggauguauucuauaaaccaacagaacaaguagauacauuacugugcgacauuggugagaguucuaguaaccccacuauagaagaagggagaaccuuacgcguacuaaaaaugguggagcccugguuaucuucuaaaccagaauuuugcauaaagguacuaaauccuuauaugccuacgguaauagaagaacuugaaaaauuacaaagaaaacauggagggaguuugguacgaugcccauuaagcaggaauaguacccaugaaauguauugggugaguggaguaucgggaaauauuguuucgucugugaauacaacguccaagaugcuacuaaacagguuuacaacaagauacagaaaaccaacuuacgaaaaagaugcagaccuuggugcggguacuagaucaguuaguaccgaaacagaaaaaccagauauggcaaucaucgguagaagauuacaacgucuccaagaagaacauaaagaaacauggcacuaugaccaagaaaauccauaccgcacaugggccuaucaugguagcuaugaagcuccaucaacuggaagugccucgucaaugguaaaugggguagugaaacucuuaacuaaaccgugggacgucauaccgaugguaacccagcuagcaaugaccgauacuaccccuuucggccaacaaagaguauuuaaagagaaaguugauacaagaacaccucaacccaaaccugguacucgaaugauaaugacaacaacagcaaauugguugugggcuuuacuuggaaagaagaagaauccucgccuauguacaagggaagaauuuauaucuaaaguuagaucaaaugcagcaaucggagcaguauuucaggaggaacaggguuggacaagugcguccgaggcgguaaaugacucaagauucugggaguuaguugauaaagaaagggcguuacaucaagaagguaagugcgaaucauguguauauaacaugauggggaaacgugagaagaaauugggggaguuuggaagggcaaaagguucucgugcgauuugguauaugugguuaggagcaagguuccucgaguuugaagcacuagguuucuuaaacgaagaccauugguucggaagagaaaauaguuggagcggcguugaaggugagggcuuacaucgauugggauauauacuugaagauauagacaagaaagacggugauuuaauauaugccgacgacacggcugggugggacacaagaaucacggaagaugaccuguuaaacgaagaacuaauaacagagcagauggcaccacaucacaaaauucuggcgaaagcaauuuuuaaacuuacguaucaaaacaaaguaguuaaaguucucaggccaacaccgaaaggagcgguaauggacauaauuucaagaaaagaccagcguggaagcgggcagguaggaacguauggccucaauacauucacgaauauggagguucaauugauacgucaaauggaagcugaaggcgucauuacucgagaugacaugcauaaccccaaggggcuaaaagagcgcguagaaaaaugguuaaaggaaugcggagucgaccgucugaagcguauggcaauaucuggagaugacuguguaguaaaaccuuuagaugaacgauuuagcaccucacuacucuuuuuaaaugauaugggaaagguuagaaaagacaucccccaaugggagccaucaaaaggauggaagaauuggcaagaaguuccauucuguucacaccacuuccauaaaauauucaugaaagauggccgaagucuuguaguuccuugcaggaaucaagaugaauugauuggcagagcgagaauaucgcaaggagcuggauggucguuacgagaaacagcgugccuaggaaaagcguacgcccagauguggagucugauguauuuccaucgacgcgauuuacgccuagcuagcauggcaauuuguuccgcagucccuaccgaaugguuuccaacaaguagaacuaccuggucaauacacgcucaucaucaguggaugacaaccgaggauaugcucaagguguggaaucgaguauggauugaggauaauccuaacaugacagacaaaacucccguucauucgugggaagacauuccauaccuugggaaacgcgaagauuuaugguguggcucccugauaggauuaagcaguagagccacaugggccaaaaauauccacacggcaauuacgcagguacgaaauuuaauuggcaaagaagaguauguggacuacaugccgguaaugaagcgcuauucugcaccauucgaaagugaagguguucuguag

SEQ ID NO: 23594 - RNA, 9867 nt, Artificial Sequence
  derived and/or modified CDS sequence (opt6) from DENV-4__FJ024476__SS-prME
aguacgauaacauuacugugucugauaccaaccguuauggcuuuccaucuaagcacucgagacggagaaccuuuaaugauagucgcuaaacaugaaagaggucgucccuuacuauucaaaaccacagaagggaucaauaaauguacgcuuauagcaauggaucugggagaaaugugugaagacacaguaacguacaaauguccccuauuaguuaauacagaacccgaagauauagacugcugguguaaucuuaccgcaacaugggugauguacggaacuugcacacaaucuggagaacgucgacgagagaaacggucuguggccuuaacaccgcauucuggcaugggacuagaaacacgcgcggaaacuuggaugucaucagaaggugcauggaaacaugcucaaagaguugaaucuuggauauuaaggaauccgggauuugcuuugcuggccgguuuuauggcauauaugaucgggcaaacugggauacaaagaaccguguucuuuguucugaugauguuagucgccccaucauaugguaugcgaugcguuggaguuggaaacagagauuuuguugaaggaguguccgggggcgcaugggucgauuuaguauuagaacaugggggaugugucacaacuauggcacaaggaaaaccuacauuagauuucgaauugacaaaaacaacagcgaaagaaguugcuuuacuacggacauauuguaucgaagcgucuaucagcaauauuacuacugcuaccaggugcccuacacaaggagaaccuuaucuuaaagaagaacaagaucaacaauacaucuguaggagagauguugucgaucgcggcugggggaacgggugcggacuuuucggaaaaggcggagugguuacuugcgcaaaauuuagcuguagcggcaaaauaacugguaauuugguccaaauugaaaaucuagaauauacagugguaguaacuguccauaauggagacacacaugcagugggaaaugacaccucaaaccauggcguaacugccaugauaacgccccgcucucccucuguggaaguaaaacugccagauuauggagaauugacauuggauugugaacccagaucggggauagacuuuaaugaaaugauauuaaugaaaaugaagaagaaaacauggcuuguacacaaacagugguuucuagaccuaccacuuccauggacugcaggggccgauacauccgaaguucauuggaauuacaaagaacggauggucacauuuaaaguaccccacgcuaaacgccaagauguuacaguacucggaucgcaagaaggagcuaugcauucggcccuggcuggagcuaccgaagucgauucuggagacggcaaccacauguucgcgggacacuuaaaauguaaaguacguauggaaaaacuuaggaucaaaggaaugagcuacacgaugugcagcggaaaauuuagcauagauaaagaaauggcugaaacccaacacgggacuacuguugucaaaguuaaauacgaaggugcgggagccccguguaaaguaccgauagaaauaagagacguaaacaaagaaaaagucguugguagaauaauaagcucuacaccacuagcagaaaauacaaauucagugacuaauauugaacuggaaccgccauuuggagauuccuauauagugauaggaguugggaacucugcucuaacucuacacugguuccguaaagguaguagcaucggaaaaauguuugaaagcacuuauagaggggcaaaacgaauggcuauccuaggugaaaccgccugggauuucgggucaguaggaggguuauuuacaaguuuaggcaaagcgguacaccaaguguuuggcucaguguauacaacaauguuugguggaguaucauggaugaucagaauacuaauuggucuauuagugcuauggauagggacuaauagucguaauacgucaauggcuaugacauguauagcagucggagguauuacccuguuccuuggauucaccguucaggcagacaugggcuguguaguaucuuggagugguaaagaauugaaaugugggucaggaauauuuguaguagacaaugugcacacauggacagagcaauacaaauuccagcccgagagccccgcaagguuggcgagcgcaauauuaaaugcucauaaagacggcguauguggaauccgaucuacaacgagguuagagaacgugauguggaaacagauaacaaacgaacuaaauuacguccuaugggaaggagggcacgaccucacuguaguugcaggcgacguaaaaggaguucuaacuaaaggaaaacgggcacuuacuccacccgucucugaccuaaaguauaguuggaaaacaugggguaaagccagaaucuuuacgccagaggcacgcaacagcacauuucucauugaugguccagauaccucagaauguccuaaugaaaggagagcguggaacucgcuagaaguggaagauuauggguucggaauguuuacaacgaacauauggaugaaauuccgagaaggaagcucggagguaugugaucauaggcuaaugagugcggcgauaaaagaccaaaaagcuguccacgcagauaugggcuauuggauagaaucuagcaaaaaucaaacguggcaaauagaaagggcauccuuaauagaggucaaaacaugucucuggccaaaaacacacacuuuauggucgaaugggguucuugaaagccaaaugcuuauuccaaaaucuuaugcagggcccuuuucacagcauaauuaccgacaagguuacgcaacacagacuaugggaccauggcaucuagguaaauuagaaauaggauucggggaaugccccggaacaacgguuacaauacaagaagauugugaccauagaggcccaucauugcgcaccaccacagcaucuggcaagcuagucacccaaugguguugucgaagcuguacuaugccaccgcuacgcuuccuaggggaagacgguuguugguauggaauggaaaucagaccacuaucugagcgcgaggaaaacauggugaaaagucaaguaacagcuggucaaggaacaucagaaacauuuaguauggggcuacuuuguuugacgcuauuuguggaggaaugcuugagaagacgaguuacaagaaaacauaugauauuaguuguaguuauaacucuaugugcaauaauauuaggcggccuuacuuggauggaccuauuaagagcacugauaauguuaggagauacaaugagcggaaggaucggaggucaaauacacuuggcgauuauggcaguuuucaaaaugucgccagguuacgugcucgguguuuuucuaagaaaguuaaccucacgugaaacggcccuaaugguuauaggaauggcgaugacaaccguucuuucaauuccgcacgaccuuauggaauuaauugacgguaucagcuuagguuugauacuucuaaaaauuguaacacaauuugacaauacacaaguagggacucuggcccuaucuuuaaccuuuauccggucaacuaugccacuggucauggcguggaggaccauaauggccguacuauuuguaguaacauuaauaccguuguguagaaccucaugucuccaaaagcaaagucauugggucgagauaaccgcauuaauucuaggagcacaagccuuaccagucuaucuuaugacacugaugaaaggcgcuagucguagaucuuggccacuaaaugagggaauuauggcuguaggucucgucagccugcuaggauccgccuuacugaaaaacgauguaccacuagcuggacccaugguagcugguggauuauuacuugcagcauaugucaugagugguuccagcgcagaucuaucucuugagaaagcagccaauguacaaugggacgaaauggccgacauuacuggauccucaccuaucaucgaagugaaacaagacgaggaugggagcuuuucgauacgggacguugaagagacaaacaugauuacguuacucguaaaacuagccuuaauaacaguuagcggccuauaccccuuggcuauucccguuacgaugacuuugugguauauguggcaaguaaaaacgcaaagaucuggggcauugugggauguaccgaguccugcagcuacacaaaaggcugcacuaagugagggagucuaccgaaucaugcagagaggacuauucgggaaaacacagguggguguagguauacacauggaggguguuuuucacacuauguggcaugucacaagaggaucaguuaucugccacgagacgggccgccuggaacccuccugggcagacguaaggaacgauaugauaagcuacgguggcgguuggcgauuaggugauaaaugggacaaagaagaagauguacaaguucuugcaauugagccuggcaaaaauccgaagcacgugcagacaaaaccuggcuuauuuaaaacauuaacuggcgaaauuggggcuguaacauuagacuuuaaacccgguacuagcggaaguccgauaauuaauagaaaagguaagguaauaggucuguacggcaauggaguuguuaccaaauccggugauuauguaagugcaaucacucaagcugaaagaauuggagaaccagacuacgaaguagacgaagauauuuuuaggaagaaaagauugaccauuauggaccuacauccgggugccggaaaaacaaaacguauacuaccgucuauaguaagggaggcuuuaaaaagaagguuacgaacacuuauucuagcgcccacuagaguugucgcagcagaaauggaagaagcacugagaggucugcccauucgcuaucaaacaccagcaguaaaaucagaacauacgggacgagaaauuguggacuuaaugugucacgcaacuuucacuacacgccuacuaucuucaacaagggucccaaauuacaaccuaauaguaauggacgaggcccauuucaccgacccauccaguguugcggcaaggggauauaucucgaccagaguugaaaugggcgaggcugcugcgauauuuaugacagcaacacccccaggagcgacugaccccuuuccacaaucaaacagcccaauagaagauauagaacgagaaauccccgagaggaguuggaacacugguuuugacuggauaacagauuaucaagggaaaacgguaugguuuguaccaucaauaaaagccggaaacgauaucgcaaacugucuuagaaaaucuggaaagaaagucguucaauuaucaaggaaaacguuugauacagaauacccuaaaacaaaacugacagauugggauuuugucgugaccacagauauuucugaaaugggggccaacuuuagggcagggcgcguaauagauccuagacgcugccuaaaaccgguaauucugacugacggcccggaacgaguaauacucgcugguccaaucccaguaacuccugcaagcgcugcgcaacgucgaggcagaauaggucguaauccagcucaagaagaugaccaauacguguucaguggagacccacuuaagaaugaugaagaccacgcucauuggacagaagcuaaaauguuauuagauaacauuuacaccccugaagggauaauacccacguuauucggaccagagcgagagaaaacccaagcaauugauggggaauuucggcuucggggagaacaaagaaaaacauuugucgaauugaugagaagaggagauuugccgguuugguuaucauauaagguagcaucggcgggaauuaguuauaaagaccgugaaugguguuucaccggagaaagaaacaaucaaauauuggaagaaaacauggaaguggagauuuggacgcgagaaggugagaagaagaaauuaagaccaagauggcuugaugcccgggucuaugcagauccgauggcuuuaaaagauuuuaaagaauuugccagcggacgaaaaucuauuacauuagacauuuuaaccgaaauagcuucacuucccacguaucuaaguucacgagcaaaguuagcgcuugacaacauagucaugcuacacacaaccgaaagagguggacgggcauaccaacacgcacuaaaugaguuaccggaaucgcuggagacccuaauguugguggcccuccugggagcuaugacagcgggaaucuuuuuguucuucaugcaaggaaaagguauagguaaauuauccaugggcuugauuacuauagcaguagcaucuggacugcucuggguagcggaaauacaaccacaauggauagccgcgucaauuauuuuagaguucuuuuugaugguacuguugauaccagaacccgaaaaacaaaggacaccacaagauaaucaacuaauauaugucauacuuacaauucuaacgaucaucggauuaauagccgccaacgaaaugggacucauagagaaaacuaaaacugacuucggauucuaucaggugaaaacugaaaccacaauauuagauguggauuuacgaccugcuagugccuggacacuuuacgcaguugcgaccaccauacucacaccuauguuaagacacaccauugagaauacaagugcaaaucugucauuggcugcgauagcaaaccaagcggccguacuaaugggucucgguaaaggcuggccgcugcacaggauggaccucggggugccucuucuugcgauggggugcuacucacagguaaauccaacaacccuuacagccucucugguuaugcuucuagugcacuacgcgaucauaggcccaggacuacaagccaaggcaacucgagaagcacaaaaacguacagcagcaggaauaaugaaaaauccaacaguagacggaauaacugucauugaucuggaacccaucucuuacgauccaaaauucgaaaagcaacucggucagguuaugcuauuaguccuuugcgcaggucaauuacuucuaaugcgaacaacuugggcauucugcgaaguucuaacauuggcaaccgguccaauacuaacgcuaugggaaggcaaucccgggcguuuuuggaauacaacuauagcugugaguacugcaaacauauucagaggaucauaccuagcaggggcgggauuagcuuuuagucuaaucaaaaacgcgcaaacaccuaggagagguacagguacaacaggcgagaccuuaggagagaaguggaaaaggcaauuaaacagucuagauagaaaagaauuugaagaauauaaaagaaguggaauauuggagguagacagaacagaagcaaagucugccuuaaaagauggcaguaagauaaaacacgccgucucaagagguaguucuaaaauucgcuggauuguagaaagggguaugguaaaaccgaaagggaaaguaguggaccucgguuguggccgaggaggauggaguuacuauauggcuacgcuaaagaacguaacagagguuaaagguuauacaaaaggugguccggggcacgaggaaccgauuccaauggcaacauaugguuggaauuuagucaaacuccauaguggaguagacguauucuauaaaccgaccgagcaaguagauacacugcuuugugacauaggagaauccuccaguaaccccaccauagaagagggaagaacguuaagagugcucaaaaugguagagccuugguuaagcucaaaaccggaauuuugcauuaaaguccuaaauccuuauaugccaacggugauugaggaacuggaaaaacuucaaagaaaacacggugggaaucuaguacguuguccuuugucaagaaauucgacucacgaaauguauuggguauccggugcgucgggcaacauagugucaucgguaaauacuaccuccaagaugcuacuuaacagauuuacuacccgccaucgcaaaccaacuuaugagaaagaugucgaccugggcgccggaacaaggucaguuucaacugaaacggagaaaccagacaugacuaucauaggaagacgacuccagcguuuacaggaagaacauaaagaaacguggcauuacgaucaggaaaauccauauagaacaugggcauaccauggaagcuaugaagcacccucaacuggaucagcgaguaguauggucaacgggguaguaaaacuauuaacgaaaccuugggauguaauuccgauggugacacaacuagcaaugaccgauacuacaccguuuggacagcaacgggucuucaaagagaaagucgauacuagaacaccccaaccgaaaccugggacaaggaugguuaugacuacuacugcuaauuggcuuugggcacuauuaggcaagaagaaaaauccucgacuauguacgagagaggaguucauaaguaaagugcgauccaaugcagcuauaggagcaguuuuccaagaagaacagggauggacaagcgcuuccgaagcagucaacgacucacgguucugggaauuaguagacaaagaaagagccuugcaucaagaaggaaaaugugaauccugcguauauaauaugaugggaaaacgagagaagaaacucggugaauuuggucgugcaaagggaucgcgcgcaauuugguacauguggcuaggagcaagguuuuuagaguucgaggcuuuaggauuuuuaaacgaagaucauugguucggccgagaaaauaguuggagcggcguugaaggagaaggauuacauagauuagguuauaucuuagaggagauugauaagaaagauggagaccuaauguaugccgaugacacggcuggaugggauacgagaaucacugaggaugaucuacaaaacgaagaacuuauuacugagcaaauggcaccgcaucauaagauacuggcaaaggcaaucuucaaauuaacauaucagaacaaagucguaaagguacuaagaccaacacccagaggugcggucauggauauaauuucacguaaagaucaacgaggaucaggucaaguugggacuuacggauugaacaccuucacaaacauggaagugcaauugauuagacaaauggaagcggaagguguaauuacgcaggacgauaugcagaaucccaagggccugagagaacgcguagaaaaaugguugaaagaauguggaguugacagauuaaaacguauggcaauuucaggugaugauuguguggucaagccacuagacgaaagauucggaacaucauuauuguucuuaaacgauaugggaaaagugcguaaggauauaccacaaugggagccaucaaaaggauggaagaacuggcaagaagugccauucugcucacaucauuuucauaaaauauuuaugaaggaugggcgaucauuaguagugccauguaggaaccaagaugaauugauagggcgugcacguauaucacaaggagcagguuggucucugagagaaacagcuugccugggcaaagccuacgcgcaaauguggucucuaauguacuuucacagaagagaccuacgacuugcgucaauggcaauuuguuccgccgugccaacggagugguuuccaacgagccgaacgacauggaguauacaugcccaccaucaauggaugacaaccgaagauauguuaaaaguuuggaacagaguuuggauugaggauaauccaaacaugacagacaaaacuccaguccauuccugggaggauauuccauauuuagggaaaagagaagaccucuggugcggcaguuuaauaggacuaucaagccgugcaacaugggccaaaaacauucauacagcaauuacacaaguaaggaaccuaauaggcaaagaagaauauguggacuacaugccagugaugaagcgcuauuccgcuccaucagagucugaaggaguucuauag

SEQ ID NO: 23595 - RNA, 9867 nt, Artificial Sequence
  derived and/or modified CDS sequence (opt6) from DENV-4__GQ868579__SS-prME
agcacgauaacucuguuaugucugauucccacgaucauggcauuucauuuauccacgcgagauggggaaccacucaugauuguggcaaaacaugaaagaggacgcccucuucucuuuaaaaccaccgaagguaucaauaaaugcacucuaauugccauggauuuaggagaaaugugugaagacacaguaacauacaaauguccucuacuaauuaauacagaaccggaagauauugauuguugguguaaucugacuagcacaugggucauguauggaacuuguacgcagucaggagaaagaagaagagagaaaagaagcguagcguuaacaccacauagugguaugggacuggaaacuagggcugaaacguggauguccucggaaggagccuggaagcaugcccaaagagucgaauccuggauuuuacgcaaucccggauucgccuuauuagcgggauucauggccuacaugaucggucagacaggcauucaaagaaccguauucuuuauacuaaugaugcuuguagcacccaguuacggaaugagauguguaggagugggaaaccgggacuuugucgaaggagucucuggaggagcauggguagauuuaguacuggaacauggcggaugugugaccacgauggcucaagguaagccgacacuggacuuugaauugacaaaaaccaccgcaaaagaaguugcgcuuuuacggacguauugcauugaagcacuuauaaguaacauaaccacagcaacuagauguccuacccaaggugaaccauauuugaaagaagaacaagaucagcaauauauauguagaagagacgucguagauaggggcuggggaaauggaugcggcuuauucggaaaaggagggguugucacaugcgcgaaauucucuuguucuggcaaaaucacugguaaucugguucaaauagaaaaucuggaguauacaguuguaguuacuguacauaacggagauacacaugcagugggcaaugacaccagcaaucacgggguaacugcaaccauuacacccagaucaccaucaguagaagucaaauugccagauuacggagaguuaacauuagacugugagccucggucaggcaucgacuucaaugaaaugauauugaugaaaaugaagaagaaaacuuggcuuguccauaaacaaugguuucuggaccuaccguuacccuggacagcaggagcugauaccucggaaguacauuggaauuacaaggaacggaugguaacauuuaaagucccccaugcaaaacgacaagacgucacgguccuuggaagccaggaaggagcgaugcacuccgcacuggcuggcgcgacagaaguagauagcggugacgguaaucacauguuugcaggacaucuaaaaugcaaagugagaauggaaaaacugagaaucaaagguaugaguuauacuauguguucaggaaaguuuagcaucgauaaggagauggcugagacacaacacgggacaaccguuguaaaaguuaaauaugaaggugccggcgcaccauguaagguaccaauagaaauucgagacguuaauaaggaaaaaguuguaggacgaguuauaucaucuacgccguuagcugagaacaccaauucuguaacaaauaucgaauuagagccuccuuucggugauucauauauaguuauuggaguaggcaacucugccuuaacacuucauugguuuagaaaaggcuccagcauagggaaaauguuugaauccacguaccgaggggcuaaaagaauggcaaucuugggagaaacagcgugggauuucgggagcguuggaggacuuuuuaccagucuuggaaaagcaguucaucaaguuuuugggaguguguacacaacuauguucgguggugucagcuggaugaucaggauacugaucggauucuuaguucuauggauuggaaccaacucaaggaauacaucuauggccaugacaugcauugccguaggagguauaacauuauuuuugggauucacgguaagagcagauaugggcugcguggucaguuggaguggcagagaguuaaaaugugggaguggaauuuuugucguagauaauguccauaccuggaccgaacaauauaaauuucagccggaaagcccugcucgauuagcaucugcgauuuuaaacgcgcauaaagauggugucuguggcaucagaucuacuacacgacucgaaaauguaauguggaagcaaaucacaaaugaguugaauuacgugcuaugggaaggaggucacgaccuaaccguaguugcuggggauguaaaaggaguacuuacuaaaggcaaaagagcguuaacuccaccgguuucugaccuuaaguauucauggaaaacuugggguaaagccaaaauauucacaccagaagcuagaaacucuaccuuccuuauugauggcccggauacaucugaauguccaaacgaacgcagggccuggaacagccuagagguagaagacuaugguuucggaauguucacgacgaacaucuggaugaaauuccgugaagggaguucagaaguaugcgaccaucgacuuaugucagccgcgaucaaagaucagaaagcuguacacgcagauaugggcuacuggauugaaucuaguaaaaaucaaaccuggcaaauugagagagcaaguuuaauagaagucaaaacaugcuuauggccaaaaacgcacacacuguggaguaauggaguacuagaaucacaaaugcugauaccaaaaucuuaugcgggaccguucagucagcacaauuauagacaaggauacgcgacucagacgguagggccuuggcauuuagguaaacuggagauagacuucggagagugcccuggcacgacuguuacgauccaagaggauugcgaucaucgugguccaagucuaagaacuacuacagccaguggaaaacucguaacacaaugguguuguagaaguugcacaaugccaccucuucgguucuuaggugaagacgguuguugguaugguauggaaauuagaccauuaucugaaaaagaagagaauaugguaaaaucgcaaguaacugcaggucaaagcacaucggagaccuucucuaugggacuuuuaugccuaacucucuucguggaagaauguuuaagacggcguguaacccguaaacacaugauuuuagcagucguaaucacacuuugcgcuauuauuuuagguggcuuaacauggauggauuuacuucgagcauugauaaugcucggcgacacaaugucgggacgaaucggagggcaaacacaccuagcgauuauggcagucuucaagaugaguccaggauaugucuuagguguguuucuucgaaaacuuacgagcagggaaaccgcuuuaaugguaauaggaauggccaugacuacuacauugaguauuccccacgaucuaauggaauuaauagaugggauaagucuaggacucauacuguuaaagaucgucacacaauuugacaauacacaaguugguacacucgcguugucucuuacauuuauuagauccacuaugagccuaguaauggcauggcgaacuaucauggcgguacuauuuguaguaacauuaaucccuuugugccggacuagcugcuuacaaaaacaaucacacuggguagagauaacagcacucauuuugggugcacaggcgcucccaguguaucugaugacccuuaugaaaggagcuaguaggcgaaguuggccccugaaugaaggaauaauggcaguaggauuagugucauuauuaggcagugcguuauuaaagaacgacgugccacuagcagguccuaugguagcugguggacuuuugcuggcagcauauguuaugucgggcaguuccgcagaucuaucacuagaaaaagcagcgaacgugcaaugggaugaaauggcagauauuacugguucaucuccaauaaucgaaguaaaacaagacgaagauggcucguuuucaauaagagacgucgaggagacaaauaugauuacucuauuaguuaaacucgcuuuaauaacaguaucagggcucuaccccuuagcaauaccaguuacaaugacacuaugguauauguggcaagucaaaacacaaagaagcggugcuuugugggauguccccucucccgcagcgacccagaaagcggcacuaagugagggugucuaccgaaucaugcaaaggggguuauuuggcaaaacucagguaggagugggaauacauauggaagggguuuuucauaccauguggcauguaacuagaggaaguguaauaugucaugaaacuggaagauuagaaccuagcugggccgauguaagaaaugauaugauaucauauggaggaggauggcgacuaggggauaaaugggacagagaagaagauguccaaguguuagcuauugaaccgggcaaaaacccaaaacauguucagacaaaaccaggucucuuuaaaacauuaacuggggaaauaggggccgucacuuuagacuucaagccgggaacaucagguuccccuauuauaaauaagaaaggcaaaguuauagggcuauauggcaacggcguaguaaccaaaaguggagauuauguaucagcaauuacucaagcagagcggauuggagaaccagauuaugaaguggacgaagacauauuccguaaaaagcgacuaacgaucauggaucuucaccccggugcagguaaaacaaaaaggauacuuccuucaaucgugcgagaagcacuaaaaagacgacugagaacacuuaucuuagcacccaccagaguuguagcagcggagauggaagaagcacugcgaggucuuccaauacguuaucaaacaccggcuguaaagucagagcacacaggccgcgagauuguggacuuaaugugucaugcgacuuucacaaccagacucuugucuucaacgagagucccgaacuauaaucuaauuguaauggaugaagcacacuuuacagauccauccuccguugcagcacgcggguacauaucaacccguguagaaaugggggaagcugcagcgauauucaugaccgcgacgccucccggagcgacugaucccuucccacaaaguaacagcccaauugaggacaucgagcgugaaauuccagaaagauccuggaauacaggauuugacuggauuacugauuaucagggaaaaacaguaugguucgucccaucaauaaaggcaggaaaugacaucgcgaauugucuucguaaauccgguaagaaaguaauacaauugucaagaaaaacauuugauaccgaauauccuaaaacaaaacuaacugauugggauuuuguuguuacgaccgacauuucugaaaugggcgcuaacuuucgagcagggcgugucauugauccucgacgaugcuugaagcccguaaucuugacagacggaccggagcgagugauacuagcaggcccgauaccaguuacaccagcuagugcagcucaaagaaggggaagaauaggcagaaacccugcccaagaagacgaccaguacguauuuucuggugauccccucaaaaaugaugaagaucaugcacacuggacggaagcaaaaaugcuccuggacaacauauacacaccugaagggauuauccccacauuguuuggaccugaaagggagaaaacgcaagcaauagauggcgaguuucgccugcgaggagagcaacgaaagacuuuugucgaacucaugaggaggggagaucuuccaguuuggcuaucauacaaagucgcuucagcggggauaaguuauaaagaccgcgaauggugcuucacgggcgagagaaauaaucagauacuagaagaaaacauggaaguagaaauuuggacccgggaaggagagaagaagaaauugagaccacgauggcuugaugcacgagucuacgcagaccccauggccuugaaagacuuuaaagaauuugcaucuggaagaaaaaguauaacauuagauauuuugacugaaauagcaucacuuccgacauaccuaagcagcagagccaaauuagcgcuugauaacaucgucauguuacauacuacagaaagagggggucgagcauaccaacaugcauuaaacgagcucccagagagccuugaaacguugauguuagucgcauuacuaggugccaugacugcaggaacguuucuguucuuuaugcaagggaaagggauaggaaagcuaucuaugggacuaauuacaauagccauggccagcggguuacuauggauugcggaaauacaaccacaauggauagcagcuucuaucauacucgaguucuuucuuaugguccuucuaauuccagaacccgagaaacaacgcacgccgcaagacaaucaacuaauuuacguuauucucacaauucuagcaauuaucgguuuaaucgcagcgaaugaaauggggcuaauagagaaaaccaaaacugauuucggauucuaccaaguuaagacagaaacaaccauucuggaugucgaucugcgccccgcuagugccuggacacucuaugccguagccaccacaauauuaacgccgauguuaaggcacacuauugaaaauacaagugccaacuuaaguuuggccgcaauugcaaaucaggcagcggucuuaaugggucuggguaaaggguggccucuucauaggauggauuugggagucccauuauuagccaugggcuguuauagccagguaaauccaacgacauuaacugcaucccuagugaugcuauuaguacacuaugcaauaauagguccaggacuacaagcuaaggcaacacgcgaagcgcagaaacgaacagcugccggaaucaugaaaaauccuaccguugaugguaucacagucauugacuuagaaccaauaucauaugauccaaaguucgagaagcagcuugggcaaguaauguuauuaguuuugugugcuggccaauuacuccuaaugcgaacaacaugggcguucugugaaguguuaacucuagccacaggaccuauccuuacauuaugggaagguaauccgggaagauucuggaacaccaccauugcuguaagcaccgccaacauauuuagagguuccuaucuagccggugcaggucucgcauuuagccuaaucaaaaaugcucaagccccaagaagaggcacagguacaaccggcgaaacacucggcgaaaaauggaaaagacaacugaauaguuuagaucgaaaagaguucgaagaauauaaacgaucagggauauuagaagucgaucgcacugaagcaaaaagugcuuugaaagacggaaguaaaauaaagcaugcgguaucaagaggauccagcaaaauuagauggauaguugagagggguauggugaaaccaaaaggaaaaguaguagauuugggauguggacgcgggggcuggucguacuacauggcuacauugaaaaaugucacagagguuaaagguuauacaaaagguggaccgggacacgaagaaccgauuccuauggcgacauauggcuggaaucugguuaaauuacauucggguguagauguauuuuauaaaccuacugaacaaguugauacuuuguugugcgacauuggugaaucgucaagcaacccaacgaucgaggaaggaaggacguuaagagugcucaaaaugguagaaccaugguuaaguucaaaaccugaauuuuguaucaagguucuaaacccauauaugccaacuguaauugaagaacuagagaaacugcaaagaaagcaugguggaaaccuagucagaugcccgcucaguagaaauucaacucacgagauguauuggguauccggugcuuccggaaacauugucucgucuguaaacacaacuucgaaaaugcucuugaauagauuuacaacucgucaccgaaaacccaccuacgagaaagacguagaucuaggugccggaaccagaagugucagcacagaaacugaaaaaccugauaugaccaucauugguagacggcuccaaaggcugcaagaggagcacaaagaaacuuggcacuaugaucaagagaaucccuaccguacuugggcguaucauggcaguuaugaagccccgucaacgggaucagcaagcagcaugguaaauggagucguaaaacuuuuaacaaaaccaugggacgucaucccuauggucacgcaacuugcgaugacagacacaacuccauuugggcaacaaagaguuuuuaaagaaaaaguagacacccguacuccccagccuaaaccugguacucgaaugguuaugacgacgacugcaaauuggcuaugggcuuuauuggggaaaaagaaaucucccagauuguguacaagagaagaguucauuucuaaagugagauccaacgcagcgaucggggcaguauuucaggaagaacaaggauggacaagugcuucugaagcggucaacgacucgcgguuuugggaacucgucgauaaagaacgagcacuacaucaagaggggaaaugugagaguugugucuauaauaugaugggaaaaagagagaagaaacuuggagaguuugguagagcgaaaggaagccgagcaaucugguauauguggcuaggagcacgguuuuuagaauuugaggcauuaggcuuucuaaaugaagaccacugguucggccgugaaaacucuuggucaggaguagaaggagagggauuacaucgacucggauacaucuuagaagaaauugauaagaaagauggagaucuaauguaugcugaugauacugcugggugggauacgagaaucacugaagacgauuugcaaaaugaggaauuaauaacggaacagauggcaccacaccauaaaauacuagcaaaagcaauauucaaauuaacauaucagaauaagguaguaaaaguuuuaagaccaacaccccgaggagcaguuauggauauaaucucacgaaaagaucagagaggcucaggucaaguagguacauacgggcuaaacacauucacuaacauggaaguacaauuaauucgacagauggaagcagagggggucaucacccaagaugacaugcaaaacccaaagggcuuaaaagaacgugucgaaaauugguuacgagaguguggaguagacagacuuaaacgaauggcaauuagcggagacgauuguguuguuaagccuuuggacgaaagauuuggaaccaguuuacuuuucuuaaacgacauggguaaaguaagaaaagauauaccucagugggagcccucaaaggguuggaaaaauuggcaagagguaccguuuugcucccaucacuuucauaaaauuuuuaugaaagauggcagaucauuaguaguacccuguagaaaucaagaugaacuaauuggcagagcacgaauuucacagggugccgguuggucacuaagagaaacugccugucucgguaaggcauaugcucagaugugguccuuaauguacuuucaucgucgcgaucuccguuuggcgucaauggcaaucuguucugcaguuccaaccgaaugguucccuacaagccgaacuacuuggagcauccaugcgcaucaucaguggaugacuacagaagauaugcuuaaaguguggaauaggguauggaucgaagacaaccccaauaugauagacaaaaccccagugcauagcugggaagacauaccuuauuuagguaaacgggaagacuuauggugcggaagccugauagggcuaucaaguagagccacgugggcuaagaauauacauacagcuaucacacaaguaagaaaucuaauugguaaagaagaauauguugacuauaugccuguuaugaagagguacucagcaccgucugaaagcgagggugugcuguga

SEQ ID NO: 23596 - RNA, 9867 nt, Artificial Sequence
  derived and/or modified CDS sequence (opt6) from DENV-4__GQ868580__SS-prME
ucgacuauuacccuccuuuguuuaauaccuacuauaauggcuuuccaucuuucaacuagagacggagaaccacucaugaucgucgcuaaacacgaaagagggaggccauuauuguuuaaaacuacagaaggaauuaauaaaugcacuuuaauugcuauggaucucggugaaaugugugaagauacgguuacauauaaaugcccgcuacuaaucaauacagagccagaagauauugacugcugguguaaucuaaccucaacuuggguaauguauggcacgugcacccaaucaggugaacgaagaagagagaaacgcuccguagcauuaaccccgcacucgggaaugggcuuagagacucgugcagaaaccuggaugaguucagaaggugcuuggaaacaugcccaacggguagaaucguggauacugaggaacccagguuucgcacugcuagcaggauuuauggcuuacaugauuggacaaacuggaauacagagaacgguguucuuuguguuaaugaugcuaguugcgccaucauauggaaugagauguguaggagugggcaacagagauuucguagaaggcgugagcgggggugcuugggucgacuugguauuagaacauggcggcugcguuacaacuauggcucaaggcaaaccgacauuagacuuugagcuuacaaaaacgacggcuaaagagguagcauuacucagaacauacugcauugaagcgcuuauaucgaacaucacgaccgccacaagauguccaacacaaggcgaaccauaucucaaagaagaacaagaccaacaauauauuugucgacgggacguuguggauagggguuggggaaacgguugugguuuauuuggaaaaggaggagucgugaccugugcuaaauuuucauguucaggcaaaauaacuggaaauuuaguucaaauagagaauuuggaauacacaguaguagucacaguacauaacggugacacacaugcagucgguaaugauacauccaaucauggcguaacagcgacgauaacgccaagaucuccuaguguagaaguuaaauugccggacuauggugaauuaacauuagacugcgaaccucgcucagggauagacuuuaaugagaugauauuaaugaaaaugaagaagaaaacgugguugguacauaaacaaugguuucuagacuuaccacuuccguggacugcgggggcggauaccucggaagugcacuggaacuacaaagaacgaaugguaacauuuaaaguaccgcacgcuaaaagacaagacgucacaguuuuaggaagccaagagggugccaugcacagugcgcuagccggcgcuacugaaguugauucuggagacggaaaccacauguucgcgggacauuugaaauguaaaguuagaauggaaaaacuuagaauaaaaggaaugaguuauaccauguguucagguaaauucucuaucgauaaagagauggcugaaacccagcacgguacuacugucgugaaaguaaaauacgaaggagcaggcgcuccuugcaaagugccuaucgagauaagagaugugaacaaagaaaaggugguaggcagaauuaucucuaguacuccauuggcugaaaacacgaacagcgugaccaauaucgaacuagaaccgcccuuuggcgauucauacauuguaauuggaguagggaauagcgcccuaacacuacauugguuucggaaaggaucuuccauuggcaagauguucgaaucuacuuauaggggugcaaaaagaauggcaaucuuaggagaaaccgccugggauuucggcagcguagguggguuauuuacaagucuaggaaaagccguucaccaaguuuuuggaucagucuacacaacuauguuuggcggcguaagcuggaugauacgaauuuuaauuggcuuuuuaguauuauggauaggaaccaauagcaggaacaccagcauggcaaugaccugcauagccgucggaggaauaacauuauuccuagguuucacggugcaagcagauaugggcuguguaguaagcuggagcggaagggaguuaaaauguggaagcggcauauucguagucgacaacgugcauaccuggacagaacaguauaaauuucaacccgaaagcccugcacgacuagcgagugcaauauugaaugcccacaaagauggaguaugugggaucagaucaacgacuagacucgaaaacguuauguggaagcaaauaacuaacgagcuaaacuacguucuaugggaaggcggccacgacuuaacaguagucgcgggagacguaaagggcguguugacaaaggguaaacgagcacuaacaccuccagucagcgauuugaaauauucauggaaaacaugggggaaagcgaaaauauuuacaccugaagcaagaaauucaacauuccugauagauggcccugacacgucugagugcccuaaugaacgacgagccuggaacagucuugagguugaagacuacggauuuggaauguuuacuacuaauauauggaugaaauuucgagaaggaucgucagaaguaugugaucacagacugaugucggccgcaauaaaagaccagaaggcuguucaugcugauaugggcuacuggauagagucuagcaaaaaucaaacguggcaaauugaaagagcaagucuuauagaaguaaaaaccugcuuauggccaaagacucauacacuguggucuaauggcgugcuggagagucaaaugcuuauaccaaaaagcuacgcgggaccuuuuagucaacauaauuacaggcaaggguaugcaacccaaaccguugguccguggcaccuagguaaacuagagauagauuuuggagaaugcccaggaacuacggugacuauacaagaagacugugaccaucgcggaccuagccuuagaacuacaacugcuuccgggaaguugguaacccaauggugcuguaggucguguacaaugccaccuuuaagauucuugggcgaagacggaugcugguacgggauggaaauaaggccacugaacgaaaaagaagaaaacaugguuaaaagccaggugacagcugggcaguccaccagugaaaccuuuagcauggguuuguuguguuugacacuauucguagaagaaugucuaaggagacggguaacucggaaacacaugauacuagcaguagugauaacauuaugcgcuaucauucuaggaggccugacauggauggaucuucuucgugcacuuauuaugcuaggggauacaaugagcggucguaucggaggucaaacucaccuugcaauaauggcaguguucaaaaugagcccaggauauguacuuggcguuuucuuaaggaaguuaacuucacgagaaacggcuuuaauggugauuggaauggcaaugacuaccacauuuucgauaccucaugacuuaauggaauuaauagacggaauuagucuuggccuaauacuucucaaaauaguaacacaguucgacaauacgcagguaggaacguuagcguugagcuuaacuuuuauuagauccacaaugagcuuaguaauggcuuggcguacuauaauggcaguauuauuuguaguaacauuaauaccccuauguagaacaaguuguuuacaaaaacaaagucacugggucgaaauaaccgcucuaauacuaggcgcccaagcccuuccaguuuaccuaaugacgcuaaugaaaggggcaagccgacgaagcuggccucuuaacgaaggcaucauggcaguagggcuaguaucauugcuuggcagugcuuuguuaaagaacgacgucccgcucgcaggaccuaugguugcagggggauuauuacuggccgcguauguuaugucaggaucaucagcggaccuauccuuggaaaaagcugcgaacgugcaaugggaugagauggcugacaucacaggaucuucacccauuauugaaguuaaacaagacgaggauggcuccuuuucgauacgagacguggaagaaaccaauaugauuacacuucuaguuaaacucgcacuaaucacaguaucaggauuauauccccuugcaauacccgucacuaugaccuugugguacauguggcaaguuaaaacucaaagaucaggagcuuuaugggauguacccucucccgcugcaacgcaaaaagcugccuugagugagggaguauaccgaauaaugcagagaggauuacuuggaaagacccaaguuggcguaggaauacauauggaaggaguguuucauacaauguggcauguuaccaggggaucaguuauuugucaugaaaccggaagacuagaaccaucuugggcagacguacgaaaugauaugauauccuauggcggugguuggaggcuaggggauaaaugggaccgagaagaagauguucaaguguuagcuauagaacccggcaagaaccccaagcacguacagacgaaaccagguuuauucaaaacgcuuacaggagaaauuggugccguaacucucgacuuuaaaccggggacaagugggagucccauaauuaaucgaaaggguaaaguuaucggauuauauggcaauggaguugucacgaagucaggggauuaugugucagcgauaacccaagcagaaagaauaggggagccagauuaugaagucgaugaagauauauuucggaaaaagagauuaacgauaauggauuuacaucccggugcuggcaagacgaaacgcauuuuaccaucgauaguaagagaagcucuaaaacgacgucuaagaacacuuauuuuggcaccuacacgaguaguugcugcagaaauggaagaagcacuacgaggacugcccauuagauaucaaacuccugcaguaaagucggagcauacaggacgugaaauagucgaccuuaugugccacgcaacauuuaccacaaggcuauuaucaucaacacggguaccgaauuauaauuuaaucguaauggacgaagcacacuucacagacccauccucaguagcggcacgagguuacauaaguacgcguguagagaugggagaagcagcggcgauuuuuaugacagccacgccaccaggcgcuacugacccuuucccacaaagcaauucucccauagaagauaucgaacgcgaaaucccagaacgaucguggaauacggguuuugacuggauuacugacuaccaggggaaaacagucugguuugucccuagcauuaaggcaggcaacgauaucgccaacugucuuagaaaaucuggcaagaaagugauucaauuaagcagaaaaacuuucgacacagaauauccgaagacaaagcugacagauugggauuucgucguaacuacagacaucucagaaaugggagcuaacuucagggcaggucgcgucauugauccgagacgcugccuaaaaccaguaauucuaacagacggaccggaaagaguaauacucgcuggaccuauaccugucaccccagcuucagcagcacagagacgaggaagaaucgguaggaaucccgcacaagaggaugaccaauauguauucagcggagauccacucaagaaugacgaggaccaugcacauuggaccgaggcaaaaauguuauuagacaacauuuauacuccugagggaauaauucccacccuauuugguccugaaagagaaaagacacaagccauugacggugaauuuagacuccguggggagcagagaaaaacauuuguugaguugaugagaaggggagauuugccaguauggcuaaguuacaaaguagcuuccgccggcauaaguuauaaagacagagaguggugcuuuacuggggagcguaauaaccagauccuugaagaaaauauggaaguagaaaucuggacgagggagggugagaaaaagaaauugaggcccagguggcuugacgcgcguguguacgcugacccaauggcauugaaagacuuuaaagaauuugcaaguggcaggaaaaguauaacauuagacauacucacagaaaucgcuucacuuccaacauaucugaguucccgugcuaaauuagcacucgacaacauaguaauguuacacacaacugaacgaggaggacgagcguaucaacaugcccuaaaugagcuacccgaaucucuagagacacucaugcugguagcacugcuaggcgcuaugacagcugguauuuuucuauucuuuaugcaaggcaaagguauugguaaauuguccauggggcuaauuacaauagcaauggcaucaggauuauuauggaucgcugagauacagccucaauggaucgcagcgucuauuauacuagaguucuucuuaaugguucuacugauaccagagccggagaaacaacggacaccccaagauaaucaacugauauacguaaucuuaacuauacuaacuauuauugguuuaauugcggcaaaugaaauggggcuaauagagaaaacaaaaacagauuuuggcuuuuaucaggucaaaacagaaacuacgauacuggauguagacuugcgaccugcgucagcguggacuuuauaugcgguagcaaccacgauccucacacccaugcuacgucacacuauugaaaacacgucugcaaauuuaucgcucgcagcaauagcuaaucaagcugcuguacuuaugggccuaggaaaagguuggcccuuacacagaauggauuuagguguaccauuacuugcuaugggaugcuacucucaaguaaaucccaccacgcuuacagccagccuaguuaugcuucuaguccauuaugcaauaauagguccuggacuucaagcgaaagcgaccagggaagcacagaaaaggacugcagccgguauuaugaaaaacccaacuguagacgguauaaccguuauagacuuagaaccaauaucguaugauccuaaauuugaaaagcaacuaggacaaguaaugcuauuaguccuuugcgcgggacaguuauuauuaaugaggacaacaugggcguucugcgaaguccuaacguuagcaacaggaccaauacuaaccuugugggaagguaaucccggacgauucuggaauacuacuauugccguuucgacagccaauaucuuucgugguagcuaucuugcgggugcaggucuagcuuuuagcuuaauuaaaaacgcacaaacgccucgaagaggaacaggaacgacaggggaaacguuaggugaaaaguggaaacgacaauuaaauagcuuggacagaaaggaauuugaagaauauaaaagaucuggcauacuagaaguagaccggaccgaagccaaaagugcacucaaggacggcagcaaaauuaaacaugcaguaaguagagggaguuccaaaauucguuggauagucgaaagaggaauggucaagccgaaagggaaagucguagaccugggauguggcagaggugguuggucguacuauauggcaacacuuaaaaacguaacagaaguaaaaggauauaccaaaggagguccaggacaugaagaaccaauuccgauggcuaccuauggauggaacuuaguaaaguuacacagcggcguugacguuuucuauaagccaacagagcagguagauacucuacuaugugauauuggggaaucuucaaguaacccaacgauagaggagggucgaacuuuaagaguauuaaaaaugguagaacccuggcuuucaucuaaaccagaauuuuguaucaaaguacuaaaucccuauaugccaacuguaauagaggaauuagaaaaacuacagaggaaacauggagggaaucuaguuagauguccauuaucaagaaauagcacucacgaaauguacugggugaguggagcuagugggaauauaguaaguagugucaauaccacuucuaaaauguuacuaaauagguuuaccacaagacacagaaaacccaccuacgaaaaagacguugauuuaggagccggcacaagaucuguaaguacagaaacugagaagcccgauaugaccaucauuggacgaagauuacaaagguuacaagaagaacauaaagaaacuuggcauuaugaucaggaaaaucccuaccgaaccugggccuaucauggaaguuacgaagcuccaaguacugguucggcuagcucuaugguuaauggaguaguaaaauuauugaccaaaccaugggacguaauuccaaugguaacacagcuugcgaugaccgauacaacuccuuuuggccagcaacggguguuuaaagaaaaaguagacacuagaacaccacaaccuaaaccaggcacaagaaugguuaugacuacgacagcaaacuggcugugggcacuacuuggaaagaagaaaaguccgcggcucuguacaagagaagaauuuauaaguaaaguaaggaguaaugcagcaauaggggccguuuuccaggaagaacaaggauggacaagcgcgucagaagcgguuucggauaguagguucugggaauuagucgauaaagaaagagcacuucaccaagaggguaaaugugaaucuuguguauacaauaugauggggaaacgggagaagaaauugggagaauuugggagagcaaaaggaucaagagcaaucugguauauguggcuaggagccagauuccuagaauuugaagcacuuggauuuuuaaacgaagaucauugguucggcagagaaaauuccuggucaggcgucgaaggcgaaggccuccacagacucggguauauuuuagaagagauugacaaaaaggauggggaccuaauguacgccgacgauacagcgggaugggacacaagaauaacugaggacgaccuacagaacgaagaacugauaacagaacagauggcaccccaucacaaaauuuuagccaaagcuaucuucaaacugacauaucaaaacaaaguaguuaaaguauuacgaccgaccccaaggggcgcuguaauggauauuauuagucguaaggaucaaagaggaucgggccaaguggggacuuacucacuaaacacauuuaccaauauggaaguacagcugaucagacagauggaagcagaagguguaaucacacaagaugauaugcagaauccuaaaggacucaaagaaaggguagagaauugguuaagggaaugcggcguugacagacuuaagcgcauggcaaucucuggagacgauuguguugucaaaccgcuugaugaacguuucggcaccucacuauuauuucucaacgacauggguaaagucagaaaagauauuccacaaugggaaccgagcaaagguuggaaaaauuggcaagagguuccauucugcucacaucauuuucauaaaaucuucaugaaagauggccgaucacuuguaguuccgugucguaaucaagaugaacuuauaggacgggcgcguauaucacaaggugccgggugguccuugagagaaaccgcaugucucgguaaggcuuacgcucagauguggagucucauguauuuccaccgaagggacuugagauuagcaagcauggcaauuuguagcgccgucccgaccgagugguuuccaacuagcagaacgacguggaguauucacgcccaucaccaauggaugacaacagaagacaugcugaaaguauggaauagagucuggauugaggacaauccaaauaugaucgacaaaacgccaguacacucgugggaagacauaccauaucugggaaaacgugaggauuuguggugcgguucuuugauaggauuaucgaguagagcaacaugggcgaaaaacauacacaccgcuauaacacaagucagaaauuuaauugguaaagaggaauauguugauuauaugccaguaaugaaaagauauuccgcaccuagcgaaucagaaggggugcucuaa

SEQ ID NO: 23597 - RNA, 9867 nt, Artificial Sequence
  derived and/or modified CDS sequence (opt6) from DENV-4__GQ868583__SS-prME
ucgacuauuacccuccuuugcuuaauucccaccgugauggcguuucaucucucaacccgcgauggugaaccccuuaugauagucgcuaaacacgaaagaggcaggccccucuuauuuaaaaccaccgaagguauaaauaaauguacucucauagcuauggaucuuggugaaaugugugaagacaccguaacuuacaaauguccucuauuaguuaauacugaacccgaagacauagauuguuggugcaaccucacaucaacgugggucauguauggcacgugcacacaauccggcgaaagaagacgugaaaaacguagcguagccuuaaccccgcauucaggaaugggccuggaaacaagagcugaaaccuggaugucauccgaaggagcuuggaaacaugcacaacgaguagaaucuuggauacuaaggaauccaggguuugcccugcuggccggauuuauggcguacaugauaggucaaacugggauccagcguacgguauucuucguuuugaugauguuaguagccccuagcuauggaaugcgcuguguuggaguaggaaaucgagauuuuguagaaggugucucgggcggcgcuugggucgaucuuguauuagaacacgguggaugugucacgacgauggcccaagguaaaccuacauuggacuucgaacuaacuaaaacaaccgcgaaagaaguagccuuauuaagaacuuauuguauagaagcucuaaucuccaacauaacaacugcgaccagaugccccacacagggugaaccauaucuaaaagaagaacaagaucaacaguauauuuguagaagggauguaguugaccggggaugggggaacggaugcggacuauuuggaaaaggcgggguagucacgugcgcgaaauuuagcugcagcgguaaaauaacaggaaacuuaguucaaauagagaaucuugaguacacagucguuguaacuguucacaauggagacacgcaugccgucggcaacgauacgucuaaucacggcgucacagcaacaauuacuccgagaucuccuucaguggagguaaaacucccagauuauggagaacugacucuagacugcgaaccaaggagugguauagauuuuaacgagaugaucuuaaugaaaaugaagaagaaaaccuggcuuguccacaaacagugguuuuuggaccuaccauugccauggacaacaggggcugacacaagugagguccauuggaauuacaaagaaagaaugguaacuuuuaaaguuccucaugccaaacgucaggacguuacaguguugggaucacaagagggagcaaugcauucagcuuuagcuggugcaacagaaguugacucuggcgaugguaaucauauguucgcuggacaucucaaauguaaagucagaauggaaaagcugcggauaaaaggaaugucuuacacaauguguucgggaaaauuuaguauagauaaagaaauggcugaaacacaacacggaacaacuguaguaaaggugaaguaugaaggggcaggagcaccauguaagguucccauagaaauuagggacguuaacaaggaaaagguagucggaagggugauaucggcaacaccgcuggcugaaaauacuaauagcguaacaaauaucgaauuagaacccccuuucggcgauagcuacauaaugauaggugucggcaauucugcccuaacacuccauugguucagaaaaggaucaucgauaggaaaaauguucgaaagcacuuauagaggcgcaaaaaggauggccauacuuggcgagacagcuugggacuuugggucaguuggagguuuauucacuucccuagggaaagcaguucaucaaguguuuggaucaguguauacuacaauguuuggaggagucuccuggaugauacguauauuaauaggauuccuggucuuauggauuggaacgaauagcagaaauacaaguauggcaaugacuuguauagcuguaggugggauaaccuuauucuuggguuuuacaguacaagcagauaugggaugugucguuaguuggucgggacgagaauugaagugcggaucagguauauucgugguugauaaugugcacaccuggacugaacaauacaaauuccaaccggaaucaccggcacgauuagccagugcaauacuaaacgcgcauaaagauggaguaugcggaauacgaaguacaacgagauuagagaauguuauguggaagcaaauaacuaaugaauuaaacuauguauugugggaagggggacacgaccuaaccgugguagcaggagacguuaagggcgugcucacaaaaggaaagcgggcacuugcacccccagcaagcgauuugaaauacucauggaaaacgugggggaaagcuaaaauauuuacuccagaagcgcgaaacucuacuuuccucauagauggucccgauacaucugagugccccaaugaacguagagccuggaacucauuugaaguagaagacuauggcuuuggaauguucacaacaaacauauggaugaaguuccgugaagguagcagcgaagucugugaucacagacuuaugucagcagcuaucaaagaccagaaagcggugcacgcugauaugggauauuggauagaaucuaguaaaaaccaaaccuggcaaauugaacgagcgucauuaauagaagucaaaacgugcuuauggccaaaaacccauacucuuuggucaaacggaguauuagagagucaaauguuaauuccuaaaucguaugcaggacccuucucucaacacaacuaucgacaggguuaugcgacgcaaacaguagguccauggcacuuaggaaaauuggaaauagauuuuggugaaugcccuggaacaaccguaacuauacaagaagacugugaccaccgaggaccuaguuuaagaacaacuaccgcuuccgguaaacucgugacgcaaugguguugcaggucguguacaaugccaccguugagauuuuuaggugaggauggauguugguaugguauggaaauccgaccacucagcgaaaaagaagaaaauaugguaaaaucgcaagugacggcaggucaaggaaccucugaaacauuuaguaugggccuucuaugccuaacgcuuuucgucgaagaauguuuaagaagacguguaaccagaaaacacaugauucuagcuguuguaauaacauuaugugccaucauauuagguggacuaacauggauggaucuacuaagagcuuuaauuauguuaggagacacgaugagcgguagaauagguggacaaacgcauuuagcaauaauggcaguauucaaaaugucaccaggauauguacucggaguguucuuaagaaaacuaaccagccgagaaacagcuuuaaugguuauaggaauggcuaugacaacaacucuaaguauuccacacgauuuaauggaacuuauagauggcaucucguuagguuuaauucuuuuaaagauaguaacccaauucgauaauacacagguaggaacacuagcacuaucuuuaacauucauaagaaguacuaugagcuuagucauggccuggagaacaaucauggcuguccucuuuguggugacauuaauuccacugugucguacaucaugucuccaaaaacaaagucauuggguagaaauaacagcucuuauuuugggagcacaagccuuacccguguacuuaaugaccuugaugaaaggggcuucccgaagaucuuggccuuuaaacgaagggauaauggcggucggguuaguaucgcucuugggaagugcucuguugaaaaaugauguacccuuagcuggucccaugguggcuggaggucuucuauuggcagcauauguuaugaguggaucgagcgcugauuugucucucgaaaaggcggcaaacguacaaugggacgagauggccgauauaacagggucgucaccgauuauagaaguuaagcaagacgaagaugguaguuucucaauacgagacguagaggagacgaauaugauaacacuguuagugaaguuggcgcucauuaccgucucuggguuguauccauuagcgaucccugugacuaugacauuaugguauauguggcagguuaaaacgcaaagaagcggugcauugugggauguacccucuccagccgcgacacaaaaagccgcucuuucagaagguguuuacaggauuaugcaacggggcuuguucgguaagacgcaagugggugugggaauacauauggaaggggucuuccacacaauguggcauguuacuagagggucaguuauuugucaugaaacuggaagacuagaaccuagcugggcugaugucagaaacgauaugauaucauaugguggcggauggcgacuaggggauaagugggauaaagaagaagacguccagguacuagcuauagaaccuggaaagaaucccaagcauguacaaacuaaaccaggccuuuucaaaacauugaccggagaaaucggagccgucacccuugacuuuaaaccggguacaucagggucaccaauaauaaaucgcaaggggaaggucaucggauuguaugguaacggcgucgugacaaaaucuggugauuacguaucagccaucacccaagcugaaagaauuggagaaccagacuacgaaguagacgaagauaucuucaggaaaaagcgccuuaccauaauggauuuacacccaggugcaggcaagacaaagagaaucuuaccaucaauagugagagaagcauuaaagagacgguuaagaacacuaauccuagccccuaccagaguaguugccgccgaaauggaagaagcguugagagguuuaccuauuagguaccaaacuccagcaguaaaaucugagcacacuggaagggagauugucgaucuuaugugccaugccacuuuuacaacacguuuauuaagcagcacacgagucccaaauuauaaucucauaguaauggaugaggcacauuuuacagacccuagcucaguugcugcgcgaggauauauaaguacgcguguagaaaugggagaggcagcugccauuuucaugacagccacgccuccgggcgcgaccgauccuuucccucaaaguaacagccccauagaagauauagaaagggaaauaccagaaagaucauggaauacuggguucgauuggaucacagauuaccaagggaaaacaguaugguucgugccgucaauuaaagcagggaaugacauagcaaauugccucaggaaaagugggaaaaagguuauucaguuaucgaggaagaccuucgauacggaauacccaaaaaccaaauuaacagauugggacuuuguuguaacuacagauauaucagaaaugggagcgaacuuccgagcaggacgaguuaucgauccacgccguugucuaaagccaguaauacuuacugauggaccggaacgcgucauuuuagccgguccaauaccugugacgccagcaucagcugcgcagagaagaggcaggauuggcagaaacccugcucaagaagacgaucaguauguguucagcggagacccauuaaagaaugaugaagaucaugcacauuggaccgaagcgaaaaugcugcuugacaacauuuauaccccugaaggcauuaucccuaccuuguucgguccagagcgagagaaaacucaggcaaucgauggcgaauuuagauuacgaggugaacaacgaaaaacuuucgucgaacuuaugcgucgaggugaucuaccgguuugguugagcuauaaagucgcuucagcaggaauaaguuacaaagaccgagaauggugcuuuacuggggaaaggaauaaucaaauauuagaagaaaauauggaaguagaaaucuggaccagagaaggagagaagaagaaacuaagaccgaaauggcuagaugcgagggucuaugcagauccuauggcacuacaagacuuuaaagaauuugcuuccgguagaaaaaguauuacauuagacauccuaacagaaauagcuagcuuaccgaccuaucugucuaguagagccaaacuagcgcuagauaauauugugauguuacauacaacagaaaggggugggcgcgccuaucaacaugcccuuaacgaauuaccagagagcuuagaaacguuaauguuaguggcgcuccuuggugcgaugaccgcaggaauauucuuauuuuucaugcaggguaagggaauaggaaaauuaucuauggguuugaucaccauugccguggcgagcggguuacucuggguagcagagauucagccgcaauggauagcggcgucuauaaucuuagaguucuuuuuaaugguucuucuuauaccugaaccagaaaaacaacgaacuccacaagauaaccaacucauuuaugucauuuuaacaauacugacaaucaucgguuuaauugccgcaaacgagaugggauugauagagaaaacuaaaacugacuuuggauuuuaucaagucaaaacagaaacaacuauacuagauguugaucuucgcccugcuucagcauggacgcuauaugcaguagcgacgaccauucuuacaccuauguuaagacauacgauugaaaauacaucagcaaacuuaucacucgccgcaauagcuaaucaagccgcaguguuaaugggccugggcaaaggcuggcccuuacauagaauggaucuuggaguaccacuacucgcuauggggugcuauucccaaguaaauccgacaacuuugaccgcaucgcugguuauguuacugguucauuaugcgauuauuggaccugggcuacaggcaaaagcgacucgggaagcacagaaaaggacagccgcgggaaucaugaagaauccaaccgucgacggcauuacggucauagauuuagaaccaaucucauaugauccuaaguucgagaagcaacuuggacaagucauguugcuaguacuaugugcaggccaacuuuuacugaugagaacaacaugggcuuucugcgagguuuuaacucuagccaccgguccgauauuaacacuaugggaagggaauccugggcgcuuuuggaauaccacuauugcaguuucuacagcuaauaucuucagaggaagcuaucuagcuggugcaggacucgcguucagcuugaucaaaaaugcucaaaccccuagacgagggacugguacaacaggagaaacguuaggcgaaaaguggaaacgucagcuuaacucgcucgacagaaaggaauuugaagaauacaaaagaucugguauucuugagguagaucguaccgaagcuaaaagugcguuaaaggacgggucuaaaauuaaacaugcugucucgcgcgguagcagcaaaauucgcuggauuguagaacgaggaauggucaaaccaaaagggaaaguaguggauuuaggauguggucgcgguggguggagcuauuauauggcaacacuuaaaaauguaacagaaguaaaaggauacacgaaagguggaccagggcaugaagaaccaauaccaauggcaacguacggauggaaucuaguuaaacuacauucuggagucgauguguuuuacaagccgacagaacaaguagauacgcuuuugugugacauaggugaaaguucaucaaauccgacaauagaggaaggaagaacucuuagaguacuaaagauggucgaaccauggcuaucuucaaagccagaguucugcauuaaaguuuugaauccauauaugccaacgguaaucgaagaauuggaaaaguuacagcgaaaacaugguggcaaucuuguaaggugcccgcuaucuagaaauuccacucaugaaauguauuggguuucuggagcaucaggaaacauaguaucaucugugaauacaacaagcaagaugcuacugaauagguuuacaacaaggcauagaaaaccaacguaugaaaaggaugucgauuuaggugcuggaaccaggucggucucgacggagacggagaagccugacaugacaauaauaggacggagacuacaaagacuccaagaggaacacaaagagacguggcauuaugaucaagaaaauccauaccguacuugggccuaucacgguaguuaugaggcaccgucaacggguagugcaucaucuaugguaaauggagucguaaaacuacuaacgaagccaugggacguuauuccaaugguaacgcaacucgcuaugaccgauacaaccccauuuggacaacagagaguauucaaagagaaggucgauacccguacgccucaaccuaaaccggggacacggaugguuaugacuacuacggcaaauuggcuuugggcacuacuagguaagaagaaaaacccgagacucuguacgcgugaggaguuuauaucgaagguacgaucaaaugcagcgauaggugcgguuuuccaggaagaacaaggauggacaagugcuagugaagccguuucagauuccagauuuugggagcucguugauaaggaaagggccuugcaccaagaggggaagugugaaucaugcguauacaauaugaugggaaagagggagaagaaauugggugaauuuggccgagcgaaaggaucgcgagccauuugguauauguggcuaggggcacgguuuuuagaguuugaagcacuuggauuuuuaaaugaagaccacugguuuggacgggaaaauuccuggucuggaguagaaggagagggguuacaccgucuuggcuauauacuugaggagauagacaagaaagauggagaccuaauguaugcugaugacacggccggcugggacacuaggauaacugaagaugauuugcaaaacgaagaguuaauaaccgaacaaauggcuccccaccauaaaauccuugccaaagcaaucuuuaaacuuacauaucaaaacaagguuguuaaaguauugagacccacaccacggggcgcgguaauggauauuauaucuagaaaggaccaaaggggaucgggacaaguggguacauauggacucaauaccuucacaaacauggaaguacaacuaaucaggcaaauggaagcugagggaguuaucacacaagacgauaugcaaaacccaaagggucuaaaagaaagagucgagaaauggcuaagagagugcggaguugaccgcuuaaaaagaauggcuaucagcggugaugacugcguugugaagccucucgacgaacgcuucgguacgucccuuuuguuucuuaaugacaugggaaaagucagaaaagauauaccacaaugggaaccaucaaaggguuggaaaaacuggcaagaagucccauuuuguucacaucauuuccauaaaauauuuaugaaggauggacgaaguuuagucguaccaugccgaaaucaggaugaauugaucgggcgagcaagaauuucucaaggagcaggcuggagucuacgugaaacggcaugucuaggaaaagcguaugcccaaauguggagcuugauguauuuccacagaagagaucuacgauuagccaguauggccauauguucagcaguaccaacagaaugguucccgaccucuagaacaacauggucaauccaugcgcaucaucaauggaugacaacggaagacauguugaagguauggaauagaguauggauagaagacaauccaaauaugauagauaaaacaccugugcacuccugggaggacauacccuaccuuggaaagagagaggaccucuggugcggcucuuugaucgggcuuucuucuagagcuacaugggcgaagaacauacacacugccaucacucaaguacggaacuuaauaggaaaggaagaauaugucgacuauaugccgguaaugaaacguuauagcgccccaagugagagugaaggugugcuauaa

SEQ ID NO: 23598 - RNA, 9867 nt, Artificial Sequence
  derived and/or modified CDS sequence (opt6) from DENV-4__GQ868584__SS-prME
agcacuauuacacuguuaugcuuaauaccaacugucauggcuuuucauuuaagcaccagggacggagaaccauugaugauaguugcgaaacacgaaaggggaagaccucuacuauuuaaaaccacugaagguauaaauaaauguacauuaauugcaauggaccugggggaaaugugugaagacacuguaacguauaaaugcccacuauuaguuaacacggagccagaagacaucgauuguugguguaauuuaacaucuacauggguaauguacggaacuugcacacaaucaggggaaagaagaagagagaaaaggucgguggcacugacuccgcauucagguaugggccuugagacgcgagcggaaacauggauguccagugaaggggcuuggaaacaugcucaaagaguugagaguuggauacuaaggaacccugguuucgcacuuuuggcugguuucauggcuuauaugauuggucagacaggcauucagagaacaguauucuuugucuugaugauguuaguggcuccaucguaugggaugaggugcguagggguaggaaaccgagacuuuguugaaggaguuucagguggagcuuggguugaucucguauuagaacauggagguuguguaacaaccauggcacaaggaaaaccaacacuugauuucgaacuaacuaaaacaaccgcuaaagaaguagcauuauugcgcacauacuguauagaagcauugauaucuaauauaacaacugccacacguugucccacucaaggcgaaccauaccuaaaagaagaacaagacagacaauauaucugucguagggauguaguagaccgugguugggguaacggcuguggacuauucggaaaaggagguguaguaacgugugcuaaauucucgugcagcggaaagauaacaggaaacuuagugcaaaucgagaaucuggaauauacgguuguaguaaccguucauaacggugauacucacgcagucggaaacgacacgucuaaccacggaguuacggccacuauaacgccuagaagucccucaguugaggucaaacuaccagacuacggcgagcuaacacucgauugugaaccgcguagcgguauugacuuuaaugaaaugauacuaaugaaaaugaagaagaaaacuuggcugguucauaaacaaugguuccuagauuuaccguugccuuggacaacuggcgcagauacgucggaagugcauuggaacuacaaagaaagaaugguuacguucaaggugccccaugcuaaaagacaagauguuacuguuuuaggaucccaagaaggugcgaugcauucagcucuugcaggggcaaccgaaguagauaguggagauggaaaccauauguucgcuggccauuuaaaauguaaagugagaauggagaaacuuagaaucaaaggaaugucuuacaccauguguagcgguaaauucucaaucgacaaagaaauggccgaaacacagcacgguacuacuguaguaaaaguaaaauacgaaggagcaggcgccccaugcaaaguuccaauagaaauacgcgacguaaauaaagaaaaaguuguugggcgagugauaucagcgacaccguuagcagaaaacacuaauucaguaaccaauauugaguuagaaccaccauuuggugauagcuauauaaugauuggaguugggaauagugccuugacacuucauugguuuagaaaaggcucaaguauagggaagauguucgagaguacauauagaggagcaaaacguauggcuauuuugggagaaacugcgugggauuuugguucuguggguggucuauuuacgaguuuaggaaaagccguccaucaaguauuugggaguguuuauacuaccauguuugguggcguuucguggaugauccguauacugaucggcuuuuugguauuauggaucggaaccaacucaagaaacacuuccauggcaaugacauguauugcagucggagggauaacccucuucuuaggauucacagugcaagcagauauggguugcguaguuagcuggucggguagggaacuaaaauguggaucaggaauuuucguagucgauaauguacauacuuggacagaacaauauaaauuccaaccagaaagcccggccagacuagcuagcgccauauuaaacgcgcauaaagacggugugugugguauaaggagcacaaccagacuagaaaauguaauguggaaacaaauaacuaacgaacuaaauuaugugcuaugggaaggaggucaugaucuaacaguuguugcaggagauguaaaagguguauuaacgaaaggcaaaagggcucucgcgcccccagccucagaucuuaaauauucguggaagacguggggaaaagccaaaaucuucacaccugaggcacgaaacucaacguuccuaauagaugguccggauaccuccgagugcccuaaugagcgcagggcauggaauaguuuugaaguggaagacuauggauuugguauguucacuaccaacaucuggaugaaauuucgcgaaggcucaagugaaguaugugaccaucgacugauguccgcagccauuaaagaucaaaaagccgugcaugcagauaugggauauuggauagaauccucuaaaaaucaaacauggcaaauagaaagagcgaguuuaauugaaguuaagaccugcuuguggccgaaaacacauacacuguggucuaacgguguauuagaaucgcaaaugcuaaucccaaaaaguuacgcaggaccuuuuucacagcauaauuaccggcaagguuaugcuacccaaaccguuggaccuuggcauuugggaaaguuagagauugauuuuggcgagugccccgguacuaccgucacuauacaagaagauugcgaccaccgcggaccauccuugagaaccacaacagcaucggggaaacuuguuacgcaaugguguuguagauccugcacaaugcccccauuacgauuucugggcgaagacggguguugguacggaauggaaauuagaccgcuaagugaaaaagaggaaaauaugguaaaaucccaaguaaccgcaggacaggggacgucggaaacauuuucaaugggcuuacucugcuuaacuuuguucgucgaggaaugcuuacgaagacgagugacuagaaaacacaugauuuuggcagucguuauuacccugugugcaauaauacuagggggacuuacguggauggaucuacuaagagcuuugaucaugcuaggcgacaccaugaguggacgaauugggggccaaacacaucuugcuauuauggcaguauucaaaaugucaccugguuauguauuggguguauuucucagaaaauuaacaagccgggaaacugccuuaaugguuauuggcauggcaaugacgaccacgcuaaguaucccacaugaccuuauggaauuaauagacgguauaucgcuaggucuuauucuauuaaagauaguaacacaguucgacaauacucaaguggguacuuuagcauugucucuaaccuucauucguaguacaaugucccuaguaauggcauggagaacaauaauggcuguccuuuuuguaguuacacuuauuccacuaugccgcacaaguuguuuacaaaaacaaucacauuggguagaaaucacagcucucauucucggagcccaagcacuaccgguuuaccuaaugacgcugaugaaaggugcuucaagaagauccuggccuuuaaacgaaggcauuauggcaguagguuuaguaucucuacucggauccgcacuuuugaaaaaugaugugcccuuggccggaccgaugguugccggcgguuuauuacucgcagcguacguaaugucaggcucaagugcagaccuuucacuagagaaagcagcaaacguccaaugggaugaaauggcggacaucaccgguaguaguccuauuauagaaguuaaacaagaugaagauggcucguuuucaauaagggauguagaggagacaaacaugauuacacuauuaguuaaguuagcauuaauaacaguaaguggacuuuauccuuuagcaauucccguaacuaugacgcuuugguauauguggcaagugaaaacgcaacgaaguggcgcuuuaugggacgucccuucaccagcggcaacgcagaaagccgcuuuaagcgaaggcguuuacagaaucaugcaaagaggccuauuuggaaaaacccaggucgguguaggaauacauauggagggaguauuccacacaauguggcacguaacccguggcaguguuauaugucaugagacugguagauuggaaccauccugggcugauguccgaaaugacaugaucucauauggaggcggauggcgucugggagacaagugggauaaagaagaggauguacaaguucuugcaauugagccuggcaaaaauccuaagcacguucaaacuaaacccggacuauucaaaaccuuaacaggggaaauaggugcagugacacuugacuuuaagcccggaacgucuggaucuccaauaauaaaucguaaaggcaaagugauaggcuuauauggaaacggagucgugacgaaaaguggagacuacguaagugccauaacccaagcugaaagaaucggggaaccggacuaugaagucgaugaggauauuuuccgaaagaaaagguuaaccauaauggacuuacauccaggugccgguaaaacgaaacgcauuuuaccaagcauagugagggaggcuuugaagagaagguuacguacacugauauuagcacccacuagagucguggcagcugagauggaggaagcucuacgaggacuaccgauccguuaucaaacaccagccgugaaaucagaacacacugggagggagauaguagaucuaaugugucaugccacauuuacaacgcguuuguuaucuaguacaagaguaccaaacuacaaccuuaucgucauggacgaggcacauuuuacugaccccucaucaguagcagcgcgugguuacaucucuacacgcguagaaaugggagaagccgccgcaauauuuaugacagcuacgccucccggugccacagauccauucccacaaucgaacagcccaaucgaagauaucgaaagggaaauaccagagagaucauggaauacggguuuugauuggaucacugacuaucaagggaagaccguuugguucguaccaucaaucaaagcggggaacgauauugcaaauugccuuagaaagucgggcaagaaagucauccaauuaaguaggaaaacauucgacaccgaauauccaaagacuaagcucacagauugggauuucguaguuaccacagacauuucagaaaugggugcgaacuuucgcgcuggacgagugauagauccaagaaggugccugaaacccguuauucucacggacggcccagaaagaguaauccuggcuggcccuauaccaguaacuccggcuagcgcggcgcagagaagaggacgaauuggcaggaacccagcccaagaagacgaucaguauguuuuuaguggcgauccucucaaaaaugacgaagaccacgcacacuggacggaagcaaaaaugcuccuggauaacaucuauacgccggaagguauuaucccuacguuauucgguccagaacgugagaaaacacaggcaauagacggugaguucaggcuacgaggagaacaaagaaaaacuuuuguugaauugaugcgaagaggggacuugccuguauggcuaaguuauaagguagcgucggcaggaauuagcuacaaagaucgagaaugguguuucaccggggaacgcaacaaucagauucuagaagagaauauggaaguagaaauuuggacaagagaaggugagaagaagaaacuucgaccaaaaugguuagacgcucgaguguaugccgacccaauggcguugaaagacuuuaaagaauuugcuagcgguagaaaaaguauaacguuagauauucuuacagaaauagcgagucucccuacauaccucuccucacgagccaaacuagcacucgauaauauaguaaugcuacauacuaccgagaggggaggacgugcauaccaacacgcacuaaacgaauugccugagagccuagaaacauuaaugcuagucgcgcucuuaggagccaugacugccgguauuuuccuguucuuuaugcaaggaaaagguauaggaaagcuaagcaugggauuaauuacaauagcgguagcuucuggauugcuuugggucgcggaaauacagccacaauggauagcugccucaaucauauuagaguucuuucugaugguauuauuaauuccugaacccgaaaagcaacgaacaccccaagacaaucaguuaaucuaugugauauugaccaucuuaaccauaaucgguuuaauugcugcgaaugaaauggguuuaaucgaaaagacuaaaacugauuuuggauucuaucagguaaaaaccgagacgacuauacucgauguugaucuacgccccgcaucggcuuggaccuuauacgcaguagcgacgacaauacuuacaccaauguugagacauaccaucgagaacacaagugccaauuuauccuuagcagcuauagcaaaucaagcugcuguauugaugggauuaggaaaaggauggccacuacauagaauggauuuaggagucccacuucuugcgaugggaugcuauucgcaaguuaaucccacuacucuaaccgccucacuuguuaugcuuuuaguucacuacgcaauaauuggacccggcuuacaagcaaaagccacgcgagaggcacagaagaggacagcggcgggaauaaugaaaaauccgaccguugauggaauaaccgugauagacuuggaaccaauuucauacgacccgaaauucgagaaacaguuaggacagguuaugcuucuuguauugugugcaggccaacuccuacuaaugcggacgacgugggcuuuuugugagguccuuacgcuugcgacugguccaauacuuacccugugggaaggcaauccugguagguucuggaacacuacaauagcugucuccaccgcaaauauuuuuagagguaguuaucuugcgggugcuggccuagccuuuagccuaaucaaaaacgcacaaacaccacgcagaggaaccgggacaacuggugaaacuuuaggggaaaaguggaaaaggcagcuuaacucacucgauagaaaagaauuugaagaauacaaaagaucugguauacuggaaguagaccgaacggaagcuaaaagugcauuaaaagacgguucgaaaauuaagcaugcagucucacguggaagcucuaaaaucagguggauaguagaaagaggcaugguaaaaccuaaaggaaaagugguagauuuggguugcgggagaggcggcuggucuuacuauauggcgacgcuuaaaaacgucacagaaguuaaaggcuacaccaagggcggucccggacaugaagaaccaauaccgauggcaacguauggauggaauuuagucaaacuacauagcggcgucgacguauuuuauaaaccuacagaacaaguggacacucuauuaugugauauaggggagucuucuagcaauccaacaauagaggaaggacguaccuuacgaguauugaaaaugguugagcccugguugucuucaaaaccagaauuuugcauuaaaguucucaacccuuauaugccaacuguaauagaagaauuagaaaaacuacaaagaaaacauggaggcaaucucgugcgcuguccuuugagccgaaauuccacgcaugaaauguauuggguaucuggagcuagcggaaauaucguaagcucaguaaacacuacgucgaagaugcuccugaauagguuuacaacucgacauagaaagcccacuuaugaaaaagauguugacuuaggagcuggcaccagaucgguaaguaccgaaacagaaaaaccagauaugacuaucauuggucgucgauuacaacgccuacaggaagaacauaaagaaaccuggcauuaugaucaggaaaauccauacagaacaugggcguaucauggcaguuaugaagcccccucaacuggaucagcaucaucuaugguaaaugggguaguaaaacuuuuaaccaaaccaugggauguaauacccauggugacucaauuagccaugacugauacgacucccuucggacaacaaagaguauucaaagaaaaaguagacacuagaacaccacagccgaaaccuggaacgcgcauggugaugaccacgacugcuaacuggcuaugggccuuauuagguaagaagaaaaauccgaggcuuuguacaagagaagaauuuaucucaaaaguccgaucaaacgcugcgauuggcgcggucuuucaagaagaacaaggguggacaucggccucugaggcaguaagcgacucaagauuuugggaauuaguagauaaagagagagcauuacaccaagaagggaaaugcgaaucauguguguauaacaugauggguaaaagagagaagaaauuaggagaauuuggacgagccaaaggaucacgugccauuugguacauguggcuaggcgcacgauuucuugaauuugaagcacuuggauuucuuaacgaagaucacugguucggacgggagaauaguuggagcggaguggaaggggaaggccuucauaggcuuggauacauuuuggaggaaauagauaagaaagacggugaucuaauguaugcagacgacaccgcuggcugggacacgcguaucaccgaggaugaucuacaaaacgaagaacucauuacagaacaaauggcaccccaucauaaaauauuggcaaaggcuauauuuaaacuuacauaucaaaauaaggucgucaaaguccuucgaccgacuccuagaggagcaguaauggauauaauaucgcguaaagaucaaagagguucuggccaaguggggacauauggauugaacacauucacaaauauggaaguacaacugauacgacaaauggaagccgaagggguuauaacucaagacgacaugcagaaucccaaaggguugaaggaaagaguggaaaaaugguuacgcgaaugcgguguugacagauuaaaacgaauggcuaucucuggugaugacugcgucgucaagcccuuagaugaaagguucgggacauccuuauuauuuuugaacgauaugggaaaaguccgcaaagauauaccucaaugggaacccaguaaagguuggaaaaacuggcaagaaguacccuuuuguucccaucauuuucauaaaauuuuuaugaaagacggaagaagucuaguaguaccaugucguaaccaagaugaauuaauaggccgcgcccgaaucagccagggagcggguuggucacuacgugaaacagcaugccuugguaaggccuacgcacaaauguggucauuaauguauuuucacagaagggaucuucggcuagcaagcauggcuaucuguuccgcaguuccaaccgaaugguucccuacuucaagaacuacuuggaguauccacgcacaucaccaguggaugacaacggaagacauguuaaaaguuuggaaucggguuuggauugaggacaauccaaacaugauagauaaaacuccaguucauucuugggaagacauucccuacuuaggaaaaagagaagaucuuuggugugguucucugauuggacuuagcucuagagccacuugggccaaaaacauucacacagcgaucacacaaguuagaaaucucauaggcaaagaagaauauguugauuacaugcccgugaugaaaagauacagcgcaccaucggaauccgagggaguccuauga

SEQ ID NO: 23599 - RNA, 9867 nt, Artificial Sequence
  derived and/or modified CDS sequence (opt6) from DENV-4__GQ868585__SS-prME
agcacuauaacguuguuaugcuuaauaccaacugucauggcauuucaucuuucaacacgugauggagaacccuuaaugauaguggcaaaacaugaacgcggaagaccuuugcuauuuaaaacgaccgaagggauaaacaaauguacuuuaauagcaauggaccuaggggaaaugugcgaagauaccguaacauacaaauguccguugcuuguuaauaccgaaccggaagacauagauugcugguguaauuuaacaagcacaugggucauguacggaacauguacccaaucaggagaacgaagaagggagaaacggucaguugcacuaacgccacauucuggcaugggucucgaaaccagagcagaaacauggaugagcagcgaaggugcuuggaaacaugcacaaagaguugaaucauggaucuuacgaaauccgggauucgcacuucuggcuggguuuauggcauacaugauuggacaaacaggaauccaacguacaguuuucuuuguacuaaugaugcuaguggcuccuuccuacgggaugaggugcguaggagugggaaauagggauuuuguagaaggaguuucaggaggcgcguggguagaccuaguucuugagcacggugggugcguuacuaccauggcccagggaaaacccacucuagacuuugaauuaacuaaaacaacagcgaaagagguagcacuuuugagaacuuacugcauagaggcgcucauaucaaauauaacaacagcaacacguugcccgacucaaggagaaccguauuugaaagaagaacaagaccagcaguacauuuguaggagagacgucguagaucggggauggggcaauggauguggcuuauucgggaaaggaggagugguuacgugcgccaaauuuucauguucgggaaagauaacaggaaauuuaguccagaucgagaaccuagaguauacgguaguuguuacuguacacaacggggacacgcacgcugucgguaaugauaccaguaaucauggagugaccgcuacaauaacaccaagaucuccuucuguagaaguaaagcugccagauuauggggaacuuacucuugacugugagccucguagugggauagacuuuaaugaaaugauauugaugaaaaugaagaagaaaacgugguuaguacauaaacaaugguuucuagaucuaccacucccauggacuacaggugccgauacuagcgagguacauuggaauuauaaagaacggaugguaacguuuaaaguaccacaugccaagagacaagauguuacaguuuugggaucucaagagggagcaaugcacucggcccuagcaggagcaacugaaguagauuccggagaugaaaaucacauguucgcgggucauuuaaaauguaagguucggauggaaaaauuacgaauuaaaggaaugucguauacuaugugcucaggaaaauuuaguauagacaaagaaauggcugaaacacagcacggcacuacagucgucaaggucaaauaugagggcgcaggggcacccuguaaagucccaauagagauacgcgaugugaacaaagaaaaaguaguaggaagaguaaucagcgcuacacccuuggcagaaaauaccaauuccgucacaaauauugaacucgagccgccuuucggugacucuuacauuguaaucgggguuggcaacagcgcacucacccugcacugguuuagaaaaggcuccucgauugguaaaauguucgaaucuacauacagaggugcgaaacgcauggcgauucuaggagaaaccgcuugggacuuuggaagugugggagggcuguuuacgagccugggaaaagcugugcaucaaguuuucggguccguauauacaacgauguuuggaggcguaucuuggaugauccgaaucuuaauugguuuucucguuuuauggauaggaacaaauucaagaaauaccucaauggcaaugacaugcaucgcaguaggcgguauaacuuuauuucugggauucacuguucaggccgauaugggguguguaguuuccuggaguggccgagaauuaaagugugguagcgggaucuuuguagucgauaaugugcacacguggacagaacaauauaaauuccagccagaguccccggcuagacuggccucugcuauacuaaacgcacauaaagauggcguaugcgggauaagaucaacuacacgacuagaaaauguaauguggaaacagauaaccaaugaauuaaacuauguccucugggagggaggucacgauuuaacgguaguagccggcgauguaaaaggaguacuaacuaaagguaaaagggcccugacacccccggcuagcgauuugaaauauucauggaaaaccuggggaaaggccaaaaucuuuacaccagaagcucggaauaguacuuucuuaaucgaugggccugauacgucagagugcccaaaugaaaggagagccuggaacagcuuugagguagaagacuauggcuucggaauguuuacuacgaauaucuggaugaaguuccgagaagguagcagugaaguaugugaccaucggcuaaugucagcagcaauuaaagaucaaaaggcgguccaugcugauauggguuauuggauagaaaguaguaaaaaccaaacguggcaaauagaacgugcgaguuuaauagaggugaaaacaugucuauggccuaaaacccauacacucuggagcaacggaguucucgaaucacaaaugcuuauaccaaagucuuaugccggaccguucucccagcacaauuaucgccaaggauacgcaacgcaaaccguaggccccuggcauuugggcaaauuagaaaucgacuucggcgaauguccagggacaacaguaaccauucaagaaaauugcgaucaucgcggcccaucccuuaggacaacgacugcuucaggcaaacucguuacucaaugguguugcagaucauguaccaugccaccauuacguuuucuuggugaagauggauguugguauggaauggaaaucaggccuuugagcgaaaaagaagaaaauauggugaaaagucaaguaacagcaggacaggguacauccgagacguuuucuaugggacucuuauguuuaacauuguucguagaagaaugucuaaggcgcagaguaacaagaaagcauaugauacucgcagugguaauuaccuugugcgccauuauauuagggggucugacauggauggaccuuuuaagagcgcuaaucaugcuuggcgauacaauguccggaagaauaggcggucaaacgcaucuggcaaucauggcaguguuuaaaaugucuccuggcuauguguuagggguauuuuuaagaaagcuaacauccagagagaccgcauuaauggugauagguauggcgaugacaacaacuuugucuauuccccaugaucucauggaacucauagacgggauaucucugggcuuaaucuuacucaaaauuguuacucaguuugauaacacccagguaggaacucuggccuuaagucucacuuucauucgaagcacuaugagucuuguuauggcauggcguacaauaauggccguacuauucgucguaacccuaauuccgcuuugccggacaaguugccuacaaaaacaaucacauuggguagaaaucacagcacuaauucugggcgcccaggcguugccaguuuauuugaugacauuaaugaaaggugcuucacgucgaaguuggccucuaaacgaaggaauaauggcagugggacuuguaucauuguuaggcagcgcacucuugaaaaacgauguuccucuagcuggaccaaugguggcaggcggucugcuuuuagcggcguaugugauguccgguuccagugcagacuugucauuggaaaaagcugcgaauguccaaugggaugaaauggcugauauaacaggaucaucuccgauuauagaaguuaagcaagaugaagaugggagcuuuucgauaagagacguagaagaaacgaauaugauaacucuguuggugaaauuggcauugauaacaguaaguggacuauacccguuagcgauaccaauaaccaugacgcuuugguauauguggcaagucaaaacccaaaggucgggcgcgcuaugggacgucccuaguccugcagcuacccaaaaagcagcacuuagcgagggugucuauagaauaaugcaaagaggauuauucggaaagacgcagguugguguaggaauccauauggaagguguuuuccacacaauguggcacguaacaagagggucaguuauaugccaugaaacagguagauuagaaccaucaugggcugacgugagaaaugauaugaucucauacggaggugguuggcguuuaggagacaaaugggauaaagaagaagauguccaaguuuuagcaauagagccuggcaaaaauccuaaacacguacaaacuaaacccggucuguuuaagacacucacgggugaaauuggagccguaacuuuagacuucaaaccaggcacuucugguucuccaaucauaaacaggaagggaaagguuauaggucuauauggaaacgguguugugacaaaaucaggcgauuauguauccgcgauaacccaggcugagagaauaggcgagccagauuaugaaguagacgaagacauauuucgcaagaaaagacuuacaauuauggaccuacacccaggcgcagguaagacgaagagaauacuaccgagcauaguacgagaagcucuuaagcgacgauuaagaacacuaauucucgcuccgacgcgaguuguagcagcagaaauggaggaagcucugcgcgguuugccaauuagauaucaaacuccggccguuaagagugagcauacaggucgagaaaucguagaccuaaugugccaugcuacauucacgacaagauuguuaagcaguacacguguaccaaauuacaaucucaucguaauggaugaagcacacuuuacugauccgucaagcguagcagcucggggauauauaaguaccagaguggaaaugggggaagcagcggcgauauucaugacggcaaccccuccuggugcaacagauccuuucccacaaucuaacucuccuaucgaggauaucgaacgugaaauacccgaacgauccuggaacacggguuucgauuggauuacagacuaucagggcaaaaccguaugguuuguacccagcauaaaagcagguaaugacaucgcaaauugcuuaagaaaaucuggcaagaaaguaauacaacucucaaggaaaacuuuugacaccgaauaccccaagacaaaacuuaccgacugggauuuuguaguuacaacagauaucagcgagaugggugcaaauuuccgugcgggaagggucauagauccacguaggugucucaaaccaguuauauuaacagauggcccggaacgaguaauucuagcuggaccaauaccugugaccccggcuucugcugcacagcggcgcggacgaauagguagaaauccagcacaagaagacgaccaguacgucuuuaguggggauccauuaaagaacgaugaagaccaugcacauuggacugaggcuaaaauguuauuagauaauauauacacuccagaaggcauuauuccaacucuauucggaccagagcgagagaaaacucaggcgaucgauggugaauuucgcuugagaggggaacagaggaaaaccuuuguugaacuaaugagacgaggcgaucuaccaguuuggcuuagcuacaaaguugcaagcgccggcauuuccuauaaggaccgagaaugguguuuuaccggggagagaaauaaccagauacucgaggaaaauauggaaguugaaauauggacacgugaaggugagaagaagaaacuucgaccaaaauggcucgaugcuagaguauaugcagauccuauggcgcuaaaagacuuuaaagaguucgcgagcggccguaaaucaauuaccuuggauaucuuaacagaaaucgcaucauugccgaccuauuuaaguagccgugcaaaacuagcccuagauaauaucguaauguuacacacaacggaacgggguggacgcgcauaucagcaugcacuaaacgaauuaccagaauccuuagaaaccuuaauguuaguagcacuucugggagcaaugacugccggaauauuucucuuuuucaugcaagggaaagguauuggcaaauuauccaugggguugauuacgauagccguugcaagcggacuauuauggguagcugaaauacagccgcaauggauugcggcaucaauaauauuagaauuuuucuuaaugguacuccuaauaccagaaccagaaaaacaacguacaccgcaagacaaucaauugauauauguuauccugacuauacucacgauuaucggucuuauagcagcuaacgaaaugggauuaauagagaaaacaaaaacagauuuuggauuuuaccaaguuaagacagagacuaccauacuagauguagaucuccgaccggcuagugcauggacucuauaugcaguagcaacgacuauccucacaccaaugcugaggcauacgauugaaaauacaucagcaaaucucagucuugcagccauagccaaucaagcagcaguucuaaugggucuagguaaaggauggccuuuacaucgaauggaucuaggaguuccauuacuagcgauggguugcuauagucaaguaaauccgacuacacugacagccucauuaguuauguuauugguccacuaugcuauuauaggaccuggauuacaagcuaaagcuacuagagaagcgcagaaacggacagccgcagguauuaugaaaaauccaaccguugaugguauaacgguaauagaucuagaaccaauuaguuacgacccuaaauuugaaaaacaauugggacaagugauguuacuggucuuaugugcgggucagcuucuucuaaugcgaacgacuugggcauuuugcgaaguacucacuuuggcaacaggaccaauacucacccuuugggaaggcaauccaggaagauuuuggaacaccaccauugcuguuucgacagcuaacauuuuucgaggaaguuaccuggcaggggcaggucuagcauucucacuaaucaaaaaugcucaaacuccaaggcgaggaacuggaacaacuggggaaacacugggagaaaaguggaaaagacaauugaacagcuuggaccguaaggaguucgaagaauacaaacgaagcggaauacuugaaguugaccguacagaagcaaaaucagcccuuaaagacggaucaaagauaaagcaugcagugucccgaggaaguagcaagauuagauggaucguugaacguggcauggucaagccgaaagguaaaguaauugauuuggguuguggacgaggaggguggaguuacuauauggcgacgcucaaaaauguuaccgaagucaaaggcuauacaaaaggagggccggggcacgaagaaccaauaccgauggcaacauauggauggaaucuaguaaaacuucacagcggaguugauguauucuauaaaccaacugaacagguagauacuuuacuuugugauauaggagaaagcaguucaaauccgaccaucgaggaaggaaggacacugaggguucucaaaauggucgaaccuugguuaagcaguaaaccugaguuuuguauaaaaguguugaauccauauaugccuacgguuauugaggaauuagagaaauuacagagaaaacacggagguaaucuagugagguguccguugucacggaacuccacgcacgaaauguauuggguaucaggcgccaguggaaacauuguuucaucagugaauacaacaaguaaaaugcucuugaacagauuuacaacaaggcauagaaaaccgaccuaugaaaaagaugucgauuuaggagccggaacgagauccguuaguacagaaacggaaaaaccugauaugaccauaauaggccgacgccuccaacgucuucaagaggaacacaaggaaacauggcacuaugaucaagaaaauccauauagaacuugggcauaucaugguucauacgaagcaccuaguacgggcucagcgagcaguauggucaaugggguagucaaguuacugacaaagccaugggacgugauuccaaugguuacacaguuagccaugacugacaccacgccguuuggucagcagagagucuuuaaagagaaaguggacacacgaacaccacaacccaaaccugggacaagaauggugaugaccaccacagcuaacugguugugggcauuacuagguaagaagaaaaaucccagacuauguacacgagaagaauuuauuucaaaaguuaggucaaaugcggccauaggagcuguuuuucaagaagaacaggguuggacguccgcaagugaggcugucaaugacagccgauuuugggaauuaguugauaaagaacgugcucuccaccaagaaggaaaaugcgaaucgugcguuuacaauaugaugggaaaaagggaaaagaaacuuggugaguucgguagagcaaaaggaucgagggcaauaugguacaugugguuaggagcuagguuuuuagaguucgaagcacucggauuuuuaaaugaagaccauugguuuggacgagaaaacagcuggucaggaguggaaggcgaaggguuacacaggcuaggguauauauuagaagaaaucgacaagaaagacggcgaucuaauguacgcugaugauacagcuggcugggauacccgaauaacugaggaugaucugcaaaacgaagaacuaauaacugaacaaauggcaccacaucauaaaauauuagcaaaagccauuuucaagcuaacuuaucaaaacaaaguaguaaaaguuuuaagaccaacgccuaggggagcgguaauggacauuauaaguagaaaggaccaaagaggaucuggacaaguggguacauacggauuaaauacauuuacaaacauggagguacaguuaauaagacaaauggaagcugaagguguuauuacucaggaugauaugcaaaauccuaagggcuuaaaggaaagaguugaaaaauggcuccgggaaugcgguguagaccgccuaaaaagaauggccauaucaggagacgauuguguugucaaaccauuggacgaaagauuugggacaagucuacucuuccucaaugauaugggcaaaguacgcaaggacaucccucagugggaaccaucaaaaggauggaaaaauuggcaagagguaccuuucugcucucaucauuuccacaagauauuuaugaaggauggucguagccuugugguuccguguagaaaccaagaugaauuaauaggaagggcaagaauuagucagggggcaggcuggagucuucgagaaacagcuugucuuggcaaggcuuacgcccaaauguggucauuaauguauuuccaucgacgcgauuuaagauuagcauccauggcuauuuguagugccguuccgaccgaaugguuccccaccucacgaacgacuuggagcauccaugcucaccaucaauggaugacaacugaagacaugcuuaaaguauggaauagaguauggauagaggacaaucccaacaugauagauaaaaccccaguacacucgugggaagauauaccguaccuaggcaaacgggaggaucuauggugcgguagcuuaauuggccugucaagucgagcgacuugggcuaaaaacauucauacggcaauaacgcaaguaagaaaccuuauaggcaaagaagaauauguagauuauaugcccguaaugaaacgauacucagcaccuagcgagucagaaggcguguuauaa

SEQ ID NO: 23600 - RNA, 9867 nt, Artificial Sequence
  derived and/or modified CDS sequence (opt6) from DENV-4__JQ922560__SS-prME
ucaaccauuacccuauuguguuuaauuccuacgguaauggcguuucaccuaaguacacgugacggggaaccacuaaugauaguggcaaaacaugaaagagguagacgauugcucuuuaaaaccaccgaagguauaaauaaaugcacuuuaauagcaauggaccuaggagaaaugugugaagauacaguaacauacaaauguccccuucuugugaacacugaaccugaagauauugacugcugguguaacuuaacgagcgcauggguaauguauggaacauguacacaaagcggagaaagacgucgagagaaaaggaguguugcgcuuacaccacacuccggaaugggauuagaaaccagggccgaaacauggaugagcuccgagggggcauggaaacacgcacaacggguugaaucauggauccucagaaauccgggcuuugcucuccuagcuggauuuauggccuauaugauaggacaaacggggauucagagaacaguguucuuuauuuuaaugaugcucguugcaccuucauacgggaugagauguguaggagucggaaaucgagacuucguagaaggaguuucuggaggagcuuggguugaucucguacuugaacacggagguugugucacuaccauggcccagggcaaaccaacccuggauuuugaauuaaucaaaacaacggccaaagagguagcucuauuaagaacuuauuguaucgaagcuaguauuagcaauauaacgaccgcaacaagauguccgacacaaggugaaccauaccuaaaagaagaacaggaccaacaguauauuugucguagagacgucguugauagaggauggggaaacggguguggacuauucgguaaaggagguguaguuacaugugcaaaauuuuccugcacgggaaaaauaaccggaaaucuaauucagaucgaaaaccuugaauauaccguaguggucaccguucacaauggagacacgcaugcuguugguaacgacacgucgaaccauggaguaacagcuaccaucacuccuagaucgccuaguguagaagucgaacugccggauuauggagaacuaacacuagauugugagccgcgcagcggcauugauuuuaaugaaaugauucucaugaaaaugaauaagaaaacuuggcuaguacacaaacaaugguuucuagaccuaccuuugccuugggcugcaggagccgacacauccgagguacauuggaaccacaaagagcgaaugguuacauuuaaaguaccacaugcgaaacgacaagauguaacuguauuaggaagucaggaaggugcaaugcacucagcauuaacuggagccacagaaguauauaguggagauggaaaucuuauguuugcuggccaccucaaauguaaaguucgcauggagaaauugagaauuaaaggcauguccuacaccauguguagugguaaauucucaauagacaaagaaauggcagaaacacagcaugggacaacagucguaaaagugaaauacgaaggcgcaggcgcacccuguaagguaccgauagaaauuagagacgugaacaaggaaaaaguuguagggagggugauaucuucaacacccuuugcagagaacaccaacucaguuacuaacauugaacuugagcccccuuucggugauucauacaucgucauaggcguaggcgacagugcacugacacuucauugguuuacaaaaggaagcucaauugggaagauguucgagucaacauacagaggagcuaagagaauggcuauccuaggggaaacagcaugggacuuuggcagcguaggaggccuauugacuagcuuggguaaagccguucaucaaguguucgguucagucuauacaaccauguuuggaggaguaucauggaugguacgaauacugauaggauucuugguuuuguggauugguacgaauagucguaauacuucaauggcaaugucguguauugcugucggagggauuacacuauuccuaggauucacuguucaugcagacauggggugugccgucucauggucugggaaagagcuaaaguguggaucaggaauuuuuauuauugauaauguacauacauggacagaacaauacaaauuucaaccagaaagcccugcacgauuggcaucagcgauauugaacgcucacaaggauggagucugcggaauccgcucuacaacacgacuugaaaaugucauguggaaacaaauuacaaaugagcuuaauuauguccuaugggaaggcgggcaugauuuaacugugguagccggugaugugaagggaguucuuaguaaagguaaaagggcucuagcaccaccaguaaacgauuuaaaauauagcuggaaaacaugggggaaggcuaagauauuuaccccugagacuagaaacucaacuuucuuaaucgacggaccugauaccagcgaaugcccuaacgagcgccgugcguggaauuucuuagaaguagaagauuauggauuugguauguucaccacuaacauuuggaugaaguuucgagaagguaguuccgagaugugugaucacaggcuuaugagugcugccauaaaagaucaaaaagccguacaugcggauaugggauauuggauagagaguagcaaaaaccaaacauggcagauagaaaaggcaaguuuaauugaaguaaaaacuuguuuauggcccaaaacacauacacuauggaguaauggaguucucgaaagccaaauguugauaccgaaagcauaugcuggccccuucagccagcacaacuaucgacaaggauaugcuacacaaacaguagguccuuggcauuuggguaagcucgaaauugacuuuggagaaugccccggaaccacgguuacuauacaggaggauugcgaucaccgagguccuuccuugcgaacgacaacagcuagugguaaguuagucacacaauggugcugcagauccuguacgaugccuccacucagauuccuaggugaagaugguugcugguaugggauggaaauaaggccuuuaagcgagaaagaagaaaacauggugaagucucagguaucugcgggucaggggacuagcgaaacuuuuagcaugggucuacuauguuuaacuuuauuugucgaggaaugucuacguagaagagucacucggaaacacaugauuuuggucguaguaacaacacuaugugcgauuauacuaggcggucuaacauggauggauuuacuaagagcccuuauuaugcuagguaacacuaugucaagccgcaugggaggucaaauacacuuggcaauaauggcggucuuuaaaaugaguccaggauacguuuuggggauauuucuacgcaaauuaacgaguagggaaacagcacucaugguuaucggaauggccaugacgaccguacucucaauaccacacgaucuaauggaguucguagauggaauuucccuugggcuaauauuacuaaaaaugguaacgcauuuugacaauacucagguagggacgcucgcuuugucuuuaacuuuuauaaaaucgacgaugccguuggucauggcauggcguaccauuauggcaguacuauuuguuguaacacuaauacccuugugccgaacaucgugucuacaaaaacaaucccauugggucgaaauuacagccuuaaucuuaggggcacaagcucuaccuguauaucuuaugacgcuuaugaaaggagcaaguaaaaggagcuggccuuugaaugaaggaaucauggcugucggcuuaguuuccuugcuuggaucagcgcuacuuaagaacgacgucccucuagcugggccuaugguagcaggcggguuacugcuugccgcauaugucaugucuggaucaucagccgacuuaagccuugaaaaggcagcuaccguccaaugggacgaaauggcagauaucaccgguucgucacccauuauugaagugaaacaagacgaagacggcucauuuaguauaagggauguggaagaaacuaauaugaucacguugcucguaaaauuagcccuuaucacaguuucggguuuauacccguuagcaauacccguuacuaugacuuuaugguauauguggcaaguaaaaacacagcgaagcggcgccuugugggacguaccaucgccagcagcggcucaaaaagccacauuaacagaaggugucuaucggauaaugcagcgaggguuauuuggcaaaacucaaguugguguaggaauacauauggaagggguguuucacacuauguggcacgugacaagagggucaguaauaugucaugaaaguggaagacucgaacccagcugggcagauguaaggaaugauaugauaaguuacggagguggauggagacuaggugacaaaugggauaaagaagaagauguacagguucuagcgguggagccggguaaaaauccuaaacacguacaaacgaaaccaggacuguuuaagaccuuaacuggggaaaucggggcuguaacauuggacuucaagccagggacauccgggucaccgauaaucaauaggaaaggaaaaguaauaggacuguaugggaacggaguuguuacaaaaucgggagacuaugugucugccauaacacaagcugaaaggauuggugaaccggacuaugagguagacgaagacauauuuaggaagaaaagauuaacaauuauggaucuacauccaggggccggcaaaacaaagaggaucuugccuagcauaguaagggaggcuuugaagaggaggcuucgcacauuaauauuagccccgacuagaguuguugccgcggaaauggaggaggcuuuaaggggguuaccaauccguuaccagacuccggcuguuaaaucagaacacacagguagagaaaucgucgacuuaaugugucaugcaacuuuuaccacacguuuguuaucaucgacaaggguaccuaauuauaacuugauaguaauggaugaagcacauuuuacagauccaucgagugucgccgcacggggguacauuucaacccggguagaaaugggugaagcagcagcaauauuuaugacugcuacaccaccaggaacgacggauccauucccacaaucgaauagcccaauagaagacauagagagagaaauaccggaacguucguggaauacaggguuugacuggaucacagauuaccaagguaagaccgugugguucgugccuucaauaaaagcaggaaaugauaucgcgaacugccuaagaaagucaggcaaaaagguuguacaauugagccgaaaaacauuugauacggaauauccgaagacaaaguuaacagauugggauuuuguaguaacaacggauaucagugaaaugggggcuaacuuuagggcaggucgagugauugauccaaggcgaugucuaaaaccgguuaucauuacggauggcccagaacguguaauucuagcaggaccaauaccaguaaccccagcgagcgccgcgcaaagaaggggacgcaucggcaggaauccagcucaagaagaugaccaauacguauuuagcggagacccauuaaggaaugacgaagaucaugcucacuggaccgaagcaaaaauguugcuagauaauauauauacgccagaagguauaauaccaacucuguuuggaccugaacgugagaaaacccaagcaauagauggggaauuuagauuaagaggagaacaaagaaaaacuuucguugaauugaugaggagaggcgaucuaccagugugguugaguuauaagguggccucagcaggaaucucuuauaaagauagagagugguguuuuacuggagaaaggaauaaucaaauuuuagaggaaaauauggaaguagaaauauggacuagggagggagagaagaagaaguugagaccaaaauggcuagacgccagaguauaugcggauccuguagcauugaaagauuuuaaagaguuugcaucagggcguaaaagcauaacgcucgacauacucaccgagauugcgucguuaccaacuuaucuuucauccagagcaaaauuagcguuagauaacauuguaauguuacauacuacggaaagagggggaaaagcauaccaacaugcccuaaaugaauugccggaaucauuagagacauuaaugcuaauagcucucuuaggugcgaugacagcagguauauuuuuauuuuucaugcaaggcaaagggaugggcaaguuaucaaugggauuaauugcaauugcuguugcaagcgggcuguuguggguggcagagauacaaccucaauggauagcugccaguauuaucuuggaguucuuucuaauggcucuacugauuccagaaccugagaaacagaggacuccacaagacaaccaacugauauacguuaucuuaacaauauuaaccauaauaggacuuguagcagcuaacgagaugggucugauagaaaagacuaagacagacuuugguuuuuaucaagagaaaaccgaaacuaccauacuugauguggauuuaagaccagcaagugcauggacuuuguaugcgguugcgacaacaauacuuacuccaauguuacgucauacaauugaaaauaccagugcaaaccugucucuagcggcaauugcaaaucaagcugcagugcucaugggacuagguaaagguuggccucuccaccgaauggauuuaggcguaccauuauuagccaugggaugcuauucucaagugaauccaaccacacuaacagccucauuagugaugcuguuaguccacuaugcgauaauaggaccuggguuacaagcaaaggcgacucgagaagcacagaagagaacagcugccggaaucaugaagaauccgacuguugaugguauuacaguaauagaucuagaacccauaaguuaugaccccaaguuugaaaagcaacuaggacaaguuaugcuauuaguucuuugcgcaggacaauuguuauuaaugaggacuacgugggcuuuuugugaaguccuuacacuagccacugggccuaucuugacucuaugggaagggaauccagggcgauuuuggaauaccacuauagcugugucuaccgcaaauauauuccgagguaguuaucuagcuggagccggucuagcguucucucuaauuaaaaacacacaaaccccgcggcgcggcacugggaccacuggagaaacauuaggagaaaaauggaaacgacagcuuaauagucuugaucguaaagaguucgaagaauauaagcggagcgggauuuuagaaguggauagaacagaagcaaaaagugcauuaaaagacggaucuaaaauaaaauacgcagugucaagaggaacuucaaaaauacguuggauuguggagaggggaaugguuaaaccaaaagguaaagugguagaucuuggauguggccguggaggauggaguuacuauauggcaacccuuaaaaauguaacagaagugaaaggauauacaaagggugggcccggacacgaagaaccaauucccauggccacguauggauggaaccuaguuaaacuacacucaggaguugacguauuuuauaaacccacagaacaaguggauacgcuccuaugugauauaggggagaguucaucaaacccaacaauugaagaaggacggacacuacgcguucuaaaaaugguugagccuuggcuuuccaguaaaccagaauuuugcauuaaaguacuuaauccauacaugccuacaguuauagaagaguuagaaaaauugcaaagaaaacauggcgggucguuagugagaugcccauuaucuaggaauagcacucaugaaauguacugggucucagguguaucaagaaacaucguaaguaguguaaacacaacaucaaaaaugcuauuaaauagguuuacgacucguuaucgcaaaccgacuuaugaaaaagaugcagacuugggcgcagguacaagaucagucaguacagaaacagaaaaaccugacauggcgauaaucggucgaagacuucaacguuugcaagaagaacauaaggaaacguggcacuaugaccaggagaaccccuauagaacgugggcuuaccaugguagcuaugaagccccaucuaccggcucagcaagcaguaugguaaauggcguuguaaagcuauuaaccaagcccugggacguaguuccaaugguaacucagcuugcuaugacugauacuacuccuuucggucaacaaagaguauucaaagaaaaaguugacacgcgaacgccacaaccgaaaccagguacucgcaugauaaugacuacuacugcaaacuggcuuugggcccuguuagguaagaagaaaaauccacgccuuuguacaagagaagaguuuaucucuaaaguaagaaguaaugcagcuauaggagcugugucccaagaggaacaagguuggaccagugcaagcgaggcuguuaacgauucaagauucugggaacuuguugacaaagaaagagcacugcaucaagaaggcaagugcgaaaguuguguguacaacaugauggguaaacgugagaagaaacuaggcgaauuuggcagggcuaaagguaguagggccaucugguauauguggcuaggcgccagguuccuagaauuugaggcauugggauuucuaaacgaagaucacugguuuggacgggaaaacagcuggucgggaguugaaggagagggacuucauagacuuggauauauucuggaagacaucgacaagaaagauggggaccuaaucuaugccgaugacacagcagguugggacacuagaauuacagaagaugacuuacuuaacgaggagcuuauaacagaacaaauggcaccacaucauaaaauccuagcuaaggcaauauuuaaauuaacauaccagaacaaagucguaaaaguauuaagaccaacuccuaagggcgcuguaauggacauaaucagcagaaaggaucagagagggucgggccaagugggcacuuauggacuuaacacauucacgaauauggaaguccagcuaauuagacaaauggaagcggagggaguaaucaccagagaugauaugcauaacccaaaagggcuaaaagaaagaguagaaaaauggcuaaaagaauguggaguugaccgacuuaaaagaauggcuauuaguggggaugauugugugguaaaaccacucgacgaaagauucucuacuucuuuacuauuucuuaaugauauggguaaaguaagaaaagauauaccgcaaugggaaccuagcaaagguuggaagaacuggcaagagguaccuuuuugcucucaucacuuccauaaaaucuuuaugaaggacgguaggucucuuguaguaccaugucgaaaccaggacgaacucauuggacgugcacgaauaagucaaggggcagguuggaguuuaagagaaacugccugccugggaaaggcuuacgcacaaaugugguccuuaauguauuuucaccgcagagacuuacgacucgcuucgauggcaauaugcagugcagucccuaccgaaugguuuccuacaucacgaacuacauggagcauacacgcacaccaccaauggaugaccacagaagauauguuaaaaguguggaaucgcguuuggauagaagacaacccaaacaugacugacaagacgccuguucacucgugggaagacauccccuacuuaggaaaacgugaagauuuaugguguggauccuuaauagguuugucaucacgagcuaccugggcaaagaacauacauacagcaauuacucaagugaggaaucugauagggauugaggaauacgucgauuacaugccugucaugaaaagauauucugcucccuucgaauccgagggagugcuauaa

SEQ ID NO: 23601 - RNA, 9867 nt, Artificial Sequence
  derived and/or modified CDS sequence (opt6) from DENV-4__JQ922558__SS-prME
ucgacgcuuacucuacuuuguuuaauacccaccgugauggcguuucauuuaagcacccgcgauggagaaccgcucaugauaguugcaaaacacgaaagagguagacccuuauuauuuaaaaccacugaagggaucaacaaaugcaccuugaucgcaauggacuuaggagaaaugugugaagauacaguuacuuauaaauguccacuauuagucaauacagaaccagaagacaucgauuguugguguaauuuaacuucaacuuggguuauguacgguacaugcacacaauccggagaaagacgaagggaaaagaggucaguugcacugacaccccacucagguaugggacuagaaacuagagcggaaacguggaugaguuccgaaggggcauggaaacaugcucaaagaguugaaucuuggaucuuacgaaacccuggauuugcacuguuggcuggauuuauggcauauaugauaggacaaaccgguauacaaaggaccguauucuuuguccuaaugaugcuaguugcaccaaguuauggaaugagaugugugggagucggcaaucgagacuuuguggaaggaguaagcggaggugcauggguagaucuaguucuagaacacggaggauguguaacaacgauggcacaaggaaaaccaacacuugauuucgaacucauaaaaacaacugcgaaagaaguggccuugcuaagaacauacugcauagaggcuuccauauccaauauaacaaccgccacuagaugcccgacgcaaggagaaccauaccuaaaagaagaacaagaccaacaguauaucuguagacgagauguuguagaucgaggcuggggaaauggcuguggauuauucggaaaaggaggagugguaaccugcgcaaaauucuuaugucuaggaaaaauuacuggaaaccucguccaaauugagaacuuagaauauacaguaguaguuacaguccauaacggagacacccaugcaguaggaaacgauauaucuaaucaugggguaacugcaacgauaaccccacgaucaccaagcguagaggugaaauugccagauuacggagaauugacgcucgauugcgaaccuagaucugggauagacuuuaaugagaugauacuuaugaaaaugaaaaagaaaacauggcuaguacauaaacaguggguauuagauuuacccuuacccugggcagcaggggccgacacaaguaaaguacaauggaauuacaaagaaaggaugguaacauucaagguuccacacgcaaaacgucaagaugugacaguucuuggcagccaagagggagcuaugcauagcgccuugaccggugcuacagaagucgauuccggcgaugguaaccauauguucgcggggcacuuaaaguguaaaguuagaauggaaaaacugaggauuaagggaaugagcuauacaauguguucaggcaaauucucgauagauaaagagauggcagaaacacaacaugguacaacagucgucaaaguaaaauacgaaggagcaggagcacccuguaaaguaccaauugaaaucagagauguuaauaaggaaaaggugguuggaaggauaauaucuucaacgccguuugcagaacacacaaacagcgugacuaacauagaauuggaaccaccauucggagauuccuauauagucauagguguuggugauuccgcucuaacguuacauugguuucguaaaggcuccuccaucggaaagauguuugaauccacuuacaggggcgcuaagcgcauggcaaucuugggggaaacagcaugggauuucggaucggucggaggacuauuuacuucauuaggaaaagccgugcaucagguauucgggagcguauacacaacaauguucgguggagucaguuggaugguacgcauacuaauuggauugcuaguucucuggauugggacuaacucgcgaaauacuuccauggcaaugacauguauagcaauaggagggaucacuuuguuucuaggauuuacuguucaugccgauauggguugcgcaguuaguuggagugggaaagaacucaaauguggcucagguauauuugugguagauaauguucauacuuggacagagcaauacaaauuucaaccggaaucgcccgcacgacuagccucggcaauauuaaaugcacauaaagacggaguuugcggaauuagaaguacgacaagauuagagaauguaauguggaaacaaaucacaaacgaauuaaauuacguauuaugggaaggcggacaugauuuaacagucguagcaggcgacguuaaaggcguguugacaaaaggaaagcgagcuuuaacaccacccgugaaugaucuaaaguauaguuggaaaacuugggggaaggcaaaaauauucaccccugaggcgagaaauaguacauuuuuaaucgaugguccagacacgucagaauguccaaacgaaaggagagcauggaauuuccuagaaguugaagacuauggauucggaauguuuacuacgaauaucuggaugaaguuuagagaaggaucaucagaggucugcgaccauaggcuaaugagugccgcgaucaaagaucagaaagcaguccaugcugauaugggauauuggauugagagcaguaaaaaucaacccuggcaaauugggaaugcaucauugauagaaguaaagacuuguuuauggcccaaaacacauaccuuauggucaaacggcguucucgaaagucaaaugcugauaccaaaggcuuacgcuggacccuucagucaacauaauuauaggcagggcuaugcaacacaaacuauagguccuuggcaucuggguaaacuagaaauagacuuuggcgagugcccagggacaaccgugacaauucaagaggacuguaaucauagaggucccucguugcgaacaacaacagcuagugguaaacuggugacgcaaugguguugcaggucauguaccaugccaccccugcgguuucuuggggaagaugggugcugguacggaauggaaauuaggccacucagugaaaaggaggaaaacauggugaaaucucaagucagugcaggacaaggcacuucugagaccuuuucuaugggccuacucugccuaacccuauuuguagaagagugcuuacgacgaagaguaacacgcaaacauaugauuuugguaguuguuacuacauuaugugcuaucauccuuggaggauuaacuuggauggauuugcuucgagcuuuaauaaugcugggagauacuauguccgguagaauggguggccaaauucauuugacgauaauggcuguuuuuaaaaugucuccagguuauguuuuagguguuuuucuaaggaaacuaacuagcagagaaacugcauuaauuguuauaggaauggccaugacuacagucuugagcauaccgcacgaucugauggaguucaucgacgguaucucccuagguuuaauucuucucaaaaugguagcacacuucgacaauacucaaguaggaacauuagcccuaucgcuaacauucauacggucaacuaugccucucgugauggcauggcgaacaauaauggcaguguuauuuguuguuacuuugauaccucugugucgcaccaguugucuacaaaagcaaagucauuggguugagauaacggcucuaauauuaggagcacaagcauuaccgguuuaucuuaugacauuaaugaagggggcgagcaaaaggagcuggccccuuaaugagggaauuauggcugucggcuuagugucccuuuuagggucagcucuacuuaaaaacgacguaccacuagcaggacccauggucgcaggaggacuacuauuagcggcuuauguaaugagcggauccagugcggaccuaucuuuagaaaaagcagcuaauguacauugggaugaaauggcugacauaacaggaaguucaccaauuaucgaagucaaacaagacgaggacgguucuuucagcaucagagauguugaggagacgaauaugauuacgcuuuuaguaaaacucgcucugauaacagugucgggacuuuacccucuugcgauuccugucacaaugacacucugguauauguggcagguuaaaacgcaaaggagcggugcccuaugggauguaccuucuccagccgccgcccagaaggcaacacucacagaaggaguauauagaauaaugcagcgaggauuauucgguaagacccaaguaggaguggggauucauauggaagguguuuuucacacuauguggcaugugacgagaggcuccguaaucugccaugaaacugguagacucgaaccaagcugggccgauguaagaaaugauaugaucuccuacggaggaggguggcgucugggagacaaaugggacaaagaagaggacgugcagguuuuggcaaucgaaccuggcaaaaauccuaaacacguacaaacuaagccgggacucuucaaaacauuaacgggggaaauaggagccguuacauuagacuucaaaccgggaacuucuggaagcccaauuauuaauaagaaagguaaaguuauuggacuguauggcaauggagucguuacaaaaaguggggauuauguaucugcuauuacacaggccgaaagaaucggggauccugauuacgaagucgacgaagauauuuuucguaagaaaagacuuaccauaauggaccuacacccuggugcgggaaagaccaagagaauccuccccucuauaguaagagaagcacuaaaaaggagguuaagaacgcugauccuagcgccuacgagaguaguugcugccgaaauggaagaggcuuuacguggguugccgauuagauaucaaacacccgcaguuaagagugagcacacuggaagagaaauaguagauuugaugugucacgccacguuuacggcuaacccuuugaguagcacacgaguaccaaacuauaaccuuauaguaauggaugaagcacaucuucaagaucuuucuaucguugcugccagaggauacauauccacucguguagaaaugggagaagcggcagcuauuuucaugacagcaaccccaccaggagcuacggauccuuuuccacaaucaaauagucccauagaggacauagaacgagaaauucccgaacgaucauggaauacaggguucgauuggauuacugacuaucaagguaaaacaguuugguuugucccuucaauuaaagcaggaaacgauauugcaaacuguuugaggaaaucgggcaagaaagugauucaacuaagcagaaagacauucgacacagaauauccuaaaacuaagcucacagacugggauuuuguagugacuacagacauaucugaaaugggagcuaacuuucgugcacggcgcguaauagacccccgacgauguuugaaaccaguaauccuaacagauggaccugagagagucauacuagcaggcccaauacccguuacaccagccucugcagcucagcguagagguagaaucgguagaaaucccgcccaggaggaugaccaguacguauucucuggcgauccacucaaaaaugaugaagaucacgcucauuggacggaagcaaaaaugcuccuugauaacauuuacacuccagaaggaauaauaccuacccuauucggcccagaacgagagaaaauucaggcgauugauggcgaauuucgauugcgcggagaacaacguaaaacauucguagaacugaugaggagaggagaucugccaguaugguuaaguuauaaggucgcaucugccgguauaucguauaaagaccgagaguggugcuuuacuggagaacguaauaaucaaauucuagaagaaaauauggagguagaaauuuggacaagagaaggugagaagaagaaauugagaccaaagugguuggacgcccgcguuuacgcugaccccauggcgcuaaaagacuuuaaagaauuugcuucuggucguaaaucaauuacacuagacauacuuacagaaauugcgagccuccccacuuacuuaaguucuagggcgaaauuagcgcucgauaacauaguuauguuacacaccacagaacgagguggaagggcauaccaacaugcauuaaacgagcuaccggaaucguuagaaacacucaugcuuguggcguuguuaggagcaaugacggcgggaauauuucuauucuuuaugcaaggcaaaggaauaggaaaacuaucuaugggguuaauggcuauagccguggcaaguggucuucuauggguagcugaaauucaaccgcaguggauagcagccagcauaauccuugaauuuuucucaauggcuuuacugauaccugaaccagagaagcaaagaacaccacaggacaaucaauuaauauauguuauucuaacaauacuaacaauaauuggacuaauagcagcgaacgaaaugggcuuaauagagaaaacuaaaacagauuuugguuuuuaucaaguuaagaccgaaacuacuauucuugauguagauuugaggccggcaagugcuuggacacuuuaugcgguggcgacuacaauacugacacccauguuaaggcauacuauagaaaauacaucugccaaucuuucguuagcggccaucgccaaucaggcugccguguugaugggccuugggaaaggguggccacuacacaggauggacuuaggaguuccauuacuugcaaugggaugcuauagccaaguuaacccaacaacucuaacugcuucguuaguaaugcugucuguucauuacgccauaaucgggcccggauuacaggccaaagcaacaagggaggcccagaaaagaagugcagcuggaauaaugaagaauccuaccguagauggaauaaccguaauagaucuagagccaauaucauacgacccaaaauucgaaaaacaacucggccaaguaauguuacuugcauuaugugccggccaauuguuacucaugagaacgacaugggcuuucugcgaaguauuaacucuagcaacugggccaauuuuaaccuuaugggaaggaaauccaggaagauuuuggaacacaaccauacccguuaguacugccaauauuuuuagaggaucguaucuugccggugcuggacuagcuuucucacuuauuaaaaacgcacagacuccccgacgaggaaccggaacgaccggugaaacuuugggcgaaaaauggaaacgacaacuaaauucauuagauagaaaggaauuugaggaauauaaaaggagcgguauauucgaaguugauagacaugaaaucaaauauacacuuaaagaugggucaaaaauaaaucacgcaaugucaacgggcucaauuaaaauaagaggaauugaugaacgaggaauggucaaaccuaaggggaaagugguagaccaaggcuguggacguggcggcuggucacacuauacugcgaccgcuaagaaaguaacagagguuaaagguuauacaaagggcggccccggccaugaagaaccgauuccaauggcuacauacggauggaaucuggucaaacuccacucaggaguugauguuuucuauaaaccaacugaacaaguugacaccuugcuaugcgacauuggggagaguucgucaaacccaacaaucgaagagggucgaacacucagaguuuugaagaugguugaaccauggcuaucaucaaaaccugaauuuuguaucaaaguguuaaauccauacaugccuacggucaucgaagaauuagaaaaauuacaaaggaaacacggcgggucuuuaguacgcuguccauuaucaagaaacucuacacaugaaauguacuggguuagugguguuagcggcaauaucguuucuucagucaauacgacaaguaaaaugcuacucaaucgguuuaccacccgccaucgcaagccaacauaugaaaaagacguagaccuuggagcagguaccagaucagugucaauugaaacugagaagccagauaugacuaucauaggcaggagacuacaaagacuaagagaggaacauaaggaaacguggcacuaugaccaagaaaacccuuaccgaacaugggcauaucacgguucauaugaagcuccuaguacuggauccgcgagcucuaugguuaauggagucguaaagcuauugacaaagccaugggacguaauacccaugguuacacagcucgcuaugacagacacgaccccauuuggucagcaaagagaauuuaaagaaaaaguauauacaaguacuccccacccgaaaccauggaccagaaugguuaugaccacgacagcgaacuggcugugggcuuuaggagggaaaaagaagucgccacgucugugcacaugggaagaguucaucagcaaaguccgaucgaaugcggcuauaggagcaguauuccaagaagaacaagguuggacauccgcuucagaagcgguaaaugauucccgauuuugggaguugguugauaaggaacgugcccuccaccaagaagguaagugcgaaaguugcguauauaacaugauggggaaacgagagaagaaacuuggagaauuuggaagggcaaaaggaagccgagcaauuugguauauguggcuaggggcaagauuuuuagaguuugaagcacucggauuuuuaaaugaggaucauugguuuggacgcgaaaacucuuggagcgguguugaaggagagggauuacacagauuaggauauauacuagaagauauagauaagaaagacggggauuuaaucuaugcagaugauacagcgggaugggauacaagaauaacugaagaugaucuacugaaugaagaacuuaucacagaacagauggcuccacaucauagaauacuagcaaaagcuauauuuaaacugacguaucauuccaaagugaugaaaguccuacgaccuacaccgaaaggagcaguuauggauauaaucucaagaaaggaucaaagaggaucaggucaggucggaacuuauggacuaaauacauuuacuaacauggaaguacaauuaauacgacaaauggaggccgaaggaguuaucacucaagacgauaugcaaaaucccaaagggcuaaaggaaaggguggagaaauggcuuaaagaaugcggcguggaccgauuaaaaaggauggcgauuucgggcgaugacugcguaguuaagccucuagaugagcgauuuagcacaucauuacucuuucuaaaugauaugggcaagguuaggaaagacauaccacaaugggaaccuuccaaaggguggaagaauuggcaagagguaccauuuugcagccaccauuuucacaaaaucuuuaugaaagaugguagaucacucgucgugccaugucguaaccaagacgaauuaauaggccgugccaggaucagucaaggagcaggauggucccuaagagaaacagcaugucuagggaaagccuacgcucaaauguggagucuaauguacuuucaccgacgggaccugcgucuugcgaguauggcgauauguucagcugucccgaccgaaugguuuccaaccaguagaaccacauggucaauccacgcucaucaucaauggaugacaaccgaggauauguuaaaaguuuggaaccgcgucuggauagaagacaauccuaauaugaccgacaaaacaccuguacauuccugggaagauguacccuaccuaggaaaaagagaagaucuguggugcgguucucuuaucggacuaucuucacgggcuacgugggcgaagaacauacauacagcaaucacucagguacggaaucuaauuggaaaagaagaauaugucgacuacaugccaguaaugaaaagguauagcgcuccaauagagucagagggagucuuauag

SEQ ID NO: 23602 - RNA, 9867 nt, Artificial Sequence
  derived and/or modified CDS sequence (opt6) from DENV-4__JQ922559__SS-prME
ucaacgauaacucuccucugccucauaccuacggugauggcuuuucacuugucaaccagagauggugaaccucuaaugaucguugcaaaacaugaaagaggucguccgcuucuauucaaaacuacagaaggaaucaacaaauguaccuuaauugcaauggauuuaggugagaugugugaagacacuguaacuuauaaauguccauuauuaguuaauacagaaccggaagauauugacuguugguguaaccuuacauccgccuggguaauguauggaacauguacucaaaguggagagcguagacgcgagaaacguagugucgcucuaaccccacauucagggaugggucuagagacgagagcugaaacauggaugucgucagaaggagccuggaaacacgcacaaagagucgaaucguggauuuuacgaaauccagguuuugcuuuauuggcaggcuucauggcuuauaugauaggacaaaccgguauccaacgaacuguauuuuucauacuaaugaugcuuguugcaccgucguacggcaugcgauguguuggaguagguaacagggacuucguagaaggugucaguggcggagcuuggguagaucuaguauuagaacauggagggugcguaacaacaauggcucaagguaagcccacuuuggacuuugaacugauaaagacgacugcaaaagaaguagcacuacuaagaacguauugcauugaagcgaguaucagcaacauaacaacagcaaccagguguccuacucagggagaaccauaucuuaaagaagaacaagaccaacaauacaucugcagaagagauguaguugauaggggaugggguaauggaugugguuuauuugguaagggaggagucgucacuugcgccaaauuuuuaugcuccggaaagauaaccgguaaccugguacagauagagaaucuggaauacacagugguaguaacuguacacaacggugauacacaugcuguaggcaacgauaucucuauucauggaguuacagcuacuaucaccccuagaaguccgucaguggaaguuaaauuacccgauuacggggagcuuacgcuggauugcgaaccacggucugguauagacuuuaacgaaaugauccuaaugaaaaugaagaagaaaacuuggcuaguucacaaacaaugguuuuuagaccucccccuuccuuggacugccggcgcggauacuucugagguacaauggaauuacaaagaaagaauggucacuuuuaaaguaccucacgcaaaaagacaagacguaaccguuuuagguagucaagaaggagcaaugcauagugcauugaccggugcaacugaaguagauuccggagauggaaaccauauguucgccggacauuuaaaauguaaaguacgcauggaaaaacuaagaauaaaaggaaugaguuauaccaugugcaguggaaaauucucgaucgauaaggagauggcagaaacccaacacgggacaacgguggucaaggucaaauaugaaggagcaggggcaccaugcaagguaccuauagaaauucgcgacguuaauaaagaaaaaguuguuggccgaauaauaucaaguacaccuuuugcugaaaauacuuauuccguaacaaacaucgagcuggaaccgccuuuuggugauucauauauaauaauuggaguuggugauagugcauuaacguuacacugguucagaaaaggcaguagcauuggaaagauguuugaaagcacguauagaggggcaaaacgaauggcaauauuaggcgaaacugccugggauuuuggcaguguuggagggcuccugacaucauuaggaaaagcaguacaccaagucuuuggaagcgucuauaccaccauguuuggcggggugaguuggaugguacggauucucauagguuuauuaguacucuggauaggaacaaauucaaggaauacaaguauggcuaugaguugcaucgcaguuggaggaauaacuuuguucuuagguuucacaguucaugcugacauggguugcgccguaaguuggucaggcaaagaacucaagugugggagcgguauuuuuguuauagauaauguacacacuuggaccgaacaauauaaauuucagccagaaagcccagcaagauuagcaagugccauucuaaacgcucacaaagacggcguuuguggaauaagauccacgacgagacuggaaaaugugauguggaaacagauaacaaaugaacuuaauuacguucuuugggaaggaggacaugacuugacgaucguagccggggacguaaaagggguacucucuaaggggaaaagagcuuuagcaccaccaguaaaugaucuaaaauacaguuggaaaacauggggcaaggcaaaaauauuuacaccagaaacacguaacagcaccuuccuuauagaugguccagauacuagcgaaugucccaacgaacgacgggcuuggaacuuuuuggagguggaagacuacggcuuugguauguucaccacaaacaucuggaugaaguuuagagaggguucuucagagguuugugaucaucgacuaaugagcgcugcgauuaaagaccaaaaggcaguacaugcugacauggguuauuggauagaaaguucuaaaaaucagacuuggcaaauagaaaaagcuagccucauagaaguaaaaaccugccuguggccuaaaacacacacacuauggaguaacggcguccucgaaucacaaaugcuaauacccaaggcauaugcagguccauuuagucaacacaauuacagacaaggauaugcaacucaaacgguggggccuuggcauuuggguaaacucgagauugacuuuggugaaugccccggcacgacuguaacaauucaggaagauugcgaucaucgagguccauccuuacgcacaacaaccgcaucaggcaaauuaguaacucaauggugcugucggucaugcacuaugccuccuuugagauuuuuaggugaggaugggugcugguaugguauggaaauucgaccacuuucagaacgugaagagaauaugguaaaaucccaaguaucagcagggcaagguacaucagaaacauuuaguaugggauuauuauguuuaacguuauucguagaagagugcuuaagaagaagaguuacgcggaagcauaugauccucgugguaguaacuacccuuugcgcuauaaucuuggguggauuaacuuggauggaucuucuucgugcuuuaauaaugcugggggauaccaugaguucaagaaugggugggcagauacacuuagcgaucauggccguauuuaaaaugaguccaggguaugugcugggaaucuucuuacgaaagcucacaucacgagaaacggcucuaauggugauagguauggcaaugaccaccguguuaaguauaccacacgacuuaauggaguucauagaugguauuaguuuaggacugauacuuuuaaagaugguaacucacuucgacaauacacaaaugggcacucucgcacugucacucacuuuuauaaagucuacaaugccguuaguuauggcauggaggacuauaauggccguacuuuucguuguaacucuaauaccgcuaugcagaaccaguugccuucaaaaacaaucgcacugggucgaaaucacggcgcuaauucuaggugcucaggccuuaccaguauaccucaugacucuaaugaaaggagcaucaaaaagaagcuggccauugaaugaaggcauaauggccguaggucucguaagccuauuagguagugcuuuacucaaaaaugacguuccacucgcaggcccgaugguggcgggaggucucuuguuggcggcauacguaaugagugggagcucagcugaucuaucccuugagaaagcugcaaacgugcagugggaugaaauggcugacauaacgggaagcaguccaauuauagaaguuaaacaagacgaagauggaaguuucucuauacgagauguagaagagacaaacaugauaacucuuuugguaaaauuggcuuuaauaacagucucaggauuauacccccuagcuauaccaguuacuaugacguuaugguauauguggcaaguaaaaacgcaaagaucgggcgcuuuaugggacguuccgucgccggcagcagcacagaaggcgacacuuacagaaggaguuuauagaauaaugcagcguggacuauucggcaaaacacagguaggcgugggcauacauauggaaggcguauuccacaccauguggcaugucacacgcggaucuguaauaugucaugaaaguggucgucuggaaccaucaugggcagauguacguaacgauaugauaucguauggggguggauggagacuaggugauaaaugggauaaagaagaagacguacagguccucgcaauagaaccaggcaaaaauccaaagcacguacaaaccaaaccuggucucuuuaaaacacuaacaggagaaauuggagcaguaacguuagacuuuaagccugggacuagcgguaguccuauaauaaacagaaaagguaaaguaauaggacucuaugguaauggaguugucacaaaaaguggcgauuacguaagcgcuaucacacaagcagaaaggaucggugaaccugacuacgaagucgacgaagacauauuccgcaagaagagacuuacaauuauggaucuacauccgggagccggcaaaacaaaacguaucuugccaaguauaguacgagaagcgcuaaaacgacgucuuagaaccuugauacuagcaccgacaaggguuguagcagccgaaauggaggaggcacugagaggauuacccauucgauaucagacuccugccguacuuucagagcauacgggaagggagauugucgacuugaugugucaugcuacguucacaaccagauuauuaucaucaacgagaguaccaaacuauaaccuaauagugauggacgaggcacauuucacggauccaucgucgguagcggcucguggauauauaucuacaagaguugaaaugggcgaggcagcggcgauuuucaugacagcaacgccaccggggacaacugacccuuuuccgcaaucgaacucaccaaucgaggauaucgaaagagaaauuccugaacggaguuggaacacagguuucgauuggaucacagacuaucaggggaagacagugugguucguaccuagcauuaaagcaggcaacgacauugcgaauugccuaaggaaaucggguaagaaaguaauccaauuaucacgaaagaccuucgacacagaauauccuaaaacuaaacuuacugauugggauuuuguuguaacaacggauauuucagugaugggugcaaauuuuagagcggggagagucauagauccgcgacgguguuugaaaccaguaauuaucacagaugguccagaaagaguaauccuagcgggaccgauaccagucacgccugcaagugcagcucaacgcagaggacgaauagggaggaacccugcacaggaagacgaccaguacguauucucaggggaccccuuacgaaaugaugaagaucaugcacauuggaccgaagcaaaaaugcuguuagauaacauauacacaccagaagguauaauuccaacucuuuucgguccagaaagagagaaaacacaagcaauagacggugaauuucguuuacgcggagaacaaaggaaaaccuuuguugaauuaaugcgaagaggugaucugccugugugguuaucuuauaaaguagcgucggccggaauaucuuacaaggauagagagugguguuucacuggagagcgaaacaaccagauacuugaagaaaauauggaagucgagauuuggacacgagaaggugagaaaaagaaauuaagaccaaaguggcuagaugccagaguuuaugcugacccaauggcccuaaaggacuuuaaagaauuugcgucagguaggaaaucuauaacauuagacauuuuaacugaaauugcaucacucccaacuuaucuuagcucucgugccaaguuggcacuagacaauauagucaugcuacauacaacagaacgggguggcaaagcguaucagcaugcacucaacgaacugccagaaucauuagaaacgcuuaugcuugucgcgcugcuaggcgcaaugacugcugggauauuucucuucuucaugcaaggaaaaggcauuggugaacugucaaugggauuaauagcgaucgcgggggcaucaggauuauuauggggaacaaaaacgccgccaccauggggugccgccucaaauaucuuagaauuuuucuuaaugguacucuuaauacccgaaccugaaaaacagcgcaccccacaagauaaccagcuaauauacguuauccugacaauacucacgauuaucggccuaguggccgcaaacgaaauggguuuaauagagaaaacgaagacggauuuugguuucuaccaaguaaagacagaaacuacaauuuuggacguagaccugagaccugcaagugcauggacacucuacgcaguggcgacaacaauauuaaccccgaugcugcgucauacaauugaaaauaccagugccaauuuaucauuagcugcaauagcgaaucaggcggcuguuuuaaugggauuagggaaaggcuggccucuucaucgcauggaucuggguguaccccuacuagcaaugggcuguuauucacaaguuaauccaacgacacuaauugcgaguuuaguuaugcuauuaguacacuacgcuauuauaggaccaggacuacaagcuaaagcgacccgagaggcacagaaaagaacggcagcggguauaaugaaaaacccuacagucgauggcauuacgguuauugaucuagaaccuauaucauacgacccaaaauucgaaaagcaauuaggucaagugauguugcuggugcuaugugcaggacaauuacuacuuaugcggacaacuugggcauucugugaaguccugacauuggcaacagguccaauauugacacugugggaaggaaacccggggcguuuuuggaacacuacuaucgcgguuucaacggcuaauauauucaggggaagcuaucucgcuggagcaggccuagccuucaguuuaaucaaaaaugcacaaacgcccaggcgcggcacagggguuacuggagagacacuaggagaaaaguggaagaggcaacuaaauucgcuggaccguaaagaguucgaagaguacaaacgaagcggaauauuagagguugaccgaacagaagcaaaaagugcauuaaaagauggcucuaagauaaagcaagcagugucgagaggaacgagcaagauuagguggauuguggaaagagguaugguuaaaccgaaagggaaaguaguagacuuagguugugguagaggugguuggucauauuauauggccacacuuaagaaugucacagaagucaaaggauacaccaagggugggcccgggcaugaagaaccgauuccaauggcaaccuaugguuggaaucugguaaaauuacauucaaggguggaugucuuuuauaagccuacugagcaagucgacacauugcuaugcgacauaggcgaaucgucgaguaacccuacaaucgaagaaggaagaacacucagaguucucaaaaugguugaaccauggcuuucaucaaagccagaauuuuguaucaaaguucugaacccauacaugccgacugucauugaagaacuagaaaaacuucaaaggaaacaugguggcagccuagucaggugcccauuaucaagaaauuccacacacgaaauguacuggguuaguggagugucuggaaacaucguaucuaguguaaacacaacgucgaagaugcuauuaaaccgauuuaccacgaaacaucguaaaccuaccuacgaaaaagaugcugacuuaggugcaggaacaagaucuguauccaccgagacggaaaaaccagacaugacaauaaucggacgcagacuacaaaggcuucaggaggaacaccaagaaacuuggcauuaugaucaagagaauccauauaggacuugggcguaccauggggguuacgaagcuccaagcacaggaucagcaaguuccaugguaaauggaguaguaaaacuauuaacaaaaccaugggacgucauuccaaugguuacacaauuggcaaugacagauacuacaccauuuggucaacaacgaguauuuaaagaaaaaguagauacccggacaccccaacccaaaccugggaccagaaugguaaugaccacaacugcaaauuggcuaugggcucuacuugguaagaagaaaaacccuaggcucuguacucgcgaagaguucauuaguaaaguucgcaguaaugcagcaauuggagcgguaucacaagaagaacaaggauggaccucaucuuucgaagcaguaaacgacagcagguuuugggaauuaguagacaaagaaagagcacuccaccaagaaggaaaaugugagagcuguguguauaauaugauggguaaaagggagaagaaacuuggagaauuuggcagagcaaagggcucaagagccauuugguauauguggcuaggugccagauuucuagaguucgaggcauuaggcuucuuaaaugaggaccauugguucggcagggaaaauucauggucagggguugaaggugagggacuucauagacuaggauauauccuugaagacuuagacaaaagggaucgaucauuaguuuuugcagacgacacagcugggugggauacuaaaauuccggaggaugaucuauugaaagagaaaccaauucccgguccaauggcaccccaucaacgcauaccugccagagcaauuuucaaacugacauaccagaauaagguaguuaaagugcuacgauugaaauugaaaggagcuguaauggacauaauuagcagaaaagaacaaagaggaucaggacaggucggaacauauggacuuaacacauucacaaacauggaagugcaauuaauaagacaaauggaggcggaaggcgugauuacccgugacgacaugcacaauccgaagggauuaaaagaaagagucgaaaaaugguuaaaagaaugcgggguugaccgauuagaaaggauggcuauaaguggugaugauugugugguuaaacccuuagacgaaagauuuagcacgagucuacuuuuccucaacgauauggggaaaguaagaaaagacaucccccaaugggaaccuucuaaagguuggaaaaacuggcaggaaguaccauucugcagccaucacuuucacaagauuuucaugaaggauggaaggucauugguuguaccaugucgaaaccaagaugaguugauagggagggccagaauuagucaaggcgcuggauggagcuuacgagaaacugcuugcuuagggaaggcauaugcccaaauguggucccuaauguacuuucacagaagagaucucagacuugcgucuauggcuauauguagugcaguuccaacagaaugguuucccacuuccaggacaacuugguccauucaugcucaccaccaauggaugacaacagaagauaugcuuaagguauggaaccguguauggauagaggauaacccgaauaugacagacaagacacccguacacaguugggaagacauaccauaccuuggcaaacgagaagaucuauggugcggcuccuuaaucggacuuuccucuagagcaacuugggcaaagaacauacacacagcgauaacgcaagucagaaacuuaauugguaucgaaggauauguugauuacuuuuuguuaauaaagugguacucagcucccuucgaaucggaaggaguauuguag

SEQ ID NO: 23603 - RNA, 9867 nt, Artificial Sequence
  derived and/or modified CDS sequence (opt6) from DENV-4__KF955510__SS-prME
ucaacaauaacucuucuuugccugauuccaacuguaauggcuuuccauuuaucaacacgugacggagaacccuuaaugauagucgcaaaacaugaaagaggacgaccccuuuuauuuaaaacaacagaagguauuaacaaauguacauuaauagcaauggaucuaggugaaaugugugaagauacugucaccuacaaauguccucuuuuaguuaacacugaaccggaagauauugacuguugguguaaccuaaccucggcuugggucauguacggaacuuguacacaaucgggagaacgcagacgagagaaaagaucagucgcgcuuacgccacacucaggaaugggacuugaaacucgcaccgaaacauggaugucguccgaaggcgcauggaagcacgcacaaagagucgaaucauggauauuaagaaaacccggcuucgcacugagugccggauucauggcguacaugauaggacaaacugggauucaacgaaccguguucuucauauuaaugaugcuaguagcgccaaguuacggcaugagauguguuggaguaggaaauagagacuucguugaaggagugaguggaggugccuggguagacuugguacuagaacauggagguugcgugacaacuauggcacaagguaaaccgacguuagacuuugaauuaauaaagacaaccgcuaaagaaguagccuugcuacgaacuuauuguauagaagccucaauauccaauauaacuaccgcaacucgcuguccuacacaaggcgaaccuuaucuaaaggaagaacaggaucagcaauauauaugcaggagagacauggucgauagaggcuggggaaacggcuguggucuuuuugguaaaggagguguuguaacaugugcuaaguucucauguucgggaaagauaacagggaaucuaguucaaauagaaaaccuagaauauaccguugucgugacgguucacaacggagauacgcacgccguagguaaugacacuucaaaccacggugaaacagcaacaaucacgccacgaucaccaagcguugaaguucgauuaccugauuauggcgaacuaacucuggacugugaaccccgaucggguauugacuuuaaugagaugauauuaaugaaaaugaaaaccaaaacaugguuaguacauaaacaaugguuucuagaucucccacuaccauggacagcaggagcagacacaagcgaagugcauuggaaccauaaagagagaaugguuacuuuuaagguaccucacgcaaaaagacaagauguuacuguucuggguucccaagaaggagcaaugcauucggcacuagccggugcaacagaaguggauaguggggaugguaaucacauguuugcaggccaucuuaaaugcaagguccgaauggagaaacugcgaaucaaagguaugaguuacaccaugugcagcggaaaguuuucaauugacaaggaaauggccgaaacccaacacggaacgacaguuguaaaaguaaaauacgaaggaacuggagcaccaugcaaggugcccauagaaauacgugauguaaacaaagaaaaggucguaggccggauuaucaguaguacuccguuugcagaaaacacaaacagugucacaaauauagaacuugagcccccauucggugacagcuauauuguaauaggagccggagacucggcccuaacacuccauugguucagaaaaggaucuagcauugggaaaauguuugaaucaacuuacagaggagcuaagcgaauggcaauacugggcgaaacagccugggacuuuggaucgguagggggacucuuaacaagucuaggaaaagcaguacaucaaguauucgggucaguuuauaccacuauguucggaggaguauccuggauggugaggauucuaauuggacuauuaguguuauggaucggaacuaauucccgaaauaccagcauggcuaugaguuguauugugguugguggaauaacacuauuucugggguuuacaguacacgcagauaugggauguguaguguccuggucugguaaagagcucaaaugugggucugguauauucguaauugauaauguacauacguggacggagcaauauaaauuccagccagaauccccagccagauuagcuagcgcaauacuaaacgcccauaaagacgguguuuguggcauucguucaacgacgcgcuuggaaaauguaauguggaaacagauaacuaacgaacuaaacuauguccuaugggagggcggacacgaucuaacaguaguagcgggggauguuaaagguguccucucaaaggggaaaagggcguuagcaccaccugucaaugauuugaaauacuccuggaaaacauggggaaaagcgaaaauauucacgccagagacgcguaauucuacauuccugguagauggccccgacacgucagagugucccaaugaaagacgcgccuggaacuuucucgaaguugaggauuauggguuugguauguucacgacuaauauauggaugaaauuuagagaagggucuagugaagucugugaucacagauugaugagcgcagcaauaaaagaccagaaagcaguccaugcagacauggguuauuggauagaaucaagcaaaaaucaaacuuggcagauagaaaaggcuucucuaauugaaguuaaaacaugucucuggccgaaaacucauacgcuauggucaaauggaguucuugagagucaaaugcucauaccaaaagcauaugcaggaccaaucucccagcauaauuaccgacagggauacgcuacacaaacagugggaccuuggcaccuaggaaaauuagaaauagacuuuggugaguguccgggaacaaccgucacaauccaggaagacugugaucauagaggaccaucacucaggacaacaaccgcuagcgguaaauuaguaacgcagugguguuguagaucauguaccaugccgccucuaagguuccugggagaggauggaugcugguacgguauggagauucgaccccuaaacgaaaaagaagaaaauaugguaaagagccaaguaucggcagggcaagguacuuccgaaacauuuagcaugggauugcucugucuuacucuauucgucgaagaaugccucagacguagaguaacacgaaaacacaugauccuaguuguggucacgacacucugugcaauaauuuuaggaggacuaacguggauggacuugcuuagggcguuaauuaugcugggugacaccaugagugguaggauggguggucaaauacauuuagcuauaauggcuauguucaaaaugucaccuggauacguuuuaggaauauuuuugagaaaacuaacaucacgagaaacagcauuaaugguaauuggaauggcuaugacaacuguacuuucuauaccccaugaucuuauggaguucauugauggcauaucacuugguuuaauucuguuaaaaaugguaacucauuucgauaauacacagguaggcacacuagcccucaguuugacauuuaucaagagcacaaugccgcugguaauggcauggaggacaauuauggcugugcuauucguaguaacguuaauaccacuauguaggaccucuuguuugcagaaacaaagucacugggucgaaauuacagccuuaauacugggcgcgcaagccuugccaguauauuuaaugacacuaaugaagggagcaagcaagcgcucauggcccuuaaaugagggcauaauggcaguugggcuugucaguuuacuuggcagcgcauuacugaaaaacgauguaccauuagccgggccaaugguggcuggagggcuauuacuagccgcuuacguaaugucuggcucuagugcagaccuaucauuggaaaaagcagcaaauguccaaugggaugaaauggccgauaucacagguuccucaccaauaaucgaaguuaaacaagaugaagauggcaguuucaguauaagagacguagaggagaccaauaugauaacucuccuaguaaaguuagcacuaauaacuguuaguggacuguauccgcucgcgauacccguaacaaugacauuaugguauauguggcaagugaaaacucagagaucaggugcauuaugggacgucccuagcccugcagcggcucaaaaagcgacacuaacagaaggugcauaccggauuaugcagagagguuuauuuggaaaaacacaaguaggaguggguauucauauggaaggaguuuuccauacaauguggcacgucacgagaggaaguguuauuugucaugaaucaggacgacuagaacccucgugggcugauguacggaaugacaugauuucuuacggaggagguuggaggcuuggagauaagugggacaaagaagaagacguucagguacuugcuauagaaccaggaaagaauccuaaacaugugcaaacgaaaccaggucuguuuaagacccugacgggagaaauuggugcgguaacucuggacuuuaagcccgggacgagcgggucaccaauuaucaauaggaaggggaagguuauaggauuguacggaaacggaguaguaacaaaaucaggggauuauguaucagccauaacacaagcagagcgaauuggagaacccgacuaugaagucgacgaagauauuuucagaaagaaacgauuaaccauaauggaucugcaucccggugcagggaaaacgaaaagaauauuaccgucuauagugagagaagcauuaaaacgaaggcugagaacauuaauuuuggcuccgaccagggucguugcagcagaaauggaggaagcucuaagaggacuuccaauacguuaucaaaccccugcaguaaaaucagagcacaccgggagagaaauaguggaucuaaugugccacgcaacauucacuacuagacuguugucaucaaccaggguuccaaauuacaaucuaauuguuauggaugaagcccauuuuacggacccuucuuccguggcagcaaggggauauauuagcacucggguagaaaugggagaggcugcagcgauuuuuaugaccgcaacaccaccagguaccacagauccauucccgcaaucaaacucuccgaucgaagacauagaacgagaaauacccgaacggucauggaauaccggauucgauuggauuacggacuaccaagggaagaccgucugguucguaccauccauuaaagcuggaaaugacaucgcaaauuguuuacggaagaguggcaagaaagugauucaacucaguagaaaaacauucgauacagaauauccaaaaacaaaacuuacggacugggacuucguugucaccacagacauuucugaaaugggagcuaauuuuagggcaggacguguuauagauccacgaagauguuuaaaacccguuaucuuaaccgauggaccagagcgugugauauuagcggggccgauaccgguaacuccugcuucugcagcacaaagacguggacgaauuggucguaauccagcacaggaagacgaucaauauguuuucucuggcgauccacuaaggaaugaugaggaucacgcacauuggacagaggcaaaaaugcuauuggacaacaucuacacaccugagggaauuauaccuacccuuuuuggacccgaaagggagaaaacucaagcaauagauggggaguuccgauuaaggggugagcaaagaaaaaccuuuguagaauugaugcgacgaggugaucuaccaguauggcuaucauacaaaguagcaucggcuggaauauccuacaaggacagagaguggugcuuuaccggugaacgaaauaaucagauacuugaagaaaauauggagguagaaauuuggacaagagaaggcgagaaaaagaaacugagaccgaaauggcuagaugcgagaguuuacgcggacccuauggcacugaaagauuuuaaagaguuugcgucagguaggaaaagcauuacacucgauauacuaacugaaaucgcuucgcuuccuacauaccuaagcucgcgagcaaaacuagcccuggacaacauaguuauguuacacaccacugagagaggugggaaggcuuaccaacacgcgcuaaacgagcugccagaaucccuggaaacucucaugcuaguagcccuacuuggagcaaugacagcagguauauucuuguucuucaugcaaggcaagggaaugggcaaacuaaguauggggcuuaucgcaauagcagucgcuucaggucuacuaugggucgccgaaauucaaccacaauggauugcggcaucaauuauauuagaguucuucuuaaugguccuauugguuccggaaccugagaaacagcgaaccccucaagacaaccaguugauauacguaauucuuacuauacuuacuauaaucgcccuagucgcagcaaacgaaaugggccuaauagagaaaacaaaaacugauuucgguuucuaucaagccaaaacugaaacgacaauucuugacgucgauuuacgaccugcuagugcuuggacguuauaugcaguagcgacgaccauucuuacaccgauguuaagacacacaauagagaacacuucugcuaaccuaagucuagcagcuaucgcaaaucaagcagcuguauuaaugggccuaggaaaggguuggccacugcaucgaauggacuuagggguuccacuguuggcaaugggauguuauagucagguaaauccuaccacccugacagcgagucucguuaugcuccugguacacuaugcuauaaucggcccuggauuacaagcuaaagcaacgcgggaagcacaaaagagaacagccgccggcauuaugaagaaucccaccguugacggaauaacaguuauugaucucgaacccauuaguuaugacccgaaguucgaaaaacaacucggucaaguaaugcuacucguacuaugugcgggacaauuacuuuugaugagaacaacaugggcguuuugugaaguauuaacgcuugccacagguccaauuuugacacuaugggaggguaaucccggacgauuuuggaacacgacaauagcaguaucuaccgccaauaucuuuagagggaguuaccuugcaggagcagguuuagcguuuagucuaaucaaaaacgcacagacaccacgaaggggaacggguacuacuggugagacccuaggcgagaaguggaaaagacagcuaaauagcuuagauagaaaaggauucgaagaauauaaacguagugguauuuuagaaguugaucgaaccgaagccaagagcgcauuaaaagaugguagcaaaauuaaauaugcugucucacgaggaacaucaaagauaagauggauaguagaaagagguaugguuaaacccaaggguaaaguggucgaccuaggauguggaagaggcggauggagcuauuauauggcaacacuuaaaaaugucacugaagucaaagguuacacaaagggcgggcccggacacgaggaaccaauaccgauggccacauacggauggaauuuaguaaagcugcacucaggagucgacguauucuauaaaccaacagaacaaguggauacucuguuaugugauaucggugagucaaguuccaaucccaccauugaagaaggcaggacucuucggguucugaagaugguagaaccaugguugucuaguaaaccagaguucuguauuaagguacuuaacccauauaugccgacugucauagaggaacuagaaaaacugcaaagaaaacacggaggaagccuaguacgauguccauuaucucgaaauucaacccacgaaauguacugggugaguggaguaaguggaaacaucguaaguucgguaaacacaacaaguaaaauguuauuaaacagauucacaacaaggcacagaaagccaacguacgaaaaagaugcggauuuaggcgcagggaccagaucaguaucaacagaaacagaaaaaccugauaugacaauaauaggacggagacuucaacgguugcaggaagaacacaaggagacauggcacuacgaucaugaaaauccauaucggacaugggcguaucaugguaguuaugaagcgcccucaacuggguccgcuucuucaaugguaaauggaguuguuaagcucuugacaaaaccgugggauguuguaccuauggucacgcaacucgcaaugacggacacaacacccuuuggacagcagagaguauucaaagaaaagguggacacacgaacuccacaaccaaagccuggaacgcgaguuguaaugacgacaacggcuaacugguugugggcccuacuugguaggaagaaaaauccucguuuguguaccagagaagaguuuauuaguaaaguaagaucuaacgccgcgauaggagcgguauuucaagaagaacaaggauggaccagcgcaagugaagcuguaaacgauucccgguuuugggaacugguugacaaagaaagagcguuacaucaagaagguaagugcgaaucauguguauauaauaugauggggaaacgcgagaagaaacuaggugaauuugguagagccaaaggaucaagagccauaugguauaugugguugggugcaagauuucuugaguuugaagcacuuggauuccugaacgaagaccauugguuuggucgugaaaacucuuggucagggguagaaggagaaggauugcaccgccugggauacauacuggaagacaucgauaagaaagacggcgacuugauuuaugcugacgacacagcgggaugggacacuagaauaacugaagacgaucuacuaaacgaagaauuaauaacugaacaaauggcgccucaccacaaaauauuagccaaagcaauauucaaacuaacauaucaaaauaaaguaguaaaagugcuuagaccaacaccaaaaggagcaguaauggauauaauuagucggaaggaucaaagagggucgggacaagucggaacauauggacuuaacacauuuacuaauauggaaguacaauugauuaggcaaauggaggcagaaggagucauuacaagggaugauaugcauaauccuaaaggucuuaaggagcgaguagaaaaauggcucaaagagugugguguagaucgucuaaaacgcauggcaaucuccggagaugauuguguugugaaaccucuggaugagagauuuagcacaagucuacuguuccuaaacgauauggguaaaguacgcaaggauauuccccaaugggaacccucuaagggauggaaaaauuggcaagaaguuccauuuuguucucaccauuuucacaaaauuuuuaugaaagauggacggagccuaguaguacccugucgaaaucaggacgaauuaauaggccgagcgagaauaucgcaaggagcgggcuggucccuccgagaaaccgccugccuaggaaaggccuacgcccaaauguggucccucauguauuuucaucguagagauuugcguuuagcuucgauggcaauaugcucggcggucccaacugagugguuuccuacaucccgaacaaccugguccauccacgcacaccaucaauggaugacgacugaagacaugcuaaaagucuggaacaggguguggauugaagauaaucccaauaugauugauaaaacaccaguucacucuugggaggauauucccuaucuaggcaagcgagaagaucugugguguggaaguuuaauaggauuauccucaagagcuacuugggccaaaaacauacauacggcaauuacucaaguccgcaaccucaucgggaaagaagaguacguagauuauaugcccgugaugaaacguuauagcgcacacuuugaaucagaagguguacuauga

SEQ ID NO: 23604 - RNA, 9867 nt, Artificial Sequence
  derived and/or modified CDS sequence (opt6) from DENV-4__GQ868594__SS-prME
agcaccaugacucuauuauguuugauuccgacugucauggcguuucaucuuaguacucgagauggugaaccauugaugauaguugcgaaacaugaacgagggcgaccuuuacuauucaaaacaaccgaaggaauuaauaaauguacuuuaauugcaauggauuugggagaaaugugugaagauaccgucacuuacgaauguccacuucuagugaauacugaaccggaagauauugauuguugguguaauuugacaagugcuuggguaauguauggaacuugcacacagucaggagaacggaggagagagaaaagaaguguugcacucacuccccacaguggaaugggguuagaaaccagagcugaaacuuggaugaguucugaaggugcguggaaacacgcacagaggguagagucauggauacugcggaauccgggcuucgcacuacuugcuggauucauggcguacaugauuggccaaacggguauacaacgaacuguauucuuuguauuaaugauguugguagcuccaagcuaugggaugcgaugcguaggugucgggaacagggauuuuguugaaggggucucagguggagcuuggguugaccuagugcuugaacacggagguugugucacgacgauggcacaagguaaaccuacuuuagauuucgaauugauuaaaaccacugcaaaagaaguugcacugcuaagaaccuacuguauagaagcaaguauaaguaauauuaccacagcaacacgaugcccaacucagggugaaccauaucugaaagaagaacaagaucaacaauacauaugccgcagggauguaguugauagggguuggggcaauggcuguggauuauuugguaaaggaggaguaguaacuugcgcgaaauuuaguuguucaggaaaaauaacagguaaucuaguacaaaucgaaaaccuagaguauaccgugguuguuacaguacauaauggagauacgcaugcaguugguaaugauauacccaaucacggaguuacagcgaccaucacaccucguucaccgucaguagaaguaaaacugccggauuauggagaacucacacucgauugugaaccuagaucaggaauagacuucaaugaaaugauucuuaugaaaaugaagaagaaaacuuggcucguucacaaacaaugguuucucgaccuaccucugccuugggcggcuggcgcagauacaucagaaguacauuggaauuauaaagaacgaauggugaccuuuaaagugccacacgcgaaacgacaagacgugauaguacuagguucgcaagaaggagcuaugcauagcgccuuaaccggagcaacagaaguugauagcggagacggaaaucacauguucgccggccacuuaaaauguaaaguacgaauggagaaauuacguauaaaaggaauguccuauaccaugugcucuggcaaauucagcauugauaaagaaauggcggaaacacaacauggaacgaccguugugaagguaaaauaugaaggcgcuggcgcaccguguaaaguaccgaucgaaaucagagaugugaacaaagaaaaaguaguagggagaauaauaucaucgacuccauuugcugaguacaccaauaguguuacuaauauugaacuagaaccaccauuuggagauaguuacauaguaauaggcgucggugauuccgcacucaccuuacauugguuuagaaaaggcucgaguauuggcaaaaugcuggaaagcacguaccgaggugcuaaaaggauggcaauccuaggagaaacggcaugggacuuuggaucaguugguggccugcuaaccagucucggaaaagcuguacaucaagucuuuggauccguguacacuacgauguuuggaggugucaguuggauggucagaauacucauaggauuuuuaguacuguggauugggacgaauagccgcaauacaucuauggcaaugacaugcauagcuguaggagguauaacucuauuuuuaggauucacggugcaugcagacacuggcugcgcaguuaguuggaguggaaaagaauuaaaaugcgggagcgggauauuuguaauagacaauguacacacauggacggagcaauauaaauuucagccugaaagcccagccagacuugcuagugcaauauugaacgcacauaaagaugguguaugcggcaucagaucgacaaccagauuagaaaacauaauguggaaacaaauaacgaacgaauugaauuacguacuaugggaaggcggacacgaucuuacaguuguggccggugacguaaaagguguccuaucaaaggguaaacgcgcuuuagcacccccaguuaacgacuuaaaguacaguuggaagacuuggggaaaagcuaaaaucuuuacucccgaagccaaaaauucuacauuccugauugaugggccugauacaagugaguguccaaacgagaggcgugcuuggaauuuccuugaaguagaagacuacggcuucggcauguuuacaacuaacauauggaugaaauucagagaagggaguuccgaaguaugugaccaccgguugaugagcgcggcaauaaaagaucaaaaggccguccacgccgauauggguuauuggaucgagagcagcaaaaaccaaacauggcagauagagaaggcaucgcuaauagaagugaaaacauguuuauggccgaaaacucacacguuauggaguaaugggguacuagagucacaaaugcucauuccaaaggcuuacgcgggaccauuuucacaacacaauuacagacaagguuaugccacacaaacgguagggccguggcacuuaggcaaacucgaaauugacuuuggggaaugcccaggaacgacggugacgauccaagaagacugcgaccacagagggcccucuuugagaacaacaacggcaucagguaagcuggucacacagugguguuguagaagcuguaccaugccaccauuaagauuccuaggagaagacggaugcugguacggcauggaaauuaggccucuaagugaaaaagaagaaaauaugguaaagagccagguaucugccgggcaaggaaccagcgaaacauuuucaaugggguugcuuugcuuaacuuuauucguugaagaaugucuacgcaggagagugacuaggaagcauaugauacuugugguaguaacuaccuugugcgcaaucauacuaggugguuuaacauggauggaucuacuacgagcauugaucauguugggggacacaaugaguggaagaaugggaggacaaauucauuuagccauaauggcaguauuuaaaaugaguccggguuauguauugggaauauuccuacgaaaacuuacgucaagggaaacggcauugauggucauagguauggcuaugaccaccguauuaucaauuccucaugaucugauggaauuuauagacgguaucagcuuaggauuaauauuguuaaaaauggucacgcacuucgacaauacucaaguugguacccuugcccucagcuuaacuuuuaucagaaguacuaugccauuggugauggcguggcggacuauaauggcagugcuguucgucgugacacuuauuccauuauguaggacaaguuguuuacaaaagcaaucacauuggguggaaauaacugcccuuauauugggagcacaggcucuacccguauauuuaaugacauuaaugaagggagcgucuaagagaucguggccauuaaaugagggaauaauggcaguaggauuaguaagccugcuaggaucggccuugcuuaagaaugaugugccucuagcuggcccaaugguagcaggaggcuuauuacucgcugcauaugucaugucaggguccucggcagaucucucgcuagaaaaagcugcgaauguacaaugggaugaaauggcugacauaacugggucaucgccuauuaucgaggugaagcaagaugaagacgguuccuucucgauccgcgauauagaagaaacaaauaugauuacauuauuaguaaaauuggcacuaauaacaguuucgggacuauauccacuugcuauuccuguaacuaugacauuaugguauauguggcaaguuaaaacacagagaucaggagcacugugggauguuccuaguccagcggcagcacaaaaagcaacacugacagaggguguuuauagaauaaugcaaagagggcuauucgguaagacacagguugggguagguauacauauggagggaguauuccauacaauguggcaugugacacguggaucgguaauaugccacgaaacaggaagauuggagccaucaugggcugauguacgaaaugacaugaucuccuaugggggugguuggagauugggcgauaaaugggacaaagaggaagauguucagguguuggccauugaaccuggcaaaaauccaaagcaugugcaaacaaagccuggucucuuuaagacccuaacuggcgaaauaggugcugucacauuagauuucaagccuggaaccaguggaucacccauuauuaaucgcaaagguaaaguuauaggguuauauggaaauggugugguaacuaaaucuggggacuauguuagugcaauaacacaagcagagcgcacuggggaaccugauuaugaaguagacgaagauauuuuccgcaagaaaagacucacuauuauggauuuacauccgggagcggggaaaacaaagcgaauccugccauccauaguaagagaagcacuaaaaaggagacuaaggacacuuauauuagcaccgacgagaguagucgccgcagaaauggaagaggcgcuaagagguuugccaaucagauaucagacuccggcaguuaaaucggaacauaccgguagagaaaucguugauuuaaugugccaugccacguuuaccaccagacuauugagcaguacuagaguaccaaauuauaaccuuaucguuauggacgaagcucauuucacagauccaucaucuguggccgcacguggguacauuucaacccgcguagaaaugggagaagcugcagccauuuuuaugacggcgacuccgcccggagcuacagauccauuuccccaaaguaacucaccgauagaagauauagaaagagaaaucccagaaagaucuuggaauacgggauuugauuggauuacagauuaccagggcaaaacaguaugguucguaccgaguauaaaagccgguaaugacauugcaaauugucuuaggaaaagugggaagaaaguaauucagcuaucucguaagacauuugauacagaguauccgaaaacaaaauuaacagacugggauuucguugucacaacggauaucagugaaaugggcgcuaacuuuagagcaggaagaguaauugauccuaggagaugccucaagccaguuauuuccacagauggcccagagcgcgucauccuagcugguccaauacccguaacuccagcaagcgccgcccaacguagggguaggauuggacgaaacccagcucaagaagacgaucaguauguauucagcggugauccacuaaagaacgacgaagaccaugcacacuggacagaagcaaaaaugcuccuggauaacaucuacacaccggaagguaucaucccuacacuuuucgguccugaacgcgagaaaaaccaggcuauagauggagaguuuaggcuacgaggugaacagagaaagacauuuguugaacuaaugagacgaggugaucucccugugugguugucauacaaaguugcuucagcuggaauuuccuacaaagauagagaguggugcuucacuggagaacguaauaaucaaauuuuagaggaaaauauggaagucgagauauggacaagagaaggagagaaaaagaaacuaaggccuaaauggcuagaugcaagaguauacgcagauccuauggcucuaaaagauuucaaagaauuugcaucuggaagaaagagcaucacauuggacauccucacagagaucgcauccuugccaacguaccuaucgucaagagcgaaauuagcacuagacaacaucguuaugcuucacaccaccgagcgaggcggaaaagccuaucaacacgcguuaaacgagcuuccugaaagccuagaaacgcuaaugcugguugcgcuccuuggcgcgaugacagcaggaauauuucuauuuuucaugcaaggaaaagguauuggcaaacuaucuaugggccuaauagccauagccguugcaaguggauuacuuugggucgcagaaauucaaccacaguggauagcugcgucaauaauuuuagaguucuuuuugaugguuuuacuaauaccagagccagagaaacaaagaacaccucaagacaaucaacuaauauacgucauacuuacuauacuaacgaucauuggguuaaucgcugcuaacgagaugggguugauugagaagacaaaaacagacuucggcuucuaucaagucaaaacugaaacaacaauauuagacgucgauuuacgacccgcuagugcguggacgcuauacgcaguagcgacuaccauucugacaccgauguugagacauacuaucgaaaauacaucagccaauuuaaguuuggcggcuauagcgaaucaagcagccguccuuaugggucugggaaaaggauggccccuucaccgaauggaccucggugugccauugcucgcaaugggguguuacucucaagugaacccuaccacccuaauugcgucuuuggucaugcuccuaguccacuaugccaucauuggaccgggacuacaggccaaagcuacacgagaagcucagaagagaacggcugcugguauuaugaaaaauccaacgguagauggaauuaccgucauugacuuggaaccuauaucauaugacccaaaauuugaaaaacaguugggucaagugaugcuacugguacuaugugcaggucaacuguugcugaugcgcacaacgugggcuuuuugugaaguacuaacguuagcuaccggcccaguacugacgcuaugggaggguaauccaggacguuucuggaauacuacgauagcaguaaguaccgcaaauauauuuaggggaagcuauuuggcaggcgcaggccuagccuuuucauugaucaaaaacgcucaaacaccacggagagggaccggaacuacgggggaaacccuuggugagaaguggaaaaggcaauuaaacuccuuagauagaaaagaauuugaagaguauaaacgguccgggauacucgaaguugauaggacugaagcaaagucagcgcuaaaggauggauccaaaaucaaacacgcuguaucccgagguaguagcaaaauuagguggauuguagagagagguaugguaaaacccaaaggaaagguaguggauuuaggcugugggagaggaggguggucauauuauauggcaacauugaagaaugugacagaaguuaaaggauauacuaaaggcggaccaggacaugaagaaccaaucccaauggcaacauacggcuggaaucuagucaaauuacauucgggcguggauguauucuacaaaccgacagagcaagucgauacccuacuuugcgacauuggugaaagcaguucgaaucccacaauagaagagggacggacacuacguguccuaaaaaugguagaaccauggcuaucguccaagccugaauuuugcauuaaaguccuaaaccccuauaugccgacugugauugaagaauuggagaaacuacaacggaaacacggcgguagcuuaguucgauguccguuaucgagaaauuccacucaugaaauguacuggguaucuggugugagcgguaauauaguaaguucggugaacacuacgucaaaaaugcuacugaauagauucacgacaagacaucgaaaaccaacauacgaaaaagauguugauuuaggugcuggaacccgcucggugucaacugaaacagaaaaaccagauaugacaauaauuggacggagacuucaaagacuacaagaagaacauaaagagacuuggcauuaugaccaagagaacccuuauagaaccugggcauaccacggcucuuaugaagcaccuaguacuggaucugcuucuucaauggucaacggaguaguaaaacuucucaccaaaccgugggauguaaucccuaugguaacacaacuggcaaugacagacacuacaccuuuuggucaacaacggguauuuaaagaaaagguagauacaagaaccccacaaccaaaaccuggaacgcgaauggugaugacgacaaccgcaaauuggcuaugggcacuguuagguaagaagaaaaacccuagacuauguaccagggaagaauuuauuaguaaaguuagguccaacgcggccaucggagcaguauuucaagaagaacaaggguggaccagcgccuccgaagcgguaaaugauuccagguuuugggaguuagucgacaaagaaagggcccuucaucaagaaggcaagugcgagucauguguauauaacaugaugggaaaaagggagaagaaauuaggagaauuugguagagccaaaggaucaagagccauaugguauaugugguuaggagcgagauuuuuagaguuugaagcauuagguuuucuaaacgaagaccacugguucggccgugaaaauucuuggagcggcguugaaggagaaggucugcauagauuaggauauauuuuagaggacauagacaagaaagacggcgaucugauuuaugcugaugacacagcgggcugggacacaagaauuacugaagaugaccugcuaaacgaagaauugauaaccgaacaaauggcgccacaccacaaaauccucgcgaaagcgauauuuaaauuaacauaucaaaauaaaguagucaagguauuaagaccaacaccgaaaggugccgucauggacaucauauccagaaaagaccagagaggaucgggacaaguggggacauauggccucaauacuuuuacaaauauggagguacagcugauacgacaaauggaagcagaaggaguuaucacgcaagaugauaugcauaauccaaaaggucuuaaagagaggguagaaaaauggcucaaagaauguggcguggauaggcuuaaaagaauggcgauaaguggcgacgauugcguugucaaaccgcuggaugaacgauuuaguacgucauuacucuuccucaaugauauggggaaaguuagaaaagauauuccccaaugggaacccucaaaaggauggaaaaauuggcaagaaguaccauucugcucacaccauuuccauaaaaucuuuaugaaagacggccguucucuugugguucccuguagaaaucaagaugaauugauagguagagcgaggauaucgcaaggugcuggauggagccuuagggagacugcguguuugggcaaagcauaugcacaaauguggucauugauguacuuucaucgccgagauuuaagauuggccucuauggcgauauguucagcagucccuacagagugguuuccaaccucacgcacaacauggucuauucaugcgcaccaucaauggaugacaacagaggauauguuaaaagucuggaacagaguauggauagaagauaauccaaacaugaccgacaaaacaccuguacacucaugggaagacauaccauacuuaggaaaaagggaagaucuuuggugcgguucgcuuauugguuugaguucgagagcaacuugggcuaaaaauauucauacagcaauaacacaagugaggaaucugauagguaaagaagaguauguagacuauaugccaguaaugaaacgauauucagcaccauuugagucagaagguguucuuuaa

SEQ ID NO: 23605 - RNA, 9867 nt, Artificial Sequence
  derived and/or modified CDS sequence (opt6) from DENV-4__FJ024424__SS-prME
ucuacuauuacucuccucugccuuauaccaacuguaauggcuuuucaucuuucgaccagagacggagaaccucugaugauugucgcuaaacaugaacguggacgaccacuguuguucaaaaccacagaagggauuaacaaaugcacauuaauugcaauggaccuuggggaaaugugugaagacaccguaacauacaaaugcccacucuuaguuaauacagaaccugaagauaucgacuguugguguaaccugacaaguacauggguuauguauggaacuugcacccaaagcggggagcgaagacgugaaaaacguagugucgcuuugacaccacauaguggaaugggauuggaaacgagagcagagacuuggauguccucggaaggagccuggaaacaugcacagcggguugaaucauggauucuuagaaaccccgguuucgcucuacuggccggguucauggcauauaugauaggacaaacuggaauacaaagaacagucuucuucgucuugaugauguuagucgcuccaagcuacgguaugcgaugcguuggaguaggaaaccgagauuuuguggaaggggugagcggcggggcauggguagauuuaguuuuagagcauggcggaugcguaacaacuauggcgcaagguaaaccaacauuagauuucgaacuaacaaaaacuacugccaaagaaguggcauuauuacgcacuuauugcauugaagccaguaucucgaauauuacuacggcgacccgcugcccuacacaaggugaaccuuaccuuaaagaagaacaagaccaacaguauauuuguaggcgagaugugguagauagagguuggggaaacggauguggauuauucggaaaaggagggguagugacaugugcaaaauuuaguugcucaggcaaaaucacagggaaccucguccaaauagagaauuuagaguacacugucguugucacaguacacaacggugauacucaugccguaggaaaugacacgucgaaucaugguguuacuacuaccauaacuccucgaucaccaaguguagaaguuaaacuaccugacuauggagaacucaccuuagacugugagccuagaaguggcauagauuuuaacgaaaugauccuaaugaaaaugaagaagaaaaccuggcuaguucauaaacaaugguuucuagauuuaccguuaccauggaccgcuggagcugacacaagugagguacauuggaacuacaaagagcguaugguuacuuucaagguuccgcaugccaaaaggcaagacguaacuguucucgguucccaagaaggugcaaugcauucggcacuagcuggagcgacagagguagauucaggugacggaaaucacauguuugcaggccaucugaaauguaaaguaagaauggaaaaguuaagaaucaaagguaugucauauaccauguguagcgggaaauuuaguauugacaaggaaauggcugaaacccagcacggaacuacuguugugaaaguuaaauacgaaggagcaggagcuccauguaagguuccuauagagauucgcgacguuaauaaagaaaaagucgucgggagagugauuagcucuacaccacuagcagagaacacuaauucgguuacaaauauagaacuagagccacccuuuggcgauucauauaucguaauaggaguaggaaauagugcgcuuaccuuacacugguuucgcaaggguuccagcauugggaaaauguucgagagcaccuacaggggugcuaaaaggauggcuauccuaggagaaacggccugggauuuugguucuguuggaggauuauuuacaucuuuagguaaagcuguucaucaagucuuuggaucaguauauacgacuauguuuggaggaguaaguuggaugauuagaauauuaauuggauuucucguacuauggauagguacaaacucucgaaauacaucaauggcaaugacaugcauagccguagggggaauuacacucuuccugggguuuaccguucaagccgauaugggaugcguuguuucguggucagguaaagaguuaaagugugggucuggcauauucguaguugacaauguucauaccuggaccgaacaauauaaauuucaaccagaaaguccagcaagacucgcaucagcgauauuaaaugcacacaaggaugguguuugugguauacguaguaccaccagauuagagaacgugauguggaagcaaauaacaaacgaacugaauuauguacucugggagggaggccaugauuuaacugugguugcgggcgauguaaaagguguauugacuaaagguaaaagagccuuaacuccaccagucucagaccuaaaauacuccuggaagacaugggguaaggccaaaaucuuuacaccagaggcuaggaacucgaccuuuuuaauugacgguccggacacaucugaaugccccaaugagcggcgggcuuggaacucacuagagguagaggacuacggcuuuggaauguucacaaccaauauauggaugaaguucagagaggguucuucugaagugugcgaucacagauuaaugucugcagcaaucaaagaccaaaaagcuguucacgcugacaugggcuauuggauagaaucaagcaagaaucaaaccuggcaaauagaaaaagcaucacuuauagaagugaaaacuugcuuguggccgaaaacacacacucuuuggucaaacggcguauuagaaucucaaaugcuuauuccaaaaagcuacgcaggacccuuuucgcaacacaauuacagacaaggcuaugcaacacaaacaguaggaccauggcaccucggcaaacuagagauagacuucggagaaugcccagggaccacagucacaauucaggaagacugcgaucauagagguccaucccuacguacaacuaccgcaucaggcaaauuggugacacaauggugcuguagaucguguacaaugccgccauuaagauuccuaggagaagacgggugcugguacggaauggaaauccggccauuaagugaaaaggaagaaaauaugguuaaaucgcaaguagcagcuggacaagguacaagugaaaccuuuucuaugggcuuguuaugccugacucuuuucgucgaagaaugucuucgcagacgcguaacuaggaaacacaugauucuugccguaguaauaacacucugugcuauaauucuuggaggucucacauggauggaccuacuuagagcucugauuauguugggcgacacaaugagcggacgaaucggcggucaaacucaucucgccauaauggcagucuuuaaaaugucucccggauauguucuaggaguguuuuuacgcaaauuaacuuccagagagacugcgcuaauggucauugguauggcuaugacgacaacccucaguaucccgcaugaucuuauggagcugauagaugggauaucccuuggccucauacuguuaaaaauaguaacccaauucgauaacacacaaguuggaacauuagcacugagucuaacauucauuaggucaaccaugagucuaguuauggccuggagaacuaucauggcaguucucuuugucgugacgcuaauaccauuauguaggacuagcugucuucaaaaacagagccauuggguagaaauaaccgcccuuauccugggugcgcaagcacuucccguuuaccucaugacccucaugaaaggcgcaucgagaagauccuggccacuaaaugaggguaucauggcuguaggucuagucaguuuacugggaucagcucuauugaaaaaugaugugccgcuagcuggaccuaugguugcagggggacuacuacucgcggccuauguaauguccggaagcucagcagaucugucuuuagaaaaagcugccaauguacagugggaugaaauggcagauaucaccggaagcagccccaucauagaggucaaacaagacgaagacggaucauuuagcauacgugauguugaagaaacuaauaugauuacauuacucguuaaguuggcucuaauaaccguuaguggucucuauccucucgccauuccagugacgaugacauuaugguacauguggcaagucaaaacucaacgaucaggagcccuuugggacguuccaagucccgcugcuacacagaaagcagcacuauccgaggguguuuauagaauaaugcaaaggggacucuuugggaaaacgcaaguaggaguagguauccauauggaaggugucuuccauaccauguggcauguuacccguggcaguguaauaugucaugagaccggacgacuagaaccgagcugggcugauguaagaaaugauaugauaucuuauggaggggguuggagauugggugauaagugggauaaagaagaagacguacaagucuuagcaauagaacccgggaaaaauccaaaacauguacaaacaaagccuggauuauucaagacuuuaaccggagaaauuggagcaguaacguuagauuuuaaacccgguacuucaggcucgccuauuaucaauagaaaagguaagguuauaggacucuacggaaaugggguuguuacaaagucaggugacuacgucucugcaauaacucaagccgagagaauaggugaaccagacuaugaaguagaugaggacauuuucagaaagaaacgucuaacuauuauggaccuacauccuggugcuggcaagacaaaaaggaucuuaccgagcauagugagagaggcauugaaaagacgucuaagaacccugauacuugcaccaacaagaguggucgccgcagagauggaagaagcgcucaggggauugcccauaagguaucaaacuccagccguuaaaagcgaacauaccggacgcgagauaguagauuuaaugugccaugcuacauucacaacucgacugcucucaagcaccaggguuccaaacuacaauuuaauuguuauggacgaagcacauuuuacggauccgucgaguguugccgcgcgaggauauauuaguaccagaguagaaaugggcgaagcagcggcgauuuuuaugaccgcaaccccaccgggagcuacagauccauuuccucaaucgaacucacccauugaagacauagagcgagaaauucccgaaagaucauggaauacaggauucgauuggauaaccgacuaccaaggcaaaacaguaugguucgucccuucaauuaaggcagguaacgauauagccaacuguuuaagaaaaucagguaagaaagucauucaauuaagucguaagacauucgacacugaauauccuaaaaccaaacuuacugacugggauuucgugguuacgacagauauaucugaaaugggugcaaauuucagagcagguagaguaauagacccucgacgauguuuaaagccaguaauacucacggaugguccagaacgggugauucuagcaggaccaauuccaguaaccccagcaucugcagcccaaagaagagggaggauaggccguaacccuacacaggaagaugaucaauauguuuucagcggggauccauuaaagaaugacgaagaucacgcccacuggacugaagcuaaaaugcuauuggauaacauuuauacacccgaaggaaucauacccaccuuguucggaccagaacgagagaaaacacaagcaauugauggugaauuuaggcugcgaggugagcagagaaaaacauuuguugaacuaaugagaagaggugaccuuccaguaugguugaguuacaagguugccucggcggggauaucauauaaagaccgagaaugguguuuuacaggcgaacgcaacaaucagauucuagaagaaaauauggaaguugaaaucuggacacgagaaggugagaaaaagaaacuaagaccaagauggcuagacgcucgcguuuaugcagaucccauggcacuuaaagacuucaaagaguucgcaagcgggagaaaaucaauaacacuagauauuuugacagaaauagcaucacuaccuacuuauuuaaguagucgagcgaaacuagcgcuagacaauauagucauguuacacacgacagaaagaggagguagagcauaucaacaugcucuaaaugaauuacccgagaguuuggaaacacuaaugcuuguugcauuacuuggagcgaugacagccggcauauuuuuauucuucaugcaaggaaaaggcauaggcaaacuaucuauggguuuaauuacaauugccguugcauccggacugcuuugggucgcagagauacaaccgcaguggaucgcugcaucaaucauucuagaguucuuucuaaugguacuacucauuccugaaccugaaaaacaaaggaccccacaagacaaccaacuaauauacguaauucuuacuauucugacuauaauuggccuuauugcagccaaugaaaugggguuaauugagaaaacgaaaacagacuucgguuuuuaucaaguaaagacagaaacaaccauauuggacguggaucuaagaccagcaagugccuggacauuauacgccguagcuacaacgauucuaaccccgauguuaaggcacacuaucgaaaauaccagcgcaaaccucucucuagcugcuauugcaaaucaagcggcugucuuaaugggacuaggcaaaggcuggccuuuacacagaauggaucuaggaguaccccuacuugcgauggguuguuauucacaaguaaauccaaccacacuaacagcuucucuuguaaugcugcuagugcauuacgcuauaauaggaccgggacuacaggcaaaagcgacuagggaggcacagaaaagaacugccgcaggaauaaugaaaaacccaacaguagaugggauaacuguuauagaucuagaaccgaucucauaugauccaaaauuugagaagcaacuaggacaggugaugcuucucguuuuaugugccgggcaguugcucuugaugaggacgacuugggcuuuuugugaaguguuaacacucgcaacaggaccgauacucacguugugggaaggaaacccugggcguuucuggaauacgacaauagcuguaucgacugcaaauauauuuagagggagcuauuuagcgggugcuggguuagcuuucaguuuaauaaagaacgcucaaacccccagaaggggaacugggacuacuggcgaaacauuaggagaaaaguggaaacgacaguuaaacucauuggacagaaaagaauuugaggaauacaaaagauccgguaucuuggaaguagaucgaacagaagcaaaaagcgcguuaaaagacggcagcaaaaucaaacaugcuguaagcagaggaucaaguaaaauacgcuggauuguagagagagguaugguaaagccgaaggggaaaguuguagaucuaggaugcggacggggcgguuggucguacuauauggcuaccuuaaagaaugucacggaaguuaaaggauacacaaaaggggguccggggcaugaagaaccaauaccgauggcaacuuacggcuggaaucuaguuaaguuacauucuggagucgauguguucuauaaaccaacugagcaaguagauacuuuacuaugugacauuggagagucaucuucaaauccaacaauagaagaaggcagaacgcuucgaguauuaaaaaugguggaaccaugguuauccagcaagccggaauuuuguauaaaaguucucaaccccuacaugccaacaguaauagaagaacuagaaaaauuacaacgaaaacacgggggcaauuugguacggugcccacuuuccagaaauucgacacaugaaauguauuggguauccggugcuagugggaacauaguuucaaguguuaauacuacaaguaaaauguugcuuaaccgguuuaccacuagacaccgaaaaccaacauaugaaaaagauguagaucuaggcgcaggaaccagauccguuucuacggagacagaaaagccagauaugacaauaauugggcguagauuacagcgacuacaagaagaacauaaggaaacuuggcacuaugaccaagagaauccuuauagaacaugggccuaucaugguucauaugaagcucccagcacagguucagcaagcucuaugguuaacgggguaguaaaacuacuaacuaaaccgugggauaugauuccuauggucacacagcuugcaaugacggauacaacuccauuuggacaacaacgaguuuuuaaagaaaaaguagacacacggacaccucagccgaaacccggaaccagaauggucaugacuacaacggcaaacuggcuaugggcacucuuggggaagaagaaaaacccacguuuauguacgcgugaggaguucauaaguaaaguaagaucgaaugccgcgauuggcgcuguuuuucaggaagaacaaggauggacuucagcgagcgaggcuguaaacgacucaagauucugggaacucguagacaaagaaagagcucugcaccaggaagggaagugugaaucgugugucuauaauaugaugggaaagagagagaagaaauuaggugaguucgggagagcuaaaggaaguagagcaauuugguauauguggcuaggggcaagauuccuugaguuugaagcucuaggauucuuaaaugaggaucacugguuuggacgagaaaauucguggaguggaguagaaggagagggccuacauagauugggguauauccuggaagaaaucgauaagaaagauggugauuuaauguaugcagaugauacagccggaugggauacuagaauaacagaggaugaccugcaaaaugaggaacuaauaacggagcagauggcuccucaucacaagauacuagccaaagccauauuuaaauuaacauaccaaaauaaagucguuaaagucuugcgaccuacuccaagaggagcuguuauggauauaauuucaagaaaagaucagagaggaagcgggcaagucggaaccuauggacuuaauacauucacgaacauggaaguccaauuaauaagacaaauggaagcagaaggaguaauuacgcaggaugauaugcaaaauccaaaaggacucaaggagcgagucgagaaguggcuccgggaauguggaguggauagacuaaagcgaauggcaauaaguggggaugauugcgucguaaagccacuugacgaaagguucgguacaagccuacuauuccucaacgacaugggaaagguuagaaaagacauaccgcagugggaaccaucgaaagguuggaaaaacuggcaagaagugccauucuguagucaccacuuucauaaaaucuuuaugaaagauggacgcucccugguaguuccguguagaaaucaggaugaguugauugguagagccaggauuagucagggagccggauggagccuacgagaaacggcuugucuuggaaaggcuuaugcccagauguggagucugauguauuuccacagaagggaucuaagguuagcuagcauggcaauaugcagugcaguaccuaccgaaugguuccccacuucuagaacgacguggucaauacacgcgcaccaucaguggaugaccaccgaggauauguuaaaaguauggaaucgaguauggauugaggauaauccuaacaugauagauaaaacuccaguccacuccugggaggauauaccuuauuuagggaaacgagaagaucucuggugcggcucucuaauaggucuuucuucgagagcaacaugggcaaagaacauacauacagcaauuacacaaguccguaauuuaaucgggaaagaggaauauguugacuacaugccugucaugaaaagauauagcgcaccaucagaaucugaagguguucuauaa

SEQ ID NO: 23606 - RNA, 9867 nt, Artificial Sequence
  derived and/or modified CDS sequence (opt6) from DENV-4__EU854295__SS-prME
ucuacuauaacccuuuuauguuuaauaccuacuguuauggcguuccacuuauccacgagagacggagaaccuuuaaugauaguugcuaaacaugaaagaggacggccguugcuauuuaaaacuaccgaagguauaaacaaaugcacauuaaucgcuauggaccuuggagaaaugugugaagauacugugacuuauaaauguccucuucugguaaacacagaaccagaagauaucgauugcuggugcaacuuaacgagcacuuggguaauguauggcacaugcacacaaucuggugaaagacgucgugagaaaaggucgguagcucuuacuccgcacuccgggauggguuuagaaacacgagcggaaacuuggaugucgucagaaggugccuggaaacaugcacaacgaguugaaucguggauucuuagaaaucccggcuuugcacuucucgcaggauucauggcauacaugauaggccaaacugguauucaaagaacuguauucuuuguuuugaugaugcuuguggcaccaucauauggaaugagaugugugggggucggcaaccgggacuuuguagaaggaguuucuggcggagcuuggguagauuugguauuggaacauggagguuguguaacgacgauggcccagggaaaaccaacauuagauuuugaacuuacuaaaacaacagcgaaagaaguagcauuguugcgaacauauuguauugaagccagcauuucuaacauaacaacugccacgcgauguccuacacaaggagaacccuauuugaaagaagaacaggaucaacaauacauuugcagacgcgacgucguagaucgaggauggggaaaugggugugggcuguuuggcaaaggagggguuguaaccugcgcuaaauuuaguuguuccgguaagaucacugguaauuuaguacagauagaaaauuuagaauauacaguugucguaacuguucauaacggagacacacaugcaguaggcaaugacacuucuaaccacggcguuacugcaacaauaacuccaagaagcccuagugucgaaguaaaacuaccagauuacggugaacuaacacuagauugugaaccccguucugggauugauuuuaaugaaaugaucuuaaugaaaaugaagaagaaaacuuggcuaguacauaaacaaugguucuuggaucugccuuuaccuuggacagccggagccgauacuucggaagugcauuggaacuauaaagaaagaaugguuacauuuaaaguaccacaugcaaaaaggcaagacguaacuguguuggguucccaagaaggugcuaugcacagcgcucuggcuggugcgacugaaguagauucaggugacggcaaucauauguuugcaggacaucucaaaugcaaagucagaauggaaaaauuaaggauuaaagggaugucauacaccaugugcagcggaaaauucucgauugauaaagagauggccgagacacagcaugggacaacagucguuaaagugaaauaugaaggugcaggcgcucccuguaaaguaccuaucgaaauuagagauguaaacaaagagaaaguuguugguagagucaucucuucaacuccacucgcggagaauacaaacucuguaaccaacauugaguuggaaccgccauucggugauaguuacauaguaauagguguggguaauucggcacuaacacuacacugguuucgaaaagguucuuccaucggcaaaauguuugaauccacuuaccgaggagcgaagcguauggcaauccugggagagaccgcuugggacuucgggucuguaggcggucuuuuuacauccuuaggcaaagcgguccaucaaguauucggcucaguuuauacuacaauguuuggggguguuaguuggaugauacguauacugaucggauuuuuagucuuauggauaggaacaaauucucguaauacuucaauggcaaugacuuguaucgcagucggcggcauuacacucuuccucgguuucacuguacaggcagacaugggcuguguugugucauggaguggacgggaacuaaaaugcgggagcggcaucuuuguaguagauaauguucauacauggaccgaacaauacaaauuucaacccgaaucuccagcaagauuagcuagugcaauuuugaaugcacauaaagauggaguaugugggauacguucaaccacaagacuagaaaauguaauguggaaacagauuacaaaugagcugaacuaugucuuaugggagggaggccacgaucuaacugucguagcgggagacgucaaagguguacuaacuaaaggaaaacgggcacuaacuccaccaguaucagacuuaaaauacucauggaaaacauggggcaaagcaaagauauuuacuccagaagcaaggaacaguacguuuuugauagacggaccggacacuucagaaugcccaaacgaacgacgagccuggaacagccucgaaguagaagauuacggauucggaauguucacaacaaauaucuggaugaaauuucgcgaaggguccucggaaguaugugaccaucgacugaugucagccgcuauuaaagaccaaaaggccguucaugcugacauggguuacuggauagagucguccaagaaucaaaccuggcaaauagaaaaggcuucuuuaauugaagucaaaaccugucuuuggccgaaaacacauacgcuauggucuaacggaguucuagaaagucagauguuaauaccgaaaagcuaugcugggccauuuucacaacauaauuaucggcaagguuaugcaacccaaacagucgguccauggcacuuagggaaacuugaaauagauuucggagaaugucccggaacgacaguuaccauacaggaggauugugaccauagaggaccuucucuacgaacaacaacagcgagugggaagcucguaacacaauggugcuguagaucuuguacuaugccgccauugcgguuuuuaggcgaagacggauguugguauggaauggaaauaagaccccuguccgagaaagaagaaaauauggugaagucacaaguagccgccgguccugguacaagcgaaacauucuccauggggcuacuuugccuaacacuauucguagaagaaugucuaaggagacgaguuacaagaaagcacaugaucuuagcaguuguaauaaccuuaugugcgauaauacuaggcggauugacauggauggauuuacuucgcgcauuaauuauguuaggagauacuaugaguggaaggauaggaggacagacacaucucgccauaauggcaguauucaaaaugucuccuggguacguacuuggaguauuuuugagaaagcuaacaagucgggagacugcucuaauggugauugguauggcuaugacaaccacuuuguccauuccacaugaccuuauggagcuuauugaugguauaucacuaggccuaauacuucuuaaaauaguaacacaguucgacaacacucaaguuggaacccucgcauuaagccuaacguucauacgaagcacuaugucacucgugauggcauggagaaccauaauggcagugcuauuugugguaacguuaaucccuuuaugcagaacgucuugcuuacagaagcagucgcacuggguagaaauaaccgcuuuaauacuaggugcgcaagcucucccgguuuauuuaaugacccuaaugaaaggagcaaguagaagaucuuggccucuuaacgaaggaauaauggcugugggucucguuagcuuauuaggaucagcacuauugaaaaaugauguaccacuagcuggcccuauggucgcuggcggccuuuuacuagcggccuacgugaugagugggucaucagcagaucugaguuuagaaaaagcugccaauguucaaugggaugagauggcagauauaacagguucgucgccuaucauagagguuaaacaagaugaagauggcuccuuuuccauuagagacguagaagaaacgaauaugauuacacuccucguuaaguuagcuuuaauuacuguuucaggccuauauccacuugccauacccguuacaaugacccuuugguauauguggcaggucaaaacacaacgcucaggagcguuaugggauguaccgucacccgcggcuacacaaaaggccgcacucucugaaggaguauaucguauaaugcaaagaggauuauucggaaaaacacaaguuggcgugggaauacacauggaagggguuuuucacacaauguggcacguuacuagaggaucugucauaugucacgaaacaggacgcuuagaaccgagcugggcagacguuagaaacgacaugauaucuuauggugguggcuggcgucugggagacaaaugggacaaagaagaggacguacagguacuggcuauugaaccagggaaaaauccaaaacauguacaaacgaagccgggucuauucaaaacacuuacaggagaaauuggggcagucacacuagauuuuaaaccaggaacaagugguucaccaauaauaaaucgaaaaggaaagguaaucgggcucuaugggaauggcguagugacuaaaagcggggauuaugugucagcaaucacucaagccgaaagaauaggagaaccggacuacgagguagacgaggacaucuucaggaagaaacgacuuaccauuauggauuugcacccuggugcagguaaaaccaaacgaauuuuaccuaguaucguccgagaggcauuaaagaggcgccugagaacuuuaauauuagcaccaacuaggguaguagccgcagaaauggaagaagcguugcgaggauugccaauuagauaucaaacaccagcugucaaauccgagcauacaggaagagagaucguggaucuaaugugucaugccaccuuuacuacgagguuacuaaguagcacaaggguacccaauuacaacuuaauaguaauggaugaggcucauuucacggacccaaguaguguagcggcaagaggcuacauaucaacgcgaguagaaaugggggaagcagcagcgauuuucaugacugcaacaccuccgggugcaacagacccguuuccacaauccaacucaccuauagaagacaucgaaagagagauaccagagcgaucauggaauacgggauucgauuggauaacugacuaccaaggaaaaaccguuugguucguaccaucaauaaaagcaggaaaugacauagcuaacugccuaagaaaauccggcaagaaagucauccaacuaucgcgcaagacauuugacaccgaguacccaaaaacaaaguuaacugauugggacuuuguaguaacaacugauaucucugaaaugggcgcuaacuuccgggcuggcagaguuauugauccaagacgaugucuaaaaccgguaauauuaacugacggcccagaaaggguaauauuagcaggacccauacccguaacacccgcauccgcugcacaaagaaggggacguauagguaggaacccagcacaggaagaugaccaauauguuuucaguggcgauccuuugaagaacgaugaggaccaugcccacuggacggaagcaaaaaugcuacuggacaacaucuacacgccagaaggaauaauaccuacacuauucggcccagaacgugagaaaacucaagccauagauggggaauuucgacugagaggugaacaacggaaaacauuuguugaacuuaugcgacgaggggacuuaccggugugguugagcuacaaaguugccagugcuggaauaaguuauaaggaucgugaaugguguuucacaggcgaacguaacaaucaaauauuggaagagaacauggaaguagagauauggacaagagagggggagaagaagaaauugaggccuagguggcuugaugcacgaguuuacgcagaucccauggcacucaaggauuuuaaagaguucgcuaguggcaggaaaucgauaacccucgauauauugacugagaucgcuagucuaccaacuuaucuuucaucuagagcaaaauuggcauuggauaauauugucauguuacauacaacagaaagagggggucgcgcauaucaacacgcguugaacgaacuaccagagagcuuggagacacuaauguuaguagcuuuguugggcgccaugacggcaggaauauuucuauuuuucaugcagggaaaaggaauaggaaaacucaguaugggucuuauuacgauagcaguugccucaggauuacucuggguugcagaaauacaaccacaguggaucgcugcaucuaucauauuggaauuuuucuuaaugguauuauuaaucccagaaccugagaaacagagaacaccccaagauaaucagcuuauuuauguuauauuaacaauacuaacaauaauugguuuaauagcagcaaaugaaaugggauugaucgagaaaaccaaaaccgacuucggauuuuaccaaguuaaaacggagacaacgauucuggauguugaucuaagaccagcuagcgcauggacacuguaugcaguugcaacgacuauacucacacccaugcugcgucauacgauugaaaauaccucagccaauuuaagccuagcagccauugcaaaucaagcugcugugcuaaugggguugggcaaaggauggccauuacaccgcauggaucuggggguaccacuuuuagccaugggcugcuacucucagguaaauccaaccacgcuaacugcaucucuuguuauguuguuagugcacuaugcuaucauaggacccggcuuacaagcaaaggcaacaagggaagcgcaaaagcgaacugcagccgggauaaugaagaauccaacaguagaugguauuacgguaauagaccucgaaccgauaucauaugacccuaaauucgagaaacaauugggacaggucauguuauuaguccuuugugcgggacaguuauuauuaaugagaacaacaugggcauucugugaaguucucacacuagcaacaggaccuauacuaacgcuaugggaagguaacccaggcagauuuuggaauaccacuauugcagugucuacagcgaauaucuuucgggguucauaccuugcgggagcaggacuugcuuuuagucucaucaaaaaugcucagacgccacguagggguaccgguacaacaggugaaacguuaggcgagaaauggaaacgacaacucaauucuuuggauagaaaagaauuugaggaguacaaaaggaguggaauauuagaaguagaccgaacagaagcaaaaagugcccuaaaagauggcucgaaaauuaaacaugccgugagucgagggaguagcaaaauacguuggauaguagaacgcggaaugguaaaacccaaagguaaaguuguggauuuaggaugcgguagagggggcuggucauacuacauggcgacccuaaagaacgucacagagguuaaaggguacacaaaaggcgguccaggucacgaagaaccaauaccgauggcaacuuacggauggaauuuagugaaacuccauucagguguagacguauuuuauaaaccuacagaacagguagacacccuauugugcgacaucggagaaucaaguaguaaucccaccauugaagaaggcagaacguuacguguuuugaaaauggucgagccauggcuuuccucgaaaccagaguuuuguaucaaaguuuugaauccguauaugccuacuguaauagaggaacuagaaaaacugcaaagaaagcacggugguaaccucguacgguguccacuuuccagaaauucaacacaugaaauguauugggucuccggcgcaucggguaauauugugaguaguguaaauacuacgaguaaaaugcuucuuaauagauuuacaacacgucaccgcaaacccacguacgagaaagacguggaucuaggcgcuggaacaagauccguuucaaccgaaacugaaaaaccagauaugacaaucauaggucgacgauuacaacguuugcaagaggaacacaaagaaacauggcauuaugaucaagaaaauccuuaucggacgugggcguaccauggaaguuaugaagcuccaucaacgggcucugcaucgaguaugguuaaugggguagugaaguugcuuacaaagccaugggacgucauacccaugguuacccaguuagcuaugacagacacuaccccuuuugggcaacagcguguuuuuaaagaaaaaguagacaccagaacuccgcagccuaaaccuggcacacggguugucaugacuacaacagcuaacugguugugggcgcuucuuggcaagaagaaaaaucccagguuauguacgcgugaagaauuuaucucaaagguaaggaguaaugcugcaauaggagcuguguuucaagaagaacaaggauggacaucugcuucugaggcuguaaacgacucccgauucugggaguugguggauaaagaaagagcauuacaucaggaagguaaaugugaaucauguguuuacaauaugauggguaaacgagagaagaaacuaggugaauuuggucgggcuaaaggaucgcgagccauuugguauauguggcuuggagcuagauuccuugaguucgaagcucuaggcuucuugaaugaagaucauugguuuggcagagagaauaguuggucagguguugaaggcgaaggacugcaccgucucggauauauacuggaagaaauagacaagaaagauggugauuuaauguaugcagaugauacagcaggcugggauaccagaaucacugaagaugauuuacaaaacgaagaacuuaucacugaacaaauggcuccacaucacaaaauucuagccaaagcaauuuuuaagcugacauaccagaacaagguagugaagguacugcguccaacuccgagaggggcuguaauggacaucauuagcagaaaggaucagcgagguuccgggcaagugggcaccuacggacuuaacaccuucacuaauauggaaguucaacuaauuagacaaauggaagcggaaggagucauuacacaagacgacaugcaaaacccaaaagguuuaaaagaacgugucgaaaaauggcugcgagagugcgguguggauagacuaaaaagaauggccauaagcggugaugauuguguaguaaagccacuugaugaacguuucggaacuucacuucucuuccuuaaugauauggguaaaguaagaaaagauauaccacaaugggaaccuaguaaaggauggaagaauuggcaagaagucccauuuugcagccaccacuuucauaaaauuuuuaugaaagaugguagaagucuagucguaccaugcagaaaucaggaugaauuaauagggagggcgagaauaucacagggcgcaggcuggagucucagagagacagccugcuuagggaaggcuuaugcccagauguggucguuaauguacuuccaccgcagagaucuuagacuggcuucaauggccauauguucugcgguucccacggaaugguucccgacuucuaggacaacuugguccauacacgcccaccaucaguggaugacaacagaagacaugcugaaggucuggaaucgggucuggaucgaagauaauccaaauaugauagacaaaacuccuguacacaguugggaggauauaccuuauuuaggcaaacgugaggauuuauggugugggucucuuauaggauugucuucacgggcaacaugggcuaaaaauauucauacagcaauuacacagguaagaaaucuuaucgguaaagaagaauacguugacuauaugccuguaaugaagagauauucagcccccagugaauccgaaggaguacucuaa

SEQ ID NO: 23607 - RNA, 9867 nt, Artificial Sequence
  derived and/or modified CDS sequence (opt6) from DENV-4__EU854296__SS-prME
ucaacuauaacgcuacuuugcuuaaucccaacgguaauggcauuucaccucaguacaagggacggugaaccgcucaugauuguagcuaaacaugaaagagguaggccgcuccucuuuaaaaccacagaaggaaucaauaaaugcacguugauugcuauggacuuaggagagaugugcgaagacacggugacauacaaauguccacugcuaguuaauacagaaccggaggauauugacugcugguguaaccuaacuaguacuugggugauguauggcacauguacucaaucuggagaaagacgucgggaaaaaagaagcguugcucuaacaccacacaguggaaugggacuugagacaagagcagaaacauggaugucaucagagggugcauggaaacacgcacagcggguagagaguuggauacuaagaaauccaggcuucgcucuguuagcugguuuuauggccuauaugauugggcaaacaggcauucaaaggacagucuucuucgucuuaaugaugcuuguggccccgucauacggcaugcgcuguguaggaguaggcaauagggauuucguagaaggcgucagcggaggagcauggguugauuugguuuuagaacaugguggcugcguuacuacuauggcgcaaggcaaaccgacuuuggauuuugaauuaaccaagaccacugcaaaagaaguagcucuacuaaggacauauuguauagaggcaucaaucucaaauauuacuacagcaacaagaugcccuacacaaggagaaccuuacuuaaaagaagaacaagaucaacaguauauaugucgucgagacgugguagacagaggaugggguaacggguguggauuguucgggaaaggaggaguagugacaugugcaaaauucaguuguucaggaaaaauaaccggaaacuuaguacaaaucgaaaaccuggaauacacggucguagucacuguacacaauggugauacacaugccguaggaaaugacacgucaaaccacgguguaaccgcgacaauaacuccccgaaguccaagcgucgaaguaaaacuccccgacuauggggagcucacccuugauugugaaccgcgaagugggauagauuucaaugaaaugauccucaugaaaaugaagaaaaaaacgugguuggugcacaaacaaugguuuuuagacuuaccacucccguggacagcuggagcagauacgucggaaguucauuggaauuauaaagagagaaugguuacauuuaaagucccgcaugcaaaaagacaagacguaacuguacucgggucccaagagggugcuaugcauagugcauuagccggugcuacggaaguagacucaggagauggaaaccauauguuugcaggacaccuaaaauguaaaguuagaauggagaagcuaagaauaaaagguaugucuuauacaauguguaguggaaaauuuagcaucgauaaagagauggccgaaacucaacauggcaccacaguaguaaagguaaaauaugaaggagcgggagcgccgugcaaagucccuauagagauuagggaugucaauaaagaaaagguuguaggucguguuauaucuagcacgccgcuugccgaaaacaccaauagcguaacaaacauagaauuggaaccaccauuuggugacagcuauaucguaauaggcgucgguaauuccgcgcucacguuacauugguuucgaaagggaucaagcauuggaaaaauguucgaaucaacauacagaggagcaaaacgaauggcgauauuaggagagacugccugggacuucggaucagucgguggauuguuuacgucacuaggaaaagcuguacaucaaguauuuggaucuguuuauacgaccauguuuggaggagugaguuggaugaucaggauucugauagguuuucugguguuauggauugguacaaacucccgaaacacaucaauggcuaugacauguauagcaguaggaggaauaacgcuuuucuuaggcuuuaccguacaagcugauaugggguguguuguuuccugguccggaagagaauuaaagugcggaucagguauuuucguaguugauaacguacauacuuggacugagcaauauaaguuucagccggaaagcccagcuagacuagcaagcgcaauauuaaacgcucauaaggauggcguaugcggcauaagaaguacaacucgucuagaaaacguaauguggaaacaaauuacgaaugaauugaauuauguauugugggaaggaggccaugaucucaccguagucgcaggugacgcgaagggaguguuaacgaaaggaaagagagcucuaacuccaccuguuagugaucuuaaauacucauggaaaacguggggcaaagccaagauauuuacuccggaagcaagaaacaguacguucuuaauugauggaccagauaccucugaaugcccaaacgagcggcgggcguggaauagucuggaagucgaagauuauggcuuugggauguucacaaccaacauuuggaugaaauuuagagaaggaucuucagaagucugugaucacagacuuaugucugcagcaauaaaagaucaaaaggcuguacaugccgauaugggauacuggauagaauccucuaagaaucaaacauggcaaauugaaaaagcaaguuuaauagaggucaaaacuugcuuauggcccaaaacucauacgcuuuggagcaauggaguuuuagaaucgcaaauguugauuccuaaaucguaugcagggccguucagccaacauaauuaucggcagggauacgcuacacaaacaguugggccuuggcacuuggguaaacuugagauugauuucggcgaaugucccggcacuacaguaacaauucaggaagacugugaucaucgcggaccuucacuacgaacaacuacugcaucgggcaaacuugugacccaaugguguugucggucauguacuaugccuccucuucgauuccuaggcgaagacggguguugguacgguauggaaauaagaccucucagcgaaaaagaggaaaauauggucaagucacaagucacggcugggcaagguacuagugagaccuucucaaugggacuccuuuguuuaacuuuauuuguagaagaaugucuucgacgucguguaacaagaaagcauaugauccucgccguuguaauaacauuaugugcgauaauacucggggggcuaacuuggauggauuuacuccgugcucuuauuaugcugggcgacacuaugucaggcaggauugguggacaaacacauuuagcaauuauggcaguauuuaaaaugucgccaggauauguauugggcguuuuccucaggaagcuuacaucaagagaaacggcucuaaugguuauuggaauggcgaugaccacaacucuaaguaucccucaugauuugauggaauuaaucgacgguauaucgcugggucuaauccuauuaaaaauaguaacucaauuugauaauacucaggucggaaccuuagcgcuaucgcuaacauuuauacgcucaaccaugucacuggucauggcauggagaacgauuauggcaguacucuuuguagugacgcuaauaccucuuugucggacaagcugucuccaaaaacaaucucacuggguagagauaaccgcauuaauacugggagcgcaggcucuaccaguguaccuuaugacccuuaugaaaggagcaaguaggagguccuggcccuugaacgaaggcauuauggcagugggacuaguuagcuuguuggggucagcucuacuuaaaaacgauguuccuuuagcaggccccauggucgcgggagggcuauuacuagcagcauacgugaugucaggaaguucagcagauuuaaguuuggagaaggcagcaaaugugcaaugggaugaaauggcagauauuacggguaguaguccaauuauagagguuaagcaagaugaagaugguucguucucgauacgggauguagaagagacaaauaugauuacccuuuuaguaaaauuggcacuuauuaccguaagcggucuauaccccuuagcaauaccugugacuaugacauuaugguauauguggcaaguaaaaacccaacgaagcggagcacuaugggauguccccagcccagcagcaacgcaaaaagcugcgcuaagugaaggugucuaccguauaaugcaaagaggauuauucgguaagacucagguugggguagguauacacauggaagguguauuucauacuauguggcacguaacucgggguagcguaauaugccaugaaacugggaggcucgaaccuucaugggccgauguaagaaaugauaugaucagcuacggaggcgguuggagacuuggagauaaaugggauaaagaagaggauguccaaguacuugcuauagagcccggaaaaaauccaaagcaugugcagacgaagccagggcuguuuaaaacucuaacaggagaaauaggagcgguuacucuagauuuuaaaccgggaacgaguggaucaccuauaauaaauagaaaagguaaagucauuggauuauacggaaacggagucguuacaaaaucaggggauuacgucucugccaucacacaagcagagagaaucggggagccugacuaugaaguugacgaagacauauucagaaaaaaaaggcuaacaauuauggaucugcaucccggagccgggaaaacuaaacgaauacuaccuagcauagucagggaagcuuuaaaaagacgauugcgaacauuaaucuuggcgccgacuaggguuguagcugcugaaauggaagaagcauuaaggggucuaccgauaagauaccaaacgccggcgguaaaaagcgaacauacuggaagagaaauaguagauuuaaugugccaugcuacuuuuacaacacgauugcuaucuagcacgcgaguacccaauuacaaccuuaucguaauggacgaagcgcacuuuacugacccaaguaguguugcagcaagaggauauauuaguaccagaguagagaugggcgaagccgcugcaauuuuuaugacagcuacaccacccggcgcuacugaucccuuuccgcaaaguaauucaccgauugaagauauagagcgagaaauaccagaaagauccuggaauacagguuuugauuggauaacugauuaccagggaaaaacuguaugguuuguaccaaguaucaaagcagguaacgauauagccaauugcuuacgaaaaagcgguaaaaaagugauacaauuaucuaggaaaacauucgauacugaauacccaaagacuaagcuuacggauugggauuuuguaguaacgaccgacauaagugaaaugggggcuaauuucagagcgggucggguaauugauccaagacguuguuugaagccaguaauauugacugacgggcccgaaaggguuauucuagcagguccaauaccugucacuccagcuucggccgcucagagaagagguaggauugguagaaacccagcccaggaagaugaucaauauguguucucaggagauccguugaagaacgaugaagaucacgcacauuggaccgaagcgaaaaugcuccuugauaauaucuacacuccagaaggaauuauaccuacucucuuuggucccgaacgugaaaaaacucaagccaucgacggggaguuuagacuuagaggagaacaaagaaaaacuuuuguggaacugaugaggagaggagacuuaccuguguggcugucuuacaaaguugcuucugcagggauuucauauaaggaucgagaaugguguuucacuggagagaggaauaaucaaauccuagaagaaaauauggaagucgaaauauggacuagagagggggagaagaaaaaauuaagaccaaggugguuagacgcucggguauaugcggacccaauggcgcucaaggauuuuaaggaguucgccucuggccguaaaucuauuacuuuagauauauugacagaaauagcgucacuuccaacuuauuuguccagucgagcuaagcuagcacuugauaauauuguuauguuacauacgacggaacgagguggcagagcauaucaacaugcauuaaaugagcucccagaauccuuggagaccuuaaugcuaguagcguugcugggggcaaugaccgcugggauuuuccucuucuucaugcagggaaaggguauaggaaagcuuagcaugggucuuauaacaauugcaguugcuucuggacuccuaugggucgcugaaauucagccucaauggauugcugccagcauaauauuggaauuuuuccuuaugguauuguugauaccggagccagaaaaacaacgaacaccgcaggacaaccaacucauauacguuauauuaacaauauuaacaauaauagguuuaauagcugcaaaugaaaugggguugaucgaaaaaacuaaaacugauuucggauuuuaccaggcgaaaacagagacaacuauucuagacgucgauuugcgaccugcaucagcauggacgcucuaugccgucgcaacaaccauucugaccccuauguuacgacacacuauagaaaauacauccgccaacuugaguuuggcggcuauagccaaucaagcagcgguacuaaugggcuuagggaaaggauggcccuuacauaggauggacuuaggcguuccacuuuuagcgaugggauguuacucacaagugaacccaacaacgcugacggccucguuaguuaugcuauuagugcauuaugcgauaauuggaccagguuuacaagcaaaggcaaccagagaggcacaaaagagaacugcagcgggaauaaugaaaaauccaacuguugauggaaucacaguaauugaucuggaaccaaucagcuacgauccaaaguucgaaaaacaacucgggcagguaauguugcuaguguuaugcgccgggcaacugcuacuaaugcgaaccacaugggcauuuugcgaaguuuuaacauuagcaacaggaccaauuuuaacccucugggagggaaauccaggacgauuuuggaacaccacuaucgcaguuuccacagcaaauauauuucgaggcaguuacuuggcuggcgcuggccuagcguuuucauuaaucaaaaaugcucagacccccagaagagguaccggaacaauaggagaaacacuuggcgaaaaguggaaacgacaguuaaauucccuagaccgaaaagaguucgaggaauacaaacgcucgggaaucuuagaaguagaucggacugaggccaaaagugcuuugaaggacgggaguaaaaucaaacacgcagucucuagaggaucaucuaaaaucagauggauuguagaaagaggaaugguuaagccaaaggguaaagugguggaucuaggcuguggccgaggcgguuggaguuacuauauggccacgcugaaaaaugugaccgaaguuaaaggauacacaaaagggggacccggccacgaagagccaauacccauggcuacuuacgguuggaaucuggucaaauugcauuccggaguggauguauuuuauagaccaacggaacagguagacacccuuuuaugcgauauaggugaaucaagcaguaacccaacuauagaggaagggagaacauugaggguauuaaagaugguagaaccuuggcuuagcucgaaaccagaguuuuguauuaaggugcuaaacccauauaugccgaccguaauagaagaauuagagaaacugcaacgaaagcauggcgggaaucuugugcgcuguccgcucucacgcaauucgacucacgaaauguauuggguaucuggagccucggguaauauaguaucgucagucaauaccacaucaaaaaugcuguuaaaucguuuuacgacaagacaucggaaaccgacauaugaaaaagacguagauuuaggcgccgguacacgaucugucagcacugaaacugaaaaaccugacaugacaaucauuggaagaaggcugcaaagauugcaggaggaacacaaggaaacuuggcauuaugaccaagaaaauccauacagaacuugggcuuaucauggcucauaugaagcuccuucuacagguucagcuaguaguaugguaaaugggguagugaaauuauuaacuaaaccuugggacgucauacccauggugacgcaauuagcgaugacagauacaacaccauucggucaacagaggguuuucaaagagaaaguagauacaagaacaccucaaccaaaacccggaacaaggaugguaaugaccacgacagcaaacugguuaugggcacuguuagguaaaaaaaaaaacccccguuuguguacaagggaggaguucauuucuaagguacgcucaaaugcagcgauaggagcagucuuccaggaagagcaaggguggacaagcgcuagcgaagcgguaaaugauucucgauucugggaguugguggauaaagaacgggcacuccaucaagaaggaaaaugugagucgugcguuuauaauaugauggguaaaagagagaaaaaacuaggagaauuuggacgagcaaaagggucacgugcuauaugguauaugugguugggugcaagauuuuuggaauuugaagcccuagguuuucuaaaugaggaucacugguuugggagagagaacagcuggucgggaguagaaggagaagggcugcaucgauuaggauauauacuugaagaaaucgacaaaaaagauggcgaucucauguaugcagaugauacugcagggugggauacacgcauuacagaggaugauuugcaaaacgaagaacuuaucacagaacaaauggcuccccaucacaagauacuugcaaaggccauauuuaaguugacuuaccaaaacaagguuguuaagguacuacggccaacuccuaggggagcagucauggacauaauaucacggaaggaucagcgaggaucaggacaaguuggaacauauggguugaacacuuuuacuaacauggaaguacagcuuauaaggcaaauggaagcugaaggaguaauaacacaagacgauaugcaaaauccgaaaggacuuaaagaaagaguagaaaagugguuacgggaauguggaguagaccgacuaaagaggauggcgaucuccggcgaugauugcguugugaagccauuagacgaacgauuugggacguccuugcuauuucuaaaugacauggguaaaguuaggaaagauauaccacaaugggaaccaagcaaagguuggaaaaauuggcaggaaguaccauuuugcucucaccauuuucauaaaaucuuuaugaaggauggaagaagcuugguuguaccuuguagaaaucaagaugaacuaaucgggagggcgagaauuagucaaggcgccggcuggaguuugagagagacggcauguuugggcaaagcauaugcacaaauguggucucuuauguacuuucacaggagagaccuucgucuggccagcauggcuaucuguucagcuguccccacugaaugguuccccaccucuaggacuacuuggucaauucaugcucaccaucaauggaugacaacugaggauauguuaaaaguauggaaucgcguauggauugaagacaacccuaauaugauagauaagacuccuguacauucuugggaggauauuccauacuugggaaaacgagaggauuuguggugugguucacuuaucgguuuaaguucccgugcaacuugggcuaaaaauauacacaccgcaaucacacagguacgcaaccucauuggaaaggaagaguacgucgauuacaugcccguuaugaaaagguauagcgcaccaagugaaagcgagggcguauuauaa

SEQ ID NO: 23608 - RNA, 9867 nt, Artificial Sequence
  derived and/or modified CDS sequence (opt6) from DENV-4__GQ199878__SS-prME
ucaaccauaacuuuauuaugcuuaauuccuacagucauggcuuuucaucuuuccaccagagauggugaaccauuaaugauaguggccaaacacgaaaggggucguccccuauuauucaaaacgacggaaggaauuaauaaauguacguuaauagcaauggacuuaggugaaaugugugaagauacagugacguauaaauguccuuuacuuguuaauacagaaccagaagauaucgauugcugguguaacuugacauccacauggguuauguacggaaccuguacucaauccggagaaagaagaagggaaaaacgcucaguugcacuuacgccucacucugggaugggucuugaaaccagagccgaaacauggaugagcucggaaggugcauggaaacaugcgcaaaggguggaaaguuggauauuacguaacccuggauuugcacugcuggcaggauuuauggccuauaugauaggacaaacgggaauacagcguacgguguucuuuguuuugaugauguuaguagcaccuucauacggaaugagauguguuggaguaggaaauagagacuucguagaaggaguauccggaggugccugggucgauuuagugcuagaacacgggggaugcguuacaacuauggcacaaggaaaaccuaccuuagacuucgaacuuacuaaaacaacagcgaaagaaguagcguugcugagaacuuauuguauagaagcgaguauuaguaacauaaccacggcuacgagauguccaacucagggagaaccauaccuaaaagaagaacaggaccaacaauacauaugucgacgagauguaguagaccgaggauggggcaauggcuguggacuuuuugguaaaggcggcguaguaacuugcgcuaaauuuaguugcaguggcaaaauuaccggaaaucucguacaaauugagaaucucgaguauaccguaguugucacgguucauaacggugauacccaugcuguagguaacgauacuucaaaucacggaguaacggcaacaaucacuccaaggaguccaaguguugaagugaaacuuccagauuacggugagcugacauuagauugugaaccacguucggguauagauuuuaacgaaaugauacucaugaagaugaagaagaaaacuugguuagugcauaaacaaugguuuuuggauuuaccgcuacccuggacagcgggagcggacaccagugaaguccauuggaauuacaaagaacgaauggugacauucaaaguaccacaugcgaaacgacaagacguuacaguguuagguucgcaagaaggcgcaaugcauagugcucucgcaggagccaccgaaguagauaguggagauggaaaucauauguuugcgggacaucuaaaauguaaaguaagaauggaaaaacuuagaauaaaaggaaugaguuauacuauguguuccgguaaguuuucaaucgauaaagaaauggcugaaacucaacaugggacuacaguugucaaaguuaaguaugaaggagcaggagcaccuugcaaaguaccuauugaaauccgagacgugaauaaagaaaagguuguugggagagucauuaguucaacgccauuagcagaaaauacaaauuccgucacaaacauagaguuagaaccaccuuuuggagacaguuacauuguaauaggcguagggaacagugcguuaacuuuacacugguuuagaaaagguucuaguauaggaaagauguuugaaucgaccuaucgaggugcaaagagaauggccauccuuggagagacugccugggauuucggaaguguuggaggauuauucacgucccuaggaaaggcgguacaucaaguuuuuggaaguguguauaccacgauguucggcggcgugucuuggaugauuagaauccucaucggauucuuagugcuauggaucgguacaaauuccagaaauacaaguauggcuaugaccuguauugccguaggagguauaacucuuuucuuaggguucacaguacaggcggauauggguugcguaguaucuuggucggguagagaacuaaagugcgguaguggcaucuucguaguugacaauguacauacguggacagagcaauacaaguuucaaccugaguccccagcucgacuagcaagcgcaauauugaaugcacacaaagacgguguuuguggcauaagaucuacaacuagacuugaaaauguaauguggaaacagauuacuaaugaauuaaauuacguauugugggaagggggacaugaccuaacuguaguagcuggagauguuaaaggcgugcucacuaaagggaaaagagcccuuacaccaccaguuucagauuuaaaguacaguuggaagacauggggaaaggcgaaaaucuucaccccugaagcaagaaauucaacauuuuugaucgacgggccggauacaagcgaauguccaaaugaaagacgagccuggaauagccuagagguagaagauuacggauuuggaauguuuacgaccaauauauggaugaaauuuagggaggggaguagugaaguuugugaucauagacuaaugagugcugcuauuaaagaucagaaagcuguacacgcugauaugggguauuggauagaaucaaguaagaaucagacuuggcaaauagaaaaagcgucucuaaucgaagugaagacuugccuauggcccaaaacccacacucucuggaguaauggcguucuagaaagccaaaugcuaaucccuaaaucguaugcuggacccuucucucaacauaacuaucgccaaggauaugcaacacaaacaguagguccauggcauuuagguaaacucgagauagauuucggugagugcccagggacuacagucacuauucaagaagacugcgaccaccggggaccgucauuaagaaccacaacagcaagcggaaaauuagugacacagugguguugucguuccugcacuaugccacccuugcgauucuuaggcgaagacgguuguugguauggcauggaaaucaggccauuaucggagaaagaagaaaauaugguaaaaagucaaguagcagccggucaaggaacuucggaaacuuucuccauggggcuucuuuguuuaaccuuauucguugaagagugucugagacguagaguaacucggaagcauaugauucuggcagugguuauaacauuaugugccauaauccucgggggcuuaacuuggauggauuuacugagggcacuaauaauguuaggugauaccaugagcgguagaauagggggacaaacucacuuggccauaauggcaguauuuaagaugucccccgguuauguacuggguguuuucuuaagaaaacuaacaucaagagagacagcauuaaugguaauagguauggccaugacuacaaccuuaucaauuccacacgauuuaauggaacuuauugacgguauaucccuugggcuuauucuauugaaaaucgugacccaauucgauaauacacaaguggggacgcuugcucugucacuaacuuucauacguucaacuaugucacuuguuauggccuggagaacaauaauggcaguacuuuuuguuguuacucuuauaccccuuugucguacaaguugucuucaaaaacagucucacuggguagaaauaaccgcauuaauacuaggugcccaggcauuaccaguuuaucuaaugacucuaaugaaaggugcaucacgacgcagcuggccauuaaacgaaggaauaauggcugucggccuaguuucucugcuggguucugcucuacucaaaaaugacgugccgcuugccgguccaaugguagcaggggguuuguugcuagcagcauacguaaugucuggaaguucugcggauuugucguuagagaaagccgcaaauguacagugggaugaaauggccgauauuacugguucuucuccuaucauagagguuaaacaagaugaagacggcucuuucucuauaagggauguugaagaaacaaacaugauaacacuacuuguaaaauuagccuugaucacugugagcggucuguacccccuugcaaucccuguaacuaugacgcuaugguauauguggcaaguaaagacgcagcgcuccggagccuuaugggacgucccuagcccagcugcuacacaaaaggcugcucuaagugaaggaguguauagaauuaugcaacguggacuauucgggaagacacaaguagguguaggaauacauauggagggcguguuucacaccauguggcauguuaccagagguucuguuauuugucacgaaacuggacguuuagaaccuaguugggcagacguaaggaacgauaugauuucuuauggcggaggcuggcgguuaggagauaaaugggauaaagaagaagacguacagguacuugcuauagagccagggaaaaaucccaaacauguacaaacuaaaccuggacuauucaagacuuugacaggcgaaauuggagcggugacguuagacuuuaaaccuggaacaaguggcaguccaauaaucaacaggaaagguaaagucauaggucucuacggaaaugguguuguaacaaagucaggcgacuacguuucagcuauaacacaagcagagcgaauaggagaaccagauuaugaagucgacgaggauauuuuuaggaagaaacgcuuaacaauuauggauuugcacccaggcgcugguaaaacaaaacguauacugccaucuauuguuagggaggcuuugaagagaaggcugcguacccugauucuggccccuaccagaguagucgcugcagagauggaagaggccuugagaggccuuccaauaagauaccaaacuccagcuguaaaaucagaacacaccgguagagaaauaguggacuuaaugugucaugcaacuuuuaccacuagguuguugucaaguacuaggguuccaaauuacaaucuaauaguuauggaugaggcgcauuucacagauccguccucagucgcagccagaggcuauauaaguacaagaguggaaaugggcgaagcagccgccauuuucaugacagcaacgccgccaggcgcuaccgacccuuuuccgcaaucuaacaguccaauugaagauaucgagagagaaauucccgaaaggucauggaacacuggguuugauuggauuacggacuaucagggcaagacggugugguuuguuccuucaauuaaagcuggaaaugacauagcuaauugucugagaaagucaggaaagaaagucauucaguuaagccguaaaacauucgacacugaguauccgaaaaccaaacuuacagauugggauuuuguagugacuaccgacaucagugaaaugggggcuaauuuccgggcagggcggguaauugauccacgucgaugucucaaacccguaauucuaacugacggacccgaacggguaauacuggcaggccccauuccagucacgccugcaucugccgcacaacgaagagggcgaauaggaagaaaccccgcacaagaagaugaucaguauguauuuucaggugauccacuuaagaaugaugaagaucaugcacauuggacagaagcaaaaauguugcuagauaacaucuacaccccugaagguauaauaccuacuuuauucggucccgaaagggagaaaacucaggcuauagauggcgaguuuaggcuaaggggagaacagagaaagacauuuguugaguuaaugcgucguggagaucucccaguuugguuaagcuauaaaguggccucugccggaauaagcuauaaggacagagaaugguguuuuacgggugaacguaauaaccaaauccuagaggaaaauauggaggucgaaauauggaccagagaaggagagaaaaagaaacuucggccacgguggcucgacgcaagaguauacgcagacccaauggcguuaaaagauuucaaagaauuugcaagugggcgaaaaaguaucaccuuggauauauugacugaaauagcuucguuaccuaccuauuuaaguaguagagccaagcuggcacuggacaacauagucauguuacauacaacugaacgugggggccgagcauaucagcacgcacuaaaugaacugccugaaucuuuggaaacuuugauguuagucgcacugcuaggggcuaugacagcagguauauuccuauuuuucaugcaaggcaaagggauagggaaacuaaguaugggacuuauaaccauagcuguggcaaguggucugcuuuggguggcagaaauacaaccucaguggauagcugcuucuauaauauuagaguucuuucuuaugguauuacuaauaccugaaccggaaaaacaacgaacaccgcaagauaaucaauugauuuauguaauauuaacaauuuugacgauuauuggauugauugcagcuaaugaaaugggccucauugagaaaacaaaaacagacuucgguuuuuaucaaguaaagacugaaacaacaauauuggauguugauuuaagacccgccucagcguggacacuguacgcaguagcuacaacuauucuaacacccaugcuccgccauacaauugaaaauacaucugcgaaucuuagucuugcggcaauugcgaaucaagcagcaguuuuaauggguuuaggcaagggcuggccccuacaccgcauggacuuaggcgucccgcuauuagcgaugggauguuauucacaaguaaacccgacaacacuuacggcuagucugguaauguuauugguacauuacgcaaucauuggcccgggcuugcaagcaaaagcgacucgcgaggcacagaagcguacugcagcgggaauuaugaaaaacccgacgguugauggaaucacaguaauagauuuagaaccgauaaguuaugauccuaaauuugaaaaacagcugggacaaguuaugcuguuaguacuaugcgccggucaacuucuacugaugcggacaacuugggcuuuuugugaaguauuaaccuuagcuacagggccaauccugacacuuugggaagguaaucccggacgauuuuggaauacuacgauugcaguaagcacugcuaauaucuuccguggcagcuauuuagcgggcgcuggccuagcauuuucucuuaucaaaaacgcccaaacgccucgacgcgguaccgggacaacaggugaaacauuaggggagaaauggaaacgacaacuuaauucgcuagaccggaaagaguucgaagaauauaaacguucugguaucuuagagguagaccggacagaagcgaagagugcgcuuaaagauggaucaaaaauuaagcacgcagucuccagagguuccucaaaaauccguuggauaguugaaagaggcaugguaaaaccgaaagguaaaguaguggauuuagggugugguagaggagguugguccuauuauauggcaacgcucaaaaauguuacagaagugaaagguuauacaaaaggaggaccgggacacgaagaaccaauacccauggcuacguacggauggaauuuaguaaaauugcauucgggagucgaugucuuuuauaaaccaacagaacagguugacacucuauuaugugauauaggugagagcuccagcaacccaacaauagaagaaggucggacauuaagaguucuuaaaauggucgaaccaugguugucaagcaaaccugaguucuguauaaaaguucucaacccuuauaugccaacaguaauagaggaauuggaaaaguugcaacguaaacacggagguaaccuugugaggugcccucuuaguagaaacucuacacacgaaauguauugggucaguggagcuucagguaacauuguauccucuguaaacacuacgaguaaaauguuauuaaacagauuuacuacacgacauagaaagccgacuuaugaaaaagauguagaucuuggcgcagggaccaggucaguaucaacagagacugaaaaaccagacaugacgauuauagguagaagauuacagagauuacaggaggaacacaaggaaacuuggcacuaugaccaggaaaacccauaccgaacgugggcuuaucaugggagcuacgaagcgccguccacaggaagcgccagcuccauggucaauggaguuguuaagcugcuaacuaaacccugggaugucaucccaauggucacucagcuugcgaugacagacacgaccccuuucgggcagcaacguguuuuuaaagagaaaguagauacacggacaccacaaccaaaaccugguacaagaaugguaaugacuacaacugcaaacuggcuuugggcguuauugggcaagaagaaaaauccucgauugugcaccagagaagaauuuauaucuaaaguacggucaaaugcugcuauaggcgcuguauuucaagaagaacaggguuggaccucagcaucugaagcaguaaaugauucucgcuucugggaauuaguugauaaagagcgagcccuucaucaagagggaaaaugcgagucauguguuuacaacaugauggguaaaagagagaagaaauuaggagaguucggccgcgccaaaggaucacgggcuauuugguauaugugguuaggagcaagauuucuugaguucgaagcacuaggguuuuuaaaugaggaucauugguuuggaagagaaaacucaugguccgggguagaaggagaggguuuacacagacuuggauacauacuugaagagauugacaagaaagacggugaucuuauguaugcugacgacaccgcaggcugggauacaaggaucacagaagaugaccuccaaaaugaagaauuaauaacagaacaaauggcaccucaccacaaaauauuagcuaaagccauuuucaaauuaacguaccagaauaaaguuguaaagguauuacgaccaacccccagaggggcaguaauggauaucaucucaagaaaagaucaaagggguucaggucaagucggaacuuauggguugaacaccuuuacgaacauggagguccaauugauaagacaaauggaggcagagggagucaucacacaagaugauaugcaaaauccuaaaggucugaaagaacgggucgagaaguggcucagggaguguggaguagaccggcugaaaagaauggcuaucucuggcgaugauuguguugucaagccacuggaugagcgauucgguaccucucuacuauuucucaaugacaugggaaaaguaagaaaagacaucccacaaugggaaccuuccaaaggauggaaaaacuggcaagaaguuccguuuugcagucaucacuuucacaaaauuuuuaugaaggacggcagaucgcuggucgugccuugccgaaaccaagaugaacuaauaggcagagcacgaaucucucaaggagcuggcuggucgcuuagagaaaccgcaugucuggggaaagcauaugcucagauguggaguuuaauguauuuucauagacgagacuugagguuagcuuccauggccauaugcuccgcuguaccaaccgaaugguucccuacuucccgaacaacauggagcauucaugcucaucaccaauggaugaccacagaagauaugcuaaaaguauggaaccgaguauggauagaggauaacccuaauaugauugauaagacaccuguacacucuugggaagauauuccuuaucucgguaaacgugaagacuuguggugcggauccuugauaggacuuucuucaagagcgacgugggcuaaaaauauacauacagcuauaacgcaaguuaggaaccuaaucggcaaagaagaauacguagacuacaugccuguaaugaagagauacuccgcuccuagugaaucugaaggaguguuauaa

SEQ ID NO: 23609 - RNA, 9867 nt, Artificial Sequence
  derived and/or modified CDS sequence (opt6) from DENV-4__GQ199879__SS-prME
ucaacgauaacuuuacugugccuaauaccaacggucauggcguuucaucugagcacuagagacggugaaccacuuaugauaguagcuaaacaugaacgcgguagaccgcuguuguuuaaaaccaccgaaggaauaaacaaaugcacguuaauagcaauggauuuaggagaaaugugugaagauacuguaacuuauaaaugcccgcuauuagugaauacggaaccagaagauauugauugcuggugcaauuuaacaaguacgugggugauguacgguacgugcacucaauccggugaaagaagaagggagaaaagaaguguagcucuaacgccccacucagguauggggcuugaaacgcgugccgaaaccuggaugagcucugaaggggcuuggaaacacgcucagagaguugaaagcuggauauuaagaaaccccggauucgcacuccucgccgguuucauggccuacaugauuggucaaacggguauccagagaacuguauucuucguacugaugaugcuuguagcuccaaguuacggaaugagguguguagggguugguaauagagauuuuguagaaggaguuaguggaggggcuugggucgauuuagugcuagaacacggagguugcguuaccacaauggcacaagguaaaccaacucuagacuucgaauugacuaaaacgaccgcaaaagaagucgcgcuccuucgcaccuauugcauagaagccucaaucaguaacauuacaacggcgaccagauguccaacacaaggagaaccuuauuuaaaagaagaacaagaucaacaauauauauguaggagggacguaguagaccgaggcuggggaaaugguugcggauuguuugguaaaggcgggguuguuacuugcgcgaaauuuaguuguucuggaaagauaacaggaaacuuaguucaaaucgaaaaucuagaauauacuguugucguuacaguucauaauggagauacccacgcugucgguaacgacacuucuaaucaugguguuaccgcuacuauuacuccuaggucaccuagcguagaagugaaacuuccugacuacggagaguugacccuugauugugaaccaagaucaggcauagacuuuaacgagaugauucuaaugaaaaugaagaagaaaacgugguuaguucauaaacaaugguuucuggauuuaccacuaccauggacagccggugcggauacaucugaaguccauuggaauuauaaggaaagaaugguaacuuuuaaaguaccgcacgcgaaaaggcaagauguaaccguuuuaggaucacaagaaggcgcuaugcauagugcauuggcaggagcaacagaaguagacucuggugauggaaaccauauguuugcagggcauuugaaguguaaaguucgaauggaaaaacuuagaauaaaaggaaugucguacacgauguguaguggcaaauucucaaucgauaaagagauggcagaaacacaacaugguaccacaguugugaaaguuaaauaugaaggcgcuggugcgccauguaagguacccauugaaauuagggacguaaauaaagaaaaaguagugggccguguuauaucaaguacaccgcuagcggaaaauacaaauucggucacgaauauugaauuagaaccuccauuuggcgauuccuauauuguuauaggcgucggcaauagugcucugacacuccauugguucagaaaagggagcucuaucgguaaaauguuugagaguaccuaucgcggugccaaaaggauggcgauuuuaggcgaaacugccugggacuuuggauccgugggaggacuguuuaccucguuaggaaaagcgguacaccaagucuuuggaaguguauauacaacaauguucggaggaguuuccuggaugguaaggauuuugauaggauuccuaguauuauggauaggcacuaauucaagaaauacaaguauggccaugaccuguauugcagugggcgguauuaccuuauuuuuaggguucaccgugcaagcugauaugggcuguguagugucuuggucagggagagaauuaaaauguggaucuggcaucuucgucguugacaauguccauacauggaccgaacaguauaaguuucagccagaaucuccagcaagauuagccagugccauacuaaacgcucacaaagaugguguaugcggaaucagaucgacuacacguuuagaaaauguaauguggaaacaaauaacgaaugagcugaauuaugugcuuugggaagggggacaugaucucaccguuguagcaggagacguaaaaggaguccucacuaagggaaaaagggcacugaccccaccaguaagcgacuuaaaauauuccuggaagacuuggggaaaagcuaagauuuuuacgcccgaagcacgaaacucuacauuuuuaauagacgguccugauacaucagaguguccaaaugaacgccgugcuuggaauagccuugagguugaagacuaugguuuugguauguuuacuacuaauauauggaugaaauuucgggaaggaaguagcgagguaugugaucaucgauuaaugucagcggcaauaaaggaccagaaggcagugcaugcggacaugggcuauuggauugagucuagcaaaaaccagaccuggcaaaucgaaaaggcaucacugauagaagucaaaaccugucuauggccaaagacccauacacuauggucgaacggugugcuagagagucaaaugcuuauuccgaaaucauaugcuggaccguuuucacaacauaauuaccgacaaggcuacgccacacagacaguaggcccuuggcauuugggaaaauuagaaauagauuuuggagaauguccugguacaacaguaacaauucaggaagacugcgaccauagaggcccaucuuuaaggacaacaacagcaagugggaaauugguaacccagugguguugccgaucuuguacuaugccuccacuucgauuccugggagaagauggaugcugguaugggauggagauaagacccuuaaaugagaaagaggagaauaugguaaagagccaagucacagccggacaaggaacaagcgagacauuuaguaugggucuauuaugccuaacacucuuuguagaagaaugucucaggcgaagggucacucggaagcacaugauucuuguuguaguuauaacucuaugcgcgaucauauugggaggcuuaaccuggauggaccuauuacgggcccuaauaauguuaggagauacaaugucugguagaauuggugggcaaauucauuuagcgauaauggccguauuuaaaaugucgccaggguaugucuuagguguauucuuacgaaaauuaaccucgagagagacagcccuuauggucaucgggauggcaaugacaacuguuuuaucgaucccacaugaucuaauggaacucauagauggcauaagccuuggcuuaauuuuauugaaaauagugacacaauucgauaacacccaaguuggaacauuagcgcugucuuugaccuuuauuagaucuacaaugccguuagucauggcuuggcguacuauaauggcaguucucuucguagucacucucauaccacuuuguagaacuucuugucuacaaaaacagagccauuggguagaaauaacagcguugauacuuggagcccaagcucugccuguauauuugaugacacuuaugaaaggugcuagccgucgcuccuggccccuuaaugaagggauaauggcaguaggacuugucagcuuacugggaucagcguuacuaaagaacgaugugccguuagcagggccuaugguagcuggcgguuuauuacuagcagcguacgucaugucagguaguucagcagaucucucauuggaaaaagcugcaaauguacagugggacgagauggcugauauuaccggcagcucuccaauaauagaaguaaaacaagacgaagacggaucauuuucaaucagggauguugaagaaacaaauaugauuacucuacuuguaaaauuggcguugauaacugugucaggauuauauccucuggcuauucccguaacuaugacacucugguacauguggcaagugaagacacaaagaagcggugcacuaugggauguaccaucuccggcggcuacacaaaaagcugcccugagcgaaggugucuaucgaauaaugcagaggggacuguuuggaaaaacacaaguaggcguuggcauucauauggaaggaguauuucauaccauguggcacguaacacguggaucagucauaugucaugagacgggucgguuagaacccucaugggcagacguucgaaaugauaugauuagcuacgggggaggauggcgauugggagacaaaugggacaaagaggaggacguacaaguacuggcaauagagccuggcaagaaucccaaacacguacagaccaaaccaggccuauuuaaaaccuuaacuggugaaauuggagcgguuacacuugauuuuaagccagggacaagugguaguccuauaauaaaccgaaaggggaaggugauaggauuauacggaaacgguguugucaccaaaucaggggacuauguaagugcaauaacgcaggcagaaagaaucggugaaccagacuacgaaguugacgaagauauuuuucggaagaaaaggcuuacaauuauggaucuccauccaggcgcaggcaagacuaagcgaauuuuaccgucaauuguacgagaggcuuuaaaaagacgucuaaggaccuuaauuuuagcaccuacuagggucguagcugcagaaauggaggaagcacugagggguuuaccuauaagguaucaaacgccggcaguuaagagugagcacaccggcagggaaauagucgacuuaaugugccaugcaacuuuuacaacucgccuauuaucgucuacaaggguucccaacuauaaucuaauaguaauggacgaggcacauuucacagacccaagcucgguugcagcaagaggguacauaaguacaagagucgaaaugggggaagcggcggcgauauucaugacugcaacaccaccaggggcuacagauccauucccacaaucaaauuccccuauagaagauauagaaagagaaauacccgagcguagcuggaacacuggauuugauuggauaacugacuaucaaggaaaaacaguaugguuugugccaucuauuaaagcuggaaacgauauugcaaauugcuugagaaaaucuggaaagaaagugauacaacugucaaggaagaccuuugacacggaauauccaaaaacaaaacucaccgacugggauuucgucgugacgacugauaucucagaaaugggugcaaauuucagggccggacggguuauagacccuaggagauguuuaaaaccuguuauacuuaccgauggcccagaaagaguuauacucgcaggcccuauacccguaacacccgcuagugcugcccaaagacguggccgcauuggacgcaauccagcccaagaggacgaucaauauguauuuucgggugauccacucaagaaugaugaagaccacgcucauuggaccgaagcuaaaaugcuacuggauaacauauacacucccgagggaauuauucccacauuguucggaccggaacgugagaagacucaggcuauagacggcgaguuccgacuccgaggugaacaaagaaaaacauucguugaauuaaugagaagaggggaucuaccuguaugguuaucguacaaaguagcuucagccgguauuucauacaaagacagagagugguguuuuacaggagaacgaaacaaucaaauauuagaagaaaauauggagguugaaauauggacuagggaaggcgagaagaagaaacuccggccaaggugguuagaugcuagaguauacgcugaucccauggcgcugaaagauuuuaaagaguucgcaagcggucgaaaaaguaucacauuagauauccuuacugaaauagccaguuuaccuacauauuugucuucgagagcaaaauuggcuuuagacaauauuguaaugcuacacacaaccgaacgagguggacgagcguaucaacacgccuuaaaugaguuaccagagagcuuggaaacacucaugcuuguggcguuacuuggcgcgaugaccgcaggcauauuuuuauucuuuaugcaaggcaagggaauugguaaacucucaaugggacuuauagcgauagcagucgccuccggguuacuaugggucgcggaaauucaaccacaauggaucgcugccaguauaauucuagaguucuuuuuaaugguucuacugauaccggaaccggaaaaacaacgaacaccacaggauaaucaauuaauuuacguaauacuuacuauccucacgaucauuggacuuauugcagcgaaugagaugggacugauugagaaaacuaaaacagauuuuggguuuuaucaaguaaaaacagagacaacaauacuugauguagacuuaagaccggcgagcgcauggacauuguacgcaguugcaaccaccauauuaaccccuaugcuaagacacacgauugaaaauaccagugccaauuuaucacuagcagcaauagcaaaucaagcagcaguuuugauggguuuagguaaagguuggccacuacacagaauggaccucggcgucccccuauuagcaaugggauguuauucccaagugaauccgacgacccuuacggcaucucuuguaauguuacuuguacacuaugcuaucauugguccaggauugcaagcaaaagccacaagagaagcacagaaacguacugcagccgguauuaugaaaaauccgacgguagauggaauaacggucauagaccuagagccaauuucuuaugacccgaaauucgaaaagcaauuaggucaagugauguuacucguuuuaugcgcuggacaacuuuuacuaaugaggaccacuugggcauuuugugaagugcugacacuagcgacgggaccgauuuuaacacucugggaaggaaaccccggaagauuuuggaauacaacaauagcagugagcacugcaaauaucuuccguggaucuuaucuagccggugcugggcuagcauucagcuuaaucaaaaaugcccaaacgccaagaagagguaccgggaccacaggagaaacacucggggaaaaauggaagcggcaauuaaauucauuagacagaaaggaauuugaagaauacaaaagaucaggaauccuagaaguggauaggaccgaagcuaagagcgcauuaaaagacggaucaaaaacuaaacacgccgucaguagaggaaguucaaagauacguuggaucguugagcgagggauggugaaaccuaaagggaaaguugucgaucugggcugcgguagagguggauggagcuauuacauggcuacacucaaaaauguaacagagguaaaagguuauaccaaaggggguccaggucaugaggagccaauacccauggcaacuuauggauggaauuugguuaaacuucauucagggguagacgucuuuuauaaaccuacagagcaaguagauacccuauuaugugacauuggugaaagcucaucgaauccuacuauagaggaagggagaacauuacgaguucugaaaaugguugagccaugguuaaguucgaaaccggaauuuuguaucaaaguuuugaaccccuacaugccuacaguaauagaagaauuagaaaaguugcaacgaaagcacggugggaaucuaguaagauguccacuaucucguaacagcacgcacgaaauguauuggguauccggugcuagcggcaacauugugucuuccgucaauacuacuucaaagauguuacuaaauagauucacaacacggcacagaaaaccgacuuaugaaaaagauguagacuuaggggccgguacacgaagcguuucaacagaaaccgaaaagccagauaugacaauuaucgggagacgauugcaacgguugcaagaagaacauaaagaaaccuggcacuaugaccaggaaaacccuuaucguacaugggcauaucacggaucauaugaagccccgucaaccggaucagcaucgucgaugguaaauggcguaguaaaacuacuaacuaaaccuugggauguuauuccuaugguuacccagcuugcgaugacugauacgacgccauuuggacaacagagaguauuuaaagagaaaguagauacacgcacaccgcaaccaaaaccuggaacuagaaugauuaugacaacaacagccaacugguuaugggcucugcuaggcaagaagaaaaauccucgauuaugcacacgugaagaguucauaaguaaaguaagaucuaaugcagcuauaggagccgucuuccaagaggaacaaggauggacuucugcuucagaagcaguaaacgacagcagauuuugggaacuuguggacaaggaaagagcgcuacaucaggaaggcaaaugcgaaucauguguauauaacaugaugggaaaaagggagaagaaauuaggugaguuuggacgugccaaagguucaagagcuauuugguacaugugguugggugcuagauuuuuggaguucgaagcacuuggauuucugaaugaagaucacugguucggaagagaaaauucauggagugguguagagggagaagggcugcauagacucggauacauacuugaggaaauagacaagaaagauggugaccuuauguacgccgaugauacugcaggcugggauaccaggaucaccgaggaugacuuacaaaacgaagaacuaauuacagaacaaauggccccgcaccauaaaauuuuagcuaaagcaauauuuaaacuuaccuaucaaaauaaagugguaaaaguucuaagaccaacccccagaggugccguaauggauaucauuucucgaaaggaccagagggggucggggcaagucgguacauacggguuaaacaccuucacaaacauggaagugcaauuaaucagacagauggaagcugaaggagucauuacacaagacgauaugcagaauccuaaaggacuaaaagagagggucgaaaaauggcuccgagaauguggaguagauagacuaaaaaggauggcaauaaguggagacgacuguguagucaaaccccuagaugaacguuucggaacgaguuuacuguuucuuaaugauaugggaaaaguacgaaaggacauuccccaaugggagccaagcaagggauggaaaaauuggcaggagguaccguuuugcucccaucauuuccauaaaauauuuaugaaagauggacgcucccuuguggucccaugcaggaaccaagacgaauuaauugggagagcacgaauaagccaaggcgccggcuggucacuuagagagacggcgugucuagggaaggcauacgcucaaaugugguccuugauguacuuucaucgaagggaccuucguuuagcuucaauggcgauauguucagccguaccaacugaaugguuuccuacaagucgaacuacuuggucuauacaugcacaccaccaauggaugacuacggaagacauguuaaaagucuggaauaggguguggauugaagacaauccaaauaugaccgauaaaacaccaauucacucaugggaagauauuccauaucuaggcaaacgugaagacuuguggugcgguagccucauuggcuuaagcagccgagcgacuugggcuaaaaacauacauacagcuauaacacaggugcgcaacuugauagggaaagaggaauacguagacuacaugcccguaaugaaacgauauagugcaccaucagaaagugaagggguacuuuaa

SEQ ID NO: 23610 - RNA, 9867 nt, Artificial Sequence
  derived and/or modified CDS sequence (opt6) from DENV-4__GQ199880__SS-prME
ucgaccauaacccuacuuuguuuaauuccgacgguuauggcauuucaucuuuccacccgagauggcgaaccucuaaugauaguagcaaaacaugaacgaggacgaccuuuacuauucaaaacaaccgaaggcauaaauaaaugcacacugauugcgauggaucuuggagaaaugugugaagacaccguuaccuacaaauguccucuguuaguaaauacagaaccggaagacauugauugcugguguaauuugaccaguacuuggguaauguacggaacuuguacacaaaguggagaaagacgaagggagaaaagaaguguugcacucacaccacacaguggaaugggccuagaaacuagagcggaaaccuggaugucaagcgaaggagcauggaaacaugcccagcgggucgaaucguggauauuacguaacccaggauucgcgcuccucgccggguucauggcauacaugaucgggcaaacagggauucaacgaacgguuuucuuuguauugaugaugcugguagcaccuaguuacgguaugagauguguaggaguggguaacagagauuuugucgaaggcguaagcggaggagcuuggguagauuuaguccuagaacauggcgggugcgugacgacuauggcacagggaaaacccacacuugacuuugaauuaacuaaaacaacagcaaaagaaguagcacuuuuacggaccuacuguauagaagccaguauaucaaacauaacaacugcuacgagauguccuacucaaggcgaaccuuaccuuaaagaagaacaagaucaacaauauaucugcaggagagacguaguagauaggggaugggggaauggauguggacuauuugggaagggugguguugugacaugugcuaaauuuucguguucaggaaagauaacggguaaccuaguacagauagaaaaccucgaauauacuguuguaguaacagugcauaacggugacacccaugcugugggaaacgacacgucaaaucauggagucacagcaacuauuacaccacguucucccucuguagaaguaaaacuaccugauuauggagaacucacauuagacugugaaccgcguuccggaaucgauuucaacgaaaugauacucaugaagaugaagaagaaaacuuggcuuguucauaaacaaugguucuuagaucuaccauuaccauggacugcuggagcugauacaagugaaguacacuggaacuauaaggaacguaugguaacuuuuaaaguaccgcaugcaaagagacaagauguuacuguacuaggaucacaggaaggugcgaugcauagcgcacuugcgggggcaacugaaguagauuccggagauggaaaucauauguucgcuggacaucucaaauguaagguacgcauggaaaaacuaagaauuaaaggcaugaguuauacaauguguucugguaaauucagcauagauaaagaaauggccgaaacucaacacggaacaacggucguaaaggugaaauaugaaggggcgggugcuccauguaagguaccaauagaaauaagagacgucaauaaagaaaaaguaguggggagaguaauuucuagcacgccguuggcugaaaacacaaauucagucacaaacauugaacuagaaccacccuucggagacaguuauauaguaauaggaguagguaacuccgcacuaacauuacauugguucaggaaaggaaguaguauagguaaaauguucgagucuacguauagaggcgcaaagcgaauggcgauacuuggagagaccgcaugggauuuuggaaguguugguggacuguuuacuucccuuggaaaagcgguucaucaggucuuuggaucaguguauacuacuauguuuggagguguaucauggaugauaaggauauuaauaggguuccuuguacuguggaucggaacaaacaguagaaauacaaguauggcaaugacuugcauagcgguagguggaauaaccuuauucuuaggcuuuacugugcaagcugauauggguugcgucguaucuugguccggaagagaacuaaagugcggcucaggaauauuugugguagauaacguacauacauggacagaacaauacaaauuucaaccagagagcccugcucgguuagccucggcuauacuaaaugcccacaaggauggcguauguggaauaagaucgacuacccgucuugaaaacgucauguggaaacagauaacgaaugaacuaaauuauguccuuugggaagggggacaugaccuaaccgucguggcaggggaugugaaggguguauuaaccaaagguaagagagcuuuaacaccaccgguuuccgacuugaaguauaguuggaaaacuugggguaaagccaaaauuuuuacuccugaagcaagaaacucaaccuuccuaaucgaugggccagauacuagcgaauguccuaaugaaaggagagcauggaacucucuugaaguugaagauuacggcuucgguauguuuacuacuaauauauggaugaaauucagggagggauccagugaaguuugcgaucaccgacuaaugucggcagcaauaaaagaucaaaaggcgguccaugcugauaugggauacuggauagaaucguccaagaaccaaacguggcaaauugagaaggccaguuuaauugagguuaaaacaugccucuggccgaaaacucacacuuuaugguccaaugguguacuagaaucacaaauguuaauaccaaaaaguuacgcagggccguuuucucagcacaauuaucgacaggguuaugcgacucagacaguaggaccguggcauuuggguaaauuagaaauugacuuuggugaauguccaggaacaacgguaacaauccaagaagacugcgaucacagagguccaucccuacggacaacaacugcaucagggaaguuagugacacaauggugcugucgaucauguacaaugccgccccuccgauuucuaggggaggauggauguugguacggaauggaaauaagaccauugaaugaaaaagaagaaaauauggucaaaucgcaaguaacugcggggcaagguacaucagaaacauucuccaugggcuuacuguguuuaacuuuauuuguugaagaaugucuccgacgaagaguaacacguaaacacaugauauuagugguaguaauuacccugugugccaucauucuagggggccugacguggauggacuuauugagagcuuuaauuaugcuaggggauacaaugagcgggagaauaggaggucagauacacuuagcaauuauggcuguuuuuaaaaugucaccaggauauguauuaggaguauuccuaaggaaguugacaaguagggaaacugcgcugauggugaucggaauggccaugacuacaguuuuaucuauaccgcaugaucuaauggaauuaauagaugguauuagucuaggccuaauucuccuaaaaauaguaacccaauucgacaauacgcaagugggaacuuuagcccuaucguuaacauuuaucagaucaacaaugccauuaguaauggcauggagaacaauuauggcgguacucuuuguuguaacacugauaccccuaugcagaacuuccugucuacagaaacagagucacuggguugaaauuacugcucuuauacuaggagcgcaagcauuaccuguauacuuaaugacguuaaugaagggugccucaaggagguccuggccacugaaugaaggaauuauggcaguaggacuuguaucucuacuugguagcgcccuacuuaaaaaugauguaccacuagcaggaccgaugguagcuggaggucuccuucuggcagcauacguaaugucagguucaucggcagauuuaucacuagaaaaagcggccaaugugcaaugggacgagauggcggauauaacgggcaguuccccgauuauagaaguaaaacaagaugaggacggcaguuuuucuauaagggacguggaagaaacuaauaugauaacucuucucguuaagcuggcauugaucacaguaucuggacucuauccccuagcuauccccguaaccaugacuuuaugguacauguggcaggucaaaacacaacgaucaggugcuuugugggaugugccaaguccggccgcaacacaaaaagcagcauuaucggagggcgucuauagaauaaugcaaagagggcucuuuggcaaaacacaaguuggcguuggaauacacauggaaggaguauuccacacaauguggcacguaacaagaggcagugucauuugccacgaaacuggaagguuggagccaucaugggcagauguacguaacgauaugauaucguacggaggagguuggagacucggggauaagugggauaaggaagaagacguucaagugcuagccauagaaccuggcaaaaacccgaaacacgugcagacgaagccuggacuuuuuaaaacuuuaacaggcgaaauuggagcaguuacucuagacuuuaaaccugggacuucuggcagucccauaauaaacagaaaagguaagguaauuggguuguauggaaacggaguaguaacgaaaagcggcgacuauguaucagcgauaacccaagccgaacguauuggugagccggacuacgagguagaugaggacauuuucaggaagaaacgguuaacgaucauggaucuccaccccggcgcugguaaaacgaagcguauccuuccgaguauaguacgagaagcucuuaaacgucgguuaagaacgcuaauacuggccccaacuagggugguagcugcggaaauggaggaagcacuuaggggucuaccuauaagguaccaaaccccggcaguuaagagugaacauaccggaagagaaauaguggacuuaaugugccacgcuacauuuaccacacgccuauuaucuucaacaagaguuccgaauuacaaccuaauuguuauggaugaggcgcacuucacggacccaaguucagucgccgcaagaggauauaucucaacacgaguugaaaugggagaagcagcggcaauuuucaugacugcaaccccacccggagcuacggauccauuuccacaaucuaacucaccaauagaagauauagaaagggaaauuccagaacgcucguggaauacaggauuugauuggauuacagacuaucagggaaagacuguaugguuuguacccagcauaaaagcaggaaaugauaucgccaauuguuugagaaaaagugguaaaaagguaauacaauuaagccguaagaccuuugacacagaauauccuaaaacaaaacuaacagacugggacuucgugguuacaaccgauauuucggaaaugggcgcaaauuuccgagccggcagaguuaucgacccuagacgaugcuuaaagccuguuaucuuaacugauggaccggagagagucauucuagccggcccaaucccagugacccccgcaucugccgcccaaagacgaggccggauagguagaaacccagcucaagaagaugaucaauauguuuucucuggugauccccucaaaaaugacgaagaucacgcccauuggacggaggcuaaaauguugcuagauaacauuuauacaccagagggaauuauacccacacuuuucggcccagaaagggaaaagacccaagccauagacggagaauuuagacuuaggggagaacaaaggaaaacguuugucgaacugaugagacgcggcgacuuaccuguguggcuaagcuacaaagucgcaagcgccgguauuucuuauaaagaucgcgaaugguguuuuaccggggagaggaauaaucaaauacuagaagagaacauggagguagaaauauggacacgagaaggugagaagaagaaauuacguccucguuggcuugaugcccgaguauacgcggauccaauggcgcucaaagacuucaaagaauuugcuuccggaaggaaaucaauaacacuugauauauuaacagagauagcuucucuaccuacuuauuugucgagccgcgcuaaauuagcacucgacaauauuguaauguuacacacaacagagaggggcggacgagcuuaucagcaugcuuugaacgaacuacccgaaucuuuggaaacuuuaauguugguagcucuccuuggagcaaugacagcaggcauuuuucuauucuucaugcaaggcaaaggcauaggaaaguuaucgaugggguuaauagccauugcgguagcauccgguuuauuauggguagcugagauccagccucaguggaucgcagccucaauuauucuggaguucuuccuaaugguucuccuaauaccagaaccggaaaagcaaaggacuccccaggauaaccaacuuauauaugucauuuuaacgauucucacuauaauaggucucauugccgcuaacgagaugggucuaauagagaaaacgaaaaccgacuuuggcuuuuaccaaguuaagacagaaacgaccauccuugacguagaccugagacccgcuagugccuggacucuauacgcagucgcaacuacaauucuuacaccuaugcuucgacauacuauagaaaacaccagugcaaacuuaagucuagcagcaauagcuaaucaagcagcaguacugauggguuuggguaagggguggccauuacauagaauggacuuaggcguaccuuuacuagcaauggguugcuauucccaagugaacccuacuacucucacggcaucacuugugaugcuauuaguucauuacgcgauaauagggccugguuuacaagcgaaagcgacgagggaagcccagaaacguacugcugcagguaucaugaaaaauccaacagucgaugguaucacugugauugaucuugaaccaauaagcuaugacccgaaguucgagaaacaguuaggacagguuauguugcuaguacuuugcgcaggacaacuacuuuuaaugaggacuacgugggccuuuugugagguucuaacauuagcaacugggccgauauugacacucugggagggaaacccaggaagauucuggaauaccacuauugcuguuucuacagccaauauauucagagggucauaucuagcuggagcuggauuggccuuuucucuaaucaaaaaugcucaaacaccucgcagagggacuggaacuacuggagaaacccuaggagaaaaguggaaaaggcaauuaaauucacuugaucguaaggaauuugaggaauacaaacguucggguauauuagaaguugacagaacagaagcaaaaagugcauugaaagauggcuccaaaacaaaacacgcuguuuccaggggaucgagcaagaucagauggauaguagaaagaggaaugguuaaaccaaaaggcaagguaguugaucucggcugcgggcguggcggauggaguuacuauauggcgacauugaaaaaugucacugaaguuaaagguuacaccaagggagguccaggacacgaggaaccaauaccaauggcuaccuauggcuggaacuuagucaaacuacauuccggaguagacgucuuuuauaaaccgacggaacaaguugauacauuauuaugcgauauaggggaguccucauccaacccaacaauagaagaaggacgcacguuacgaguacugaagaugguagagccuuggcuaaguaguaagccugaguucuguauaaaaguauuaaaccccuauaugccaacaguaauagaagaacuugaaaaacuacaacguaaacauggaggaaacuuaguccggugcccucucaguagaaacucaacacaugaaauguacuggguaucaggugcuucggguaacaucguuaguucugucaacacaaccagcaaaaugcuacuaaauagauucaccacuagacacagaaaaccaacguacgaaaaagaugucgauuugggagcgggaacgcggucuguuagcacggaaacugaaaaaccagacaugacuauaaucggaagacgguuacaaagguugcaagaggaacauaaagagaccuggcauuaugaucaggagaacccauauagaacaugggcauaccacgguucuuacgaagcgccaucaacaggaucagcaaguuccauggucaacggaguaguaaaauuauuaacaaaaccaugggaugugaucccgaugguuacacaauuagcaaugacagacaccacacccuucggccaacaaagagucuucaaagaaaagguugacacacggaccccacagcccaagccugggacaaggaugauuaugacuaccacugccaauugguugugggcucuguuaggcaaaaagaaaaauccgaggcuaugcacaagagaggaguucauuucuaaagucagaucaaaugccgcgaucggagcuguauuucaggaagaacaaggauggacaagugcuagcgaagccguuaacgacucgagguucugggaacuuguugacaaagaaagagcucugcaucaagaaggaaaaugcgaaaguugcguauauaauaugaugggaaaaagagagaagaaacuaggagaguucggccgugccaaaggauccagagcaauaugguauauguggcuaggggcccgauucuuagaauuugaggcuuugggauuucuaaacgaggaucacugguuuggaagagagaacuccuggaguggaguugaaggugaaggauuacaucgguuaggcuauauccuugaagaaauagauaaaaaggauggagaucuaauguaugcagaugauacagcuggaugggauacacgaauaacugaggacgaucuacaaaaugaggaguuaauuacagaacaaauggcaccucaccauaaaauuuuggcaaaagcuauauuuaagcuaacauaucaaaauaaaguaguuaagguauuaaggccaacaccccgaggagccguaauggacauaauaagucguaaagaucaaagggguucaggucagguuggaacauauggcuuaaauacuuucacuaacauggaaguccaacuaauucgccaaauggaggcagagggagugauaacucaagaugacaugcaaaauccuaagggucuuaaagaaagaguagagaaaugguuaagagaauguggcguagauagauuaaaaaggauggcuauaucgggugaugauuguguugugaaaccccuggaugaacgauucgggacuucgcuauuauuucuuaacgauaugggaaaaguacggaaggauauuccccaaugggaacccucaaagggauggaaaaauuggcaagaaguuccauuuuguagccaucauuuccauaaaaucuucaugaaagacggaagaucccuuguuguaccauguagaaaccaagaugaauuaauagguagagcccguaucucacaaggugcaggauggaguuuacgcgaaaccgcuugcuuaggaaaggcauacgcgcaaauguggucucuaauguacuuccaucguagggaucuacgguuggccucuauggcaauauguuccgcaguaccaacggaaugguucccgacuucacgcacaacguggaguauacaugcccaucaccaguggaugaccacagaagacauguuaaaagucuggaauaggguauggauagaagauaauccaaauaugacggacaaaaccccuauacauaguugggaagacauuccguacuugggaaaacgagaagaccuaugguguggaaguuugauaggacucagcagcagagccacgugggcuaaaaacauacacacugcuauuacgcagguaaggaaucugaucggcaaagaggaguacguagauuacaugccaguaaugaagcgauauuccgcuccaagcgagagugagggcguacuuuaa

SEQ ID NO: 23611 - RNA, 9867 nt, Artificial Sequence
  derived and/or modified CDS sequence (opt6) from DENV-4__GQ252675__SS-prME
ucaacuauaacuuuacuaugucucauaccuacuguuauggcuuuccaucucucuacacgagauggcgaaccgcuaaugaucguugcaaaacacgaacgugguaggccucuauuguuuaaaacuacugaaggaauaaacaaaugcacauuaauugcaauggaucuuggggaaaugugcgaagauacagugacauacaaauguccauuauugguuaauacggaaccagaagacauagacugcugguguaaucugaccucaacauggguaauguauggaacuuguacgcagucuggugaacgaagaagagagaaaaggagcguggcgcuaacaccccauucagguauggguuuagaaacccgagccgaaacauggaugucaagugaaggggccuggaaacacgcacaacgaguugaauccuggauucuaagaaaccccgguuuugcauuauuggcuggcuuuauggcauauaugaucggucagacaggaauacaaaggacaguauuuuucguacuuaugaugcugguagcaccgagcuacgggaugagauguguagggguuggcaauagagauuuugucgaagguguaucagguggugcauggguagaccucguacuggaacacggugguuguguuacaacuauggcacaggguaaaccgacguuagacuuugaauuaacaaaaacaacugccaaagaaguugcucuguuacguacguauugcauagaagccagcauaagcaauauuacgaccgcaacgagguguccgacacaaggugaaccauaucucaaagaagaacaagaccagcaguauauauguagaagagauguaguugauaggggaugggguaauggcugugggcuauucgggaaaggcggaguuguaacuugugcuaaauucagcugcagugguaaaaucacagguaauuuaguucaaaucgaaaaucuagaauacaccguaguagugacgguccacaauggcgacacacaugccguaggaaaugauacaaguaaucacggggucacagccacaauuacgccaagaucgccaaguguagaaguuaaauugcccgauuauggagaacuaacacuagauugcgaaccaagaucaggcauugacuucaaugaaaugauacucaugaaaaugaaaaagaaaacguggcucgugcacaaacaaugguucuuagauuuaccccuaccauggacugcgggugcugacacgucagaagugcauuggaacuauaaagaaagaauggugacuuuuaaaguuccacaugccaagagacaggauguuacaguauuagggucccaggaaggagccaugcacucagcacuugcaggcgccacagaagucgauagcggagauggcaaucauauguuugcuggacauuuaaaauguaaaauuaggauggagaaacuaagaauaaaaggaaugucguacacuauguguagugguaaauuuucuauugacaaggagauggcggaaacucagcacggaacaacaguaguaaagguaaaauacgaaggagcaggagcuccaugcaagguuccuauagaaauuagggauguaaacaaagaaaagguagugggacgcguaauaaguucaacaccacucgcugaaaacacaaauaguguaacuaacauagaguuagaaccacccuuuggagauucguacauaguaauuggugugggaaauucagcuuugacuuuacacugguucagaaaaggcucaaguauaggaaaaauguuugaauccacauauagaggagccaagcgcauggcgauacugggcgaaacggcaugggauuucgguucaguaggcggacuuuucacaucuuuagguaaggcgguucaucaaguguuuggaucaguauacaccacgauguuuggaggcguaucuuggaugauacgaauacuuaucggcuuccuaguccuuuggauuggaacuaacucuagaaacaccucaauggccaugacuugcauugcaguagggggaauaacguuguuuuugggcuuuacgguacaagcugauaugggcugcguggucucuuggucgggacgggaacugaagugcggcucaggaauuuucgucguggauaauguacauacauggacggaacaauauaaauuccaaccagaaucuccagcucgccuagccucugcaauucucaacgcacacaaggaugguguuugcggcauaaggagcacaacuagauuagaaaacguaauguggaaacagauuacaaacgaacuaaacuauguauuaugggaaggcggacacgauuugacaguagucgcuggggacguaaaagguguacugaccaaggggaagcgugcacuuacaccucccguuucugaccuuaaguauaguuggaaaacaugggguaaagcaaaaauauuuacaccagaggcuaggaacaguacauuccuaauagacgguccugauacuucagaaugcccaaaugagagacgagcauggaauaguuuagaaguggaagacuacggcuucggaauguuuacaacaaauaucuggaugaaauuccgugaaggauccucagaagucugugaucacagacuuaugucagcagcuauaaaagaucaaaaagcuguucaugcugauauggguuauuggauugaaucgucgaaaaaucagacguggcaaauugaaaaggcaucuuugauagaaguaaaaacaugucucuggccaaagacucacaccuuauggagcaaugguguccucgagucccaaaugcuuauaccuaaaucauaugcaggaccauucucccaacauaacuaccgucaaggauaugcaacucaaacgguaggaccauggcaucuuggaaaacuugaaauugauuucggagaaugcccugggacgacggugacgauccaagaggauugugaccaccgaggaccaagucuacgaacaacaacagcauccggaaaauuaguaacgcaaugguguugcagaaguugcacaaugccuccgcuaagauucuuaggagaagacgggugcugguaugguauggaaauaagaccacugaaugaaaaggaggaaaauaugguaaaaagucagguaacagcaggacaaggaaccuccgagacauucucaaugggacuacuuugucucacccuauucguugaggagugccuaagacgcagaguaacgagaaagcauaugaugcuuguagucguaauuacucugugugcuauaauacuaggugggcuuacauggauggaucuccucagagcguuaauaaugcuaggggauacuaugagugggagaauaggaggucaaauccauuuagcaaucauggcuguauucaaaauguccccuggguacguacuaggaguguuucugagaaaacuaacaucuagagaaacagcacuaauggucaucggaauggcaaugaccacaguuuuaucgauaccccaugauuuaauggaacuaauagaugggauaagccugggauuaauuuuacuaaagacugucacacaauuugauaacacucagguuggaacauuagcccuuucuuuaacauuuauaagaucaacaaugccuuuaguaauggcauggcgaacgauaauggcaguucuuuucgucguaacucuuauaccacuuugcagaacaaguuguuuacaaaaacaaucgcauuggguagaaauaacagcauugauucucggugcacaagcacuuccugucuauuuaaugacacuaaugaaaggcgcuaguagacguaguuggccucuuaaugaaggaauaauggcgguaggucuugugucucuauuagggagugcuuuauuaaagaaugauguaccccuagcugguccuaugguugcaggaggguuauuauuagccgcauacguuaugucugguucuucagcugacuuaucucucgaaaaagcugcaaacguccaaugggaugaaauggcugauauuacaggcaguaguccaauaauugaaguaaaacaggacgaggauggaaguuucuccauacgggacgucgaagaaaccaauaugaucacucuuuuaguaaaacuugcauuaauuacggugucaggcuuauacccucuugcgauaccggugaccaugacauugugguauauguggcaaguaaaaacacaacgaaguggagcguuaugggauguacccucgccugcagcaacucagaaagcggcucuaagcgaagguguauacagaaucaugcaaagggguuuauuuggaaaaacacaaguaggcguaggcauacauauggaaggaguguuccauacgauguggcauguuacgcgggguagcguaauaugccacgaaacagggagauuagagccguccugggcugacguccgaaacgauaugaucucauaugguggaggauggcgauuaggugauaaaugggacaaagaggaggauguacaaguacuggcaauagaaccagguaagaacccaaagcauguucagacuaaaccaggacuauucaaaacgcuaacaggugaaauuggagcagucacauuggauuuuaaaccagguacaaguggaucgccaauaaucaacaagaaaggaaaaguaauugguuuauauggaaaugguguagucacuaagagcggagacuacgucucagcgaucacacaagcggagcgcauaggugaaccagauuacgaagucgaugaagauauauuccguaagaaacgacucacuaucauggaucugcauccuggugcagggaaaaccaagcguauacugccaagcauaguaagagaagcguuaaaaagaagguuaagaacccucauauuagcuccaacaagagugguagcagccgaaauggaagaggcccugagaggacuuccgauaagauaucaaacuccugcuguaaagucagaacacacgggaagagaaauaguagauuugaugugccaugccaccuuuacgacuagauuacuaucaucaacaagaguuccuaacuauaaucuaaucgugauggaugaagcccauuucacugacccaucuagugucgcagcaagaggauauauaucaacgcgaguggaaaugggugaagccgcggcuauauuuaugacggccacgccuccuggugccacagauccauucccacaaagcaacucuccuauagaggauauagaaagagagauaccugaaaggaguuggaauacgggguucgauuggaucacggacuaucaggggaagaccguuugguucgugccaucuauaaaagcuggaaaugauauugccaauugucuaagaaaaagcggcaagaaagugauccagcuaucaagaaaaacuuuugacacugaauauccaaagaccaaauuaacagauugggauuuuguugucacaacagacauaagcgaaaugggcgcaaacuucagagcaggacggguaauugauccuagacggugucuuaagccagugauucugacugaugggccagagagaguuauacuggcuggccccauucccguuacgccagccagcgcugcucaacgcagagguaggauaggaagaaauccggcucaagaagacgaucaauauguauucaguggugauccgcugaaaaaugaugaggaucaugcgcacuggacugaagcuaaaaugcuacuagacaauauauacacaccagaagggauaauaccuacuuuauucggcccagagagggagaagacccaagcaauugauggcgaguuccgucugagaggagaacagagaaaaacguuuguggagcuuaugcgucgaggagaccuaccaguguggcucucauacaaaguagcaagcgcgggcauaucauauaaagauagggaguggugcuuuacaggagaacguaauaaucagaucuuggaagaaaauauggaaguagagauuuggacacgugaaggggagaagaagaaauugagaccaaggugguuggaugcucgaguguaugccgauccuauggccuuaaaagauuuuaaagaauuugcgagugguagaaaaucaaucacuuuggauauacuuacagagauagcuucucuaccaacauacuuaucuagccgggcaaaacuugcacuugacaauauaguuauguuacauacgacggaacgcggaggacgcgccuaucaacacgcucucaacgaacuaccagaaagccuagaaacucuuauguuaguagcgcuauuaggggcuaugacugcgggcauauuuuuauucuuuaugcagggaaaagguaucgguaaacuguccaugggacuuauagcuauugcaguugcuagcggacuucuauggguagcagaaauucagccacaauggaucgcugcaucaauuauacuugaguucuuucugaugguauuauuaauaccagaaccugagaagcaacguacaccacaagauaaucaguugaucuaugugauccuaacuauacugacuauaauaggucugauugccgcuaacgaaaugggcuuaauagagaaaacaaagacggauuucggauuuuaccaaguaaaaacugagacuacaauccucgauguugauuuacgaccagcuagugcauggacccuauaugcugucgcgaccacaauauuaaccccaaugcuacgacauacuauugaaaauacuucagcgaaucuaaguuuagcggccaucgcaaaccaggccgcgguauuaaugggucucggaaaggguuggccauuacaucgcauggaucuuggaguaccuuuguuagcgauggggugcuauucccaagugaaucccacaaccuugaccgccagucugguaauguuauuaguucauuacgcuaucaucgguccaggucuucaagcuaaggcaaccagggaggcucagaaacgaacggccgcaggcauaaugaaaaauccuacuguagauggaauaaccgugauagaucuugagccgauaaguuaugacccaaaauuugaaaaacaauuaggacagguaaugcuccuaguacugugugcaggucaguuacuuuugaugcgcaccacuugggcuuucugugaaguacuaacacuugcaacuggcccuauucuuacgcucugggaagguaacccgggcagguuuuggaauacaacgaucgcgguuucuacugcaaauauuuuuagagguucuuaccuagcaggcgcaggucuagcauuuuccuuaaucaaaaaugcacaaacaccccggagagguacuggaacgacaggggaaacucuuggagaaaaauggaaaaggcaacuaaacagccuggauaggaaagaguucgaagaauacaaaagaucuggaauauuagaaguagaucguaccgaggcgaagucagcauuaaaagaugguucaaaaaccaaacaugcaguuuccagggguaguuccaagauaagguggaucguagaacgaggaauggugaagcccaaagggaaggugguagaucuagggugugggaggggaggcuggucuuacuauauggcgacccuuaaaaauguaacagagguaaaaggguauacaaaggguggcccaggacaugaagaaccaauuccaauggcgacuuacggguggaaccuaguaaaacuacacagcgguguggacguauuuuacaaaccaacugaacaaguagauacgcuccuaugcgacaucggugaguccucuuccaaucccacaaucgaagaggguagaacucugaggguacuaaagauggucgaacccugguugagcucaaaaccagaauuuugcauaaaaguacugaacccguacaugccaacgguaaucgaagaacuagaaaaauugcagagaaagcauggggguaacuuaguucguuguccacuaucaaggaacaguacacacgagauguacugggucucaggggcauccggaaauauaguauccagcguuaauacuacgagcaaaauguuacuaaacagguucacaacaagacacagaaagccgacauaugaaaaagacguggauuugggggcaggaacgcguagugugagcacggaaaccgaaaaaccagauaugacuauaauaggacgucggcugcagagauuacaggaagaacacaaagaaacauggcacuaugaucaagaaaauccuuauaggacaugggcuuaucacggaaguuaugaagcacccagcaccggaucagccaguaguaugguaaacgguguuguuaaauuacucacuaaaccgugggauguuauaccuaugguaacacaauuagcuaugacggacacuacaccuuuuggccaacaacguguauucaaagaaaaaguugacacgcgaacgccacaaccuaaaccuggaacaagaaugauaaugacaacaacagcgaacugguuaugggcgcugcuuggcaagaagaaaaacccucgccucuguacgcgugaagaguucaucucuaaaguuaggagcaaugcagcuaucggagcaguauuccaagaggaacaaggauggacaucugccucagaagcaguaaacgauagcagguuuugggagcuuguugacaaggaaagggcauuacaucaagaagguaaaugcgaaaguugcgucuauaauaugaugggaaagagagaaaagaaacuaggagaauuuggaagggcuaaaggcucacgugcaaucugguauaugugguugggagcgcgcuuucuugaguuugaagcacuuggcuuucucaaugaagaccauugguuuggccgugaaaacagcugguccgguguggaaggagagggucuucacaggcugggguauauucuagaggaaauagauaagaaagacggggaucuuauguacgcugaugauacagcugggugggacacgaggauuacugaagaugacuuacaaaaugaagaacuaaucacugaacaaauggcaccacaucauaaaauuuuagcgaaagcgauauucaaacuaaccuaucaaaauaaagucguuaagguucugagaccgacaccgagaggagcgguuauggacauaauuucccggaaggaucaaaggggcaguggacagguuggaacuuacggguuaaacacguuuacaaacauggaaguucaauuaauacgacagauggaggcagaaggaguaauaacacaagaugauaugcaaaacccaaaaggccucaaagagagaguagaaaaaugguuaagggaauguggcguagauagauuaaagagaauggccauaucaggugacgacuguguagugaaaccauuggacgaacgauucgguacaagccuucuauuccuuaacgauaugggcaaaguaaggaaggacauaccgcaaugggaaccuaguaaaggguggaaaaacuggcaagaagugcccuucugcagccaucacuuucauaaaauauuuaugaaagacggaagaaguuuagucguuccauguagaaaucaagacgagcuaaucgggagagcaaggauaucucaaggugcaggguggagccuacgcgagacggcuugucugggaaaagccuaugcgcaaauguggagcuugauguauuuucacagaagagaucuuaggcuugcaucaauggcuauauguagcgccguaccuaccgaaugguuuccgacaucaagaacuaccuggucuauacacgcacaucaucaauggaugacaacagaagacaugcugaaaguuuggaaccgaguauggauugaagacaacccaaauaugacugacaaaacacccauacauaguugggaagacauaccauaucucgggaagcgcgaagauuuauggugcgguagucuuauugggcuuucaagccgugccaccugggcaaagaacauccauaccgcaauaacucaggucaggaauuuaauaggaaaagaagaauacguugauuauaugccagucaugaaaagauacagugcaccguccgaaagugaaggaguauuauaa

SEQ ID NO: 23612 - RNA, 9867 nt, Artificial Sequence
  derived and/or modified CDS sequence (opt6) from DENV-4__FJ810417__SS-prME
ucgacgauuacgcuacuuugccuaauaccaaccguuauggcauuccaccuaucaacgagggauggggagccgcuuaugauagucgcgaaacaugagcgaggacgaccguuacuguucaaaacuacugaagguauuaacaaauguacucugaucgccauggacuuaggagagaugugugaggauaccguaacuuacaaauguccauuauuaguaaacacugaaccagaggauauagacugcuggugcaauuuaaccaguaccuggguuauguauggaacaugcacacaaaguggagagaggaggagagaaaaacguucaguugcacuaacuccgcacagcggaaugggcuuagaaacgcgagcagagacguggaugucaagugagggugccuggaaacacgcacaaagaguggaaucuuggauuuuaaggaacccugguuuugcuuugcuagcuggauuuauggcauacaugauaggacaaaccggaauacaaagaaccgucuucuucguguugaugaugcuaguagcuccaucuuauggaaugcggugcgucggcguagggaaccgagauuuuguugagggagugaguggaggugcauggguagauuuaguccuugaacauggaggcugugucaccacaauggcucaaggaaaaccaacacucgacuuugaguuaacaaaaacuacagcaaaagaaguagcucuauuacgaaccuacuguauugaagcaucaauaucgaacaucacgacggcuacaagauguccgacgcaaggugagcccuacuuaaaggaagaacaagaccaacaauauauaugccggagggacguaguugacaggggauggggaaaugggugcggucuauuuggaaaaggggguguagucacgugugcgaaguuuaguuguucuggaaaaauaaccgguaaccuuguucagauagagaauuuggaauauaccguaguuguuacaguucauaacggugauacgcaugcuguaggaaacgacacuucaaaucauggagugacagcaacuauuacaccucguagucccuccgucgaaguaaaacugccugauuacggugagcugacacucgauugugaaccgcggagugggauagacuuuaacgagaugauauugaugaaaaugaaaaagaagacgugguuaguacacaagcaaugguuccuagauuuaccgcucccauggacagcaggagcagauacaagcgagguacauuggaacuacaaggaaagaaugguaacauuuaaggucccucacgcgaagcgacaagauguaaccgucuuagguucacaagaaggugcaaugcauuccgcgcuagccggcgcuacagaaguugacucgggugaugggaaucacauguuugccgggcauuuaaaauguaaaguacgaauggagaaauugcgaauaaaagguaugagcuacaccaugugcucagguaaauuuucgauagauaaggaaauggcagaaacacaacaugguaccacagugguaaaaguaaaauaugaaggagcgggcgcgccuugcaaggucccaauagagauuagagacguuaacaaagaaaagguagucggaagagucaucagcucuauaccucuugcagaaaauaccaauucaguuacaaauauagaauuagaaccuccuuucggggauaguuauauagugauaggaguuggaaauagugcuuuaacucuucacugguuuagaaaaggaaguaguauuggaaagauguuugaauccacauauagaggagcuaagcgaauggcgauauuaggggaaaccgccugggacuuuggguccguaggugggcuauuuacuucucuaggaaaagcuguacaucaaguauuugggucagucuauaccacuauguuuggagggguaucuuggaugauucgcauacucauagguuucuuaguguuauggauugguacaaauaguagaaauacaaguauggcaaugacuuguauagcaguagguggaaucacccuuuucuuggguuucacggugcaagcugauaugggaugugugguuucuuggucgggacgagaauuaaagugugguucagggauauuuguuguugauaacgugcauacguggacagaacaguauaaguuucaaccggaaucucccgccaggcuagcuagcgcaauacuaaaugcacauaaagaugguguaugcgggauucguaguacaacacguuuagaaaauguaauguggaaacaaauaaccaaugaauuaaacuacgugcuaugggaaggaggccacgauuuaacuguuguggccggugauguuaaaggaguucuuacaaaaggcaaacgagcguuaacaccaccgguuucggaucuaaaauauaguuggaaaacauggggaaaagcgaaaauauuuacuccugaagcuagaaauucuacauuuuugauagacgggcccgacacaagcgaaugucccaacgaacguagggcguggaauagucucgaaguggaagacuaugguuucggaauguuuacaacaaauaucuggaugaaguucagagaggguuccucggaagugugcgaucaccguuuaaugagcgccgccauaaaagaccaaaaagcgguccaugccgauaugggauauuggauagaaucuucaaagaaucaaacauggcaaauugaaaaagcauccuuaauugaggugaaaacauguuuauggccuaaaacucacacgcucuggucuaauggcguguuggaaucgcagaugcuaauaccaaaauccuacgcgggaccauucucucagcauaauuaccgucaaggcuaugcuacgcaaaccguuggcccuuggcaucuugggaaauuggaaauagauuuuggcgaauguccaggcacuacaguuacaauucaggaggacugcgaucacagaggaccgucacuuagaacaacaacagcauccggaaaacugguuacucaaugguguugucgcucuuguacgaugccuccauugagauuucugggagaagacggauguugguauggcauggaaauuagaccucuaaaugagaaagaagaaaauauggucaagucgcagguuacagcaggucaggggacgagugaaacguucaguauggguuuauugugucuuacgcucuuuguagaagaaugucuacguagacgaguuacacguaagcacaugaucuuaguugugguaauaacguuaugcgcaauaauuuugggcggacucaccuggauggaucuucuacgcgcucuaauaaugcugggagauacaaugucgggaagaauugggggacaaauacauuuagcgauaauggcagucuuuaaaaugagcccagguuauguucuaggagucuuucuaagaaaacucacaagucgagaaacugcacuuaugguaauagggauggccaugacaaccguacuguccaucccccaugaucuuauggaacuaauagacgguauaagccuaggacuuaucuuguuaaaaauagucacgcaauuugacaauacacaagugggaacguuggcguugaguuugacuuucauccguucaacaaugccacucguuauggccuggcgcacaaucauggccguacucuuuguaguaaccuugaucccuuuaugucguacaaguugcuuacaaaagcaaucgcauuggguugaaaucacagcccuaauacugggagcucaggcauuaccgguuuacuugaugacacucaugaaaggugcaagucgacguaguuggccauuaaacgaagguauaauggcaguagggcuggucuccuuacuugguagugcauuguuaaagaaugauguaccacuugcugggccaaugguggcaggaggucuucuuuuagcagcuuacguaaugaguggaaguuccgcugaucuaucacuagaaaaagcugcuaauguacaaugggaugaaauggcagauauaacuggcucauccccuauuauagaaguaaaacaagaugaggaugguucuuuuucuauaagagaugucgaggaaacaaauaugauaacucuauuaguaaaauuggcacuuauuacagucucaggccuauacccucuagcuauacccgucaccaugacacugugguacauguggcaaguuaaaacacaaagaagcggugcucugugggauguaccaaguccggcugcuacgcaaaaagcggcacuuagcgaggguguuuaccggaucaugcaacggggacuuuucggcaagacacaaguagguguggguauucauauggaaggaguuuuucauacgauguggcacguaaccagaggaucaguuauuugccacgaaacaggucgccuggaaccauccugggcagacguuagaaacgauaugauauccuacggcggcggguggagacucggagacaaaugggacaaagaagaagauguacagguacuagcuauugaaccaggcaaaaauccaaaacacguacaaacgaaaccgggauuauuuaaaacacuaacaggagaaaucggugcaguaacgcuagacuuuaaacccggaacaaguggaucuccaauuauuaauagaaaagguaaagucauaggccuguacggaaacggaguaguaaccaaaagcggugauuacguaucugcaauuacacaagccgaacgcaucggugaaccugacuacgaaguugacgaagauauuuuuagaaagaaaagacuaacaauaauggauuuacacccaggugcaggaaaaacaaaacgcauucuacccucaauaguaagagaagcccugaagcguagguuacggacucucaucuuggccccaacacgaguuguagcggcagaaauggaagaagcguuaaggggacuaccaauaagguaucaaacaccagcaguaaaaucugaacauacuggacgcgagauaguugaucuaaugugucaugcgaccuuuacaacaagacucuuaaguucuacaaggguaccaaauuauaacuuaauuguaauggacgaggcccauuuuacugauccuaguucgguagccgcaagaggcuacauuagcacccggguggaaaugggagaggcagcggcaauauuuaugacagcuacuccacccggugcaacugauccguuuccucaaucgaauagccccauagaagauaucgagagggagauacccgaaaggucauggaacacuggcuuugacuggauaaccgauuaccaagggaagacugucugguuuguaccaagcauaaaagccgggaacgauauagcgaauugucucagaaagucuggcaagaaaguaauacagcucucuaggaaaacguuugacaccgaauacccaaaaacaaaauuaacugauugggauuuuguaguuacaacagacauuuccgaaaugggagccaauuucagagcagguagagugaucgauccuagaagaugucuaaaaccuguaauauuaacugauggaccagaaaggguaauucuagcugggccuauccccgucacuccggcgucugcagcacagcgcaggggaaggauaggacguaauccagcgcaagaagaugaccaauauguauucucuggcgauccgcugaaaaacgaugaggaccacgcgcacuggacugaagcaaaaaugcuacuugauaacauauauacaccagaaggcauuauacccacuuuauuuggacccgaaagagagaaaacacaagcuaucgacggagaauuuagacuaagaggggaacagcggaaaacuuuuguagaacucaugagaaggggagauuugcccgucuggcuguccuauaaagucgcgucugcugggauuuccuauaaagacagagaguggugcuucacgggcgaacgaaacaaccaaauacuagaagaaaauauggaaguggagauuuggacuagagaaggugaaaagaagaaacuuagaccuagauggcuugaugcucguguauaugcagacccaauggcuuugaaagauuuuaaagaguucgcgucgggaagaaaaucuauaacccuggacauauuaacagagaucgccucuuuaccaacuuaccuuuccagucgagcuaaacuagcuuuggauaacauuguaauguuacauacaacugaaagaggcggcagagcguaucaacacgcacugaaugaauugccggaaagccucgaaacgcuaaugcugguagccuuacuaggagcuaugaccgcggguauauuuuuguucuuuaugcaaggaaaagggauugggaaacugucaaugggacuaauagcaauagcgguugcgucaggguuacuuuggguagcagaaauacaaccacaauggaucgccgcaaguauaauucuagaguucuuucuaaugguacugcuuauuccagagccagagaaacaaaggacaccucaagauaaucaauuaauauaugugauucuuacuauacugacaauaauaggauuaauagcagcaaacgagauggguuuaauugagaaaaccaaaacagauuuugguuucuaccaaguaaaaaccgaaacaacaauauuggacguugauuuaagaccugcuagugcuuggacgcuuuaugcgguagcaacaacaauauuaaccccuaugcuuagacacacaaucgaaaauacaucggcgaaucuaagccuagcagcuauugccaaccaggcagccgugcugaugggguuggggaaaggguggccucuccauagaauggaccucggagucccccuauuagcuaugggaugcuacagccaagucaauccuacaacauuaacagcuucauuaguaaugcuccuaguucacuacgcaaucauaggcccgggacuacaggcgaaggcaacuagagaagcucagaaaaggacugccgcagguauaaugaaaaauccgaccguagauggcauuacaguaaucgauuuagagccaauaucguacgacccuaaauuugaaaaacaacuaggucaaguaaugcuacuuguacuaugugcaggacaauuacucuuaaugagaacuacgugggcauuuugcgaaguacucacuuuggcaacggggccuauauuaacccuaugggaggguaaucccggucgauuuuggaauacaaccaucgcgguaucaacagcaaauauuuuuagagguucguauuuagcaggagcuggcuuggcauuuucuuuaauuaaaaacgcucaaacuccccguagaggcacaggcacaacaggagaaacacuaggugagaaauggaagcgacaauuaaauaguuuagaccguaaggaauuugaagaauacaagcggucuggaauuuuagagguagaccguacagaagcuaaaagugcacugaaagacggaucgaaaacaaagcacgcagucucgagagggucaucuaaaauaagguggauaguagagaggggcauggucaaaccgaaaggaaagguggucgauuuagguugcggcaggggaggauggagcuauuacauggccacucugaagaauguaacugaagucaagggauauacgaaaggagggcccggacaugaagaaccuauaccgauggcaaccuacggauggaaucuaguaaaacuacacaguggagucgauguauuuuacaaacccacggaacaaguggauacacuacugugugacauaggagaaucgagcucaaaucccacaauagaagagggacggacauuacgaguccuaaaaaugguggaaccauggcugaguucaaaaccggaguuuuguauuaaaguacuuaauccauauaugccaacugucauagaagaguuggaaaaauuacaacgaaaacacggcggaaauuuaguuagguguccacuuucgaggaacagcacacacgagauguauugggugucgggagcgucugggaauauagugucgucaguuaacaccaccucaaaaaugcuacuaaauagauuuacaacaagacauagaaaaccuacuuacgagaaagauguugaucucggagcagguaccaggaguguaucaacugaaaccgagaaaccugacaugaccaucauugggagaagauugcaaagacuucaggaggaacauaaagaaacguggcauuaugaccaagaaaacccauauagaacaugggcuuaucauggaucuuacgaagcaccuagcacuggaucugcuucuuccaugguuaauggaguaguaaaacuguuaacuaaaccuugggaugugauuccgauggucacucaacuggcgaugacugacaccacaccauuuggacaacaaaggguauuuaaagaaaaaguggacacccguaccccgcaaccgaaaccuggaaccaggaugauaaugacuacuacugcuaauugguuaugggcuuuguuagggaagaagaaaaacccaagacuguguacacgugaagaauuuauaucaaaagugagaucuaaugccgcaauaggagcgguauuucaagaggaacaaggcuggacaucggcgucagaagcgguuaaugacagccguuuuugggaacucguagauaaagaaagagcuuuacaccaggaagggaagugugaaucaugcguuuacaauaugauggguaagagggaaaagaaguugggggaauuuggcagagcaaaagggucuagggcaauaugguacaugugguuaggugcaagauuuuuagaauuugaggcauuaggauucuuaaacgaagaucauugguuugggcgugagaacagcuggucaggaguagaaggagaagguuuacaccgauuggguuauauucuagaagagaucgauaagaaagacggcgaucugauguaugccgaugacaccgcaggaugggauaccagaauuaccgaggacgauuuacaaaaugaggaauugauuacagaacaaauggcgccacaucauaagauauuagcaaaagcuauauuuaaacuuacuuaucaaaacaaaguggucaaaguacuuagaccaacuccgagaggagcagucauggacauaauuagcaggaaggaccaaagaggaucgggccagguaggaacuuacggauugaacaccuuuaccaauauggagguccaacuuauaagacaaauggaggcggaaggcguuauaacacaggaugacaugcaaaaucccaaaggacuuaaagaacgcgucgaaaaguggcuaagagaauguggaguugaccgacugaagcgaauggcaauaucaggcgacgauuguguagucaagcccuuggaugagagauuuggcacgagcuuauuauuucuuaacgauaugggaaaaguucgaaaagauauuccacaaugggagcccuccaaaggguggaaaaacuggcaagaagucccguucuguagccaccauuuccacaaaauauuuaugaaagacggucgaucccugguaguaccauguagaaaccaagaugaauuaauuggccgugcaagaauaucacaaggcgccggauggucauuaagagagaccgcguguuuaggcaaagcauaugcccaaauguggucauuaauguacuuccauagaagggaucuuagacuagcuucgauggcaaucuguucagcagucccaacugaaugguuuccuaccucccguaccacauggucgauccaugcacaucaccaauggaugacaaccgaagauauguuaaagguauggaaccgaguauggauugaagacaacccuaacaugacagacaagaccccuauacauaguugggaagauauaccuuauuuaggaaagagggaagaccuauggugugggagucugauaggccuuucuucuagggccaccugggcgaagaauauacauacugcgauuacacaaguccgaaaucucaucggaaaagaagaauacguggauuauaugcccgugaugaaacgauacagugcaccaagugaaucggaaggaguucuguga

SEQ ID NO: 23613 - RNA, 9867 nt, Artificial Sequence
  derived and/or modified CDS sequence (opt6) from DENV-4__FJ850057__SS-prME
agcacuauaacccuacuaugucugauaccaacagccauggcauuucauuugagcacaagagauggagaaccauuaaugauuguggcaaaacacgaacguggucgcccccuuuuauucaaaacaacagaaggcauaaauaaaugcaccuuaauagcgauggauuuaggggaaaugugugaagacacggugacguauaaauguccauuacucgugaauaccgaaccagaagauauagauugcugguguaaccugacaucaacuugggucauguauggaacguguacacagagcggcgaaagacgaagggagaaacgaucgguggcacugacaccacauucaggaaugggacuagaaacacgcgcagaaacguggaugucgagcgaaggcgcauggaaacacgcucaaaggguagaauccuggauucuaaggaauccaggcuuugcguuacuugcaggcuucauggcauauaugauuggucaaacagguauacaaagaacaguauucuucguauugaugaugcuggucgcaccaagcuauggaaugcgaugugucggaguagguaaucgugauuucguagaagggguaaguggcggagcguggguggauuuaguccuugaacauggcggaugcguaacuacuauggcacaagggaaaccaacauuggacuuugaauuaacaaaaacgacagcaaaagaaguugcgcugcugaggacguauugcaucgaagcaaguauuucuaauauuacuacagccacaagauguccaacucaaggggaaccuuauuuaaaagaagaacaagaccagcaauacauuugucgaagagauguugucgaccgaggauggggcaauggguguggauuauuuggcaaaggagguguaguuacaugugccaaauucucguguucgggaaaaauaacuggaaauuuaguacaaauugaaaaucuagaauacacugucgucguuacgguucauaauggagauacacacgcaguugggaacgauacgaguaaucauggaguuaccgcaacgaucacuccacgcucaccaaguguagaagugaaacuuccugacuacggggaacucacacuagacugcgaaccucggaguggaauagacuuuaacgaaaugauacucaugaaaaugaagaagaaaacguggcucguacauaaacaaugguucuuagaucugccacuaccauggaccgcaggcgcagauacaucagaaguacauuggaauuauaaagaaagaaugguaacguucaaaguaccucaugcuaaacgacaggauguaacaguacucggaucacaagaaggugcaaugcauuccgcgcuagcgggagccacggaaguagauagcggagauggaaaucacauguucgccggucauuugaaauguaaagucagaauggagaaacucagaauuaaaggcaugucauauacgaugugcagugguaaauuuagcauugacaaagaaauggccgaaacacagcauggaacuacuguaguaaaagucaaauaugaaggugcgggugcacccugcaaagugccaauagaaauacgggauguaaauaaagagaaagugguuggaagaguaauaucgagcacucccuuagccgagaacaccaauucgguuacaaauaucgaacucgaacccccuuuuggugacuccuacauugucauugguguaggaaacagcgcauugacucuucauugguucaggaaaggaucgucgauuggaaaaauguucgaaaguacauaccgcggagcuaaaagaauggcaauucucggugagacugcgugggauuuuggaucaguaggagggcuauucaccucucuuggaaaagcaguacaucaggucuucggaucaguauauaccaccauguuuggcgguguuucguggaugauccgaauauuaaucggauuucuagugcuguggauugguacgaacucacgaaacacaaguauggcaaugacauguauugcugucggugguauaacacuauuucuagguuuuacgguacaagccgacaugggcuguguggugucauggucuggcagagaauuaaaaugugggagugggauuuucguuguugacaacguacacacuuggaccgaacaguauaaauuccaaccagaaagcccugcaaggcuagcuucagccaucuuaaacgcacacaaagaugguguaugcggaauaagaucgacaacaaggcuugaaaacgugauguggaagcagauaacuaaugagcuaaacuauguucuaugggaagggggucacgaucuaacagugguagccggugacguaaaggguguacugacaaaagguaaaagggcauuaacgccuccggugucggacuuaaaauauucauggaaaacuuggggaaaagcuaagauauuuacgccagaggcuaggaacucgaccuucuuaauagacggucccgauacaucagaaugcccgaaugaacgacgugcauggaauagucuagaaguagaagacuaugguuuuggcauguuuacaacuaacauuuggaugaaguuccgggagggaagcucagaaguaugcgaccaucgacuuaugagugccgccauaaaagaccaaaaagcuguacacgcggauaugggcuauuggauagaaucaucuaaaaaccaaacauggcaaaucgagaaagcaagccugauagaggucaagacaugcuuguggccaaaaacccauacccuauggucuaacggugugcuagaaagccagaugcuaauuccgaaaucguacgcgggcccuuucagucaacauaauuauagacaggguuaugccacgcaaacggugggaccauggcaucuagggaaacuagaaaucgacuuuggagaauguccaggaacgacagucacgauccaagaagacugcgaccaucgugguccuucauuacgaacaacgacugcaucaggaaagcuaguaacacagugguguuguagaaguugcacaaugccaccacuaagauuccuuggagaggaugggugcugguaugguauggagauucgacccuuaaaugaaaaagaagaaaacaugguaaagagucaagugacggcgggccaaggcacuucagaaacguuuaguaugggguuacuauguuuaacauuauuuguagaagaauguuuaagacgccgaguaacacgaaaacauaugauucuugucguaguuauaacacuuugcgcaaucauauuggguggauuaacguggauggaucuauugcgcgcguuaauaauguuaggagauacuaugagcggacguaucgguggccaaauucauuuagcuauaauggccguauucaaaaugucuccuggauacguacuaggcgucuucuuaagaaaauuaaccaguagagaaacagcacuaaugguuauaggaauggcgaugacuacuguucugucaaucccucaugacuugauggagcucaucgacggcauaucuuuaggucucauacuccuaaaaauuguaacucaauuugauaauacacaaguuggaaccuuagcacuuaguuugaccuucauuagaucaacaaugccccuaguuauggcauggaggacaauaauggcagugcuauucguuguuacauugauuccguuaugucgaacaaguugccuucagaaacaaucucauuggguggagauaacggccuuaauucuaggggcacaagcccuaccgguuuaccuaaugacacuaaugaaaggagcgagcaggagaaguuggccacucaaugaggggaucauggcggucgggcuagucagucuccuaggaucagcucuccuuaaaaaugaugugccacuagcagggccaaugguugcaggagguuuauuacuagccgcguauguaaugucaggaucuucugcugauuugucucuugaaaaagcagccaaugugcagugggaugagauggccgauauaacaggcagcaguccuauaauagaaguaaaacaagaugaggacggcuccuuuaguauaagggaugucgaagagacaaauaugauaacauuacucgucaaauuagcuuuaauaacaguaaguggccuauaucccuuagcaaucccaguaacaaugacccugugguauauguggcagguuaaaacacagagaucuggugcacuuugggauguuccgaguccagccgcuacucaaaaagcugcgcuaagcgaaggaguauauagaaucaugcaaaggggccucuucggaaagacucagguggguguagggauucacauggaaggaguguuucauaccauguggcacgugacaagaggaaguguaauuugucacgaaacaggcagguuggagcccaguugggcagaugugcguaacgauaugauuaguuaugguggaggguggaggcucggcgauaaaugggacaaagaggaagacguccaaguguuagcuauagaaccuggcaaaaaucccaaacaugugcaaaccaagccggggcuauuuaaaacauuaaccggugagauaggagccgugacuuuagauuuuaagccaggaacaagugggucaccaauuauaaauaggaaggguaaggugauaggccuauaugggaauggugucguaacaaaaucuggugauuacguauccgcaaucacccaggcagagcgaauaggggaacccgacuacgaaguagacgaagauauauucagaaagaaaaggcuaacgaucauggaccuacacccaggugcggguaaaacuaaacgaauacuaccuucgauagucagagaagcacuuaaacggagacugagaacucuaauacuugcuccuacgagaguaguggcagcugaaauggaagaagcacuacgcggauugccuauucguuaccaaaccccagcagugaaaucagaacacacagggcgugagauaguagaucugaugugccaugcuacauuuaccacuaggcuacuuaguagcacgagagucccuaauuauaauuugauaguaauggaugaagcacauuucaccgacccgucgagcguagcugcucgagguuacaucaguacaagaguugagaugggcgaggcggcagcaauauucaugacggcuacaccgcccggcgcaaccgauccauucccucaaucuaacucacccauagaagacauagaaagagaaauaccagaaagaucauggaauacagguuuugacuggauaacugauuaucaagguaagacuguaugguuugucccaucgauuaaagcggguaaugacauagcaaacugccugagaaaaucuggcaagaaaguuauccaacuaucucggaaaacguuugauacagaguauccaaaaacgaaguuaacagauugggauuucguuguuacgaccgauauuucagaaaugggugccaauuucagggcuggccgagucauugauccacguagguguuuaaagccaguaauacuuacagaugguccagaaagggucauauuggcaggaccaauaccugugaccccugcaagcgcagcgcaaagacgagguagaauagggagaaacccugcucaagaagacgaccaauaugucuuuucgggagauccccugaagaacgacgaggaucaugcgcacuggacagaagcgaaaaugcucuuagacaacauauacacuccagaagguauaauccccaccuuguuugguccggaaagagagaaaacucaagccauagacggggaguuuaggcuacgaggagaacaaaggaagacauucguggaauuaaugcgacguggcgaucuucccguauggcuauccuacaaaguagcgucugcaggaauaucuuauaaagaucgcgagugguguuuuacaggagaacgcaauaaccaaauuuuagaagaaaacauggaaguagagaucuggacgagggaaggugagaaaaagaaacuacguccaagaugguuggaugcuagaguuuacgcagacccuauggcacugaaagauuuuaaagaguucgcuucaggacgaaaaucaaucacacuggacauuuuaaccgaaauagcuucccuuccuaccuacuuaucauccagagcaaaguuagcacuagauaauaucguuauguugcacacaacagaaagagguggucgagcauaccaacaugcuuuaaacgaacucccagaaagccuagaaacuuuaaugcuaguagcuuuauuaggugcaaugaccgcaggaauauuuuuauuuuucaugcaaggaaagggaaucgguaaacuaucaauggguuugaucgcaauagccguggcaaguggucuucucuggguagccgaaauacagccccaauggauagccgcaaguaucauacuugaguucuuccucauggucuuauuaauuccagaacccgaaaaacagcgaacaccacaagauaaccaguuaauuuauguuauacuaacaauucuuacaauuaucggacugauugcugcgaacgaaaugggacucauugagaagacaaagacugacuuuggguuuuaucaagucaaaacggagacaacaauauuagauguagaccuccgaccagcuagcgcauggacgcuuuaugcuguugcgaccacgauacucacuccaaugcuacgacacacuauagagaacacaagcgcaaaucuuaguuuagcagcuauagcaaaccaagcagccguucuaaugggacuugguaaaggcuggccauuacauagaauggaucucggugugccacuucuggccaugggcuguuacagccaaguaaacccaaccacacuaacagcaagucuuguaaugcuauugguacauuacgcaauuauuggacccggauugcaggcaaaggcuacuagagaggcacagaaaagaaccgcggcugguauuaugaagaacccgacgguagacggaauaacaguaauugauuuagaaccaauuucuuacgaucccaaauucgaaaagcaauuaggacaagugaugcuauuggugcuuugcgccgggcaacuacuuuuaaugagaaccacuugggcuuuuugcgaaguguugacccuugcuacgggcccaacuuugacuuuaugggaaggcaacccgggaagauuuuggaauacaacaaucgcuguguccacugcaaacauauuucgaggcaguuauuuggccggugcaggauuagcauuuagucuaaucaaaaacgcacaaacaccgcgcagagguaccggaacaacaggagaaaccuugggagaaaaauggaaaagacaacuuaauucgcuggaucgaaaagaguucgaagaauauaaaaggagcggcauccuagaaguagaucguacagaagccaagucagcgcugaaggauggcagcaaaacgaagcaugccgugucucgagguucaagcaagauaagguggauuguugagagagggaugguaaagccaaaaggcaagguaguugauuugggaugcgguaggggcggauggaguuacuauauggccacacucaaaaauguaacggaaguuaaaggauacacaaaaggaggaccuggacacgaggaaccaaucccuauggcaacuuacggguggaauuugguaaaacugcacuccgguguugauguguuuuauaaaccuacggaacaaguugacacuuuauuaugcgacauaggagagucaagcucaaauccaacaaucgaggaggguagaaccuugcgaguacucaaaauggucgaaccauggcucaguucgaaaccagaauuuuguaucaaggucuuaaauccuuauaugccuacagugauagaagaauuagaaaaguuacaacguaaacauggaggaaaucuaguaagauguccuuugaguagaaauucuacucaugaaauguacuggguuucuggugcgucaggaaauauuguuuccucuguaaacaccacauccaagaugcuacuaaaucguuuuacaacaagacacagaaaacccacauaugaaaaagauguugaccuaggagcaggaacaagaagcgucuccacugagacagaaaaaccugauaugacuauuauaggcagaagacuacaaagguuacaggaagaacacaaagagacauggcauuacgaucaagaaaauccguaucgcacaugggcuuaucauggaagcuaugaggcccccucgacaggaucagccucuaguaugguuaauggaguaguuaaguuauuaacaaaaccuugggacgucauaccuaugguuacacagcucgcgaugacagauacuaccccguuuggacaacaaagaguauuuaaagagaaaguagauacuagaacaccacagcccaaaccaggcacaaggaugauaaugacaacgacugcgaauuggcuuugggcccuauuagguaagaagaaaaauccacgacugugcaccagggaagaguuuauaucgaaaguaagaucuaaugcugcaauaggagcagucuuucaagaagaacaagguuggaccagugcuucagaggcggucaaugacucacgauuuugggaauuaguugacaaagaacgggcuuuacaccaggaagggaagugugaaagcugcguuuauaacaugaugggaaaaagagagaagaaacuaggugaguucggacgugccaaaggcagucgugcaauuugguauauguggcucggagcuagauuuuuggaguuugaggcuuuaggcuuucuaaacgaagaccauugguuuggacgagagaacucauggucaggaguggaaggagaaggcuuacaccgauuaggauacauacuugaggaaauagauaagaaagauggugaccuaauguaugcggaugauacggcuggaugggauacgcguaucacagaggacgauuugcagaaugaagaauuaauaacagaacaaauggcgccgcaucauaagauccuagcaaaggcaauauucaagcuaacauaucaaaauaaaguggucaagguucuucgaccuaccccuaggggugcaguuauggauauaauaagcagaaaagaucaaagggggucuggacaagucggaacauacggacuaaacacauucacaaacauggaaguacaguugauacgacaaauggaagccgagggagucauaacucaagaugauaugcaaaacccaaaaggacuuaaggagagaguagaaaaauggcuaagagaaugcggcguggauaggcucaaaagaauggcgauauccggagaugauugcguugucaagccccuugacgaaagauuuggaacaagucuucuuuuucucaaugacauggggaaaguaagaaaagacauaccccaaugggaacccagcaaaggauggaaaaacuggcaagagguaccauucuguagucaccauuuccauaaaauauuuaugaaggauggaagaagucugguuguuccgugccguaaucaagacgaguugauugggcgcgcgcgaauaucacaaggagccgguuggagccuacgcgaaaccgcauguuuagggaaagcauacgcccaaauguggucacuaauguacuuucaucgaagggauuugcgucucgcaucgauggcaauuugcucugccguuccuacagagugguuucccacaagcagaacaacauggagcauucaugcacaccaucaauggaugacgacugaagauauguuaaagguauggaauaggguauggaucgaagauaacccaaauaugacugacaagacgccuauucacucaugggaggauauuccuuaccuaggaaaaagagaggacuuauggugcgggucccucauagguuuaagcucacgugcuacaugggcuaaaaauauucauaccgcgauuacucagguacggaauuuaauaggaaaagaagaauacguagauuauaugccaguaaugaaaagauauucagcaccaucagaaucagagggaguacuauaa

SEQ ID NO: 23614 - RNA, 9867 nt, Artificial Sequence
  derived and/or modified CDS sequence (opt6) from DENV-4__GQ199881__SS-prME
ucaacaaucacguuauuaugcuuaauucccacgguaauggcauuucaucugaguacucgggauggugagccuuuaaugauaguggcgaaacacgaaaggggccggccacugcuauuuaaaacaacagaaggcauuaacaaauguacacuaauagcgauggauuugggagaaaugugcgaggauacuguuacauauaaaugcccgcuauuaguaaacaccgaaccagaggauauagauuguuggugcaaucugacaaguacauggguaauguaugguacaugcacucagaguggagaacgucgaagagagaaaagaucgguagcuuugacaccacacucuggcaugggguuagaaacaagagcugagacuuggaugagcagugaaggagcauggaaacaugcacagagaguagaaaguuggauucuuaggaacccaggguuugcauuacuugcgggauuuauggcauauaugaucggacaaacacgaauccaaagaacaguauuuuucgugcuaaugaugcucguagcaccuucguaugggaugcguugcgucggaguagggaaucgagauuuuguggaaggaguaucaggaggugcuuggguggauuuaguauuagaacauggagggugugucacgacaauggcgcagggaaaaccaacacuugauuucgaacugacgaaaacaacggcgaaagaaguugcucuuuuaaggacuuacugcaucgaagccagcauaaguaacauuacuacagcuacgcgauguccuacacaaggagagccuuaucuuaaagaagaacaagaucaacaauauauauguagacgagaugugguugacagaggaugggggaauggcugcggauuauuuggaaaaggugggguaguaacgugugcaaaauuuuccuguucuggaaaaauuaccggaaauuuaguucagauugaaaacuuagaauacacaguaguuguaacaguccacaauggagacacacaugcaguaggcaaugacacauccaaucauggagugacggcaacaauaacaccgcgaaguccuagcguagaagugaaauuacccgauuacggcgaauuaaccuuagacugugagccuaggagugguauugauuuuaaugagaugauacuaaugaaaaugaagaagaaaacuuggcuaguacauaaacaaugguuuuuagauuuaccgcuaccauggacagccggugcagauaccucagagguacacuggaauuauaaggaacgaauggucacauucaagguuccacacgccaaacgacaagacgucacuguucuagguagccaagaaggagcaaugcauagcgcuuuagccggagccacagaaguugacagcggagacgguaaucauauguucgcaggucauuuaaaauguaaaguacgaauggaaaaauuacgaauaaagggaaugagcuauacaauguguagugguaaauuuucuauagacaaggaaauggccgagacccaacacgguaccacaguagugaaaguaaaguaugagggagccggugcaccaugcaaaguaccaauagaaauaagagauguaaacaaggagaaaguaguaggucgcgugauaucuuccacgccccucgcggaaaacaccaacaguguaacuaauaucgaacuagagccucccuuuggcgauaguuauauugugauuggugucgguaacucugcccuaacguuacacugguucagaaaaggauccaguauagggaagauguuugaauccacuuaucguggugcuaaaagaauggcaauacuaggagagacagcaugggauuucggcucuguuggaggauuauuuacuagccucggaaaagcuguccaucaaguauuuggcucuguguacacaacaauguuugguggggucuccuggaugaucagaauuuuaauuggauuuuuaguuuuauggauaggcaccaauucacgaaauacuucgauggcaaugaccuguauugccguaggagggauuacauuauuucugggguuuacgguucaagcugauaugggaugcguaguaucauggagcgguagagaacucaaaugcggaucaggaaucuuuguggucgacaacguacacacuuggacugaacaauauaaguuucagcccgaaucuccagcuagauuggccuccgcuauacucaaugcacauaaggauggagugugugguaucagaaguaccacaagacuagagaacguuauguggaaacaaaucacuaaugagcuuaauuacguccugugggaagggggucacgauuuaaccguaguagccggagaugucaaagggguucuuaccaaagguaaacgugcuuugacaccucccgucagugauuuaaaauacucuuggaaaacguggggaaaagccaaaauuuuuacaccugaagcuagaaacaguacguuuuuaauagacggaccagauacaucugagugcccuaaugagcggcgugcauggaauagucuugaagucgaagacuauggcuuugguauguuuaccacaaauauuuggaugaaauuucgagaggguaguucagaaguaugcgaccaucgcuugaugagugcagcgauaaaagaucaaaaagcuguacaugccgacaugggauauuggauagaauccaguaaaaaccagacuuggcaaauugaaaaagcaucucugaucgaaguaaaaacaugucuauggcccaaaacucauacacuguggucaaaugguguauuagaaucgcaaauguuaauaccgaaaaguuacgcuggaccguucagucaacacaacuaccgacaaggcuaugccacucaaacaguagguccguggcaucuagggaaauuagagauagacuuuggggaaugcccagguacgacuguaacuauucaggaagauugugaccaccguggucccucuuuaagaacgacgaccgcgagugguaaacuggugacccaauggugcugucggucuugcacaaugccuccauugcgguuucuaggagaagauggauguugguauggaauggagauucguccgcugucagaaaaagaggaaaacaugguaaagucucaaguggccgccgggcagggaacuagcgaaacauuuuucaugggacucuuguguuuaaccuuguuuguagaagagugccucagaagaagggugacgagaaaacauaugauauuagcaguaguuauaacauuaugcgcuauaauacuaggugggcugacauggauggauuuauuacgagcacuaauuaugcucggugauacaaugucgggucgaaucggagggcaaacucaucuagcuauaauggcaguauucaaaaugucgccgggauauguccuuggaguuuuccugcguaaauuaacaaguagggaaaccgcucucaugguaauuggaauggcaaugacaacaacucucucaauaccucacgaucuuauggaacucauagauggcauaucucuaggucugauacucuuaaaaauuguaacacaauuugauaauacccagguugguacucuggcauuaucccuuacuuucaucagaagcacaaugucauuaguaauggcauggcggaccauaauggcugucuuauuuguugucacauuaaucccauuauguagaaccaguugcuugcaaaaacagagccauuggguugaaaucacggcucugauauuaggugcucaagcauuaccuguguacuuaaugaccuugaugaaaggagcuucuagaagaaguuggccucuaaaugaggguaugauggccguuggcuugguaucuuuacuagggagugcuuuauugaagaacgaugucccuuuggcagguccgaugguagcaggcggacuguuauuggcagcauauguuaugucugggucaagcgcugaucuuaguuuagaaaaagcggccaauguucaaugggaugaaauggcggauauaacgggcuccucaccaauaauagaaguaaaacaggaugaagauggaucauucucaauucgagauguggaagaaacaaauaugauaacuuuacucguuaaauuggcauugauuacagugaguggacuguacccucuugcuauacccguaacgaugacauuaugguauauguggcaagucaaaacacagagaucgggagcguuaugggacgugccaagucccgcugcgacacaaaaagcagcucuuucagaggguguuuacagaaucaugcagagaggauuauucggcaagacgcaaguugggguaggaauacauauggagggcgucuuucacacaauguggcacgucacucgcgggucggugauaugucacgagacaggacgacucgagcccaguugggccgaugugcguaacgacaugaucaguuauggugguggcuggcgacuuggugauaagugggacaaagaagaagacguacaaguacuagcaauagaacccggaaagaacccuaagcacguucaaaccaagccagguuuauucaaaacacuaaccggugaaauuggcgcaguaacacuagacuucaaacccggcucaucuggcagcccgauaauuaacaggaaaggcaaaguaaucggucuuuauggcaaugguguaguaacgaaaucuggagauuauguaucugcuauaacacaagcagaaagaauuggagaaccagauuaugaaguagaugaagauauauuccguaaaaagagauuaacuaucauggaucuucacccgggugccggaaaaacgaaaagaauacuaccgucuauaguaagagaggcucuuaaacgacguuuaagaacacugauacuagcaccgacuagaguaguggcagcagaaauggaagaggcgcuuagaggucugccaauaagguaucaaaccccugcuguaaagucagagcauacgggucgugagaucguagaucuaaugugucaugcgacuuuuacuacaagguuacugagcucuacgagaguaccaaauuacaaucuaauagugauggacgaggcccauuucacagauccgaguagugucgcugcccgagguuacauuucaacuagaguugaaaugggagaagcggcagcaaucuucaugaccgcaacaccuccuggcgcuacagacccguucccccaaagcaacucaccaauagaagauauugaacgcgaaauacccgaacguucauggaauacaggguuugauuggauaacugauuaucaaggaaaaacuguaugguuuguacccagcauuaaggcgggaaaugacauagcuaacugucuaagaaagucagguaagaaaguaauacagcuaucccgcaaaacauuugauacagaauauccuaagaccaaguuaaccgauugggacuucguuguuacaacugacauuagugaaaugggagcaaacuuuagggcagguaggguaauagauccaagacgaugucuaaaaccgguuauccuaacagauggaccugaacgagugauauuagcgggcccuauaccaguaacucccgcaucagcugcucaaagaagaggucguauugggagaaacccagcucaagaggaugaccaauacguauuuuccggcgauccucuaaagaaugaugaagaccaugcccauuggacugaggcaaaaauguuacucgauaauauauacacuccggagggcauaaucccuacucuauuugguccugaacgugagaaaacucaagcuaucgauggagaauuuagacuacgaggugagcaaagaaaaacuuuugucgaacuaaugagacgaggagaccucccagugugguuaucauacaaaguagcaagugcaggaauaaguuauaaagacagagaaugguguuuuacaggugaaagaaauaaccaaauacuagaggaaaacauggaggucgaaauauggacgcgugagggugagaagaagaaauuaagaccccgauggcuagacgcaagagucuaugcggauccaauggcauuaaaagauuuuaaagaauuugcuucugguagaaagucaauaacauuagauauucuuacggaaauagcaucucuaccuacauaccuaagcucucgugcaaaguuggcacuagauaauauuguaauguuacacacuacagaacgugguggccgagccuaccaacacgcacuuaacgaacuuccagaaucuuuggaaacucuaaugcuuguggcauuauugggugcuaugacugcuggaauauuccuguucuuuaugcaagguaaaggaauaggaaaguuaucaaugggucucauaaccauagccguagccucgggauuguuauggguagcagaaauacaaccucaauggaucgcagcuucaaucauauuggaguucuuucuaaugguacucuuaaucccugaaccugaaaaacagagaacaccccaagauaaccaauugaucuacguuauuuuagcaauauuaacuauaauaggacuuauugcggcgaaugaaaugggacuuauugagaaaacuaaaaccgauuucggguucuaccaaguaaaaacagaaacaaccauacuggacgucgacuuacgcccagcgucagcuuggaccuuauaugcaguagcuacaaccauccucacccccauguuaagacauacaauugaaaauacaucugccaauuuaucguuagcugcaauagcgaaucaagcagcugucuuaaugggauuagggaaaggauggccacugcacagaauggaucugggcguaccgcuacuagcgauggguuguuauagucagguuaauccaacgacccuaacugcuaguuuggucauguuguugguucauuaugccauaauaggaccagggcuccaggcaaaggcaacacgugaggcucagaaacguacggccgcugggauaaugaaaaaccccacagucgaugguauuaccguaauugaucuagaaccuauaucauaugacccuaaauucgaaaaacagcuuggccaagugaugcucuuaguccuaugugccgggcagcuauuacucaugaggaccacuugggcuuuuugcgaggugcuaacacuugccacgggcccgauucucacucuaugggaagggaauccagguagguucuggaauaccacaauagcaguaaguacagccaauauuuucagggguucauaucuugcuggggcaggguuggcauucagccuuauuaaaaaugcacagacaccaagaagaggaacaggcacaacaggagagacguuaggagaaaaguggaaaagacaacuaaauucuuuagacagaaaagaauuugaagaauauaagcgaucagguauucuugaaguagaucguacugaagcgaaaucggcuuugaaggauggaucaaagauaaagcaugccgucagucgggguucuucaaagauacguuggauugucgagcguggaaugguaaagcccaaaggcaagguaguggauuuaggaugugggcgaggcgguuggucauauuauauggcuacccuuaaaaauguaacugaagugaaggguuacacaaaagggggacccggacaugaagaacccauacccauggcaacauacggcuggaaccuaguaaaacuucauaguggaguugauguauuuuauaaacccacggaacagguagauacauuauugugcgacauuggugaaucaaguagcaauccgacuauagaagagggccgaacccuucgaguucuuaaaaugguagagccgugguuaaguaguaaaccugaauuuuguauuaaaguacucaauccauauaugccaacaguaauugaagaauuagagaaauuacaacggaaacacggaggaaaucuuguuaggugcccgcuaagucgcaauagcacacaugagauguacuggguaucaggagccucagguaauauugucucaucaguaaacacuacuucaaaaaugcuccuuaacagauuuaccacacgucaccgaaaaccuacauaugaaaaagacguggauuugggagcuggcacacgaaguguaucuacagaaacagaaaaaccagauaugacaauaauaggucgcagauugcaaagauuacaagaagaacauaaggagaccuggcacuaugaccaggaaaauccauauagaacaugggcauaccauggaucguaugaagccccaucaacaggaagcgcaagcuccaugguaaaugggguaguuaaacuacuaacaaaaccaugggaugucauuccaaugguuacucaauuggcaaugacugacaccacuccauucggccaacaacggguuuucaaagaaaaaguagauacuaggacgccgcagccaaaaccgggaacgagaaugguaaugacaacaacggcaaauugguuaugggcauuacucgggaaaaagaaaaauccccgacugugcacgagggaagaauuuauaagcaaagugagaucaaaugcagcgauaggagcuguuuuccaagaagaacagggauggaccagcgcaagugaagccgucaacgacagcagguuuugggaauugguugauaaagaaagagcacuucaucaggagggaaaaugcgagucguguguguauaauaugaugggaaaaagagagaagaaauuaggagaauuuggacgagcaaaaggauccagagcgauaugguacauguggcucggagccagauuuuuagaauuugaagcccugggauucuugaaugaagaccacugguuugggcgagaaaauagcuggucaggaguagagggggaaggccuacauagacuaggauacauacucgaagaaaucgauaaaaaggacggagaucucauguaugcugaugacacagcaggaugggauacgcgcauuacugaggaugaccuccaaaaugaggaacuaauuaccgagcaaauggccccacaccauaagauauuagcgaaggcaauuuuuaaacuuacuuaucaaaacaaaguuguaaaaguguugagaccaacaccaagaggggcugucauggacaucaucucaagaaaagaucaaagaggaucuggccaaguaggaacauacggauuaaacacuuuuaccaauauggaaguucaauugauuagacaaauggaagcagaggguguaaucacacaggaugacaugcagaaucccaaaggacucaaagagagaguagaaaaaugguuaagggaaugcggugucgaucgacuaaaaagaauggccauuucaggagaugauuguguaguuaaaccauuagacgagagguuugggacaucauuauuauucuuaaaugacaugggaaaaguacgaaaagacaucccgcagugggaaccuuccaaaggauggaaaaauuggcaagaagugccauuuuguagucaccacuuucacaagauuuuuaugaaggauggucgcagccuuguaguacccugccgaaaucaggacgaacuaauuggacgugcucguauaucucaaggggcugguuggagccuuagggaaacggcgugucuaggaaaagcguacgcucaaauguggucguugauguacuuucacagacgugacuuacgauuggccaguauggcaauauguucagcugugccaacggaaugguuuccaacgucgagaacgacuuggucaauccacgcacaucaucaauggaugacuacugaagacauguuaaaaguauggaaccgugucuggauugaagacaauccuaauaugauagacaaaacucccguucauaguugggaagauauaccuuauuuagggaaacgcgaagaccucuggugcgguucauugauuggguuaucaucucgugccacgugggcgaaaaauauacacacggcgauaacucagguccgcaaucugauagguaaagaagaauauguugacuauaugccgguaaugaagagauacucggcaccaucagaaagcgaaggaguucuauga

SEQ ID NO: 23615 - RNA, 9867 nt, Artificial Sequence
  derived and/or modified CDS sequence (opt6) from DENV-4__GQ199882__SS-prME
agcacgauuaccuuauuaugccuaauucccaccguaauggcuuuccaucuaaguacaagagauggggaaccguuaaugauuguagcaaaacaugaaagaggacgaccccuguuauuuaaaacuacagaagguauaaacaaauguacacuuauagcaauggaucugggagaaaugugcgaggauacaguaaccuauaaaugcccuuuauuagucaauacggaaccggaagauaucgacugcugguguaacuuaacgucaacuuggguaauguacgggacauguacgcaaagcggugaaagaagacgagaaaaacguuccguagcacuaacaccccauagugguaugggauuggaaacaagagcagaaacguggaugaguucugaaggugcauggaaacaugcgcaaaggguggaaucauggauauuacguaacccuggguucgcgcuauuagcagguuuuauggcauauaugauugggcaaacaggaauacaaagaaccguauucuuugugcuaaugaugcuuguugccccaaguuacgguaugcgguguguuggcguuggaaaccgggacuuuguugaaggaguaucaggaggagcuuggguagaucugguacuggagcauggaggguguguuacaacuauggcccaaggaaaaccaacucuugacuucgaauuaacaaaaacuaccgcuaaagaaguagcguuauugcgcacauacugcauagaagcaucuauaagcaauauaacaaccgcgacccgcugcccaacucaaggagaaccauacuuaaaagaagaacaagaccaacaauauaucuguaggagagaugugguugacagaggaugggguaauggcuguggauuauuuggcaaaggagguguaguuacaugcgccaaauuuagcuguucugggaaaaucaccggcaaccuaguacaaauugaaaacuuagaauauacagucgucgugacaguccauaauggugacacacacgcuguaggaaacgacacgucaaaccauggaguaacugcuaccaucacaccacgcucuccaucagucgaagucaaacuucccgauuacggugaacugacacuugauugcgaaccgagaaguggaauagauuuuaaugagaugauuuugaugaaaaugaagaagaaaacuugguuaguccacaaacagugguuucuugaccuuccgcucccauggacugccggugcagauacaagugaaguccacuggaauuacaaagagaggaugguaaccuuuaaaguaccgcaugcaaaaagacaagauguaacuguguugggaagucaagagggagcaaugcacuccgcacuagcgggggcaacugaaguagauucuggagaugguaaccauauguucgcugggcaccuuaaauguaaaguuagaauggagaaacuccgcauaaaaggaaugucuuauacuauguguucggguaaguuuuccauagauaaagaaauggcugaaacacaacaugggacgacuguaguuaaagugaaguaugaaggugccggagcaccuuguaagguaccgauagaaauacgugaugugaacaaagagaaaguuguaggacgcguuauaucaagcacccccuuggcagaaaauaccaacucaguuacgaacaucgaauuggagccuccuuuuggagacagcuacauagucauaggcguuggaaacucagcccuaacccuacauugguuucgaaaaggaucuucgauuggcaagauguuugaaucaacauauagaggugcaaagcgaauggcuauauugggggaaacggcgugggacuuuggaaguguggguggguuauuuacgucacugggcaaagcagugcaucaaguguucggaucaguauacaccacgauguuuggagguguuaguuggaugauucguaucuuaaucggauuuuugguucucuggaucggcacaaauucccgaaacacuuccauggcuaugacuuguauagccguaggcggaauaacauuauuccuaggguuuacuguacaggcugacaugggaugugucguaucguggucgggacgugaguuaaaaugcggcucggguauauucgugguagauaacguacacacuuggacugaacaauacaaguuucaaccagagucuccagcucguuuagcaagugcaauucucaaugcacacaaggacggaguaugugggauuagaaguacaacccgccucgaaaacguuauguggaaacagauaacaaacgaacuuaacuauguauuaugggaaggaggacaugauuuaacaguugucgcaggagacgugaagggaguucuaacaaaaggcaaacgugcacuaacucccccaguuagugaucugaaguacaguuggaagacguggggcaaagcaaagauuuuuaccccugaggcuagaaauucgaccuuucuaaucgacgggccugacacaucggaaugcccaaaugaacgucgugcuuggaacucauuggaaguagaagacuauggauuugggauguuuaccacgaacauauggaugaaauuccgagaaggaucuagugaagucugugaucauagauuaaugucugcagcuaucaaagaucaaaaagcaguacaugcugauaugggauauuggaucgaaucaaguaaaaaucaaacuuggcaaauagaaaaggcaucauuaauugaagugaaaacaugucuauggccaaaaacgcauacucuuugguccaauggaguacuugagucccaaaugcuuauucccaaaagcuacgcugggccauucucacaacauaauuauagacagggauaugcaacacaaacgguugguccguggcaucuaggaaaauuagagauagauuucggagaaugcccuggaacuacaguaacuauacaagaggauugugaccauaggggaccuucucuucgaacgaccacagcgucagguaaauuaguaacucaauggugcuguagaucauguaccaugccaccgcuccguuuucugggggaagauggauguugguauggaauggaaauaagaccccuaucagagaaagaagaaaauauggugaaaucucaaguggcggcaggucaaggcacgucagaaacuuucaguaugggauuacugugucuaacacuguuugucgaagaaugucuaagaaggaggguuacacgaaaacauaugauuuuagcagucguuauaacacugugugccauuauacuugguggccugaccuggauggauuuacuuagagcucuaauaauguuaggagacacaaugagcggaagaauagggggacagacgcauuuagcaauaauggccguuuuuaaaaugagcccgggauacguacuaggaguuuuccuuagaaaauugaccagccgagaaacggcuuuaauggucaucgggauggcaaugacuacaacacuaucaauaccacacgaucucauggagcucauagauggcauaagccuuggcuuaauuuugcuaaagauugucacucaauuugauaacacucagguagguacgcuggcacuaucauugacuuucauacguucgacuaugagcuuagugauggcguggaggacuauaauggccguuuuauuuguugugacguuaauaccacuuugccgaacaucaugcuuacagaaacaaucgcauuggguagagauaacugcgcuaauacugggugcccaggcuuuaccgguguaccuaaugacauuaaugaagggugccagucgaagaucguggccucuaaaugaaggcauuauggcugucggucuagucagucugcuugggucagcacuacugaagaacgacgugccgcucgccggaccuaugguagcaggaggauuauuacucgccgcauacguuaugaguggaucaagcgcagaccuaucucuagagaaagcugcaaauguucagugggacgaaauggcggacauaacuggaagcucucccauaaucgaaguaaaacaagaugaggaugguagcuuuuccauccgugacguggaggaaacuaauaugauuacacuauuaguaaaauuagcuuuaauaaccgucagcggacuguauccgcuugcuauccccgucacaaugacacucugguauauguggcaaguaaagacucaaagaucuggagcacuaugggaugugcccucuccagcggcuacucagaaagcagcccugagcgaaggcguauauagaauuaugcaaagagguuuguucggaaaaacacaaguuggaguggggauucacauggaaggaguuuuucacaccauguggcaugucacacguggaaguguaauaugccaugaaacuggcagguuagagccaaguugggcugacguuagaaaugauaugauaagcuacggcgguggauggagacuaggcgauaagugggauaaggaagaggauguacaaguacuagcaauugaaccagguaaaaacccaaaacaugugcaaacuaagccaggccuguucaagacucugacgggugaaaucggcgcaguuacauuggacuucaaaccaggaacuucgggaaguccaaucaucaacaggaaagguaaaguuauaggcuuauacggaaauggaguaguaacaaaauccggagacuauguuucugcaauuacgcaagcagaaagaauaggagaaccagauuacgagguagaugaagauauauuuaggaagaaaagguuaacaaucauggacuuacaucccggugcaggcaagacuaagcguauauuaccgucaauaguccgcgaggcucugaaaagaagacuccggacguuaauucuugcaccuacucguguaguggcagcggaaauggaggaggcauuaaggggacugccuauaagauaucagacuccagcagucaaaucggagcacacugggagagaaauaguggauuuaaugugucaugcgacuuuuacaaccagacuuuugucaucgaccagaguaccaaacuauaaccuuauaguuauggaugaagcacauuuuacagacccuucuagcguagcagcgaggggcuauauuucaacucgcguggaaaugggagaagccgccgcaaucuuuaugacagcgaccccaccaggugcuacagacccguucccacaaucaaacaguccuaucgaagauauagaacgagaaaucccagagagauccuggaacacaggauuugacuggauaacugauuaucaagguaaaaccguaugguucguaccuaguauaaaagcgggaaacgauauagcuaauugucucagaaagucaggaaagaagguaauacagcuuaguagaaagacguuugauacagaauaccccaaaacuaaacucacagauugggauuuuguaguaacaacugauauaagcgaaaugggagcaaacuuuagggcuggacgggugauagacccaagacgaugcuuaaaaccaguuauuuuaacagacggaagcgaaagaguaauccuagcuggacccauacccguaacaccggccagcgcagcgcagagaaggggccggauagggagaaacccagcacaagaggacgaccaauacguauuuagcggcgauccacucaaaaaugacgaagaucaugcacauuggacagaggcuaagaugcuauuggacaauauauauaccccagaagguauaauaccgacgcuuuucggaccugaaagggagaaaacacaagcaauugacggagaauuucgacuucgaggagaacagcgcaaaacuuucguugagcuaaugcgaagaggcgaucuacccguauggcuaucauacaaaguagcgagugcggguauuagcuacaaggacagggaauggugcuuuacuggugaaagaaauaaucaaaucuuagaagaaaacauggagguugagauauggacgagggaaggagagaagaagaaauuaagaccccgaugguuagacgccagaguauaugcugauccuauggcguuaaaggacuuuaaggaauuugccagcggcagaaaguccauaacuuuagacauucuaacagaaaucgcuucacugccuaccuauuugaguucacgagcaaaguuagcacuugauaauauaguuauguuacacacaaccgagagaggaggaagggccuaucaacaugcuuuaaaugaacuaccugagagccuggaaacauuaaugcuaguugcuuuauugggcgcuaugacagcaggaaucuuucuauuuuucaugcaaggcaagggaauagguaaacucagcaugggauugauaaccauagcagucgccucaggcuuauuauggguagccgagauccagccacaauggaucgccgcuucaauaauccuagaauuuuuccugaugguucuacuuaucccagaacccgaaaaacaaagaaccccacaagauaaucaacuaauauauguuauacugacaauuuuaacuauaauuggacuuauagccgcuaaugaaaugggguuaaucgagaaaacgaaaacugacuucgguuuuuaccaaguaaaaacugaaacaacaauuuuagacguugauuuaagaccagcuucugccuggacauuguaugcagucgcgacaaccauauuaacuccaaugcuaagacauacuauagaaaauacaucugcaaauuugagccuagccgcaauagcuaaucaagcugcgguauuaaugggauuaggcaagggauggccauugcauaggauggauuuagggguuccacuucuugcuaugggaugcuauagucaaguaaacccaaccacccuaacugcaucacuuguaaugcuuuugguccacuaugcuauuauagguccaggcuuacaagcgaaagcuacuagagaggcacaaaagcguacagcugcuggaauuaugaagaauccaaccguugacggaauaacaguuauagacuuagaaccaauaucguaugauccaaaauuugaaaaacaacuaggacaaguaauguuacuggucuuaugugcuggacaguuauuacucaugcggacuacaugggcauuuugcgagguauuaacccuugcaaccggaccgauauugacccuuugggaaggaaacccaggucgauuuuggaauacaaccaucgcaguuagcaccgcgaacauuuuucggggcagcuauuuagcuggugcaggucuugccuucucuuuaauaaagaaugcgcaaacaccaagacguggaacagguaccacuggggaaacucuuggcgagaaauggaaacggcaacuaaauucguuagauagaaaagaauuugaggaguacaaaagaaguggaauuuuagaaguugacaggacggaagcuaaaucagcgcuuaaagacggaucuaagauuaaacaugcgguaucucgaggaaguaguaaaaucagauggaucgucgaaaggggcauggugaaaccaaaagguaaaguaguagaucuagggugcggaagagguggauggucauauuauauggccacgcucaaaaauguuacggaagucaagggauacacuaaaggagggccaggacaugaagaaccuauuccuauggcgacauauggcuggaauuuagucaagcugcauaguggugucgacgucuuuuauaaaccuacagaacaaguagauacguuguugugugauauuggagagagcucaucaaauccgacaaucgaggaagguagaacacugcggguauugaaaaugguagagccuugguuaucauccaaacccgaauuuuguauuaagguacugaauccauauaugccgacuguuauagaagaacuagaaaaguuacaaagaaaacauggaggaaacuuaguacgauguccacucucaaggaauagcacccaugaaauguauuggguaaguggcgcuaguggcaauauaguaucgaguguaaauaccaccucuaaaauguuguugaacagguuuacgacaagacauagaaaacccacauaugaaaaggauguugauuuaggugcgggaaccagaagcgugucuacugaaaccgaaaaaccagacaugacaauaaucggacgaagacuacaacgccuacaagaagaacacaaagagacuuggcacuacgaucaagaaaaucccuaucguacgugggcuuaccauggaucauaugaagcacccagcaccggaagugcuagcagcauggucaauggcgucgucaaacuccuaacaaagcccugggauguuauaccaauggugacacaauuagcuaugaccgacacgacgccuuucggacagcaaaggguuuuuaaagaaaagguugauaccaggaccccacaacccaaaccuggcacacgcaugguaaugacgacaaccgcaaauugguuaugggcucuuuugggcaagaagaaaaauccgcguuuaugcacgcgugaagaauuuauaucaaaagucagaaguaacgcagcaaucggugcaguguuucaagaagaacaaggauggaccucagcgucagaagcgguaaacgacagcagauuuugggagcuaguugacaaagaacgagccuuacaccaagaagguaaaugcgagucuuguguuuacaauaugaugggaaagagagaaaagaaauugggcgaguuuggaagggccaaagggucucgagcaauaugguauaugugguuaggagcgcguuuccuagaguucgaagcauuaggauuuuuaaacgaagaucacugguuuggucgcgaaaacaguuggucgggaguagaaggagaaggacuucaucgauuaggguacauuuuagaggaaauagauaagaaagauggugaucuuauguaugcagacgauacugccgggugggacacacguauaacagaagaugauuuacaaaaugaagaacugaucacggagcagauggcgccucaccacaagaucuuggcgaaagcaaucuuuaaacuuacauaucaaaauaaaguuguuaaaguauuaagacccacacccagaggugcugucauggacauaauaucacgaaaagaucaacguggcucuggccaaguggguacauacgguuuaaauacuuuuacuaauauggaaguacagcuaauccgacagauggaagccgaagguguaauaacucaagacgauaugcagaaccccaaaggucuuaaagaacgcguagaaaaguggcugagagagugcgggguagaucggcuaaagagaauggccauaucaggugacgacugcguuguaaaaccauuagaugaacguuuugguacaucacuacuguuucuaaacgacaugggcaaaguccgaaaagauauaccacaaugggaacccucaaaaggauggaagaacuggcaggaaguuccuuucuguagccaccauuuucacaaaauuuuuaugaaagauggcaggagcuuaguugugccaugcagaaaucaggaugaguuaaucggcagggcaaggaucagccagggugcuggauggucacucagagagacggcaugucuagguaaagcauaugcacaaauguggagccucauguauuuccaucgcagagacuuaagacucgcuaguauggcaauuugcucagcuguaccuacugaaugguuuccaacuucuagaacgaccuggucaauccaugcucaucaucaauggaugacuacggaagauaugcugaaaguuuggaaucgagucuggauagaagauaauccgaacaugauagacaaaacuccaguacauucuugggaagauaucccauaucuaggaaaaagagaggauuuauggugugggucacucaucggacuuucuucuagagcaacaugggccaaaaacauacauacugcgauaacucagguaagaaaucuaaucgguaaagaagaauacguagauuauaugccuguaaugaaaagauauucagcaccaagcgaaagugaaggaguacuuuag

SEQ ID NO: 23616 - RNA, 9867 nt, Artificial Sequence
  derived and/or modified CDS sequence (opt6) from DENV-4__GQ199883__SS-prME
ucgacuauaacccuauuaugucuaauaccuacuguuauggcuuuccaccugaguacucgcgauggugaaccuuuaaugauuguagcgaaacacgaacgagguaggccccugcuuuuuaaaacuacugaaggcauaaauaaaugcacgcugauugcuauggauuugggcgaaaugugcgaagauacugucacauacaaauguccauuguuaguaaacacggaaccugaagauauagauuguugguguaacuugacuucaacuugggugauguauggaaccuguacccaaucaggggaaagacgaagagagaaacgaucuguugcauuaaccccacauucgggaaugggucuugaaaccagggcggaaacauggaugucaucagaaggagcauggaaacaugcacaaagaguggaaagcuggauacuaaggaauccagguuucgcacuacuugccggauuuauggcguauaugauaggucagacggguauacaacggacaguauuuuucguuuuaaugaugcuuguugccccuucuuaugguaugcggugugucggaguaggaaaucgggauuuuguggaaggcguuaguggaggggcauggguagaccuugucuuagaacauggugggugcgugaccacuauggcacaaggcaaaccaacauuggauuuugaauugacaaaaacaacagcaaaagaagucgcauugcuaaggaccuauugcauagaggcuagcaucaguaauaucacuaccgcaacacgcugcccuacccaaggagaaccauaccuaaaagaagaacaagaucaacaguacauuuguagacgcgauguaguugaucgugguuggggcaauggaugcggauuauuugggaaaggaggugucguaacuugugcuaaauuuucuuguucgggaaaaauaacuggaaaucuggugcaaauagaaaacuuagaauauacgguaguagucacgguacauaacggcgauacacaugcuguugguaaugacacaaguaaccacggcgucacugcaacaaucacuccacggagcccuuccgccgaaguuaaauuaccugacuauggagaauuaacucuagacugugaaccucgcucuggcauagacuucaaugaaaugauacuaaugaaaaugaaaaagaaaacaugguuaguucacaaacaaugguuucuggaccuaccacuuccuuggaccgcgggggcugauacaucagaaguccauuggaacuauaaagaaagaauggugacuuuuaaaguuccccacgcgaaaagacaagauguuacuguuuuagguucgcaagaaggcgcgaugcacuccgcacuagccggcgcaacugaaguagacucaggagacggcaaccacauguucgcgggacacuuaaaauguaaaguacgcauggaaaaauuacgaaucaaaggcaugagcuauacaaugugcucaggaaaauucaguauagauaaagagauggccgaaacacaacacgguacgacuguaguuaaaguaaaauacgaaggugcuggugcaccaugcaaaguuccaaucgagauacgggacguaaauaaggaaaaagucguagguagaguuauaucgaguacgccacuagcagagaauacgaacucgguaaccaauauugaacuggaaccacccuuuggagacaguuauauagucauaggagucggcaacuccgcacucacccuacauugguuuagaaaaggaagcaguaucggaaaaauguuugaaucaacauaucguggagcuaaaagaauggccaucuugggagaaacugcaugggacuucgguuccgucgguggacucuuuacaaguuuagggaaagcgguucaccaaguuuuuggaaguguauacacaacaauguucggaggcguaaguuggaugaucagaauacucauaggauuuuuaguucuguggauuggaaccaacucgagaaauacaagcauggcgaugacaugcauagcaguaggcggaauaacacuuuuucugggauuuaccguacaagccgauauggguugugugguuuccuggucaggacgagaacugaaaugugguagcggaaucuucguaguggacaauguucacacuuggacagaacaauacaaauuccaaccagagucacccgcaagauuagcaucggcgauauuaaaugcgcacaaagacggaguauguggaauacggucaacgaccagauuggaaaacguuauguggaaacaaauaacuaacgaacugaauuacguacuaugggaagguggccaugaucuuacaguagucgccggagaugugaaagguguauugacuaaaggaaaacgagcacuuacgcccccugucucggacuugaaguauaguuggaagacgugggguaaggcuaaaaucuuuacgccugaagcuagaaauucuacuuuccugauugacgguccagacacuucugaauguccaaaugagcggagagcauggaauagcuuagaagucgaggauuacggguuugguauguucacaaccaacauauggaugaaauuucgggaaggaucuucggaaguaugcgaucaccgucuaaugagcgcugcaauaaaagaucaaaaagcgguacaugcagauaugggauacuggauagaaucgagcaaaaaucaaacguggcaaauugaaaaagcuagcuuaauugaaguuaagaccuguuuauggccgaagacccauacccuuuggaguaacggcguguuagaaagucagauguuaauaccuaagucauacgcaggaccguuuucacaacacaacuaccgacagggauaugcaacacaaacugucggaccuuggcauuuaggaaaacucgagaucgauuuuggcgaguguccaggcaccacaguaacuauacaggaagauugcgaucaucgcgguccaucgcuacgaacgacuaccgcgucgggaaaauuaguuacccaguggugcuguaggucaugcaccaugccuccauuaagguuccugggagaggacggcugcugguaugguauggaaauccgaccccuuucugaaaaggaggaaaauaugguaaaaagucaaguugcagcaggacaaggaacaucagagacauuuagcaugggauuacuaugucuaacguuauuuguagaagaauguuuaagaagaagaguaacacguaaacauaugauacuagcaguuguuauuacucuaugugcuauuauacuuggcgguuugacauggauggaucuucuaagagccuuaauaauguuaggugauacgaugucaggaagaauugguggacaaacccaccuagcgaucauggcaguuuuuaaaaugucacccggguaugugcuaggagucuucuuaagaaagcugacuucaagagaaacagcauuaaugguuauaggaauggcuaugacaacuacacuuuccauaccacaugaucugauggaguuaauugacggaauaucacuaggacuaauacuucugaaaauuguaacgcaguuugacaacacgcaaguagguacgcuugcguuaagccugacauucauaagaucaacuaugagccuaguaauggccuggagaacuaucauggcaguuuuauuuguggucacauuaauaccucuauguagaacaaguugccuacaaaagcaaucgcauuggguugagauaacugcccuaauccuuggggcucaagcccugccaguuuaccuaaugacccuaaugaaaggagccuccagaagauccuggccacuuaacgaaggcaucauggcugugggacucguguccuuacugggcucagcgcuauuaaagaaugacguccccuuagcggguccuaugguagcuggcggacuuuuauuggccgcguacguaaugucagguagcagugcagauuuaucguuagaaaaagcagcaaauguacaaugggaugaaauggcagauauaacaggaucaaguccaauaauagagguaaaacaggaugaagaugguuccuucagcaucagggauguagaagaaacuaauaugauuacauuauuaguuaaacuugcacugauaacaguuucuggcuuguauccauuagccauaccgguuacaaugacacuaugguauauguggcaaguuaaaacgcaacggucaggagcacucugggaugugccaucgccagcagcaacccaaaaagcugcacuuucagaaggaguguacagaauaaugcaaagaggccuauucgguaaaacacaaguaggugucgguauacauauggaaggaguauuucacacaauguggcacguaacacgcgguucaguaauaugccacgagacaggacgacuagaacccucuugggcugacguacguaaugauaugauuucuuacggagguggcuggagguuaggagauaaaugggacaaagaagaggacguacaaguccuggccauagagccaggcaaaaaccccaagcauguacagacaaaaccagguuuauucaaaacccuaacaggggaaauuggugcaguaacacucgacuucaaaccagggacaucaggaucgcccauaauuaaucgaaaaggaaaaguaauagguuuauauggcaauggagugguaaccaaauccggcgauuacguuagcgcaauuacccaagcugaacgaauaggcgaaccagauuaugaaguagaugaagauaucuuuagaaagaaaagacuuacaaucauggauuuacauccuggcgccggaaaaacaaaaaggauauugccuucaauaguacgagaagcgcuaaaaaggcggcuaagaacacuaauauuagcgcccacaaggguagucgcugccgaaauggaagaggcuuuaagaggacuaccgaucagauaccaaacgccagcgguuaaaucagaacacacaggacgggaaauaguugaucuaaugugucaugcaacauuuacaacgaggcugcuuaguagcacuagagucccaaauuauaacuuaauaguaauggaugaagcgcacuuuacagauccgucuucaguggccgccaggggauauauuucaacuagaguagaaaugggcgaagcugcugcaauuuucaugacagcuacaccgccgggagcuacggauccuuucccccaaagcaauagcccuauagaagauauagagagagagauuccagaacguucauggaauaccggcuuugauuggauaacugauuaucagggcaagacgguaugguucgugcccucaaucaaagcuggcaaugauauugcaaauugcuuaagaaaaucugguaagaaagucauucaacuuucuaggaagaccuuugauacugaauauccaaaaacaaaacucacagauugggacuucguuguaacaacugauauuucggaaaugggggcuaacuuuagggcaggaagaguaauugacccgaggcggugucucaagccugucauauuaacagauggcccagagaggguaauacuugcaggacccauuccaguaacgccggcaagcgccgcgcaaagacgaggacggauagggcgaaauccggcccaagaagacgaucaauauguauuuuccggugacccccucaaaaacgaugaagaucacgcgcauuggacggaagccaagaugcuccuugauaauauauacacccccgaaggaauaauuccuacauuauucgggccugagagagagaaaacucaagcuaucgauggagaguucagauuacggggagagcagcgcaagacguuuguagaauuaaugcgacguggagaucuccccguuuggcuaucuuacaagguagcgucagcagguaucaguuacaaggaccgagagugguguuuuacgggagagcgaaauaaccaaauccuugaagagaacauggaaguggaaauauggaccagagaaggugagaagaagaaacuucggccuagauggcucgaugcccguguauacgcagauccuauggcgcuaaaggacuucaaagaguucgccucugggaggaaaucaauuacccuugauauauuaacugaaauugccucccuuccaacauaucucagcucccgcgcaaaauuggccuuagacaauauuguaaugcuacacaccacagagaggggagguagagcguaucaacaugcguugaacgaguugccagagagucuagagacucucaugcuaguagcauuauuaggugcuaugaccgccggaaucuucuuauuuuucaugcaagguaaagggaucgggaagcuaucgaugggauuaauaaccauagcaguugcaucuggauuacucugggucgcggagauucaaccgcaauggauugccgcuuccauaauucuugaauuuuuccucaugguacuacucauaccagaaccggaaaaacaaaggacaccucaagacaaucaacucauuuacguuauacuggcuaucuuaacuaucauuggucuuauagcagcaaaugaaaugggauuaauugagaagacuaaaacagauuuuggauucuaucaagugaaaacugaaacgacaauauuagacguugaucuaagaccagcaagugcguggacauuauaugcggucgcaacuacgauccuuacaccgaugcugcgacauaccauugagaacacaucggccaaccuaucgcuagcugcaauugcuaaccaagcagcaguacuuauggggcugggaaagggcuggcccuuacauagaauggaccuagguguuccccuuuuagcaaugggguguuauucacaagugaacccaaccacucuaacggcuaguuugguaaugcugcucguacauuaugcaauuauuggccccggguuacaagcuaaggcaacaagagaggcacagaaaagaacagcggccgggauuaugaagaauccaacagucgacgguauaacuguaaucgaccuggaacccauaucauaugauccgaaauuugaaaagcagcuuggccaaguaaugcuacuuguguuaugugcagggcaauuauuacuaaugcgcacuaccugggccuuuugugaaguucuaacucuagcaacaggaccuauacuuacguuaugggaaggaaauccgggccgauuuuggaauacaacaauagcggugagcacagccaacaucuucagaggaaguuaucucgccggagcaggccuagcguuuucucuaaucaaaaaugcacaaacucccaggagagggacugggacgacuggagaaacccuuggugaaaaauggaagcgucaguuaaauucuuuagaucgaaaagaguucgaagaauauaaaagauccggaauccucgagguagacagaacggaagcgaaaucugcgcugaaagacggcucaaaaaucaaacaugcagugucucggggcucgucgaaaauucgcuggauaguagaaaggggaaugguuaaaccuaaaggcaaagucguagaucucgggugugggaggggcgguugguccuauuauauggcaacuuugaaaaaugucacagaaguuaaaggauacacaaaaggaggaccaggacacgaagaaccaauuccaauggccacuuaugguuggaaucuaguaaaguuacauagugggguagauguuuucuacaaaccuaccgaacaaguagauacguuauuaugcgauaucggagagucaucaaguaauccgacaauagaggaaggaagaacgcuaagggucuugaaaaugguagaaccuugguuaaguucuaaaccagaguucugcaucaaaguccuaaaccccuauaugccaacugugauugaagaacuagagaaacuucagagaaagcacggcggaaacuuaguaagguguccacuaucucgaaauuccacucaugaaauguacuggguaucgggagcgagcgggaacauuguaucaagugucaauacuaccucaaagauguuacuaaaucgguucacuacucgacaucgcaagccaacuuaugagaaggacguagauuuaggggcagguacacggaguguaaguacggagacagagaagccggauaugacuauuauuggucgaagauuacaacgauuacaagaggaacauaaggaaacauggcauuacgaucaggaaaacccauacagaacaugggcauaccaugguaguuaugaagcuccaucaacuggaagcgccaguuccauggugaaugguguagugaaacuccuuacgaaacccugggacguuauccccauggucacacaguuagccaugaccgauacaacgccauucggacaacagcgagucuucaaagagaaaguagauacacgaacaccucagccaaaaccagguacacgaaugguuaugaccacaacagcaaacugguuaugggcacuauuagggaagaagaaaaacccacgacuauguacaagagaagaguuuauuucaaaaguacguucaaaugcugcgauaggggcuguguuccaagaagaacaaggauggacauccgcaucagaggcaguaaacgacucuagauuuugggaguuagucgauaaggagagagcccuacaucaagagggcaaaugugagucaugcguuuauaacaugaugggcaagagagagaaaaagcuaggagaauuuggcagagcaaaaggcaguagggcaauaugguacaugugguuaggggcuagguuucuagaauuugaagcccugggauuccuuaaugaagaucauugguucggucgugaaaauaguuggucagggguggaaggugagggacuucaccgauuaggauacauuuuagaggaaaucgacaagaaagacggagacuuaauguaugcagacgauacagcaggaugggacacacgaaucacggaagacgaucuacaaaaugaagaauuaauaacagaacagauggcgccucaucauaaaauccuagcuaaagcuauuuucaaauuaacguaccagaacaaaguuguuaaaguacucagaccaacaccuagaggagcagucauggauauaauaaguagaaaagaucaacgggguagugggcaagugggaacauacgguuuaaacacuuucacgaacauggaaguucaauuaauucgucagauggaagcagaagguguaauaacacaggaugauaugcaaaauccaaagggauugaaagaaaggguugaaaaguggcugcgagaaugcgggguagaccgucuaaaaagaauggcaauuagcggugacgacuguguagugaagccgcuagacgagcgguucggcacaagucuccuguuccuaaaugauauggguaagguuagaaaagacauuccacaaugggaacccucgaaaggauggaaaaacuggcaagaaguaccguucuguagccaucauuuccauaaaauauuuaugaaagauggcagaagucuagucguuccaugcagaaaccaagacgaauuaauaggacgugcacgaauaagccaaggugcgggcuggagucucagagaaaccgcaugccuaggaaaggcauacgcucagauguggagucuaauguauuuucacaggagagaucuaagauuagccuccauggcaauuugcuccgcaguucccaccgaaugguucccuacaucuaggacaacauggucgauucacgcucaccaucaauggaugacaacugaagauaugcuaaagguuuggaaucguguauggaucgaagauaauccuaauaugauagauaaaacaccaguacauaguugggaggauauucccuaccuuggaaaacgggaggaccuuuggugugguucguuaauaggauugagcucccgagcaacuugggcuaaaaauauacauacagccauaacccaaguacguaacuugauagguaaagaggaauacgucgauuacaugccuguaaugaagcgauauucugcccccagcgaaucagaagguguguuauaa

SEQ ID NO: 23617 - RNA, 9867 nt, Artificial Sequence
  derived and/or modified CDS sequence (opt6) from DENV-4__GQ199884__SS-prME
aguaccaucacacuacuuugucugauaccuacagugauggcauuccauuugucuacccgcgauggagaaccuuuaaugaucguagcaaaacaugaaagaggaagaccacugcuguuuaaaacgacagaaggcauaaauaaauguacacuaauugcaauggauuugggggaaaugugugaagauacggucacguacaaauguccauugcuaguuaauaccgaaccagaagacauagauuguugguguaacuugaccucaacauggguuauguaugguacauguacacaaaguggagaacgcagaagagagaaaagaucggucgcguuaaccccacacucggggaugggauuagaaacuagggcugaaacauggaugucaucugaaggagcauggaaacacgcacaaagaguugaaagcuggauauuacgcaauccaggauucgcauuguuagcgggguuuauggcuuauaugauuggccagacggggauacaaaggacaguauucuuuguacuaaugauguuaguugcaccuucguacgguaugcgaugcgucggcguugggaaucgagacuuuguggaaggagucagcggaggagcguggguggauuuaguccuagaacacggugguugcguaacaaccauggcacaaggaaaaccaacuuuagacuucgaauuaacaaaaacaaccgcaaaagaagucgcuuuauuaagaacauacuguauagaagcaagcaucucuaacauuacuacagccacaagauguccgacacaaggagaaccauaucuaaaagaagaacaagaucaacaauauauuugucggcgugaugugguagacagaggguggggaaacgguuguggucuauucggaaaaggugggguagucacaugcgccaaauuuucaugcagcggaaaaauaacagguaacuuaguacagauugaaaaccuagaguauacaguaguagucacuguucauaauggcgacacacaugcaguuggcaacgauacuucaaaucauggagucacugcuacgaucacgccuagaaguccaaguguugaaguaaaacucccugacuacggugaauuaacucuagauugcgagccaaggucagguauugacuucaaugaaaugauucuaaugaaaaugaaaaagaaaacauggcuagugcauaaacaaugguuucuugaccucccauugccguggacagccggugcagacacuagcgaaguacacuggaauuacaaagaaagaaugguuacuuuuaagguaccacaugccaagagacaagaugugacaguauuaggcagucaagaaggagcuaugcauagugcccuagcaggcgcuacagagguagacaguggggaugggaaccauauguuugccgggcaccuuaaaugcaagguacgaauggagaaguuacggauuaaaggcaugagcuacacgauguguucgggaaaauuuaguauagauaaggaaauggcagaaacgcaacacggaacaacagucguaaaagucaaauacgaaggagcgggagcaccauguaagguuccaauagaaauucgagacguaaauaaagaaaaaguuguuggaagagugauaucaaguacgcccuuagcggagaauacaaauagugucacaaacauagaacuagaaccaccauuuggugacucauauaucguaaucggugucggaaauucagcgcuaaccuuacacugguuuagaaaagguucaaguauaggaaaaauguuugaaaguacauacagaggggcaaaacguauggccauacuaggugaaacagcuugggauuuugguaguguuggcggccuuuuuacaucauugggaaaagcaguacaccaaguguuuggaucuguuuacacuacaauguuuggaggggucucauggaugauaaggauacuuauuggcuucuuaguauuauggaucgguaccaauucucgaaacacgucaauggcuaugacauguaucgcaguaggcgggauaacacucuuccuaggcuuuacuguacaagcugauaugggaugugucguaucauggucugggagagaacuaaagugugggucagggaucuuugucguagacaaugugcacacauggacugaacaauauaaauuucaacccgaaucccccgcacgucuugcuagugcaauccuuaaugcccauaaggauggagugugcggcauuagaucgacuacccguuuggagaauguuauguggaaacaaauaacuaaugaauuaaauuaugugcuaugggaaggaggacaugaucuaaccguuguugccggggacgugaaagguguauuaacuaagggaaaaagagcacucacacccccgguaagcgaucugaaguacagcuggaaaacauggggaaaagcuaaaauuuuuacucccgaagcacgaaauagcacauuccuuauugacgguccggauacuucagaaugcccgaaugaacggagagcuuggaacaguuuggaaguagaggauuauggcuuugggauguuuacaacaaauauuuggaugaaauuucgugaagggaguagcgaggugugugaucauagacuaaugagcgcggcaauaaaagaccaaaaagcuguacaugcagacaugggcuacuggaucgagucuucgaaaaaccaaacauggcagaucgaaaaggccucacugaucgaagugaaaacuugccuguggccaaaaacacacacauuauggagcaacggaguuuuggaaagucagauguuaauuccgaaaucauacgcuggaccuuucagccaacacaauuacaggcaagguuaugcuacucagacaguaggaccauggcaucuaggaaaacucgaaauugacuucggcgagugcccaggaacuaccguaacaauacaagaggacugugaucauagagggccaucgcuaagaacgacuacugcauccggaaaacuuguaacgcaaugguguugcagaaguuguacuaugccaccccuaagauuucuaggugaagacgggugcugguauggaauggagauaagacccuugagcgaaaaagaagaaaacaugguaaagucgcaagucgcugccggacaagggacgucugaaacuuucuccaugggauugcuuuguuuaacacucuucguagaagaaugcuuacgacgucgcguaacucgaaaacauaugauccuggccguaguaauuacauugugcgccauaauacuugguggccucacauggauggaccuauuaagggcauuaaucaugcucggggacacuauguccgggagaaucggaggucaaacucaucucgccaucauggcggucuuuaagaugucaccuggauacguauuagggguauuuuugagaaaauuaacgucaagagaaacagccuuaaugguaauagguauggcaaugaccacgacccuuucuauaccccaugaccucauggaacuaauagacggaauaagucugggccuaauacuucucaaaauagucacccaauucgacaauacacaggugggaacgcuugcgcuuagccuaacuuuuauucguucgaccaugagccuuguaauggcguggaggacuauaauggcgguccuauucguuguaacgcuaaucccacuauguagaaccuccugcuuacaaaaacaaucucauuggguagagauaacugcuuugauacugggcgcacaagcguuaccaguauauuuaaugacacugaugaaaggagcuucucgaagaagcuggccgcuaaaugaaggaaucauggcaguaggauuaguuagucuauuaggcucagcacuucugaaaaaugacguaccucuagcugggccaauggucgcaggcggacuauuacuggccgcuuacguaaugucugguucauccgcugauuuaagucuugaaaaagcagcuaauguacaaugggacgaaauggcugauaucacggggucaagcccaauaauugaagucaaacaggacgaagauggaaguuucuccaucagagauguggaagagacuaacaugauaacuuuacucgugaaacuugcacuuauuacaguaucuggauuauauccacuagccauuccugugaccaugacacuuugguacauguggcaagucaaaacccagagaagcggagcucuuugggauguaccuucuccggcggcgacacaaaaagcagcgcucucugaaggaguuuaccggauuaugcaacggggauuguuugggaaaacacaaguagguguagggauucauauggaaggaguuuuucacacaauguggcauguuacaaggggaagcguaauaugccacgaaacaggccgauuggaaccauccugggcugacguaagaaacgacaugauaucauauggaggagguuggagguuaggcgauaaaugggacaaagaagaagauguucagguauuagcaauagaaccaggcaaaaacccaaagcacguucaaacgaaaccagggcucuuuaaaacauuaacaggagaaaucggcgcggugacucuagacuucaagccaggaacgagcgguucaccuauuauaaauagaaaaggcaaaguuauaggccuauaugggaauggaguuguaacaaagaguggagauuauguaagugccauaacccaggcugaaagaauaggugagccggauuacgaaguugacgaagauaucuuuaggaagaaaagguuaacaauaauggacuuacauccuggagcaggcaaaacaaagaggauuuuaccuucaauagugcgagaagcauuaaaaaggcgacugcguaccuugauucuagcgccuacaagaguaguugcagcagaaauggaagaggcacuucgggguuuaccuauuagauaucaaacuccagcuguaaaaucagagcauacuggacgcgaaauuguugaccuuaugugucacgccacauuuacuacccgauuauuaucgucaacaagaguccccaacuauaauuuaauaguaauggaugaggcacacuuuacggacccuucaucuguggcggcucgugguuauauuagcacacgcguugaaaugggagaggcugcagcuaucuuuaugaccgcgacaccaccgggugcuacagauccguuuccucaaucaaacaguccaauagaagacauugaacgagaaauaccagagaggucauggaacacaggauucgacuggauaaccgacuaccaaggaaaaacagucugguucguuccuucgauaaaagcugggaacgacauugcuaacugucugcgaaaaucaggaaagaaagugauucaacucagucguaaaacguuugacacugaauauccaaaaaccaaacucaccgacugggacuuuguuguaacaaccgauauaagcgaaaugggagcuaauuuucgagcgggacgagucauugauccccggcguugcuuaaaaccaguaauacuaaccgauggaccggagcgcgugauucuugcggggcccaucccaguaacaccagcauccgcagcgcaaaggaggggaaggauagguaggaacccagcucaagaagaugaucaauauguauucucuggcgacccucucaaaaaugaugaggaucaugcucacuggacugaagccaagaugcuacuagauaacauuuacacucccgaagggauaauaccaacguuauucggaccugaacgugagaaaacgcaggcaauugauggugaguucagacuucgaggagagcaaaggaaaacguucguagaacuaaugcggaggggugacuugcccgugugguuaucauauaaagucgcguccgcugggauuucguacaaagaucgggaaugguguuucaccggagaaagaaauaaucaaauacuagaggaaaacauggaaguugaaauauggacacgggagggagagaagaagaaacuucguccgcgguggcuagaugccaggguauaugcagacccaauggcguuaaaagauuucaaagaguucgcuucaggacguaaaagcaucacucuggacauccuaacugaaaucgcuagccugccgacauaccuaagcucaagagcaaagcuagcccuagauaauauugucauguugcacacaaccgaacgaggcgggcgagcauaucaacacgcucugaaugagcuuccggagagccucgaaacauuaauguuaguagccuuauugggagcuaugaccgcgggcauauuucuguucuucaugcaagguaaggggaucgguaagcuaucaauggguuuaaucacaaucgcaguugcgagcggauuacuguggguagcggaaauacaaccgcaguggauagcagccagcauuauccuagaauuuuucuuaaugguauugcuaauaccagaacccgagaaacaacguacgccacaggauaaccagcuaauauacguaauuuuagcaauucuuacuauaauaggacuaaucgcagcaaaugagaugggacuaauugagaaaacaaaaaccgauuuuggguucuaucaaguaaagacugaaacaacaauacuagacguugacuuaaggcccgcgucagcguggacccuuuacgcugucgcaaccacgauacuaacgccuaugcuaagacacacuauugaaaauacaucugcaaacuugagcuuagcagcgaucgcaaaccaagcugcggugcuaaugggacuuggcaaaggauggccuuuacauagaauggaccugggcguuccauuacuggcaauggggugcuacucucaaguuaauccuacaacccuaacggcuagccuuguuauguuauuaguacauuacgcuaucauaggacccggccuacaagcaaaggcaacucgggaggcgcaaaagagaacagcagcagggauaaugaaaaauccuaccguagauggaauaacuguuauagacuuggaacccauuuccuacgauccaaaguucgaaaaacaguugggacaaguaauguuauuaguacuuugcgcuggacaauuauugcuaaugagaaccacgugggccuucugcgaggugcuuacgcucgcgacagguccgauacucacgcuuugggaaggcaauccaggacgauucuggaacaccacuauugcggucucgacagcaaauauauucagagguuccuauuuggcgggagcgggacuagcauuuucauugauuaaaaacgcucaaacuccaagaagagguacaggaacaacuggagaaacccuaggagagaaguggaaaaggcaacugaauaguuuggaucgcaaggaauuugaagaauauaaacgcagcggcauacuagaaguugaucgcacggaagcaaaaucagcccucaaggauggaagcaagauuaagcacgcaguaagucgcgggucgucgaagauuagguggauaguagaaagaggaaugguaaaaccaaaagggaaaguuguugacuuaggauguggaagagggggauggaguuauuauauggcuacccucaaaaauguaacagaagugaagggauacacaaaaggaggaccaggacacgaggagccaauaccgauggcaacauacggcuggaaucuagugaaacuucacucagguguugauguauucuacaaaccaaccgaacaaguugauacccuucuaugugauauuggagagucuucgucuaacccuacaauagaagaaggucguacacuaagaguccucaagaugguugagccaugguugucaagcaaacccgaauuuuguauaaagguacugaauccauauaugccuacaguaauagaagaauuagaaaaauuacaacgaaaacauggagguaauuugguacgauguccauuauccagaaauucaacccaugagauguacuggguuucaggcgcuucaggaaacaucguuuccucgguaaauacuacaucgaaaauguuacuaaauagauuuacgacacgacaccguaaaccgacguacgaaaaagauguugaccuaggagcaggaacgaggagcguaucuacugaaacagagaagccagauaugacaauaauaggaagacgacugcagcgucuacaggaagaacacaaagaaacauggcauuacgaucaagaaaacccauaccguaccugggcauaucauggaucauaugaagcaccaucgacaggcucggcuucaagcauggugaacggaguaguaaaauuacuaacuaagccgugggacguaaucccaaugguaacccagcuagcaaugacugauacgacaccuuucggacaacaacgaguuuuuaaagagaaaguggacacaaggacaccccaaccuaagccugguacacgcauggugaugacaacaacugccaacugguuaugggcauuacuugguaagaagaaaaacccuaggcuuuguacaagagaggaguucauaagcaaaguacgcucuaaugcagcaauuggagcgguuuuucaagaggaacaagguuggaccagugccagugaagcaguaaaugacaguagauuuugggaacugguggauaaagaaagagcauuacaccaagaagguaagugugagucguguguauauaauaugaugggaaagcgugagaagaaauuaggugaauuugggcgagcgaaaggauccagagccauuugguacauguggcuaggagcccgauuccuagaauuugaagcccuaggguuucucaacgaagaccauugguuugggcgggagaacaguugguccggcguagagggcgaggguuugcaucgcuuaggauauauacuugaggaaauagauaagaaagauggagaccuaauguaugcggaugauacugcagguugggacacaagaauuaccgaggaugaucuucaaaacgaagaacugaucacagaacaaauggcgccacaucacaaaauacuggccaaagcaauauucaaacucacuuaccaaaauaaaguuguuaaaguucuuagaccuaccccaagaggugcgguuauggacauaauuucaagaaaagaucaacgcggaucaggacaaguggguaccuacggauugaauacguuuacaaacauggaagugcaacuuauccgacagauggaagccgagggggucauuacgcaagacgacaugcagaaccccaagggauuaaaagagagaguugaaaaguggcugcgagaguguggaguugaucguuuaaaaagaauggcuauuagcggugacgauuguguuguaaaaccacuagacgaaagauuuggcacuagccuacuauuccuaaacgacaugggcaaagucagaaaagauauaccccagugggaaccaucuaaaggauggaaaaauuggcaagaagucccauucuguucacaccauuuucauaaaaucuucaugaaagacggaagaaguuuaguggugccaugcaggaaccaagacgaacuuaucgguagagcaagaauuucacaaggagccggcuggagucuaagagaaacagccugcuugggaaaggcuuacgcacaaauguggucacuaauguauuuccauagaagagaucuacgacuagcaaguauggcgauaugcucagcgguucccacugaaugguuuccuacaucucgaacaacuuggaguauucaugcccaucaucaguggaugacuacugaggauaugcugaaagucuggaaucguguauggauugaagauaauccuaauaugauugauaaaacgcccguacacucgugggaagacaucccauaucuagggaagagggaagaucucuggugcgguucgcuaaucggacuaucaucaagagcaaccugggcuaagaauauacacaccgcaauaacccaaguaagaaauuugauuggaaaggaggaauauguagauuauaugcccguaaugaagcgauauucagcaccgagugaaagcgaaggaguguuauag

SEQ ID NO: 23618 - RNA, 9867 nt, Artificial Sequence
  derived and/or modified CDS sequence (opt6) from DENV-4__FJ882595__SS-prME
ucgacaauaaccuuacuauguuugauacccacagcuauggcauuccacuugucuacaagagauggagaaccacuaaugauuguagcaaaacaugaaagagggcguccuuuacuauuuaaaacuacagaagguauaaauaaauguacccuuaucgcaauggauuuaggagaaaugugcgaagauacaguaacuuauaaaugcccgcuacuuguaaauacggaaccugaagauauagacuguugguguaaccuuaccagcaccugggucauguacggcacuuguacgcaguccggugaaagacgccgugagaaacgcucuguugcucuaacaccgcauagugguaugggauuagaaacacgugcugaaacauggauguccucugaaggcgcauggaagcaugcacaacgaguagaaagcuggauauuaagaaauccuggguucgcacucuuggcaggauucauggcauauaugauuggacaaacggggauucagcgaacaguauucuuuguacucaugauguuaguagcaccuuccuaugguaugcgauguguaggcguaggaaacagggacuuugucgaagggguuuccgguggugcuuggguagaccucguucuggaacauggaggcuguguaacaacgauggcacagggcaaaccuaccuuagauuuugaauuaacuaaaacuacugcuaaagaggucgcauuacuucguacuuauugcaucgaagcuaguauauccaacauuacaacggcaacaagauguccaacacagggagaacccuaccucaaagaagaacaagaucagcaauauauuugccgaagagacgucguagacaggggaugggguaauggguguggacuuuucgguaagggaggcgucgucacaugcgcaaaguuuagcugcagugguaaaauaacuggcaaucuuguacaaauagagaaccucgaguacacaguaguuguuacuguucacaauggagauacucaugcgguuggaaacgacacaucaaaucaugguguaacagcuacaaucacaccgagaagcccauccguagaaguuaaguuaccugauuacggagaacuaacgcuugauugcgaaccccgaaguggaaucgauuucaaugaaaugaucuuaaugaaaaugaaaaagaagaccuggcuaguccauaagcaaugguuucuagauuugccauuaccuuggaccgccggugcugacacaucagaaguacauuggaacuacaaagaaagaauggucacauucaaggucccgcaugcaaaaaggcaagauguaaccguacuagguagucaggaaggagcaaugcauuccgcccuagccggcgcaacugaaguugauagcggagaugguaaccacauguucgcaggacacuuaaaauguaagguaagaauggaaaaacucagaauaaaaggcaugucguacaccauguguucuggcaaguucucaauagacaaagaaauggcggaaacccaacauggaacuaccguagucaagguaaaguaugaaggagccggggccccuuguaagguacccauagaaauucgugauguuaacaaagaaaaagucgugggacguguaauuuccuccacaccccuugcagaaaacaccaacaguguaacaaacaucgaacuugaaccaccauucggagacagcuauauaguaaucgggguaggaaauucugcgcugacgcugcacugguuucggaaaggcucaaguaucggcaaaauguucgagucaaccuacaggggugcaaaaagaauggcgauauuaggcgagacagcuugggacuuuggaucaguagguggcuuauucacgaguuuaggaaaagccguucaccaaguguuugggucaguuuauacaacaauguuuggagguguuaguuggaugauuaggaucuuaauaggauuuuuagucuuauggauugguacgaacucgcgaaauaccucuauggcgaugaccugcauugcagucggaggaauuacacuauuccuaggauucacuguucaagccgacauggggugcgugguuaguuggucaggacgugaacugaaauguggcucugguaucuuuguuguagacaacguucauacuuggacugaacaauauaaauuucagccagaaucuccugcacgacuagcuagugccauacuuaaugcccacaaggauggcguauguggaauacgaaguacaacucgacuagaaaauguaauguggaaacaaauaacaaaugaacuaaauuacgucuuaugggaaggaggccacgauuuaacagugguugcaggagacguuaagggaguguuaacgaagggaaaaagggcauuaacuccgccagucagcgaucugaaguauucuuggaaaacauggggaaaagcuaagaucuuuacaccagaggcacguaacucaaccuuccuuauagacgggccugacacaagcgaaugcccuaacgaaaggagagcauggaacucauuagaaguugaagacuauggauuuggaauguucacgacuaacauuuggaugaaauuuagagaagguuccagugaaguuugugaccacagauuaaugucagcugcaauaaaggaccaaaaagcaguacaugccgauaugggauauuggauagaaaguucuaaaaaccaaacuuggcaaauagagaaagccagcuuaaucgaaguaaaaacauguuuauggccaaagacgcauacauuauggucaaaugguguucuugagagucaaaugcuuauuccaaaauccuaugcuggaccguuuucacagcacaauuacagacaaggauacgccacccaaaccgucggaccauggcaucuugguaaacuagaaauugauuuuggggaaugcccagguacaacaguaacuauacaagaagauugcgaucaucgugggccaaguuuacguacuacgacugccaguggcaaauuaguaacccaauggugcuguagaaguugcacaaugccacccuuacgauucuugggagaagaugguugcugguacggaauggaaauuagaccacucagcgaaaaagaggaaaacauggucaagagucaaguugcagcugggcagggcaccagugagacauucucgaugggcuuacuaugccuuacauuguucgucgaagaaugccucagaagacgaguuaccagaaaacacaugaucuuagccguaguaauaacccuuugugcuauaauauuggguggcuuaacuuggauggauuuacuacgcgcauuaauaauguuaggagacaccaugucuggcagaauaggcggacaaacacaucuagcaauaauggcaguguucaaaaugucgccgggauauguauuggguguauuuuuacggaaacuuaccagucgugagacagcacucaugguuauugguauggcaaugacgacaacuuuaucuauuccacacgaucuuauggaacucaucgacgggauuaguuuggguuugauacuacucaagauuguaacucaauuugauaauacacaaguggggacacuugccuugagccugacuuuuauucgcaguacgaugagcuuagugauggcguggaggacgauaauggcagucuuauuuguugucacauuaaucccucuaugucgcaccagcugccuucaaaaacaaagccacuggguggaaauaacggcacugauucuaggagcacaagcucugcccguauaccuaaugacccucaugaaaggcgccucgaggcguagcuggccacucaacgaagggauuauggcuguaggcuuaguuagccuuuuaggaucugcccuacuaaagaaugauguaccucuagcuggacccaugguugccgguggccuccuauuggcagcguauguuaugagcggcaguucugccgaucuaagccucgaaaaagccgcuaauguacaaugggacgaaauggcagauauaaccgguuccucaccgauaauugagguaaaacaagaugaggacggcucauuuaguauccgugacguagaggaaacgaacaugauaacacuauuagugaaauuagcauuaauuacaguuuccgguuuauacccgcucgcgaucccgguaacaaugaccuugugguauauguggcagguuaaaacucaaaggucaggagcacuaugggauguuccaucacccgccgcuacacaaaaggccgcacuuucggaaggaguuuauagaauaaugcaacgaggacuuuuuggaaaaacacaaguaggugucgguauacacauggaaggcguauuucacacaauguggcauguaacacggggaaguguaauuugucaugaaacaggcagacucgagccuucuugggcggauguuaggaaugacaugauaucuuauggaggaggguggagauugggcgauaagugggacaaagaagaagauguacagguguuggccauagagccggggaaaaaccccaaacacguucaaacaaaaccaggccucuucaaaacacugacaggagaaauaggagcugucacauuagacuuuaaaccagguaccagcgggucuccaaucauuaauagaaaagguaaaguaaucggacuauaugguaaugguguuguaacaaagucaggugauuaugugagugcaauuacacaagcggaacguauuggcgaacccgauuacgaaguagaugaagauauauucagaaagaaacguuugacuauuauggauuuacacccaggagcuggaaaaacaaaacggauuuuaccaaguauuguacgugaagccuuaaagagaagauuacgcacauuaauucuagcaccgacuaggguugucgccgccgaaauggaagaggcuuuacgaggcuugccaauucgauaucaaacuccggcaguaaaaucggaacauacaggccgagaaauaguugaccuuaugugucacgcaaccuuuacaacaagacuccucucuaguacuagggucccuaacuacaaccuuauagucauggaugaggcacauuuuaccgauccaucaaguguagcugcgagaggcuauaucucaacgcgcgucgagaugggcgaggccgcugccauauucaugacggcuacaccaccgggagcaaccgauccauucccucaauccaacaguccaauagaggauauagaacgcgaaauacccgaacgcucauggaauacaggguuugauuggauuaccgacuaucaaggaaagacagucugguuuguuccgucgauuaaagcaggaaacgauauugcuaauugccugcgaaaaucuggcaagaaaguaauucaauuaagccggaaaacguuugauacugaauauccaaaaacaaaacucaccgacugggacuuuguagucacaaccgauaucagugaaaugggugccaacuuucgugcagggaggguuaucgauccuaggcggugcuuaaaaccagugauacugacagaugguccagaacgaguuauucucgcaggaccaauaccaguuaccccagcgucagcagcacaacgaagagguagaauaggaagaaauccugcacaggaagaugaucaauauguauuuuccggugauccccucaaaaaugaugaggaucaugcgcauuggaccgaggcuaagaugcuacuagacaauaucuacacgccagaaggaauaauaccuacucucuuuggccccgaaagagaaaagacacaagcuauagauggugaguuuagacuucgcggugagcaacgaaaaacuuucguagaauuaaugagacgaggagaccugccggucuggcuaaguuauaaaguagccucggcggguauaucauauaaagacagggaaugguguuucacaggagaaagaaacaaucagauuuuagaagaaaauauggagguagaaauuuggacacgcgaaggugagaaaaagaaauuaagaccuagauggcuugacgcacguguauacgcagacccaauggcauuaaaagauuuuaaagaauuugcaucaggccgcaaaucgauaacgcuagacaucuuaaccgaaauugcuagcuuaccaaccuacuuaucgucuagagcaaaauuagcauuagacaacauagucaugcuacacacuacggaacguggggguagagccuaccagcacgcgcucaacgagcuccccgagagucucgaaacucugaugcugguugcauuacuaggggcuaugacugccgggauuuuucuauucuucaugcaggguacaggaaucggaaaauuaaguauggguuuaauaacaauagcaguagcaucgggucuucuauggguagcggaaauacagccgcaauggaucgcugcuaguauuaucuuagaauuuuuccuaaugguccuguugaucccagaaccagaaaaacaacgcacaccacaagacaaccaguuaauauaugucauccuuacuauauugacaauaauaggacuaaucgcggcuaacgaaaugggauuaauagagaaaaccaaaaccgauuucgguuuuuaucaaguaaaaacagagacaaccaucuuagacguggauuuacgucccgcgagugcauggacucuuuacgcuguagcuaccacaauuuugaccccgaugcuacggcacaccaucgaaaacaccucugcuaacuuguccuuagcugccaucgcuaaccaagcggcgguguugaugggacuuggcaaggguuggccuuugcacagaauggaucucggcgucccucuucucgcgaugggaugcuacucacaagucaaccccacuacuuugaccgcaagccuuguuauguuauuaguacauuacgcaaucauugggccaggucugcaggcuaaagcgacaagagaagcgcagaaacguacggcugcaggcauuaugaagaauccaacaguagacggcauaaccguuauugaccuugaaccgauaagcuacgacccaaaauucgagaaacaacucgggcaaguuauguuacucguacuaugcgccggacagcugcuuuuaaugagaacuacaugggcuuuuugcgaaguacuaacuuuggccacaggaccaauauuaacucuaugggaaggaaauccugggcgguuuuggaacacuacaauagcagucucaacagccaauauuuuuagagguucuuacuuagccggugcaggauuagcauuuucacugauaaagaaugcucaaacuccgaggagaggaacagguacuacgggcgaaacucuaggggagaaauggaaaaggcaauuaaauucacucgauaggaaagaguuugaagaauauaaacgaucagggauacucgaaguggauaggacugaagcaaaaucugccuuaaaagauggaagcaagauaaaacaugcagucucgagggguagcagcaaaaucagauggauaguagaaagaggcaugguaaagccaaaaggcaagguaguugauuuaggauguggacggggaggcugguccuacuacauggccacuuugaaaaauguuacggaaguaaaagguuauacaaagggaggcccgggacacgaggagccaaucccuauggccacauauggcuggaacuuagucaaauuacauagcggaguagauguguuuuauaaacccacagaacaaguggauacgcuguuaugugauaucggugagagcuccucaaaucccacaauagaagagggaaggacuuuacgcguucuaaaaaugguugaaccgugguuaaguucaaagccagaauuuuguauaaaaguacucaaccccuacaugcccacgguuauagaggaauuggaaaaauugcaaagaaaacaugguggaaaucuuguacgaugucccuuaucacguaacucuacccaugagauguauugggugaguggagcuaguggaaacauuguaucaaguguaaauaccacgagcaaaaugcuauugaaucgauucacuacgaggcauagaaagccaacuuaugagaaagauguagaccuaggcgcuggaacacguucaguaucuacagaaaccgaaaagcccgacaugacaauaauugguagaagauuacaaagauuacaagaagaacauaaagagacuuggcauuaugaccaagaaaauccguaccggacaugggccuaucauggaucuuaugaagccccuuccacggguucugcuaguucaauggucaaugggguaguaaaauuacuaacuaaaccaugggaugucauuccuaugguaacgcaauuggccaugacugauacaaccccuuuugggcagcaaagaguauuuaaggaaaaggucgacacgagaacuccacaaccaaaaccagggacccgaaugguuaugacgacuacagcuaacugguuaugggcgcugcucggcaagaagaaaaauccacgauuguguacacgagaagaguuuauuucaaaaguucgauccaacgccgcaauaggagcuguauuucaagaggaacaaggauggacuagcgcaagcgaagcgguuaaugacucaagauuuugggaacuuguagauaaagaaagagcauuacaucaggagggcaagugugaaucuugcguauauaacaugaugggaaaaagggagaagaaauuaggagaauuuggacgagcuaaaggaaguagagcaaucugguauaugugguuaggggcacgguuucucgaguuugaggcucugggguuucugaaugaggaccacugguucggaagagaaaacagcuggucggggguggagggagaggggcuucauagguuaggauauauacuagaagaaaucgauaaaaaggauggggaucuuauguaugcagaugacacagcuggcugggauaccagaauuacugaagaugauuuacaaaaugaggaacuuauaaccgaacaaauggccccacaccauaaaauauuagcuaaagcaauuuuuaaauuaacauaccagaacaaaguaguuaaaguucuacgacccacaccacguggggcaguaauggauauaauaucgagaaaagaccaacgaggaagcggucaggucggcacuuauggucugaacacguucacgaacauggaggugcaacuaauuagacaaauggaagcagaaggagugaucacgcaagaugauaugcaaaauccaaaaggucuaaaagaaagaguagaaaaaugguuacgugaguguggcguagacagguuaaaacggauggcgauaucuggcgaugacugcguaguuaaaccucucgaugagcgcuucggaacuucuuuacuguuccuaaaugacauggggaaaguacggaaggauauuccacagugggagcccagcaaaggcuggaaaaacuggcaagaagucccauuuuguagucaucacuuccauaaaauuuucaugaaggacgggagaucucuaguuguaccauguagaaaucaagacgagcuaauaggaagggccagaaucagucaaggagcuggguggucacuccgcgaaacagcuuguuuagguaaagcguaugcacagauguggucacuaauguauuuccaccgaagagaucucagacuugcuucaauggcuaucuguagugcaguuccgacagaaugguucccaaccucucgaacuacuuggucaauacacgcgcaccaucaauggaugacaacugaagacauguugaaaguauggaauagaguuuggauugaagacaauccaaacaugauagauaaaacaccaguucauucuugggaagauauacccuaccuaggaaaacgggaggauuuauggugcgguagucuaauaggucucucuuccagagcgacaugggcuaaaaacauucauacggcuauaacgcaagugaggaaucuaauuggaaaagaagaauacguggacuauaugcccguaaugaaaagauauucagcuccuagugaauccgaagguguuuuauga

SEQ ID NO: 23619 - RNA, 9867 nt, Artificial Sequence
  derived and/or modified CDS sequence (opt6) from DENV-4__FJ882596__SS-prME
ucaacaauuacacuccucugccuuauaccaacaguaauggcauuucaucuaucaacucgagacggagaaccucuuaugauuguggcaaaacacgaaagagguagaccacuacuguuuaaaacaaccgaagggauaaauaagugcacacuaauagcaauggaccuuggagaaaugugugaagauacagugaccuauaagugcccacuacuugucaacacggaacccgaagacauagauuguugguguaaccucaccucaacauggguaauguauggaaccugcacacaaagcggagaaagacgucgggagaaacgauccguagcauuaacaccgcauucaggaaugggucucgaaacaagagcugaaacauggaugucuagcgaaggugccuggaaacacgcacagagagucgaaucguggauauugcgcaacccaggauucgcucugcucgcaggauuuauggcuuauaugauuggacagacaggaauacaaaggacaguauuuuucguuuuaaugaugcuaguagcacccagcuacgguaugcgauguguaggaguaggcaauagggauuuuguagaaggcguaucaggcggggcuuggguagaccucguauuagaacaugggggcuguguuacgacaauggcucaagggaaaccuacguuggauuuugaauuaacaaaaacgacugcaaaagaaguagccuuacuacggaccuauugcauugaagcaucgauuucaaauauaacuacggccacaagaugcccgacacaaggggagccguaucuaaaagaggagcaagaucagcaauacaucugucgaagagauguaguggauagaggguggggaaauggcuguggucucuuuggaaaaggaggaguaguuacaugugccaaauuuaguuguagugguaaaauaacuggaaacuuaguacaaauagaaaacuuagaauacacggucguagucacuguacacaauggggauacccaugccguaggcaacgauaccaguaaucacggagucacugcuacuauuaccccaagaucuccaucaguagagguuaaacuuccagauuacggggaauuaacacuagauugcgaaccuagauccggaauugacuuuaacgaaaugaucuugaugaaaaugaagaaaaagacuugguuaguucacaagcaaugguuucuggauuugccauuaccuuggacagcuggagcugacacaagcgaaguccacuggaauuacaaagagaggauggucacguuuaagguuccacaugcaaaaagacaagacguaacuguuuuggguucgcaagaaggugcuaugcauuccgcucuagcuggagcuaccgagguugauucaggugaugggaaucacauguucgcaggucaccuuaaaugcaaaguacgcauggaaaaacuccggauaaaagggaugaguuacacaaugugcagugggaaauucucaauagauaaagaaauggcggagacacaacacgguacaacaguuguuaagguaaaguaugaaggugcaggagccccuugcaagguucccauugaaauuagagaugugaacaaggaaaaagucguagggcgagucauaucaucaaccccguuagccgaaaauacaaacaguguuacaaacauagaguuagaaccaccauucggugauaguuacauugugauuggaguaggaaacagcgcauuaacgcuucauugguuuagaaaagguucuaguaucggaaagauguucgaaucgacguacagaggagccaaaagaauggcuauacuaggagaaacggccugggacuucgguagcguaggagggcuuuuuacgagucuaggcaaagccgugcaccaaguauuugguaguguauacacaacuauguucggugggguuuccuggaugauaaggauuuuaauaggauuucuagugcucuggauaggcacaaauagucgaaauaccaguauggcuaugacuuguauagcaguaggaggaauaacgcuuuuccugggcuuuacagugcaagcugacaugggcuguguugugucguggagcggaagagaauuaaagugcgggucuggaauauuugugguggacaauguacauacauggaccgaacaauauaaauuucaaccagagucucccgcacgauuggcuucggcaauuuuaaacgcgcacaaagaugggguauguggaauuaggagcaccacaagauuagagaacguaauguggaaacaaauaacgaacgaacuuaauuaugugcugugggaaggaggacacgaucuaaccguaguugcuggagacguucgagggguacuuacaaaagggaagagggcuuuaacaccuccggugucagaucuuaaguauuccuggaaaaccuggggaaaagcaaaaaucuucacuccagaagcucgaaauucgacguuccuuauugacggaccggauaccagcgaguguccuaacgaacguagagcauggaacucgcuagaaguugaagacuacggauuuggaauguuuacuaccaauauauggaugaaguuuagggaaggcagcagugagguaugcgaccaccggcugaugagcgcagcaauaaaggaccaaaaagcgguucaugcagauaugggauauuggaucgagagcucuaagaaucaaaccuggcagauugaaaaagcgucauuaauagaagucaaaaccugccucuggccuaaaacccauacauuauggucaaacggaguacuagagagucagaugcucauaccaaagucauacgccggaccauuuucccaacacaacuacaggcagggauacgcgacucaaacaguagguccauggcauuuaggaaaguuggaaauagacuucggggaauguccagguacuacuguaacuauucaagaagauugcgaucaccgcggaccuucuuuaagaacuacuacagcaucugggaaauuagucacucaauggugcugucguucuuguacaaugccaccuuuacgauuuuuaggcgaagaugguugcugguauggaauggagauuaggccuuuaucugagaaagaagaaaacaugguaaagucacaaguagcugcgggacaaggaaccagugaaacuuuuucgaugggccuauuaugccucacgcuauuuguggaggaaugcuuacgaagaaggguaacaaggaaacacaugauccuagccguagucauaacacuuugcgccauuauccucggaggguugacauggauggaccuauuacgagcccuuaucaugcugggagauacuaugucagguaggauuggaggacagacccaucuagcgauaauggcuguauuuaagaugucaccaggauaugugcuaggaguuuucuuaaggaaacuuacuagccgugaaacugcuuuaauggucauugggauggcaaugaccacuacacucagcauaccgcacgauuugauggaguuaauugauggcauuucuuuaggauugauuuuacuuaaaaucgucacccaguuugacaauacacaaguagggacucuggcacuaagucugacauucauaagaucaacaaugagccucguaauggcguggcgcaccauaauggccguuuuguucguaguaacacuuauaccacuaugucgaacauccugcuuacaaaaacaaucucauuggguagagauaacagccuugauauuaggcgcacaggcauugccuguuuaucuaaugacauugaugaaaggagccaguagaaggucuuggcccuuaaacgaggguauuauggcaguggggcuaguuucauuguuagguagugcacuauugaaaaacgauguaccccuagcuggucccaugguagcaggagggcuuuuacuagcagcuuauguuaugucgggaagcagugcagaccucagcuuagagaaagcggcaaauguccaaugggaugaaauggcagacauuacugggucuucacccauuaucgaaguuaaacaagaugaagauggcucguuuuccauccgugacgucgaagagacuaauaugauuacacuuuuagugaaauuagcacuaauaacuguuaguggauuguauccucuggcaaucccagugacgaugacuuugugguacauguggcaaguaaaaacgcagcgcaguggagcucucugggauguuccaaguccagccgcuacacaaaaagcugcuuugucugaagguguauaucgaauuaugcaacguggacuguuugguaaaacacaagucggaguaggcauucacauggagggaguauuucauacaauguggcacguuacgaggggcucuguaauaugccacgagacugguagacucgaacccagcugggccgauguaagaaaugauaugauuucuuauggugggggauggcgauuaggagacaaaugggauaaagaagaagacguucaaguacuugcaaucgaaccagguaagaauccuaagcauguacaaacaaagccaggucuuuucaaaacacucacuggugagauaggagcaguuacguuagacuuuaaaccggggacgagugguucgccuauaaucaaccguaagggaaaaguuaucggacuguacgguaaugggguugugacgaaaagcggugauuauguuagugccauaacucaagcagagcgaauaggagagccugauuaugaggucgacgaagauauuuucagaaagaaacgacucaccaucauggaccuacaucccggugcugguaaaacgaagcguaucuuaccuagcauaguaagagaagcauuaaaacgucgauuaagaacguugauucuugcgccaacuagaguaguagcugcagaaauggaagaagcauugagaggucuacccauaagauaucaaacuccagcuguaaaaucugagcauacgggcagggaaauuguagaccuaaugugucacgcaaccuucacuacaagauuacuaaguaguaccagagucccuaauuauaaucuaauaguaauggaugaagcucauuucacugacccaucgaguguagcugcacguggcuauauuaguacuagaguggaaaugggagaagcagccgcaaucuuuaugacggcaacaccaccaggggccacagacccauucccucaaaguaauagcccaauagaggauaucgaaagagaaauaccagaaagauccuggaauacgggcuuugacuggauaacagauuaucaaggcaaaacaguuugguuugugcccagcauaaaagcaggaaaugauauagcaaacuguuuaagaaaaucaggaaagaaaguuauucaacuuagcagaaagacauuugauacggaauacccaaagacuaaacuaaccgauugggacuuuguggugacaacagacauaagcgaaaugggugcgaacuucagagccggaagagugauugauccaagaaggugcuuaaagccagucauucuaacggaugguccagagagaguuauuuuggcaggucccaucccuguaacgcccgcaucggcagcccaaagaagaggacguauaggcaggaacccugcucaagaagaugaucaauaugucuuuaguggagauccucugaaaaaugaugaagaucacgcacauuggacugaggcaaaaauguuguuagacaauauuuauacuccagagggaaucauaccgacccucuuugguccagagagagagaaaacucaggcaauugauggcgaguuccgauugcgcggggaacagcggaagacuuucguagaacuaaugagaagaggagaucugccaguauggcuaucauacaaaguugcuucagcuggaauaucguauaaagaucgugaaugguguuuuacuggagaacgaaauaaccaaauuuuagaggaaaauauggagguggaaauauggacaagagaaggagagaagaagaaauuaagaccucgaugguuagacgcaaggguuuaugcagauccuauggcguuaaaggacuucaaggaguucgcaaguggacgaaagagcauaacguuagacaucuugacagaaaucgcuucguuaccaaccuaucuuucuagccgagcuaaguuggcacuagacaacaucguuaugcuucacaccacggaacgggguggacgagcauaucaacaugcgcugaacgagcucccggaaucauuagaaacacuaaugcuuguagcucuauuaggugcaaugacugccgguaucuuuuuauucuucaugcaagggaagggaauaggaaaacuaaguaugggauuaauaacaauagcaguugccagcggacuacuauggguugcagagauucagccccaauggauagcagcuagcaucauucuugaguucuuccuuaugguguuacuuaucccugaaccugaaaaacaaagaacaccucaagauaaccaacuuauauauguaauacuaacaauacuuacaauuauaggccuaauugcagcaaacgaaaugggcuuaauagaaaagacaaaaacggauuuuggguucuaucaagucaagacagaaaccacuauccuggauguugaucuuagaccagcaagcgcguggacucuauacgcgguagcgacaacgauacucaccccaauguugagacauacaaucgaaaauacgagcgcgaauuuaucgcuugcagcgauagcaaaccaagcagcagucuuaaugggccuugguaaaggcuggccccuucacaggauggacuugggaguaccucuauuagcaaugggguguuauagccaaguaaauccuaccacgcucacagcgucucugguaaugcuacuuguacauuaugcaauaauagggccgggucuacaagcuaaagcaacacgagaggcacagaaaagaaccgcugcaggaauuaugaagaaucccacaguggauggcaucaccguaaucgaccuggagccgauuucuuaugauccuaaguuugaaaaacaacuagggcaagugauguuauuaguucuaugugcaggacaacuacuccuaaugagaacaacgugggcuuuuugugagguacuuacacuagcaacuggcccgauucucacauugugggaagggaauccaggaagguuuuggaacacaacaaucgccguuuccacagcuaauauauuucggggaagcuaucucgcaggcgcagguuuagcguucagccuaauuaaaaacgcacaaacaccgagaagaggaaccggcacaaccggagaaacacuaggcgagaaauggaagaggcaauuaaacagccuugaccgcaaagaguuugaagaauauaagcggucaggcauucucgagguagacagaacagaagcgaaaucagcucuaaaggaugguucaaaaaucaagcaugcagucaguagagguaguagcaaaauacgguggauaguagaaagaggaauggugaaaccaaaagguaaagucgucgaucucggauguggaagagggggcuggucguacuauauggcaacacucaaaaacguaacagaaguaaagggguauaccaaagggggaccuggucaugaagaaccuauacccauggcuacauacggauggaaucuaguuaaauugcauagcggaguggauguauuuuauaagccaacagaacaaguugauacccuccuuugugacauuggugaaucaucgaguaacccuacaauugaggagggucgcacucuuagaguccucaaaaugguagaaccaugguuaucauccaaacccgaguuuugcaucaagguccuuaauccuuacaugccaacugugauugaagaauuagagaaguugcaacgcaagcacggugguaauuugguuagauguccuuuaucgagaaacucaacacacgaaauguacuggguuaguggagcaagugggaauauuguaucuucagucaacacgacuagcaaaaugcuacuaaauagguuuacuacaagacacagaaaaccuacauaugagaaggauguagauuuaggagcagggaccagaucgguaagcacugagacagagaaaccugacaugacaauaaucggcagaagauuacaaaggcuucaagaagaacauaaagagacuuggcacuacgaucaagaaaacccauacagaaccugggcauaucacggaaguuacgaagcgccuaguaccggaagcgcauccucuaugguuaauggugucguuaaacuuuugacaaagccuugggacguaauaccaaugguuacacaacuggcaaugaccgacacuaccccguuugggcaacagagaguuuucaaggagaagguugauacaaggacgccacagccuaaaccaggcacgcgaaugguaaugacaacaacagcgaauuggcuuugggcacuauuagggaagaagaaaaacccacgccucugcacucgagaagaauuuaucucuaaaguucgaucuaaugcugcaauaggugccguauuccaagaagaacaaggguggacauccgcgagugaagcgguaaacgacucacguuuuugggaauuaguugauaaagagcgugcauuacaccaagaggguaaaugcgagaguugcgucuauaauaugaugggcaagcgggagaagaaacuaggcgaguuuggacgugccaaagggagcagagcaauuugguauauguggcuaggugcgagauuccuggaguucgaagcucugggauucuuaaacgaagaucauugguuugguagggaaaacaguuggagugggguggagggcgaaggauugcaucgccuaggcuacauauuagaagaaaucgacaagaaagauggagauuuaauguaugcagacgacacugccggcugggauacaagaauaacugaggaugaucuacaaaacgaagaauuaauaacggaacaaauggcaccacaccacaaaauacuagccaaagcgaucuuuaaauuaacauaucagaauaaaguugugaaaguucuccggccgacgccaaggggagcgguaauggauaucauuagcagaaaagaccaaagaggguccggccaaguaggcacuuauggacuuaauacuuucacaaacauggaaguacaacuuauuagacaaauggaagcagagggcgugauuacgcaagaugauaugcagaacccuaaaggccugaaagaacguguggagaaauggcuucgagaguguggagucgacagacuaaaaaggauggcaauauccggagaugacuguguaguaaagccguuagaugagcguuuugguacuucucuacuauuuuugaacgauaugggaaaaguacgcaaagauauaccgcaaugggaaccuucuaaaggcuggaaaaauuggcaagaaguacccuuuuguagccaccauuuucauaaaaucuuuaugaaagaugggaggucccuaguaguaccaugccguaaccaagacgaauuaaucgguagagcuagaauuucacagggagcugguuggucauuacgagaaacagcuugccuuggaaaagcguacgcucagauguggucguuaauguauuuccaucguagagauuuacgcuuagccaguauggcaauauguucagcugucccgacagagugguuuccgacgagccgcacuacguggucgauccaugcacaucaucaauggaugacuacugaagacauguuaaaagucuggaaucgaguuuggauugaagacaaccccaacaugauagacaaaaccccaguacauucaugggaagauauuccguauuuagguaaacgugaggaucucuggugcggcucauugauaggacuauccucacgggcaacaugggcuaaaaacauacacacagcuaucacacaaguaagaaaucuaauaggcaaggaagaauauguugauuacaugccaguuaugaaacgauacagugcucccucagaaagcgaaggaguucucuga

SEQ ID NO: 23620 - RNA, 9867 nt, Artificial Sequence
  derived and/or modified CDS sequence (opt6) from DENV-4__FJ850059__SS-prME
ucaacuauaacucuucuaugcuuaauaccaacuguuauggcguuucaucuaucaaccagggacggggaaccacuuaugauaguugcgaaacaugaacgugggagaccgcuacuauuuaagacuaccgaaggaauaaauaaaugcacauuaauagcgauggauuugggagaaaugugugaagauacgguuacauacaaaugcccuuuauuagucaauacugaaccagaagauaucgauugcuggugcaaccucacaaguacuuggguuauguacggcacuuguacacaaagcggagaacgcagaagggagaaacguucuguggcucugacaccacacagugguaugggacuagaaacgcgagcagaaacguggaugucaucugagggcgcuuggaaacacgcacaaagaguagaaucauggauccugagaaaucccggauuugcacuuuuagcagguuuuauggcuuacaugauaggucagacaggcauacaaagaacaguauucuuuguacuaaugauguuggucgcuccauccuacggaaugagguguguaggcguugggaaucgugacuucguagagggaguaaguggcggagucuggguagaccuaguauuagaacauggagguugcguuacaacuauggcgcaagguaaaccuacuuuagauuucgaacugacaaagacgacugcgaaggagguagcccuucuacguaccuauuguaucgaagcaucaauaucgaauaucacaaccgcaaccagauguccgacacaaggagaaccauaucuuaaagaagaacaggaucagcaauauauuugucgaagggaugugguggauaggggauggggcaauggcugcggucucuuugguaaaggaggcgucgucacaugugcaaaguuuuccugcucuggaaagauaacggguaaccuuguacaaauugaaaaccuugaauauacuguugugguaacagugcacaauggugacacacacgcuguaggcaaugacaccucaaaucacgguguuacugcaacgauuacaccgagaucacccucuguagaaguuaaguuaccagacuacggagaacucacacuggauugugaaccucgaagugguauagacuucaacgagaugaucuugaugaaaaugaaaaagaaaacuuggcuuguacauaaacaaugguucuuagaccuccccuuaccuuggacagcaggagcagacacgucagaaguacauuggaacuacaaagaacgaaugguuacguuuaaggugccacacgcuaaacgacaagacgugacgguauuaggcagccaggaaggugcuaugcacucugcacuugcaggagcaacugaaguagacaguggagacggaaaucauauguuugcgggacaccugaaguguaaagucagaauggaaaaacuaagaauaaaagggaugaguuacacaauguguucggggaaauucucaauugauaaagaaauggcagaaacccaacauggcacaacggugguaaaagugaaauaugagggcgccggagcaccguguaaaguaccgauugagauucgugacgucaauaaagagaaaguaguagggaggguaaucaguucgacgccuuuagcugagaauacaaacucggugaccaauauugaacucgaaccgcccuucggggacagcuacauaguaauaggagugggaaauagcgcauuaacacuacacugguuucguaaagggucaaguauugggaaaauguucgaaaguacauauagaggcgcgaaaagaauggcgauauuaggcgaaacugcgugggacuuugguucuguggguggauuauuuacaaguuuaggaaaagcuguacaccaaguauuugggaguguauauacaaccauguucgguggaguaucauggaugauuagaaucuuaaucgguuuucuaguucuuuggauugggacuaacagccgaaacacgaguauggcaaugacaugcauugcaguaggaggaaucacuuuauucuugggcuucacaguacaggcagauaugggaugcguaguuucuugguccgggagagaacugaaaugugguagcgggauauuuguaguugauaauguacacacuuggacagagcaauacaaauuccagccugagucuccagcuagauuagcgagugcuauacugauagcacauaaagaugggguuugcggcaucagaucaacaacaagacuggaaaacgugauguggaagcaaauuacaaacgaauugaauuauguacucugggaaggugggcacgauuuaacaguggucgcuggagaugcgaaaggaguacuuacaaaaggcaaacgugcuuuaacuccacccguaucugaccugaaauauucuuggaaaacuuggggaaaagcuaaaauuuuuacuccagaggcaagaaauagcaccuuucuaauagacggaccggauaccucagaguguccgaacgagcgucgugcauggaacucacucgaaguagaagauuacggauuuggaauguucaccacaaacauuuggaugaaguuuagagaaggaagcuccgaaguaugugaccaucgauuaaugucggcggccauaaaagaucagaaagcaguucaugcagacaugggauauuggauugaaucuagcaaaaaucaaacauggcaaauugaaaaagcaucauuaauagaagugaaaaccugucuauggccuaaaacgcacacucugugguccaauggagugcuugagagccaaaugcuaaucccuaaaaguuaugcagggcccuuuagucagcauaacuaccgccaaggcuacgcaacacaaacaguggggccguggcauuuagggaaauuagaaauugauuucggcgaaugucccgggaccacaguaaccauacaagaagauugugaucauagaggaccuagccuucgaacgaccacagcuuccggcaaauuaguaacgcaauggugcugccgcucgugcacaaugccuccacuuagauuucuuggagaggauggcugcugguauggcauggaaauacggccacuauccgaaaaagaagaaaauaugguuaagagucaggucacagcaggacaggguacaucugaaacuuuuaguaugggucuguuaugcuuaacuuuauucguggaggaaugucuaagacguagagucacuagaaaacacaugauacuggccguuguaauaacuuuaugcgcgaucauccuaggaggucuuacguggauggaucucuuaagggcacucauaaugcucggugauacaaugucgggacgaauuggaggucaaacacauuuagcuauaauggcaguauuuaaaaugagcccuggcuacguacuaggaguguuuuugagaaaacuaacgucgagagagacagcuuuaauggugauagggauggcgaugaccaccacacuaaguauaccccacgaucuuauggaacucauugacgguauuucacuagguuuaauacuccuuaagaucgugacacaauuugacaauacacaaguuggaacauuagcccucaguuuaacguucauacgaucuacuaugucuuugguaauggccuggagaacaauuauggcuguacuauuuguuguuacacuuauaccacuaugcagaacgaguuguuuacaaaagcaaagccauuggguggaaauaacagcauugauauuaggagcgcaggcauugcccgucuaucuaaugacguuaaugaaaggagccucucgcagaucauggccacuaaacgaaggaauuauggcggugggccuaguaucgcuauuaggaucggcacuacuuaaaaaugauguuccuuuagcaggaccaaugguagccggaggccugcuuuuggcggcguacgucaugucuggaaguucagcggaccuauccuuagaaaaggcagccaacguucaaugggaugaaauggcggauauaacaggauccucaccuaucauagaagucaaacaagacgaggacggaucauuuaguauaagagauguagaagaaacaaacaugaucacauuacuuguuaaguuagcucucauuacagucucaggucucuacccccuagcuauaccgguaacuaugacgcugugguacauguggcaaguaaaaacgcaaaggucaggagcacucugggaugucccuagcccugcagcaacccaaaaagcggcauuaagugaggguguauacagaauaaugcaacgcggguuauuugggaagacacaaguuggcguaggaauacauauggaaggcguuuuucauacaauguggcauguuacacgaggcaguguuauuugccacgaaacaggaagauuagaacccucaugggcagauguccguaaugacaugauaagcuaugggggaggcuggcgacuuggcgacaaaugggauaaagaagaagacguacagguacuagcgauagaaccuggcaaaaauccaaaacacguacaaacuaaaccgggacuuuuuaaaacucugaccggggagaucggggccguaacauuagacuuuaaaccagggacaaguggaucaccuauaaucaauagaaagggaaagguaaucgggcuauaugggaaugguguugugacaaaaagcggugacuauguauccgcaauaacucaggcagaacguauuggagagccugacuaugagguagaugaggacauuuuucgcaagaaacgauuaacaauaauggacuuacacccaggcgcaggcaaaacaaaaaggauacucccgaguauuguacgagaggcacuuaagaggagacuaagaacccuaauacuagcaccuacucgcguagucgcagccgaaauggaggaggcuuuaagaggacuaccuauacgauaccaaacuccugcgguaaaaucugaacacacgggaagggaaaucguagaucuaaugugucaugcuacauucacaacaagguuacugucaucgaccaggguaccaaacuacaaccugaucguaauggaugaggcgcacuuuacugauccgucaucuguggccgcaagaggguauauuaguacaagagucgaaaugggagaagcagcggcgaucuuuaugacggcgacgccgccaggcgcaacagauccuuucccacagucaaacucuccgauagaggauaucgagagagaaauacccgagagaaguuggaauacagguuuugacuggaucaccgacuaucaagggaaaacagucugguuuguaccaucuaucaaagcagguaacgauauugcaaacuguuuacgaaaaucugguaagaaagucauccaauuaucucgaaaaacguucgacacugaguaucccaaaacgaaacucacagauugggacuucguaguuacuacggacauuagugaaaugggagcuaacuuuagagcaggaaggguaauagacccaaggagaugucucaagccaguaauacuaacugaugggccugaaagggucauccuugccggaccuaucccuguuacacccgcgagugcagcucaaagacgcggaaggauaggacgcaaccccgcccaagaagacgaccaauaugucuuuaguggugacccacucaaaaacgacgaagaucacgcacacuggaccgaagcuaagaugcucuuagacaacauauacacuccagaaggaauaauaccaacguuauuugguccagaaagagagaaaacucaagcaauagauggcgaauuuagauugaggggagaacaacgaaaaaccuuuguagaacugaugcgaagaggugacuuaccgguaugguuaucauauaagguagccucagcaggaauaagcuacaaagacagagaaugguguuuuacaggugaaagaaauaaccaaauuuuggaagaaaacauggaaguugaaauuuggacaagggagggagagaaaaagaaacucaggccaaggugguuagaugccagaguauaugcagauccaauggcuuuaaaagauuuuaaagaauuugcaagcggucgaaaaucuaucacgcuagauauccuuacugagaucgcgagucugccaacauacuuaucgucuagagccaaacuagcgcuugacaauauuguaauguuacauacuaccgaaaggggagguagagccuaccagcaugcauuaaacgagcuaccagaaaguuuggaaacgcuuaugcucgucgcauugcuuggagcaaugacugcgggcauauuccuauucuuuaugcaaggaaaaggcaucgggaaacuuaguauggggcuaaucacaauagcgguagcguccggucuguuauggguggcugaaauacaaccacaauggauugcagcgagcauaauucuagaauuuuuccuaaugguacuacucaucccagaaccugaaaaacagcgaacuccacaagacaaucagcugauuuacguaauccugaccauauuaacuauaauagggcugauagcugcgaacgagauggggcuaaucgagaaaacuaaaacagauuucggauucuaccaaguaaagacagagaccacaauuuuagauguugaucuucgcccugcgucugcauggaccuuauaugcuguagcgacuacaauauuaacaccuauguuacgacauacaauagaaaauaccagugccaauuuauccuuggccgcuauagccaaucaggcugcuguacuaaugggcuugggaaaaggauggccacuacaucgaauggauuuagggguaccgcuucuagccaugggaugcuauucacaaguaaauccaacuacccuuacagccucauuagucaugcuguuaguacauuacgcgauaaucgggcccggucuacaagcgaaagcaacgagggaagcgcagaaaagaacugccgcggggauuaugaaaaauccuacaguagauggcauaacuguuauagaucuagaaccaauuaguuacgauccgaaauucgaaaagcaacugggacaagucauguugcuaguccucugcgcugggcaacuucuacuuaugcguacuacaugggcauucugugaaguccugacucuagcgacuggaccgaucuugaccuuaugggagggaaacccugguagauuuuggaauacuacuauugcuguaagcaccgcuaauauuuuuagaggaucuuauuuggcaggagccggauuggcauucagucuuauuaaaaacgcgcagacaccuagacgugggacagggacaacaggagaaacgcuuggggaaaaauggaaacgucaguuaaacagucucgaccgaaaagaauuugaagaauauaaaagaagcgggauauuggaaguagacagaacugaggcuaaaucggcccucaaggacgguaguaaaauuaaacaugcuguuucuaggggaaguucaaaaauuagauggauuguugagaggggaaugguuaagccaaaggguaagguaguugaccuugggugugggcgagggggauggagcuacuauauggccacacucaaaaacguaacagaagucaagggauacacaaagggugguccaggucacgaagaacccauuccuauggcaacauauggcuggaaucuagucaaacuccauucgggaguagauguauuuuauagaccuacggaacagguggacacucuacucugcgacaucggcgaaucaucuagcaaucccacaauagaagaaggccgaacgcuuaggguacuuaagaugguagaaccuugguuauccucaaaacccgaauuuuguauaaagguuuugaauccauacaugccaacugugauagaagaguuggaaaaauugcaaagaaagcauggagggaaccuaguaagaugucccuuaaguagaaacagcacucaugaaauguacugggucucaggggcgagugguaacauugucucgucggucaacacaacaucgaagauguuacuaaaucgauuuacuacgagacacagaaaaccuacauaugaaaaagacguagaccuaggugcagguacucgcagcguuucaacagaaacugaaaaaccugauaugacuaucauuggaagacggcuccaacgccuucaagaagaacacaaagaaacuuggcauuaugaccaggagaacccauaucgaacaugggccuaucauggaaguuaugaagcuccaucgacaggcucggccaguagcauggugaauggcguagugaaacuacuaacaaagccuugggacguaauaccaauggucacacagcuggcaaugacagacacuaccccauuuggucaacaaagaguuuuuaaagagaaaguugauacccgaacaccgcagcccaaacccggaacacgcauggucaugacuacgacggcgaauuggcuaugggcacuucuaggcaagaagaaaaacccgcgauuauguacgcgagaagaauuuaucaguaaaguccguaguaaugcagcaauaggcgcaguguuucaggaagaacaaggguggacuagcgcuagcgaagcaguaaaugauuccagguucugggaauuaguugacaaagaacgagcuuugcaccaagagggcaaaugugagaguugcgucuauaacaugauggguaaaagagagaaaaaguuaggagaguucggacgugcaaagggaagcagagcuauaugguacauguggcucggggcucgauuuuuagaauuugaagcacuaggauuucuuaacgaagaucacugguucggucgggaaaauuccuggaguggaguagaaggagaaggccugcaucgccuugguuacauacuagaagaaauugacaagaaagacggugaccuuauguaugcagacgauacugccggaugggauacgagaauaacggaagaugaucuucaaaaugaggaacucauaacggagcaaauggcaccccaccacaaaauacuagcuaaggcgauauucaagcucacauaccagaauaaaguagucaaagugcuacgaccaaccccuagaggcgcaguuauggauauaauaagcagaaaagaucaaaggggcucggggcaaguaggaacauacggacuaaauacuuuuaccaacauggaaguacaauugauaagacaaauggaggcagaaggaguuauaacgcaggaugauaugcaaaauccuaaaggcuugaaagagcgaguagaaaaaugguuacgagaaugcggaguagacagacuaaaacgcauggcaauuuccggggaugacugcgucguuaaaccgcuggaugaacguuucggaacuagcuuauuauuuuuaaacgacauggguaaggucaggaaagacauaccccaaugggagccaucaaaagguuggaaaaacuggcaagaagugccguuuuguucacaccauuuucauaaaauuuucaugaaagaugggagaucccuuguugugcccuguaggaaucaagacgaguuaauugggagagcaagaauuucacaaggugcuggguggucuuuacgagaaacugcuugccuugguaaagcauaugcccaaauguggucccuaauguauuuccacagacgcgaucugcguuuagcgagcauggcaaucugcagugcagugccuacugagugguuuccaacauccagaacgacguggucgauacacgcacaucaucaauggaugacuacugaagauauguuaaaaguauggaaucgggucuggaucgaagauaaucccaauaugauugauaaaacaccagugcauucaugggaggauauaccauauuuggguaaacgagaagaucucuggugcgguagucuaauagggcuaagcucaagggcaacaugggcaaagaacauucacacagcgauaacccaaguacguaaccugauaggcaaagaggaauauguugauuacaugcccguaaugaagagauauucagcacccagcgagucugaaggcguucuuuga

SEQ ID NO: 23621 - RNA, 9867 nt, Artificial Sequence
  derived and/or modified CDS sequence (opt6) from DENV-4__FJ882598__SS-prME
aguacaauaacacuuuuaugcuuaauaccaacagcuauggcauuucacuuaaguaccagagacggcgaaccgcugaugauaguggcgaaacacgaaagaggacgaccccucuuguuuaaaacaaccgaagguauuaauaaaugcacgcugauagcaauggauuugggcgaaaugugcgaagauaccguaacauacaaaugcccacucuuaguuaauacagaaccagaggauauugacuguuggugcaaccuaaccucaacuugggugauguauggaacauguacacaaucaggggagcgaagacgggagaaaagaucaguagcgcuuacaccgcauagugguaugggguuagaaaccagggcggagacauggaugaguagugaaggcgcauggaaacacgcacaaagagucgaaagcuggauacuuagaaauccaggauuugcccuacuugcgggauuuauggcuuauaugauaggacaaaccggcauacaaagaacuguauucuuuguucuaaugauguuaguugcgccuucauauggcaugagaugugucggaguuggcaauagagauuucguagaaggggucagcggaggcgcuugggucgaucuugugcuagaacaugguggauguguaaccacaauggcccaggguaaaccuaccuuggacuuugaauuaacaaaaacgacggcaaaagagguugcccuguuaagaacuuacugcauagaggcuucgaucucaaacauuacaaccgcaacgagaugcccaacacaaggggaacccuaccuaaaagaagaacaagaucaacaauacaucuguagaagggauguaguagauaggggauggggcaauggaugcggucuuuucggaaaaggaggaguggucacgugugcaaaauuuaguuguucuggaaaaauaacggggaauuuagugcagaucgaaaaucuagaauauacuguugugguaacaguucauaauggcgauacgcaugcuguagguaaugauacgaguaaucacgguguuacugcgacaaucacuccacguucuccaucuguagaagugaaacucccggauuacggggaacuaacauuggauugugaaccuagaagcggaauagacuuuaacgagaugauauuaaugaagaugaaaaagaagacuugguuaguucauaaacaaugguuuuuagauuuaccucuaccuuggacggcaggagcugauacgucagaaguacacuggaacuauaaagaaaggaugguuacauucaaagugccacaugcgaaaagacaagaugugacaguacuugguucccaagaaggcgccaugcauucugcccucgcgggggcaaccgagguugacagcggugacgggaaucauauguucgcgggccaccuaaaauguaagguacguauggagaaacuaagaauuaaaggaaugucuuauacaauguguaguggaaaauuuagcauugauaaagaaauggcugaaacgcaacaugguaccaccguaguuaaggugaaguacgaaggugcuggggccccuugcaaggucccgauugaaauuagagauguuaauaaagaaaagguugucggaaggguuauuucuagcacaccccucgcagagaacacaaauagcguaacaaacaucgagcuagaaccacccuuuggagacucauacauaguaauuggcguaggcaauucagcuuugacacuacauugguuuagaaaagguucaucuauuggaaaaauguuugagagcacauacaggggugcaaagcggauggcaaucuugggggaaacugcgugggauuuugguuccguaggaggucuauuuacaucacuaggaaaggcgguacaucaaguauuugguucaguauauacaaccauguuugguggagugaguuggaugauuagaauuuugauaggauuuuugguucuauggauuggaacuaauagcagaaacacaaguauggcuaugacuuguauagcaguagggggcaucacauuguuccugggauuuacuguucaagcagauaugggauguguagugucuugguccgguagagagcucaaaugcggcucagggauauuuguaguagauaauguacauacuuggaccgaacaauauaaauuccagccugagaguccagcccgauuagcaagugcaauacuuaaugcucauaaggauggaguuugugggauacguucaacaacgcgcuuagaaaaugucauguggaaacaaauaacaaaugagcugaacuauguucucugggaaggcggacaugaucuaaccgugguagcuggagauguaaaagguguccuuacgaaggggaaacgggcccuaacuccucccgucagugaccuaaaauacucauggaaaacguggggcaaagccaaaaucuucacaccagaagcacgaaacucuacauuuuuaauugauggaccagacaccagcgaauguccgaacgaacggagggccuggaauagcuuggaaguugaagauuauggcuuuggaauguuuacgacaaauauauggaugaaguuuagggaaggaucuucagaagugugugaucauagguugaugucagccgcuauaaaagaucaaaaggcagugcacgcugacaugggauauuggaucgaaucaucaaagaaucagacuuggcaaauagaaaaagccagucuuauagaggugaaaacauguuuauggccaaaaacccauacacuauggucuaacggaguuuuagagagucaaaugcuaauaccuaaaucuuaugccggaccauuuagccaacauaauuauagacaaggcuacgcaacucaaacgguugggccauggcaucuuggaaaacuugaaauagauuuuggagaauguccuggaacgacuguaaccauccaggaagauugcgaucauagggguccaagucugcguacaacaacagccagcggcaaacugguaacgcaaugguguugcagaaguuguacuaugccaccccugagguuccugggggaagaugguugcugguauggaauggaaauccgaccauugucugaaaaagaagaaaauaugguuaagagucagguugcggcaggccaagguacuucagagacguuuucaaugggucuauugugucuaacacuauucguagaagaaugccuaagaaggagagucacaagaaaacauaugauacuugcaguaguuauaacuuugugugcgauaauuuuaggcgguuuaacauggauggaucuauuaagagcuuuaauaauguugggcgauacgaugaguggucgaauaggaggacaaacucacuuagcuaucauggcgguauuuaaaaugucuccaggcuacgugcuaggagucuuucugcgaaaauugacaucaagggagaccgcucugaugguaauagggauggcuaugaccacaacacucucuauuccacacgaccuaauggaacuuauagaugguauuagcuuaggucuaauauuauuaaaaaucguuacgcaauucgauaauacucagguaggcacacucgccuuaaguuugacauucauaagaucaacaaugagccuagucauggcguggcgaacgauuauggcagugcuuuucguggucacacuuauaccucugugucgcacuucaugccuccagaagcaaucucauugggucgaaauaacagccuuaauauuaggugcacaagcauugccgguuuaucugaugacauugaugaaaggcgccaguagacgauccuggccccuaaaugagggaauuauggcuguagguuuagugaguuugcucgguuccgcccuguuaaagaacgacguuccguuagcaggcccgaugguugccgguggauuauuacucgcugcguacgucaugagcgguucuucugccgaucuaucgcucgagaaagcugcuaacguccaaugggaugagauggccgauauuacaggauccucuccuauaaucgaaguuaaacaggacgaagaugguucauuuagcauacgagauguugaagaaacuaauaugauuacacucuuaguaaaacucgcgcuaauaaccgucucaggacuauacccacucgcgauuccuguuaccaugacauuaugguauauguggcaaguaaaaacucagcgaucgggagcuuuaugggaugucccaucuccagcagcaacccaaaaagccgcauuaucugaagguguguacagaauuaugcaacgaggacuuuuuggaaagacacaagucggaguagguauacacauggagggcguguuccauaccauguggcauguuacaagaggaagcguaauaugccaugagaccggacgucuagaaccgucaugggcagacgugaggaacgauaugaucuccuacggaggaggauggagacuuggugacaagugggacaaagaagaagauguacagguucuagcuauagaaccagguaagaacccaaaacauguacaaacgaaacccggccucuuuaaaacacucacaggggaaauuggcgcagucacauuagauuuuaagccgggaacaagcggcaguccgauuauaaaccgaaaagguaaaguuauagguuuauacgggaauggggucgugacaaaaagcggugauuacguaucagcaauuacucaggcugaaagaauaggagaaccggauuaugaaguagaugaagacaucuucaggaagaaacgguuaacaaucauggaccuucauccgggcgcagggaagacaaaaaggauauuaccaucuaucgugagagaggcuuuaaaacgacgcuugcggacuuuaauauuggccccaacaaggguaguugccgcagaaauggaagaagcacuaagaggauuaccuauucgauaucagacuccugcaguuaaaagugagcacacuggacgcgaaaucguugaucuaaugugucacgcuacuuuuacaacacgucuccuauccaguacaaggguaccuaauuacaaccugauagucauggaugaagcucacuuuacagacccuaguucuguagcugcgcgggguuauauuucuacgcgaguugaaaugggcgaagcagcagcuauauucaugacugccacaccaccaggagcaacagaccccuucccucaaucaaacaguccgauugaagacauugagagagaaauuccugaacguucauggaacacaggauuugacuggauaacagauuaccaagggaaaacggugugguuuguaccaucaauaaaggcgggaaaugacauagcaaacugccuacguaaaaguggaaagaaagugauacaacugucuagaaaaacauuugauacagaguauccuaaaacgaaauugacagauugggacuuuguaguaacaacagauauauccgaaaugggagcaaauuuccgagcugggagagugauugacccacgacguugcuuaaaaccugugauucuuacagauggaccagagcgggugauccuggcuggaccgauaccaguuacuccugccagugcugcccagaggcguggacguauuggacguaacccagcgcaagaggacgaucaauacguauucuccggugacccccuuaaaaaugacgaagaccaugcacacuggacagaagcuaaaauguuacuagacaauaucuauacaccugaaggaauuaucccgacccuauuugguccagaacgugaaaagacccaggcgaucgauggugaauuucgacuaaggggagaacaaagaaaaacauuuguugagcucaugcgaagaggcgacuugccgguaugguuaagcuacaagguggcaagugcugguauuucguauaaagaucgugaaugguguuuuaccggagaacgcaauaaucaaauauuagaggaaaauauggaaguugaaauauggacccgggagggcgagaaaaagaaauugagaccuaggugguuagaugcacgaguuuacgccgacccgauggcacuaaaagacuuuaaggaauuugccucgggcagaaaauccauuacacuugauauuuugacagaaauagcaaguuugccuacauacuuaagcuccagagcuaaauuagcacuagauaacauagugauguugcauacaaccgaaagaggugggagggcauaccagcaugcgcuaaaugaauugccggaaucuuuagaaacucuuaugcucguugcccuauuaggcgcaaugacagcaggaaucuuccuauucuuuaugcaaggaaaaggaauugguaaguuaagcaugggacuaauaaccaucgcgguugcuucuggauuauuaugggucgccgaaauacaaccacaauggauugcagccucaauuauccuagaguucuuuuugauggugcuguugauaccagaaccugagaaacaacguacaccacaagauaaccaauuaauauacguaauauugacaaucuugacuauaauuggccuaauugccgcaaacgaaauggggcuuauagagaaaacaaagaccgacuucggauucuaucagguuaagacagagacaacaauucuugauguagaucuccguccagcaagcgcuuggacacuauacgcuguggcgacuacgauauuaacaccuaugcuccgccacacaauagagaauacaagugcuaaucuaucguuagcagcaauagcuaaccaagcggcuguucugaugggacuagggaaaggguggccucuucaucgcauggaccuagguguaccauuauuagcuaugggguguuauucucaaguaaaccccaccacuuuaaccgcuagucuaguuaugcuucuaguucauuacgccauaauagggccaggauuacaagcuaaggcgacuagagaagcacagaaaagaacggcggcagggauaaugaaaaauccuacuguagaugggauuacugucaucgaccucgaaccaauuagcuaugauccaaaauucgaaaaacaacuaggacaaguaauguuacuuguacuaugcgccggucagcucuuacucaugcgaacuacaugggcguuuugugagguacuuacacuugcgacaggaccaauucuaacuuuaugggaggguaauccuggacguuuuuggaauaccacaauagcaguauccacggcuaauauauuucggggaaguuauuuggccggugcaggauuggcauucucucuaauaaagaaugcacaaacaccacgucgagggacugguacgaccggagaaacucuaggagagaaguggaagcgacaacugaauagcuuagaucguaaagaauuugaagaauacaaaagaaguggaauuuuagaagucgaccgaaccgaagcaaaaucagccuugaaagaugguagcaagaucaaacaugcaguaagccggggcagcucgaagauaagauggauuguagaaagaggcauggucaaaccuaaagguaagguaguagaccuugguuguggaagaggaggauggagcuauuauauggcuacucuuaaaaauguuacagagguaaaggguuacacaaaagguggcccuggacacgaggaaccuauuccaauggcaacguauggguggaaucuaguaaaauugcauaguggugucgauguauuuuauaagcccacugaacaaguugauacucuauugugcgacauuggagaauccucaucuaauccaacaauagaggaaggaaggacacuacgaguauugaaaauggucgagccauggcuauccuccaaaccagaguuuuguauuaagguguuaaauccauauaugccaacagugauagaggaacucgaaaaacuucaaagaaagcacggugguaaccuaguacgaugcccguuaagcagaaauucaacccacgaaauguacugggucaguggagcuagcgggaauauugugucuucaguuaauacaacaucaaagaugcugcuuaauagguucaccacgcgacaccguaaaccuacguaugaaaaggacguugauuuaggagcgggcaccagauccguaagcaccgaaacagaaaagccugacaugaccauaauagggaggagauuacaaagguuacaagaagaacacaaagaaaccuggcacuaugaccaagaaaacccauauagaacuugggcguaucacggaucauaugaggccccaucaacaggaucagcaaguucaauggucaauggcguagugaaacugcuuacuaaaccaugggacgugaucccuaugguuacucaauuagcuaugacggauacaacuccuuuuggucaacaaagaguuuucaaagagaaagucgauacaagaacuccccaaccuaagcccgguacucguaugguuaugacaacaacagcaaacugguugugggcgcuccuaggcaagaagaaaaaccccaggcuaugcacaagagaagaguucauuucuaaagugagauccaacgcagcaauaggugcaguauuccaagaagaacagggauggaccucggcaagugaggccgucaaugacagccgauuuugggaacucgucgauaaagaacgagcucugcaucaggaagguaaaugugaaaguuguguuuacaauaugauggguaaacgagagaagaaacugggggaauuuggacgugcuaaaggcagucgagcaauaugguauaugugguuaggagcucguuuucuugaauuugaagcccuuggauuccuuaacgaagaucacugguucggucgagagaacaguuggaguggaguggagggagaaggucuacaccgacuuggcuauauacuagaagaaauagauaagaaagauggggaucuuauguaugcggaugauacugcugguugggauacgcgaauuaccgaagaugaucugcaaaaugaagaauugaucacagagcaaauggcgccacaccacaaaaucuuggccaaagccauauucaagcucacguaucaaaauaagguuguaaaaguucucaggccuacaccaagaggagcagucauggacaucauaagcagaaaggaucaacgaggaucuggucaaguugggacauacggauuaaacacguuuaccaauauggaaguucaacuaauccggcaaauggaagcugaaggaguuaucacucaagaugauaugcaaaacccaaaagggcuuaaagaacgaguugagaaaugguuacgagaaugcggaguagacagguuaaaacgaauggcaauaaguggagacgauugcguuguaaaacccuuagaugaacguuuuggcaccagccuacuauuucuaaacgauaugggaaaagugcguaaagauauaccccaaugggaaccaucaaaagguuggaaaaauuggcaagaaguaccauuuuguagucaucauuuucauaagauauuuaugaaagauggacgaagucuagucguaccuuguagaaaccaagacgaauuaauagguagagcccgcauuucucaaggcgcaggcuggagucuaagagaaaccgcgugccuagguaaggcguaugcccagauguggagcuugauguauuuucauagacgcgauuugcgguuagcauccauggcuaucugcagugcaguaccaacugaaugguucccgacgucccgaacaacguggucuauacaugcccaccaccaauggaugacaacugaagacaugcuaaaagucuggaauagggucuggauagaagacaauccaaauaugaucgacaaaacaccuguacacucaugggaagacauuccauauuuaggaaaaagggaagaucucuggugcggaucucuaauaggccucagcagucgagcuacaugggccaaaaacauacauacagcgaucacucaaguuagaaauuuaauaggaaaagaggaauacguugauuauaugccggucaugaaaagauauagcgcucccuccgaaucugaaggaguucuuuaa

SEQ ID NO: 23622 - RNA, 9867 nt, Artificial Sequence
  derived and/or modified CDS sequence (opt6) from DENV-4__FJ882601__SS-prME
ucuacgaucacuuuacuaugucuaauaccgacugucauggccuuucauuuaucgacgcgagauggcgaaccuuugaugaucgucgcaaaacaugaaaggggaagacccuuacuuuucaaaacuaccgaaggcauaaacaaaugcacccuaauagccauggaucuaggggaaaugugcgaagauacuguaaccuacaaauguccacuccuagucaauacugaaccagaagacauugacuguuggugcaauuuaacaaguacuuggguaauguauggaacaugcacacaaucaggcgaacggaggcgugaaaaacgaaguguugcacuuacaccacacagcgguaugggguuagaaacgcgcgcagaaacauggaugucgagugaaggggcuuggaaacacgcacaacgaguagaaaguuggauacuaagaaaucccggauuugcacuucuggcuggguucauggccuacaugauaggucaaaccgggauacaaaggacaguguucuuuguacugaugauguuagucgcaccgaguuacggaaugcgaugcgucgggguagguaauagagauuucguugagggugucucaggaggcgcgugggucgacuuaguacuugaacacgggggauguguaaccacaauggcgcaagguaaaccgacacuugauuuugaauuaaccaaaacaacugcuaaagagguagcucuacuuagaacauacuguauagaagcgaguauaaguaacauaaccacagcaacgagauguccuacucagggagagccauaucugaaagaagaacaggaucaacaauacauuugccgacgggauguaguagauagaggauggggaaauggaugcgguuuguuuggcaaaggggguguagugacaugcgcuaaauuuaguuguagcggaaaaaucacaggaaacuuaguccaaauagaaaaccuugaguacacaguaguaguaacaguucauaauggagauacacaugcgguaggaaaugacacuucuaaccauggagucacggcuacuauaacaccuaggagccccuccguagaaguuaagcuaccugacuauggggaguuaacacuagacugugaaccccggucagguaucgacuucaacgaaaugauacuuaugaagaugaagaagaaaacguggcuuguacauaaacaaugguuuuuagacuuaccuuuaccguggacugcuggugcagacacgucggaaguacauuggaauuauaaggagcgaaugguaacuuuuaaagucccucacgcuaaacgacaagacguuacuguauugggaagccaagagggugcuaugcauagcgcccuugcaggcgcaacagaagucgacucaggagaugguaaccacauguuugccggacauuugaaaugcaagguaaggauggagaaauuaagaaucaagggaaugucguauacuaugugcucuggaaaauuuucgauugacaaagaaauggcggaaacacaacacgguacuacgguugugaaaguuaaauacgagggcgcaggcgcuccuuguaaggucccgauugaaauaagagauguuaacaaagagaaagucguaggaagaguuauuuccagcacaccccuagcggagaauacuaacucagucaccaauauugagcuugagccgccguuuggcgacagcuacauuguuauaggcguuggaaauuccgcgcuuacauuacauugguuuaggaaaggaagcucgauagggaaaauguucgaaagcacguaccgaggcgcaaagcgaauggcgauauuaggcgaaacagcgugggauuuuggaaguguaggaggacuauucacaagucuaggcaaagcaguacaucaaguauuuggaucuguuuauacaacaauguucggagguguuuccuggaugauacguauucuaauaggcuuuuuaguccucuggauaggcacaaauucaagaaauacuucaauggcuaugacuuguauugcuguagguggaauuacguuguuuuuaggauuuaccguacaagccgauauggguugcguaguuucuuggaguggacgggaacucaaaugcgguucgggaauuuuuguaguagauaaugugcauaccuggacagaacaguauaaauuucaacccgaaucacccgcccgacuagcgucagcaauauugaacgcacacaaggauggaguaugcggaauaagaaguacaacccgccuagaaaauguuauguggaagcaaauaacgaaugaacuaaacuacguacugugggaaggaggacacgaccuaaccguaguagcuggagauguuaaaggaguacuuaccaaagguaaacgugcauuaaccccucccguaucagaccuaaaauacucguggaaaacuugggguaaggccaaaauuuuuaccccagaggcgcgcaauaguacauucuugauagaugggcccgacacaagcgaaugcccgaaugaaagacgagccuggaauaguuuggaagucgaagauuauggauuugggauguuuacaacgaacaucuggaugaaguuucgagaaggaucaagcgaaguuugugaccauagacuaaugucggccgccauuaaagaccaaaaagcaguucaugcugacaugggcuauuggauugagaguagcaaaaaccagacuuggcaaauugaaaaggcgaguuuaauagaaguaaaaacuugucuguggccuaaaacacacacacuguggaguaauggaguuuuagaaagucaaauguugaucccuaagucuuacgcaggaccauucagccagcacaauuacagacaagguuacgcaacacaaacaguagggccguggcaccuuggaaaguuagagauagauuuuggagaaugcccaggaacaacagucacgauacaagaagauugugaccaccguggacccucacugagaacgacaacagcaagcgguaagcuaguuacgcaguggugcugcagaucaugcacgaugccacccuuaagauuucugggcgaggacggauguugguacgguauggaaauuaggccauugucugaaaaagaagaaaauauggugaaaucucaagucgccgcuggacaaggaacaucagaaacauucucgaugggcuugcuauguuugaccuuauuuguagaagagugccuaagacgacgcgucacgcgcaaacauaugauccucgcgguugugauuaccuuaugugccauaauucuaggcggauuaacauggauggacuuacuuagagcacucaucauguuaggcgauacaaugucuggucggauuggaggccagacucaccucgcaauaauggcagucuuuaaaaugagcccaggguacguuuugggcguuuuucugcgaaaacuaacaucacgagaaacagcucuuaugguaauuggaauggcaaugaccaccacauugucuauaccgcaugaucucauggaauuaauugaugggauuucucucggcuuaauccuacuuaaaauaguaacacaauuugacaauacacaagucgguacuuuagcuuuauccuuaacauuuauucgguccacaaugagucuagucauggcuuggaggacaauaauggcaguuuuauuugucguuacuuuaauaccauuaugccggacaucgugucuccagaagcagucgcacuggguugaaauuaccgcgcuuauucuaggggcacaggcauugccuguuuacuugaugacgcugaugaagggagcaucuaggagaucuuggccauuaaaugaaggaauaauggcaguaggauuaguuaguuuacuuggaagugcacuacucaaaaaugacguuccgcuugcaggaccaaugguggcaggcggauuguuauuggcagccuacguuaugagugguucaagcgccgaucuuuccuuagaaaaagcugcaaauguccaaugggaugagauggcugauauaacgggaucgucuccaauuaucgaaguaaagcaagaugaagaugggucauucaguauaagggacguugaagaaaccaacaugauuacucugcuagugaaauuagccuugauuacuguaucgggucuuuacccauuagcuauaccaguuacaaugacccugugguacauguggcagguuaagacgcaacgaucgggcgcuuuaugggaugugccaaguccagcagcgacacaaaaagccgcucuuagcgaagggguguacaggaucaugcaacgaggauuguuugguaaaacgcaaguaggaguuggcauacauauggaaggcguguuccauacuauguggcauguuaccagaggaucagugaucugccaugaaacugguagacuagaacccagcugggcugacguuagaaaugauaugauauccuacgggggaggguggaggcuuggcgauaaaugggacaaagaggaagacgugcaaguucuagccaucgaaccaggaaagaauccaaaacacguacaaacuaaaccgggucuuuucaagacgcuaacgggugaaauuggugcugugacauuagacuucaagccaggaacaucaggaaguccuauaguaaauaggaaagggaaaguaauagguuuguauggaaacgggguggugaccaaauccggagacuauguuagcgcuauaacgcaagcagaaagaaucggagaaccugauuaugaaguagaugaagacauuuuccgaaagaaaagacugacaaucauggaccuacauccaggugcuggaaaaaccaaaaggauauugccaaguauaguuagggaagcauuaaaacgacgacucagaacccuaauacuagccccaacaagaguggucgccgcggaaauggaggaggcuuuacguggauuaccuauccguuaucaaacuccagccguuaagucggaacacacgggcagagaaauaguggauuuaaugugucaugcaaccuuuacgacuagacuuuuaucgucaacacgaguaccgaauuacaaucuaaucguaauggacgaggcucauuuuacagaucccaguagcguagcugcucgugguuauauaaguacaagaguggaaaugggagaagccgccgcuauauuuaugacggcaacaccgccaggcgcaacagacccguuuccccaaucgaauaguccaauugaagacauagaaagagaaauaccugagcguucguggaauacagguuuugauuggauaaccgauuaucaaggcaaaacuguuugguucguaccaucuauaaaggcaggaaaugacauugcaaacugccuuaggaaaaguggcaagaaaguuauacaauuauccaggaagaccuuugacaccgaauauccaaagaccaaacuuaccgauugggauuucguugucacaacagauauaagcgagaugggugcuaacuucagggcaggaagaguaauugauccaaggcgcuguuuaaaaccagugauacuaacugauggaccggagcgcguaauucuagcaggcccaauuccaguaacucccgcuagugccgcacaacgccggggacggaucggccggaauccugcccaagaagaugaccaguauguguuuucuggcgacccacugaagaaugacgaagaucaugcucauuggacagaagcuaaaaugcugcuagauaauaucuacacuccggaaggcauuauuccaacauuauuuggaccagaaagagagaaaacucaagcaauagauggggaauuucgucuaagaggugaacaaagaaagacauucgucgaacuuaugaggcggggugaucuaccagucugguuauccuauaaagucgcgucugcaggaauaucuuauaaagauagagaaugguguuuuacgggagagcgaaauaaccaaauauuagaagaaaacauggaaguugaaauauggacgagagaaggagagaagaagaaacuacguccgcgaugguuagaugcuagaguguaugcagauccaauggcacuuaaagacuucaaagaauuugcaagcggaagaaaaaguauaacucuagauauacuaacggagauugccuccuugccaacauaucugagcucgagagcaaaacuggcauuagacaacaucgugaugcuacauacuacugaaaggggaggacgagccuaucaacacgcuuuaaaugagcuuccagaaucauuagaaacacugaugcugguggcauugcucggugcaaugacagcaggaauauuuuuguucuuuaugcaggggaaagguauuggaaaacuaucaaugggacuaauaacaauagcuguggcaagcggucuacuauggguagcagagauucaaccccaauggauagcagcaucuaucauucuggaauuuuucuuaaugguauugcucauacccgaaccagaaaagcaacgaacuccgcaagauaaucaauugauauacgugauacuugcgauucucacgauuauuggauugauagccgccaaugaaaugggguuaauagagaaaacuaaaacugauuuuggauucuaucaggaaaagacggaaacuacaauuuuagaugucgauuuaagaccugcaagugcuuggacacuauaugcagucgcaacuacuauauuaacacccaugcuucgacacacgauugagaauacaucggcaaacuuaucguuaacagccaucgcaaaucaagcagcaguucuaaugggacuagguaaaggauggccgcuucaucgaauggacuugggcguuccccuucuugccaugggguguuauucacagguaaauccuacuacucucacagcaaguuuagugaugcuucugguacauuacgccauaauuggcccaggauuacaagccaaagcgacuagggaggcacuuaagaggacagcugcuggaauaaugaagaauccuacuguagauggcauaacgguuauugacuuagaaccgauaaguuaugacccgaaguuugagaagcagcuaggucaaguaaugcugcuuguacuaugugcaggccaauuauugcugaugcgaacaacgugggccuucugugaggugcugacucuugcgacugggccuauuuuaacucuaugggaggguaacccaggccguuuuuggaacacgacuauagccgucaguacagcaaacauuuuuagagguaguuaccuagccggugcggggcuagcauuuucuuuaauuaaaaauguacaaacaccucgacgcgggacaggaacaaccggagagacucuuggggagaaguggaaacggcaauuaaauuccuuagaucgaaaagaguucgaagaauauaagaggucaggcauccucgagguggauagaacugaggcaaagucugcccucaaagaugggucuaagauaaagcaugcagucucucguggcucaagcaaaaucagguggauuguagaaagggggauggucaagccuaagggcaaaguagucgaucucggaugcggaagaggaggauggucauauuacauggcgacauugaagaacgucacagaggucaaagguuauacgaaagguggacccggacacgaggaaccgauuccaauggcuaccuacggauggaauuuaguaaaauugcacucaggaguugacguauuuuauaaaccaacagaacaagucgauaccuuacucugcgauauuggagaaucaucgaguaauccaacaauugaagaaggcagaacacuccguguacuaaaaaugguagaaccuugguuauccaguaaaccggaauuuuguauaaaaguuuuaaauccuuauaugccuacuguaauugaagaacuugagaagcuacagagaaaacauggcgggaaucuaguaagauguccucucucgagaaacucaacgcaugaaauguauugggugucgggagcaucugguaauauaguuagcucaguaaauacaacuucaaagaugcuauugaauagguuuaccacuagacacaggaaaccgacauaugagaaggauguggacuuaggugcagguacaagaagcguaucaacugaaacagaaaaaccugauaugacaauaauuggaaggagacuucaaagacuacaagaggagcauaaagaaaccuggcauuacgaucaggagaacccauacagaacgugggcauaccauggaucguaugaagcuccaucuacgggaagcgcauccucaauggugaauggagugguaaaacuacugacuaaaccuugggauguuaucccuaugguuacccaacuagcaaugacagauacgacaccauucggacagcagcgaguauucaaagaaaaaguugacacaagaacuccacaaccuaaaccugguacuagaaugguuaugaccacgacugcaaauugguugugggcgcucuuagggaaaaagaaaaauccaagacucugcacacgggaagaguuuaucaguaaaguuagaaguaacgcggcaauaggagcaguauuucaagaggagcaaggcuggacaagugccuccgaagcugucaaugauucgagguuuugggagcuaguagauaaagaaagggcgcuacaccaagaagggaagugugaaucaugugucuauaauaugauggguaaaagagagaagaaauuaggagaguucggacgcgcaaaagguagcagggcaauuugguauauguggcuaggagcuagguuccuagaauuugaagcauuagguuuccuuaacgaggaucacugguuuggaagagaaaauucauggucaggaguugaaggagaagguuuacacagacuuggcuacauauuggaagaaauagacaagaaagauggggaucucauguaugccgacgauacugcaggaugggauacucgaauaacagaagaugaucuucaaaaugaggaacugguuacagaacagauggcuccccaucacaaaauacuugccaaggcuauuuuuaaacucacauaucaaaauaaggucgucaaaguauuaaggccuacuccacgaggggcaguuauggauauuaucagcaggaaagaucaaagagguucuggccaaguugguacuuauggcuuaaauacauuuacuaauauggaagugcaauugauaagacaaauggaagcagaagggguuauaacacaagaugauaugcagaaucccaaaggccugaaagaacgaguagaaaaauggcuaagagagugcggaguggaucgcuuaaagagaauggcgauuaguggcgacgacugcguuguaaagccgcuggacgagcgcuucgguacgucccuucuuuucuuaaacgauaugggaaaaguuagaaaagacauaccucaaugggaaccuucuaaagguuggaaaaacuggcaggaagucccguuuugcucgcaucacuuucacaaaauuuucaugaaggauggaagguccuuaguaguuccuuguagaaaucaagacgaacugauuggacgagcaagaauuucccaaggcgcaggauggaguuuacgagaaacagcuugccuaggcaaggcuuaugcucagauguggucuuuaauguauuuccauagacgagaccuaagacuugcuaguauggcuauuugcagugcaguuccuacugagugguuucccacaaguagaacaacauggucaauacaugcgcaccaucaauggaugacuacugaggacauguugaagguauggaacagaguuuggaucgaggacaauccaaacaugauagacaaaacaccaguacauaguugggaagauauuccauaccuugggaaacgagaagaucuauggugugguucuuuaauuggacuaaguuccagggcaacgugggcgaaaaauauucauaccgcaauuacacaagugcguaaccuuauaggaaaagaagaauauguagacuacaugccgguaaugaaaagauauagugcaccaucagagucagaaggaguauuguag

SEQ ID NO: 23623 - RNA, 9867 nt, Artificial Sequence
  derived and/or modified CDS sequence (opt6) from DENV-4__FJ226067__SS-prME
ucuacaauaacacuacuaugccucauucccacagugauggcauuccauuuaucaacuagggauggggaaccucuuaugauugucgcaaaacacgaacgggggagaccucuauuguucaaaaccacugaaggaaucaauaaauguacauugauagccauggauuuaggugaaaugugcgaagacacuguaacguacaaauguccauugcuaguuaauacagaaccagaagauauugauuguuggugcaaucuuacauccacauggguaauguacggaacguguacccaaucaggagaacgacggagggagaaaagaaguguagcuuugacuccgcacucaggcaugggcuuagaaacaagggccgagacguggaugucaucugaaggagccuggaaacaugcccaacgaguggagucauggauucuaaggaacccuggauucgcauuacuggcaggauucauggcauacaugaucggacagaccggcauucagcgaacgguauuuuucguccugaugaugcuuguagcgcccucguaugguaugagaugugugggaguaggaaauagagauuucguagaagggguaagcgggggugcuuggguagauuugguuuuagaacauggaggguguguaacaacaauggcacaggggaaaccgaccuuagauuucgaacugacaaaaacaaccgcgaaagagguagcacuacuacgaacuuauuguauagaggcuucaauuucuaauauaacuacugcaacccguugcccuacacaaggcgaaccauaucugaaagaagaacaagaucaacaauacauaugccgucgagacguaguggacagaggauggggaaacggcuguggacuauucggaaaagguggggugguaacuugugccaaauucucuuguagcgggaaaauaacaggaaaccuagugcaaaucgaaaauuuagaauacaccgugguggugacagugcacaacggagauacacaugcaguaggaaaugauacaaguaaccacggagucacugcaacgauuacaccacguagcccaucuguggaaguaaaacuucccgacuacggcgaacuaacguuggacugcgaacccaggagugguauugauuuuaacgaaaugauuuuaaugaaaaugaaaaagaaaacaugguugguucauaaacaaugguucuuagauuuaccauuaccguggaccgcaggcgccgauaccucggagguucacuggaacuauaaagagagaaugguuaccuuuaaaguaccacaugccaagcggcaagacguaacuguauuagguucccaagaaggagcaaugcauucugcucuugcuggggcuacggaaguggauagcggagauggaaaccauauguuugcuggacacuugaaaugcaagguacgaauggaaaaguuaagaauuaaagguaugucauauaccaugugcuccggaaaauucaguauugacaaagaaauggcagaaacucagcaugguacuacaguaguaaaaguuaaauaugaaggugccggagcaccuugcaaagugccaauugaaauacgagauguuaacaaagaaaagguagucgggaggguaaucuccucuacaccauuagcagaaaacacuaauagcguaacuaauauagaacuugagccaccauucggcgacagcuauauagucauugguguuggcaacagugcuuuaacuuuacacugguuucgucgcgguucuagcauuggaaaaauguuugaaagcacguaucggggugcgaaaaggauggcgaucuuaggggagacagcaugggauuucggguccguuggagggcuauuuacgucucuugggaaagcuguacaccaggucuuugggucaguauauacaacaauguuugguggagugucguggaugauacggaucuugauuggguucuuaguauuguggauagguacuaauucacgaaauacaucaauggcaaugacauguauaaccguaggcgggauaacccuuuuucugggguuuacaguacaagccgauaugggcugcguuguaucuuggucuggucgcgaauugaaaugcgggagcggaauauucguuguggauaaugugcacacauggacggaacaguauaaauuucaacccgagucaccagcaagauuggccagcgcgauucuaaaugcucauaaggauggaguuugcggaaucaggaguacuaccagauuggaaaaugucauguggaaacaaauaacaaaugagcuuaauuaugcguuaugggaagguggacacgaucuuacaguaguagcuggagauguuaaaggaguacuaacaaaagggaaacgggcauuaaccccucccgugagcgaucugaaguauucauggaaaacuuggggcaaagcaaaaaucuuuaccccagaagcaagaaacucaacguuccuaauagaugguccggacacuagcgaguguccaaaugagcgccgagcauggaacaguuuggaaguugaagacuauggauuuggaauguuuacaacuaauauauggaugaaauuuagagaaggcagcagcgaaguaugugaucaccgacuaaugagcgcagcaauuaaagaccagaaagcaguucacgcugauauggguuauuggauugagagcagcaaaaaucaaacauggcaaauagaaaaagcaagucugauugagguaaaaacaugucuauggccaaagacacauacgcuauggagcaauggaguacuggaaucacaaauguuaauuccuaaauccuacgcgggaccauucagucaacauaauuaccgacagggauacgccacgcaaacaguaggacccuggcauuuaggaaaguuggagauagauuucggcgaaugccccggaaccacaguuacuauacaagaagauugugaccaucgcgggcccucccuacgaacaacaacagcuagcggaaaauuaguuacgcaaugguguugcagaaguuguacuaugccaccucugagauuuuuaggcgaagacggauguugguacggaauggaaauuagaccguuaagugaaaaagaggagaauauggugaaaagccaagucacagcaggucaaggaacaagcgaaacuuuuucaaugggccugcuaugccuuacgcuuuuuguugaagaaugcuugaggcggagaguuacaagaaaacacaugauccuagucguuguaaucacacuaugcgcaauaauccuaggaggacuaaccuggauggaucuacucagagcacucauuauguuaggagauacuauguccggcagaaucgggggacaaauacaccuugcaauaauggccguauuuaaaaugucccccggcuauguuuugggaguauuuuuaagaaaauuaacuagcagagaaaccgcauuaaugguaauagggauggccaugacaacagucuugagcauuccccaugacuuaauggaauuaauagauggcauuagccucgguuuaauauugcuaaagauagugacucaguuugauaauacucaaguuggaacgcuugccuugagucugacauuuauacguucgacuaugccuuuggucauggcauggcggacaauuauggcagucuuauuugucgugacucucauaccgcugugucgaacaagcugucuucaaaaacagagucauuggguggagauaacugcacuaauacuaggugcucaggcauuaccaguauaccucaugacccuaaugaagggggcgucacgaagaucauggccguugaacgagggaauaauggcaguuggccuaguuucuuuacuuggaucagcauuacuaaagaacgauguuccucucgcugggcccauggucgcuggcggcuuacuucuugcggcauacguaaugucuggaucaucagcggacuuaagucuagaaaaagcugcgaauguacaaugggaugagauggcugauaucacaggauccucaccuaucaucgaggucaagcaagacgaagacgguucauuuuccauaagggauguugaggaaacaaacaugauaacuuuauuggucaaauuagcauugauaacaguaucaggguuauaucccuuagcuaucccagugaccaugacauuaugguauauguggcaaguaaaaacacaaagaaguggugcgcuaugggaugugccuucuccugccgcuacccaaaaagcggcauuaucggaagguguguaucguauaaugcaaaggggucuguuuggaaagacgcaagugggaguggguauacauauggaagguguauuucauacgauguggcaugugacucgaggcucaguaauaugucaugaaacagguagacuggaaccaucaugggcugauguccgaaaugauaugauuucuuauggugguggauggaggcuaggggauaaaugggauaaagaggaggaugugcaaguucuagcaauugaaccaggcaaaaauccuaaacaugugcaaacaaaaccaggauuauuuaaaacauugacaggcgaaauaggagcaguaacgcuggauuuuaaaccaggaacauccggaagccccauaaucaauagaaaaggcaagguaauaggacuauacggaaacggggugguuacuaagucaggugauuauguaagugccauuacucaagcagaaagaauuggggaaccagauuacgaaguugaugaagauauuuuucguaagaaacgauugacaauaauggaucuacauccuggugcugguaaaacaaaaagaauacuaccuaguaucguuagagaagcguuaaaacgacgauuacggacacugauacuugcucccacuagaguugucgcugccgagauggaggaagcauugcggggacuuccgauacguuaucaaacaccggcaguuaagagugaacauacaggucgagagauuguugaccucaugugucaugccacauuuacaacucgacuucuaucuucaacuagagucccaaacuacaauuuaauagugauggaugaagcacacuuuacugauccauccucagucgccgcucguggauacauuucaacucgcguugagaugggugaagcugccgccauauuuaugacagcgacaccaccuggagcgacugauccguuuccacaauccaacagccccauagaagauauagaacgggaaaucccagaacgcucguggaacacaggcuucgauuggauuacugauuaucaaggaaaaaccguaugguuuguacccuccaucaaagcagggaacgacauagcuaacugcuuaagaaaaagcggaaagaaaguaauccaauugucuagaaaaacauucgauacggaguauccuaaaacaaaacuuacugauugggauuucgucguuacaacagacauaucagagaugggagcaaacuuccgggcuggcaggguuauagauccacgaagaugccuuaaaccaguuauucuaacagacggcccagagagaguaauccuagccgguccaauuccuguaaccccagccucagcggcccaaagaaggggcagaauaggccgaaacccagcucaagaagaugaccaauauguauucaguggagacccacucaaaaaugaugaagaucaugcccacuggacagaagcgaaaauguugcuugauaauaucuacaccccagaaggaauaauuccaacccuauuuggaccagagcgagagaaaacucaagcuauugauggugaauuuagauuacgaggugaacaaagaaaaacauuuguugagcucaugcgacguggcgaucuaccaguaugguugucuuacaaaguugccagugccggcauauccuauaaggaucgcgagugguguuuuaccggugaacgaaauaaucagauacuagaggaaaauauggaaguagaaauauggacccgagaaggugagaagaagaaacucaggcccaggugguuggaugccagagucuacgcugacccuauggcacuuaaggacuucaaggaauuugccaguggucgaaaaucaauaacacuagauauacuaacggagaucgcgucucucccuacuuaucuuucaucaagagccaaguuagcuuuggacaacauaguuaugcuccacaccacagaaagaggcggccgugcauaucaacaugcccuaaacgaacuaccagagucauuagaaacguuaauguuaguugcccuucugggugcaaugacagcuggaaucuuuuuauuuuucaugcagggaaaaggaauugggaagcuaucuaugggguuaaucgcgauagcaguugcaagcggcuuacucuggguagcggaaauacaaccacaauggauugcagcuagcauuaucuuagaguucuuccucaugguguuacuaauaccggaaccugaaaagcagcgaacgccacaagacaaucaacuaauauauguuauucuuaccauuuuaacgauaauuggucugaucgcugcuaaugaaaugggauuaauagagaaaaccaaaacagacuucgguuuuuaccagguuaaaacagaaacaacuauauuagaugucgaucugaggccggcaagugcguggacccuguacgcaguagcgaccacuauauuaaccccuaugcuuagacacaccauagaaaacacaucugcuaauuuaagucuugcagcaaucgcaaaucaagcagcuguauuaaugggucuaggaaagggauggccccuucacaggauggaccuuggcgucccccuauuagccauggguugcuacucacagguaaauccuacaacguugaccgcuuccuuaguaaugcuccuaguucauuacgcgauuauuggcccuggguugcaagcgaaggcuacuagggaagcgcagaaaagaacugcggcaggaaucaugaagaauccuacaguggauggaaucacgguaauagauuuagaaccaauaucuuaugaucccaaauucgagaaacaguugggacaaguaaugcuucuaguuuuaugcgcaggacaauugcuucuaaugagaacgaccugggcuuuuugugaaguuuuaacacuagccacuggaccgauucuuacuuuaugggaggggaacccaggacgguucuggaauacuacuauagcagucagcacggcuaauauauuccgagguaguuaucucgcaggggcgggacucgcauuuucacucauuaaaaaugcucaaacaccuagaagggguacaggaacgacaggcgaaacauuaggggaaaaguggaaaagacaauuaaacucacuugaucgcaaggaguucgaggaauauaaaagaucgggcauucuugaaguagaucgaacagaagcaaaaucggcacugaaagacggaucgaaaaucaaacacgccguaucgcgcgggucuaguaagauaagauggauaguagaacguggaaugguuaaacccaaggggaaaguaguggacuuggggugcggucgagguggguggucauauuacauggcaacccugaagaacguuaccgagguaaagggauacacaaagggaggacccggccaugaagaaccaaucccuauggcaacauauggguggaauuuagugaagcuacauuccgguguugacgucuuuuacaaaccgacugagcaaguugauacacuacuaugugauauaggagagucaucuucuaauccaacgauagaagaggguagaacauugagaguguuaaaaaugguggaaccaugguugaguucgaagccagaguuuugcauaaaaguuuuaaacccguacaugccgacggucauagaggaauuggaaaaacuccaacggaaacauggaggaaacuuaguacgguguccacucucuagaaauagcacccaugaaauguauugggugucaggggcguccggaaacauaguuucuagcgugaacacuacgaguaaaauguuauuaaauagauucacuaccaggcauagaaaaccaacauacgaaaaggauguagauuuaggggcagggacgagaucaguauccaccgaaacggagaaaccugauaugacuauuaucggaagacguuuacaaagguuacaagaggaacacaaagaaacauggcacuaugaccaagaaaauccauaccgaacaugggcauaucauggaucuuaugaagcaccuaguacaggguccgcgaguaguaugguaaauggaguuguaaaguuacuuacaaagcccugggaugucauuccgaugguuacacaacuagcgaugacugauacaacaccauuuggacaacaaagaguguuuaaggaaaaaguggacacaagaacaccacagccuaagccagguacgaggaugguuaugacuacaacggcuaacuggcucugggcucugcugggcaagaagaaaaauccccgucuauguacaagagaggaauuuauaucuaaaguaagauccaacgcugccauaggugcaguauuucaagaagaacagggcuggacuucggcaagugaagcagugaaugacucgcgguuuugggaauugguagacaaggaaagagcccuacaccaggaaggcaaaugugaaucguguguguacaauaugaugggaaaaagagagaagaaauuaggagaauuuggcagagcuaagggaagccgggccauaugguauaugugguuaggugcuagguucuuagaguuugaagcucuuggcuucuuaaaugaagaucauugguuuggucgggaaaauuccuggagugggguagaaggugaagggcuucacagguuggguuacauauuggaagaaauagauaagaaagacggagacuuaauguaugccgaugauacugcgggcugggauacacgaaucaccgaagacgacuuacagaacgaagaguuaaucacagaacaaauggccccacaccacaaaauauuagcaaaggcaauuuuuaaauuaacuuaucaaaacaaaguaguuaaagugcuacggccaaccccaaggggugcggugauggauaucaucagccguaaggaccaaagaggcucgggacagguagguacguauggacuuaacacuuuuacaaauauggaaguacagcuaauucgacaaauggaagcagaaggagucauaacacaagacgauaugcaaaauccaaaaggauuaaaggaacguguggaaaaauggcuaagagaaugcggcguggacagacugaaacgcauggccauuaguggcgacgacugcguaguaaaaccauuagaugaacgauuugguacgagucuacuauuucucaaugauauggguaagguacgaaaagauauuccucagugggaaccaucaaaaggauggaaaaauuggcaagaaguaccuuucuguucucaccauuuucacaaaauauucaugaaagacgggaggaguuuaguuguucccuguagaaaccaagaugaguuaaucggacgggcacggauaucacaaggugcuggauggagcuugcgagaaacagcuuguuuagguaaggcuuaugcgcagauguggucacugauguauuuccaucgucgggauuuaagguuagccaguauggcuauuuguagugcgguaccaaccgaaugguuuccaaccaguagaacaacauggucgauacaugcccaucaccaauggaugacaacagaagauauguuaaaaguauggaaccgaguguggauugaagauaauccgaacaugaccgacaaaaccccaguucauaguugggaggauauacccuacuugggaaaacgcgaggaucuaugguguggaaguuuaauaggauugucgucacgcgccacgugggcuaagaauauucauacagcaauaacgcaggucagaaacuuaauagguaaggaagaauaugucgauuacaugccgguuaugaaaagguauucagcguugagugagagugagggaguauuguga

SEQ ID NO: 23624 - RNA, 9867 nt, Artificial Sequence
  derived and/or modified CDS sequence (opt6) from DENV-4__EU854299__SS-prME
ucaacuaucaccuugcuauguuuaauaccuaccguuauggcauuucacuuaagcacacgagacggugaaccuuugaugauagucgcaaaacacgaaagagggagaccacuacuuuuuaaaacaacugaagguauaaauaaaugcacacuaauagcuauggaucugggagaaaugugugaagacaccgucaccuauaaaugucccuuauuaguaaauacggaaccugaagacauugacuguuggugcaaucuaacaucaaccuggguuauguauggaaccugcacucagaguggagaaaggcgucgcgagaaaagguccguagcccuuacaccccacuccggaaugggauuagaaacccgggcggaaacguggaugucuucugaaggggcguggaaacaugcacaacgaguugaaucauggauccuucggaauccaggauuugcgcucuuagccggauuuauggcguauaugaucgggcaaacagggauacagagaacuguguuuuucgugcuaaugauguuaguagcuccgucauaugggaugagauguguuggaguagguaaccgcgauuucguagaaggaguaucagguggagcauggguggaccuaguacuagaacacggcgguuguguuacuacgauggcacaaggcaaacccacucuagauuuugaacuaacuaaaacgacugcaaaggaaguggcacuacuuagaacauauuguauagaagcauuaaucucaaauaucacaacugcuacuagauguccaacacaaggagaaccuuaccucaaagaagaacaagaucaacaauauauuugucgucgcgacgucguugauagagguuggggcaauggauguggauuauuuggcaaaggaggaguuguuacgugugcaaaguucucauguaguggaaagaucacagguaaucuaguccagauagaaaaucuagaauauaccgucguaguaacaguucacaauggggacacacacgcaguaggcaacgacacaucuaaccacggagugacagcgacaauaacuccgcggucuccuucaguugaagucaaguugccggauuauggggaauuaacauuagauugcgaaccgcgcaguggaauagacuuuaacgaaaugauacugaugaaaaugaagaagaaaacuuggcuaguucacaaacagugguucuuagaccuaccgcuaccuuggacuaccggugcagacacaagugaaguacauuggaauuacaaagaacgaauggucacuuuuaagguuccgcacgcaaaaaggcaggauguaaccguacuuggaucccaggagggugcuaugcauuccgcacuugccggugcaacugaaguugauucuggcgauggcaaccacauguuugcaggacacuuaaaauguaaaguuagaauggaaaaauuaagaauaaaaggcaugagcuauacaaugugcagugguaaauuuaguauagauaaagagauggcagaaacucaacaugguacaacagucguaaaagugaaauaugaaggagccggagcaccaugcaaggugccuauugaaauacgugauguuaacaaggaaaaaguaguaggaagaguaaucuccgcaacuccacuugccgaaaauacaaauagcguuacgaauauugaauuggaaccaccuuuuggagacucuuacauugucauaggagucggcaacagcgcuuuaacccuacauugguuccgcaaggggucaucaauaggaaagauguuugagucaacauaccggggcgccaaaagaauggcaauuuugggagagacggccugggacuuugggaguguagggggauuauucaccucacuaggaaaggcaguucaccagguguucggaucaguuuacacuacgauguuuggaggcguuucuuggaugauucggauucucaucggauuuuugguauuauggauuggaacgaauaguaggaacacaagcauggcgaugacaugcauagccguggguggcauaacguuauuccuagguuuuacgguacaagcggacaugggaugugucgugaguuggaguggccgagagcuaaagugcggaaguggaauuuuuguaguugacaauguccauacauggacagaacaauauaaauuccaaccugaaucacccgcgagacuagcuucugcaaucuuaaacgcucauaaagauggggugugcggcauucggucgaccacucgucuugagaacgucauguggaaacagauuacaaacgaauugaauuauguuuugugggaaggaggacaugaucuaacaguagucgcuggugacgucaaagguguauuaacuaaaggaaagagagcacuaacgcccccagcaucagaucucaaauauucguggaagacauggggaaaggcuaaaaucuuuacgccagaagcucgcaauaguacauuuuuaauagaugguccagauacaagcgaaugcccaaaugagcgacgagcauggaacucauuugaagucgaagauuauggguucgguauguucacaacaaauauauggaugaaauuuagagaaggauccucagaaguaugugaccauagauuaaugagcgcggcaauaaaggaccaaaaagccgugcacgcagacaugggcuauuggauugaaucuagcaaaaaucaaacauggcaaauugagagggccuccuuaauagaggucaaaacuugcuuauggccaaagacacacacucuauggucaaacggcguacuugaaucacaaaugcuuauaccgaaaucauacgcuggaccauuuagucaacacaauuauaggcaaggcuaugcaacucagacaguaggaccuuggcaucucggaaaguuggaaauugacuuuggagagugcccuggaacaacugugacaauacaagaaaacugugaucaucgagggccgucgcucagaacaacuacugcaagcggaaaguuaguaacacaaugguguugccgcagcugcacaaugccgccauugcgauuucuaggagaagaugguugcugguaugggauggagauaaggccacuaagugagaaagaagagaauauggugaaaagucagguaacagcgggacaaggaacaagugaaacuuuuucuaugggcuuacugugccugacauuguucguagaggagugucugagaagaagagucacucguaaacauaugauauuagcaguugugauaacauugugugccauaauacuaggaggauuaacuuggauggaucuuuuaagagcgcuaauuaugcuuggugauacgaugucgggacgaauagggggucagacgcaucuugccauaauggcuguauucaagaugagcccggguuacguauuaggaguguucuuacgcaaacuaacuucaagagaaacggcgcugauggucauagguauggccaugacaaccacuuuaucgauaccccaugaucuaauggaauugaucgacgggauuucauuaggcuugauauuauuaaaaaucguaacucaauucgauaacacgcagguagggacgcuagcccuaucccuuacuuucauuaggagcacgaugaguuuaguuauggcauggcgaacaauaauggccguuuuguuugucguaacucuaauuccgcuaugcagaacaucaugucuucagaaacaaucgcacuggguagagauaacagcauuaauccuaggggcacaagcauuaccagucuaucuuaugacauugaugaagggagcaaguagacgaucauggccauugaacgagggaauuauggcuguuggccuaguaucauuacucggcucagcguuacuaaagaacgauguaccuuuagcggguccaauggucgcuggaggauuauuguuagcagcauacguaauguccggcucauccgcugaucuuucacuugaaaaagcagcaaacgugcaaugggaugaaauggcagauauuacggguucaagcccuaucauagaaguuaaacaagacgaagacgguucguucucaauucgcgaugucgaagagacaaacaugauuacacuauuaguuaaacuagcucugauaacuguguccggucuguauccucuggcuauuccaauaaccaugacucugugguacauguggcaaguaaagacacaacguaguggcgcucuuugggaugucccaaguccugcagcaacacaaaaagcggcgcuauccgaaggaguguaccgaauaaugcaaagagggcuuuucggaaagacccaggugggcguagguauacauauggaaggugucuuucacacaauguggcauguuaccagaggaucaguaauaugccaugaaacgggucggcuagagccaucuugggcggacguuagaaaugacaugaucagcuauggaggaggguggagacucggagauaaaugggauaaagaagaagacguucagguuuuggcaauugaaccuggcaaaaaucccaaacauguccaaacaaaacccggguuauuuaagacauugacgggugagauuggugcgguaacucuagacuucaaaccgggaacaucggguagcccaauaauuaaucgaaagggaaaaguuauaggauuauaugguaacggcgugguuaccaaaaguggagacuauguaagcgcaauaacacaagccgaaaggauaggcgagccagauuaugaaguagacgaagauauauucagaaagaaacgacugacgaucauggauuuacacccaggagcuggaaaaacaaaaaggaucuugccuagcauuguucgcgaagcgcugaaaagacguuugcgcacacugauucuggcaccaacaagaguuguagcggcugaaauggaggaagcauuaagagguuuaccgauaagguaucaaaccccugcagucaaaagcgagcauacgggacgagaaauaguagauuuaaugugucacgccacguucacaacaaggcuacuaaguaguacacgcguacccaauuauaaccuuauagugauggaugaagcucacuuuacagauccauccucuguagcugcacgaggcuacauaagcacgcguguugaaaugggcgaagccgccgcaauuuuuaugacagcuacaccgccaggggcaacagacccauucccucagaguaauucuccaauagaggauauagaaagagaaauuccagaaagaagcuggaauacuggauuugauuggaucaccgauuaccaggguaaaacugugugguucguaccgucuaucaaggccggaaaugauauagcuaauugucuaagaaagucugguaagaaaguaauccaacugagcagaaaaaccuuugacaccgaauauccaaaaacgaaacuaaccgacugggauuuuguaguaacaacugacauaucggaaaugggggcaaauuuucgcgcgggacgagucauagacccccgaagaugcuuaaaaccuguaauauuaaccgauggaccagaacggguuauacuugcagguccaauuccaguaacaccagccagugcagcgcagcggcgagguagaauaggaaggaauccugcucaagaggacgaccaauauguauucucaggggauccgcuaaagaaugaugaagaucaugcgcauuggaccgaggcuaaaauguuguuagacaacauauauaccccugaaggaauaauaccuacccuauucgggccugaaagagagaaaacacaagcuauagacggugaguuucgauuacgaggggagcaacgaaagacauucguggaauuaaugcgaagaggggaccucccgguguggcuaagcuauaaaguagcgucagccgggauauccuauaaagauagagaauggugcuucacuggugaacgcaauaaccaaauauuggaagaaaauauggaagucgaaauauggacuagggagggagagaaaaagaaauugagaccuaaaugguuagaugccagaguauacgcugaucccauggcuuugaaagauuuuaaagaguucgcuaguggacgaaaaucaauaacccuagauauacuuacagaaaucgcgaguuugccgacauaccuaucgucaagggcuaaguuggcauuagauaauaucgugaugcuacauacaacagagcguggagggagagccuaccagcaugcacuaaacgaauugccagagucccucgaaacgcuaaugcuugucgcuuuacuuggagcuaugacggcggguauuuuucuauucuuuaugcaaggaaagggaauaggaaaacuaucuaugggacuuauaacaauugcgguagcaucgggguuacuuuggguagcagagauacaaccccaauggauugcagcauccauuauacuugaguuuuucuugaugguacuuuuaauaccagaaccugagaaacagagaacuccccaagacaaucaacuaaucuauguaauacugacuauuuuaaccauaauagggcugaucgcagcaaacgaaaugggauuaauugagaaaacaaaaacggauuucggauucuaucaagucaaaaccgaaacaacaauacuugauguagaccuucgaccagcuucagccuggacauuauacgccguugcuacaacaauuuuaacuccuaugcugagacauacaauugagaauacgagcgcgaaucuuagcuuggcggcaauagcuaaucaagcagcaguacuaaugggacucgguaaaggauggcccuuacacaggauggauuugggagugccauuauuagcaauggggugcuacucccaaguaaauccuacaacacuaacugccagcuuggugaugcuauugguccauuaugcaauaauaggaccaggauuacaagccaaagcgacaagggaagcccagaaacgcacagcggcaggcauaaugaaaaacccuaccguugaugguauaacagucaucgauuuggagcccaucucauaugaucccaaauucgagaaacagcugggacaggugauguuacuggucuugugugcaggucagcuuuuauugaugcguacaacgugggcguucugugaaguacucaccuuggcaacugggccgauuuugacucuaugggaggggaauccaggaagguuuuggaauacuacuauagcaguaaguacagcuaauauauuuagaggaucguacuuagcgggagcuggccuagcguucaguuuaauuaaaaacgcacaaacaccgagacgcggaacaggaacaacuggagaaacauuaggggaaaaauggaaacgucagcuaaauucguuagacagaaaagaguucgaagaauauaaaagauccggaauauuagaaguagaccgcacagaagcuaagagugcuuugaaagauggaaguaaaauuaaacaugcuguaagucguggaucgaguaaaaucagauggauugucgagcgaggcaugguaaagcccaaaggaaagguaguagaccuugguuguggccgcggggguuggaguuacuauauggcaacccugaaaaacgugacagaagugaagggauauacuaaaggagggccaggucacgaagaaccuauaccuauggcaacuuauggauggaaucucguaaaauuacauucagggguagacguauucuauaagccgacagaacaaguagacacauuacuaugcgacauaggagaaaguagcaguaauccuacaauagaagaaggccggacauugcgaguuuuaaagaugguagagccaugguugagcagcaaaccagaauuuugcaucaaaguacuuaacccauauaugccaacagugauagaagaauuagagaaauuacagcguaaacacggcggaaauuuaguccguuguccguugagcagaaauuccacgcaugaaauguacuggguaucaggugcaaguggaaauauaguuaguucuguaaauacaacaaguaaaaugcugcucaauagauuuacaacacgacaucguaaaccuacuuaugaaaaagauguggaucuuggagcaggaacaagaucaguuucuacagaaaccgaaaaacccgacaugacuauaauagggcggagauugcaaagguuacaagaagaacacaaagagacauggcacuaugaucaagagaauccguaucguacaugggcauaucauggcaguuacgaagcaccaucuaccggaucugcuucaucuaugguaaauggcgugguaaaauuacucacuaagccgugggacguaauucccauggugacacagcuagcgaugacugauacuacaccauuuggucaacagaggguauucaaagaaaaagucgauacucgaacaccccaacccaagccagguacacgaaugguuaugacgacaacagccaauugguuaugggcucucuuaggcaagaagaaaaauccaaggcuuugcaccagagaagaauuuaucuccaaaguacgaucuaacgcugcaauaggcgcgguguuucaggaagaacaaggguggacgucagcuucagaggccguaaaugacucuagauuuugggaacuuguagacaaagaaagggcacuccaucaggaaggaaaaugugaaaguuguguguacaauaugaugggaaaaagagaaaagaaacuaggagaauuuggcagagcuaaagguucgcgagccauuugguacauguggcuaggggcucgcuuucuagaauuugaagcacuagguuucuugaaugaagaccacugguucgggagagaaaacucguggucaggcgucgaaggggagggauugcacagacucggauauauccuagaagaaaucgauaagaaagauggggaucuuauguaugcugacgauacggcaggaugggacacucguauaacugaagaugaccugcaaaaugaggagcuaauaaccgagcaaauggcaccccaccauaaaauucuugccaaggccauuuuuaaauugacuuaccaaaauaagguagucaaaguuuuaagaccaacccccagaggugcgguuauggacauuauaucgcgaaaggaucagagaggcagugggcaaguuggaaccuaugggcuaaacacuuucacaaauauggaaguucagcucaucagacaaauggaagcggaaggggugauaacucaagaugacaugcaaaaccccaaaggucuaaaagaaagaguagaaaaauggcuaagggagugcggcguggauagauuaaagcguauggcuauaucaggagacgauugcgucguuaaaccgcuagacgaacgauuugggacaaguuuacuauuccucaaugacaugggaaagguucguaaagauauaccacaaugggaaccuaguaaaggguggaaaaauuggcaagaggucccauucugcucucaccacuuucauaaaauauucaugaaagauggaagaucucugguuguucccugccggaaucaagacgagcucauaggcagagcccgcauuucucaaggagcaggguggucucugcgugaaacugccugcuuagggaaggcguaugcccaaauguggucauuaauguacuuucaccgccgugaccuuagauuagcaaguauggcaaucugcucugcugucccgacagaaugguuuccgacgucacgcacaacauggagcauacaugcucaucaucaauggaugaccacugaagauaugcuaaaaguauggaaucguguauggauagaagacaauccaaauaugauagauaaaacaccaguacauaguugggaggauaucccguauuuagggaagcgagaagaucuaugguguggaucuuuaaucggucuaucgagcagggcgacaugggcuaagaacauccauacugcaauaacacaagugcgaaacuugauugguaaagaggaauacguggauuacaugccugugaugaaaagguauucugcaccuucagaaucugaaggaguccuguaa

SEQ ID NO: 23625 - RNA, 9867 nt, Artificial Sequence
  derived and/or modified CDS sequence (opt6) from DENV-4__FJ182016__SS-prME
aguacgauaacacuauuaugccugauaccuacaguuauggcauuucaccuaucaacgcgugacggcgagccuuuaaugaucguugcaaaacaugaacgaggacgcccacuacuauucaaaacgacugaggguauuaacaaauguacucucaucgcaauggauuuaggggaaaugugcgaagauaccguaacguacaaauguccguuauuagugaauacugaaccagaagauauagacuguugguguaauuuaacaagcacauggguuauguacgguaccuguacacaaucaggagaaaggcguagggaaaaacgaagugucgcucuaacaccucacucaggaaugggacuagagacccgugcagaaacuuggaugaguucagagggagcauggaaacaugcacaacggguugaaagcuggauucuaaggaaucccggcuucgcacuuuuggccgguuuuauggcauacaugauaggacaaacagggauacaacguacaguauuuuucguacuuaugaugcuaguagcuccuucauacggcaugcguuguguagguguagguaaccgagacuucguagaaggcguaucaggaggagccuggguagacuuaguauuggaacacggaggaugcguaacuaccauggcucaagguaaaccaacacucgacuucgaacuuaccaaaacuacagcaaaagaggucgccuuacuacgaacauacuguaucgaagcacucauuaguaauauaacgacggcaacacgguguccuacucaaggugaaccuuaucuaaaagaagaacaagaucagcaauauaucuguagaagagauguaguagauagaggauggggcaacggaugcgggcuauucggcaaagguggagugguuaccugcgcaaaauucaguuguucaggcaaaauaacaggaaaccuugugcaaauagaaaaucuagaauacacaguuguaguaacgguacauaacggagauacucacgcuguagggaacgauacaaguaaccacggugucacagcgaccauaacccccaggaguccauccguugaaguaaaauuaccagacuacggugaacugacacuagacugugaaccaagauccggaauugauuucaaugaaaugauacugaugaaaaugaaaaagaaaacaugguuaguccauaaacaaugguucuuggauuugccguuaccauggacuacaggugcggauaccucagaaguacacuggaauuauaaagagagaaugguaaccuuuaaaguaccacaugcgaaacgccaagauguuacaguacuaggaagccaagaaggagcuaugcacagugcgcucgcuggugccacagaagucgacaguggcgauggaaaccauauguuugcuggacauuugaaaugcaaagugagaauggaaaaacuccguauuaaaggaaugaguuauacuauguguucugguaaauuuucaauagauaaagaaauggccgagacgcaacacgguacgaccguugucaaaguaaaauacgagggagcuggagcgccuuguaagguaccuaucgagaucagagauguaaacaaggaaaaaguaguaggaagaguaauaucugccaccccacucgcagagaauaccaauuccguuacaaauauugagcuagaacccccuuuuggugacaguuauaucguaauaggcguuggaaauucugcacuuacguuacauugguuuagaaaaggaucauccauaggaaagauguucgaaucgaccuaccgaggugcaaaacguauggccauacuuggagaaacagcuugggauuuuggaucuguaggagggcuguucacaucuuugggaaaggcuguccaccaaguguuuggaaguguauauaccacaauguuuggaggcguuagcuggaugauaagaauauugauagguuuucucgugcuauggauugguacuaauucaagaaacacaucaauggcuaugacauguauagcagugggugggaucacauuauucuuaggauuuacaguccaagcagauaugggguguguuguguccugguccggcagggaauugaaauguggcucagguauuuuuguagucgacaacguccauacuuggacagaacaauacaaauuucagccagaauccccagcccgucuugcuagugcaauuuuaaaugcgcacaaagauggcguauguggcaucagaaguacuacaagguuagaaaacgucauguggaaacaaauuacaaacgaauuaaacuauguccugugggaaggagggcacgaucuuacaguuguagccggugacgucaaaggggugcuuacuaagggaaagcgagcuuuaacuccaccagcuagugaccuuaaauacagcuggaaaacguggggaaaagcaaagauuuucaccccugaagcucgaaauagcacauuccucauugauggaccagauacaucagaaugcccuaaugaaagacgugcauggaacucauucgagguagaagacuacggcuucgggauguucacaacaaauaucuggaugaaguucagagaagggucaagugaaguuugcgaucaccggcugaugagcgcagcuauaaaggaccagaaagcaguacaugcagacauggguuacuggauugaaucaagcaagaaccaaacuuggcaaauagaaagagcuagccuaauugaagucaagacuuguuuguggcccaaaacacauacauuguggagcaaugggguacuagaaucacaaauguugauaccaaaauccuacgcaggaccuuucucacagcacaacuaucgacaaggcuacgcaacucagaccguagggcccuggcaucuagggaaacucgagaucgauuuuggagaaugcccuggaacaacaguuaccauccaggagaauugugaucacagagguccuucauugcgaacaacgacagccagcggaaagcuagucacacaguggugcugucggucauguacuaugccgccccuaagguuucucggagaagaugguugcugguacgguauggaaauacguccguuaucagaaaaggaagaaaauaugguuaaaucccaaguuacggcuggucagggcacaagugagacauuuucuaugggucuuuuaugccugacccuauuugucgaagaaugcuugagacgccgaguaacuagaaaacauaugauacuagcgguagugauaacacuuugugcgauaaucuugggugggcuaaccuggauggaccuacugagagcucuaauaauguuaggagauacaaugucuggucgaauaggcggacaaacucaccuagcaauaauggcaguuuuuaaaaugucgccuggauacguauuaggaguguuucugcggaagcuaacaucaagagagaccgcccuaaugguaauagguauggcaaugacaaccacguuaagcaucccccaugaccuaauggaacucauagauggaauaucauuagguuuaauucuuuugaaaaucguaacccaauuugacaauacgcaagucggaacauuagcacuaucguuaacguucauccgaucaacuaugucacugguaauggcuuggagaaccauuauggcaguuuuauuuguugugacacugauaccccuuugccguacaucuugucuacaaaaacaaagucauuggguagaaauaacugccuugauacuaggagcacaagcauugccaguguauuuaaugacuuugaugaaaggggcaucucgacggucguggccacuaaaugaaggcauuauggcuguaggauugguuucauuauuaggauccgcauuauugaagaacgacgucccauuggcaggcccuaugguggcaggcggcuuguuacuugcugcuuauguaaugucagggaguuccgcagaucugaguuuagaaaaagcugcaaacguccagugggaugaaauggcagauauaacagggucgaguccaauuauugaaguuaagcaagacgaagacggcucguucucaauaagggauguugaagaaacaaauaugauaacacuuuuagucaaacuugcauuaauaacaguaaguggacucuauccucuugcaauaccaauaacaaugacuuuaugguacauguggcaaguaaagacacagagaagcggugcguugugggacguccccaguccggcugccacgcagaaggccgcccuauccgagggaguauauaggauuaugcagagaggcuuauucgguaagacacagguggguguugguauucauauggaggggguguuccauacuauguggcauguuacuagagguaguguuauaugucacgaaacuggucguuuagaaccaucuugggccgacguacgaaacgauaugauuuccuauggaggcggauggaggcuuggagauaaaugggauaaagaagaagauguccagguccucgcaaucgagccaggcaaaaaucccaaacauguacaaacgaaaccaggacuauuuaagacacuaacuggugaaaucggcgcaguaaccuuagauuucaaaccaggcacaucagguagucccauuaucaacaggaaagggaaaguuauuggauuauaugggaacgguguaguaacuaaaucaggugauuaugucucggcuaucacgcaggcagaacgcauuggugagcccgacuaugaagucgaugaagauauauucagaaagaaacgacuaacaauuauggaucuucacccuggugcugguaaaacuaaaaggauccuuccaucaauaguucgagaggcgcucaaacgaagauuacgaacacuaauauuagccccaacacguguuguugcagcggaaauggaggaggcacuaagaggccuaccaauaagauaccagacuccugcgguaaaaagugagcacacggguagggaaauuguagauuugaugugucacgcaacauucacgacuagacuguuguccucaacaaggguccccaacuacaauuuaaucguaauggaugaagcacacuucacagacccuucuucaguugccgcuagagguuacauaaguacuagaguagaaaugggugaagcagcagcuauauuuaugacugcaacucccccgggugcuacugaccccuuuccacagucaaacucaccaauugaagacauagaaagagaaauaccugaacgcaguuggaauacugguuuugauuggaucacggauuaucaggguaaaacagucugguucguaccuagcauuaaggcuggaaacgauauugccaauugcuugagaaaaagugguaagaaaguuauacagcuuucacgaaaaacauucgacacagaauacccuaaaaccaaauuaacagauugggauuucgugguuacaacagacauaucagaaaugggagcaaauuuccgggcuggacguguuauugaucccagaagaugucucaagccgguuaucuugacagacggcccggaacgugugauacuugcaggaccuauacccgucacgccagcaucagcugcucaaaggagaggccguaucggacgcaauccggcccaagaagacgaucaauauguguuuagcggagauccuuuaaagaaugacgaggaucacgcucauuggacagaagcuaaaauguuacuggacaauauauacacaccagagggcauaauaccuacacuguuugggccugaacgagagaaaacucaagcaauagauggggaauuucgacuuagaggcgaacaacguaagacguucguugaacuaaugcgacgaggagaucuaccugucuggcuuaguuauaaaguagcuucugcggguauaucguauaaagaccgcgagugguguuuuaccggagaacgaaacaaucaaauccuagaagaaaacauggaaguugaaauuuggacgcgcgaaggggagaaaaagaaguuacgcccaaaauggcuugacgcaagaguguacgcagacccuauggcucuuaaagacuucaaagaauuugcaagcgguagaaagaguauaacacuagacauacuaacagaaauugcgucacuaccaacauauuuaucuucacgugccaaacuggcacuagauaauauaguaaugcuacacacaaccgaaagaggugggcgggccuaucaacaugcguugaaugagcuuccggagucacuagaaacucugaugcugguggccuuauuaggggcaaugaccgcuggaauauuuuuauuuuucaugcagggaaaaggaauagguaaauuaaguaugggacuaaucaccauagcagucgcaaguggacuccuauggguggcagaaauucaaccgcaauggauugccgcaagcaucauccuggaguucuuucuuaugguacuacuaauuccagaaccggaaaaacaaaggacaccucaagacaaucaacuaauauaugucauauuaacaauuuuaacgaucauuggcuuaauagcugcuaacgaaaugggauugauugagaaaacuaaaaccgauuuuggauucuaccaagucaaaacagaaacaaccauauuagauguagaucuaagaccggcaucagccuggaccuuauaugcgguagcaacaacaauccuaaccccaaugcuacgucauacuauugagaauacgagugcaaacuuaucuuuagccgcaauagcgaaucaagccgcagucuuaaugggacucggaaaagguuggccuuuacaccgaauggaccuaggaguuccauuauuggcuaugggaugcuauucacagguaaacccaacaacacuuacagccucuuuaguuaugcuauugguacauuacgcgaucauugggccaggacuccaggccaaagccacacgagaagcccagaaaagaacagcggcaggaauaaugaaaaacccaacugucgacgguaucaccguuauagaucuagaaccaauaucauaugauccuaaauuugaaaaacaacuagggcaagucauguuguuaguacugugugccggacaacuacucuugaugcgaacgacaugggccuuuugugaagucuugaccuuagcgacaggaccaauauuaacuuuaugggaaggcaaucccggaagauuuuggaacacaacaauagcuguuucuacugcaaacaucuuuagagguucauaucucgcaggggccggucuugcguuuuccuuaaucaaaaaugcacaaacacccagacguggaacagguacaacaggagaaacucuaggagaaaaguggaaacgacaauugaauaguuuagaccgaaaggaauuugaggaauauaaaagaagcggaauauuagagguagacagaacugaggccaagagugcccuaaaggauggaagcaagauuaagcacgcaguaagccguggaaguucgaaaaucagauggauaguugagagggguaugguuaaacccaaagguaagguaguggaucuugggugugguaggggcggauggaguuacuauauggcuacccuuaaaaacguuaccgaaguucgaggcuauacuaaaggaggacccggucacgaagaaccaaucccaauggccacauauggcuggaaucucguuaagcugcacagugguguggacgucuucuacaaaccaacagaacaaguagacacccuauuaugugauauuggagaaucaucaucaaauccgacuauugaagaagguagaacucucagaguauuaaaaaugguugaaccaugguuaagcagcaagcccgaguuuugcauaaaaguucuaaaccccuacaugccgaccguaaucgaggaauuagaaaaacuccaaagaaaacauggggguaaccuuguacgguguccccugucuagaaauucuacacaugaaauguacugggucucaggagccucuggcaauauuguuucaucaguaaacacaacaucgaaaauguuacucaacagauucacaacgcgccaucgaaaaccgacauaugagaaagauguggauuuaggcgcggguacucguaguguuucgacugaaaccgagaagccggauaugacuaucauagguagacgauuacagagauuacaggaagaacauaaagaaacauggcacuacgaucaggaaaauccauauaggacaugggcauaucaugguaguuaugaggcuccaucaacaggcagugcaaguagcaugguaaauggugucguaaaauugcugacaaagccaugggaugugauaccaaugguaacccaauuagcgaugacugauaccacuccuuucggacaacaaagaguauuuaaagaaaaaguugauacuagaacaccacaacccaaacccggcacuagaauggucaugacaacaaccgcuaacuggcuaugggcguuacucgggaagaagaaaaacccgcgacuauguaccagagaggaauuuauuaguaaaguacgcagcaacgcagcuaucggagcagucuuccaggaggagcaagguuggacuucagcuuccgaagccgucaacgacucucgauuuugggaauuaguugacaaggaaagagcguuacaccaggaggggaaaugugaaaguuguguguauaauaugaugggcaagagagaaaagaaacuaggagaauuugguagggcuaaaggaagucgagcuauaugguauaugugguuaggcgcaagauuucuggaauuugaagcacugggcuuucuaaacgaagaucacugguuugguagagaaaacucauggucuggcguggagggagaagggcuccacagauugggauauauacuggaagaaaucgacaagaaagauggagacuuaauguacgcggaugacacugccggcugggauacaagaauaacagaagacgacuugcaaaaugaggaauugauaacggaacaaauggccccacaccauaaaaucuuggcaaaggcuauauuuaaacucacuuaccagaacaaagugguuaaaguguuaagaccaacacccagaggggcagugauggauauuauuucaaggaaagaucaaaggggcucgggccaagucggcacauauggacuaaauacauuuacaaacauggaaguacaacuaauaagacaaauggaagcagaggguguaauaacacaggacgauaugcaaaauccaaaaggguuaaaagaaaggguugaaaaauggcuucgggagugcggaguagaucgauuaaaaaggauggcaauaucgggagaugauuguguaguuaaaccccuugacgaacgcuucggaacgucgcucuuauuccugaacgauaugggaaagguucgaaaagacaucccacaaugggaaccaucgaaagguuggaaaaacuggcaagaaguucccuuuuguucacaucauuuucacagaaucuucaugaaagacggaagaucgcuuguuguuccguguagaaaucaagaugagcucauuggucgagcaagaauuucgcaaggagcgggauggucgcuacgagaaacagcaugccuaggaaaggcuuacgcccaaauguggucucugauguauuuccauaggagagauuugagguuagcaaguauggcaaucuguucggcagugccaacugaaugguuuccuaccaguagaacgacuuggucaauacacgcccaccaucaguggaugacaaccgaagauauguuaaaaguauggaaucgcguauggauugaggauaauccaaauaugauugauaagacaccaguacacuccugggaagacauaccguaccuaggaaaacgcgaagacuuauggugugguaguuuaaucggauugagcaguagggcgacuugggccaaaaacauacauaccgcaauaacacaaguaagaaaccugauuggcaaagaagaguauguagauuacaugccggucaugaaacgauauucugcaccaucugagagugaaggaguguuguga

SEQ ID NO: 23626 - RNA, 9867 nt, Artificial Sequence
  derived and/or modified CDS sequence (opt6) from DENV-4__EU854300__SS-prME
ucuaccauaacauuacugugucugauuccuacggucauggcuuuucauuugagcacuagagauggggaaccccugaugauaguggcaaaacaugaacgugggagaccuuuauuguucaaaacuacugaaggaauaaacaaaugcaccuuaauagcgauggaccuaggugaaaugugugaagacaccguaacauacaaaugcccacuccuagucaacacagaaccagaggauaucgacugcugguguaaccuuacaagcacguggguuauguacgguacuuguacgcaaucuggagaaaggagaagagagaaaagaucgguagcacuuacuccgcauagcggcaugggguuggaaacaagagcugagacguggauguccagcgaaggagcauggaaacaugcacaaaggguagaaaguuggauacuacgcaauccgggauuugcucuauuagcaggauucauggcguacaugauaggacaaacuggaauccaacguacaguauuuuucguacuaaugaugcugguagcaccguccuaugguaugcggugcgucggagucggcaauagagacuuugucgaagguguaucuggcggagcauggguagacuugguguuggagcauggcggcugcguuacuacaauggcacaaggaaaaccaacguuagauuuugaacuuacaaaaacaaccgccaaagaagucgcccuauuaaggacuuauugcauagaagcauuaaucagcaacauaaccacagcaaccagguguccaacucaaggcgaacccuacuuaaaagaagaacaagaucaacaauauauaugccgacgagauguuguagauaggggauggggaaacggauguggcuuauucggaaaaggcggcgucguuacuugcgcuaaauuuucaugcaguggcaaaauaacagggaaccugguacaaauagagaaccuagaauauacaguaguaguaacuguccauaacggugauacucacgcaguuggcaacgauacaucaaaucacggggugacagccacaaucacgccuaggucuccgucaguagagguaaaauuaccugauuauggcgaacuaacuuuggacugcgaaccuagaucugguauugauuucaaugagaugauauuaaugaaaaugaagaagaaaaccugguuaguacauaaacaaugguuuuuagaucugccucuuccauggaccaccggagcagauacgucagaaguucauuggaauuacaaagaaagaaugguaaccuuuaaagucccucacgcaaaaagacaggaugucaccguacucggaagucaagaaggagcaaugcauucagccuuagcuggggccacagagguagauucgggagacggaaaucauauguuugcgggucauuuaaaaugcaagguaagaauggaaaaacuucgcauuaaagggauguccuacacaauguguucaggcaaguuuucgauugacaaagagauggcagaaacacaacauggcacaaccguaguaaaagucaaauaugaaggagcuggagcacccuguaaagugccaauagagauaagggauguaaauaaggaaaaagugguagggagaguaauaucugcaacgccgcuugcugagaacacaaauaguguaacaaauauagaacuggaaccaccuuucggagacagcuauauagucauuggcguggguaauucugcucuaacacuccauugguuuaggaaaggaucauccaucgggaaaauguuugaauccacguacagaggugcgaaaagaauggccauucuaggggagacagcaugggacuuugguagcguaggugggcuauuuacaaguuuagggaaagcaguacaucaaguauuugguaguguuuauacaaccauguucggagguguuuccuggaugauaagaauauugauagguuuccuagugcuuuggaucggaacaaacagucguaauaccaguauggcaaugacuugcauagcaguuggagggauaacuuuauucuugggcuuuacaguacaagcagacaugggaugcgucguaucuuggaaugguagagaacuaaaaugugggucggggauuuuugucguagauaaugugcauacguggacagaacaauacaaauuucaaccagaaaguccagcgagauuagcaucagcuauucucaaugcgcauaaggacggugucugcgguauaagaagcacaacuagauuagagaauguuauguggaaacaaaucacuaacgaacugaauuauguauuaugggaaggaggucaugaccuaacaguaguagccggugauguaaaaggcguccuaacuaaaggaaaacgugcucuuacgccaccagcuuccgaccuuaaguauucguggaaaacguggggaaaagcuaaaauuuucacuccugagacaagaaauucuaccuuuuuaaucgacggcccugauacaagcgaguguccgaaugagaggagagcguggaauagcuuugaaguagaagauuauggguuuggcauguucacgacaaauauuuggaugaaauuuagggaggggucgucugaaguaugcgaucaucgccucaugucugcugcaauuaaagaucaaaaagccguacaugcugacaugggcuauuggaucgaaucaaguaagaaccaaacauggcaaaucgaacgcgcaucacuaaucgaagugaaaacaugccuauggccaaagacacauaccuuauggagcaacgggguacuagaaagccaaaugcucauaccuaagucguaugcaggcccuuuuucccaacauaauuauagacaaggauaugcaacacaaacagucggaccguggcaccugggcaagcuagaaauagauuuuggcgaguguccggguacuacuguaaccauucaagaaaacugcgaccacagaggaccaagucuaaggacuacgacagcaucaggaaagcuagugacacagugguguugucguucuuguaccaugccgccucuacgauuucuaggagaagauggaugcugguaugguauggaaauccgaccauuaucagagaaagaggaaaacauggucaaaucccaaguuacagcaggacaggggaccagcgagacauucaguaugggacucuuaugucuuacacuuuucguugaagaguguuugcgaagacgcguuacaaggaaacauaugauacuagcgguuguuauaacacuaugcgcaauaauacuagggggauuaacauggauggaucucuugagagcucuuauuauguuaggugauacaaugaguggcaggauaggaggccaaacgcacuuggcuauaauggcuguauuuaaaaugagcccgggauacguguuagggguuuuucuuagaaaacugacgaguagggagacagcgcuaaugguuauaggaauggcuaugaccacgacauuaucgaucccucacgaucuaauggaauuaauagacgguauaucguuaggcuuaauacuucuaaagauagugacacaguucgauaauacacaaguugguaccuuagcacugagccucaccuuuauacguucaacaaugucauuggucauggcauggaggacaauuauggcugugcuauucguuguuacccuaauacccuugugcagaacaucgugucuacagaaacaaucucauuggguagagauuacggcacuaauauuaggggcucaggcgcuuccgguauaucuuaugacauuaaugaaaggugcauccagaagaaguuggccguuaaacgaagguauaauggcuguuggacuugucucacuguugggaucagcuuuguugaaaaacgauguaccacuagcggggccuaugguggccgguggguuacuccuggcagcauaugucaugucaggaucaucagccgaccuuagcuuagagaaagcagcgaaugugcagugggaugagauggcagacaucacaggaagcaguccaauaaucgagguuaaacaagacgaagauggaucauucucgauaagagauguggaagagacaaauaugaucacguuacucguaaaauuagcacuaaucacaguauccggauuguauccacucgcuaucccgaucacaaugacccuuugguacauguggcaaguuaaaacacaaagaagcggggcgcugugggacguaccguccccagcagccacacagaaagcggcccuuuccgagggcguauacagaauuaugcaaagagguuuauucggcaaaacucaaguuggcguuggcauccauauugagggcguguuucauacaauguggcacguuacucgcgggaguguuauaugucaugagacaggccgauuggagccuucaugggcugacguacguaaugauaugaucaguuaugggggugguuggagauuaggagauaaaugggauaaagaagaggauguacaaguacuugcaauagaacccggcaaaaacccaaaacacguucaaacaaaaccuggauuauucaaaaccuuaacaggagaaauaggugcggucacucuagacuuuaagccuggcaccagcggaucccccauuaucaaucgaaaaggaaagguaauaggucuauacggcaacgguguaguaacuaagucaggagauuauguuagcgcgauaacgcaagcagaacggaucggugaaccagauuaugaaguagaugaagauauauuuaggaaaaagcguuugacuauaauggacuuacacccaggugcagguaaaacgaagagaauauuaccuuccaucguucgagaagcccuaaagagacgauuaagaacguuaauacuagcaccaacuaggguuguugcagcagaaauggaagaagcccuaagagguuugccaauaagguaucaaacaccagcaguaaaaagcgaacauaccggacgcgaaaucgucgaccuuaugugccaugcaacauuuacaacuagacuucucucuuccacgagaguaccuaacuacaaccuaauugucauggaugaagcgcauuucacagauccuucuucaguugcugcucgaggauacauuuccacacgagucgagaugggugaagcagcugcgauuuucaugacagcaaccccaccuggcgcuaccgaucccuuuccacaauccaauaguccuaucgaagauauugaacgcgaaaucccugagcguucauggaauaccgguuucgauuggauaaccgauuaucaaggaaaaacagucugguuuguaccaaguauaaaagcggguaaugauauagcgaauugcuuaaggaaaaguggcaagaaagucauucaacuaagccguaagacauuugauacugaauauccaaagacuaaguuaaccgauugggacuucguaguuacaacggauauuucugaaaugggugccaauuucagagcuggucgcguuauugauccacgccguugccugaaaccaguuauacuaacugaugguccugaaagagucauacuagcagggccaauccccguaacaccagcaagcgcagcucaaaggcguggcaggaucggucguaauuuagcccaagaagaugaccaauacgucuuuagcggagauccauuaaagaacgaugaagaccacgcacacuggaccgaagcaaagaugcuacuagauaauauauauacuccagaagggauuauaccgacucucuucgggcccgagcgagagaaaacucaagcgaucgauggggaauuuagacuacgcggagaacaacgaaaaacauucgucgaacugaugcgacgaggagauuuacccgugugguuaagcuauaaaguagcaucagcuggaauuaguuauaaagacagagaaugguguuuuaccggggaacgaaauaaccaaaucuuggaagaaaacauggaaguagaaauuuggacacgugagggugagaaaaagaaguuacggccuaaaugguuagaugcucgugucuacgcagauccaauggcccuaaaagauuuuaaagaauuugcuucuggucgcaaauccauaacacucgauauucugacagaaauugccucauuaccaacauacuuaucaucuagagcaaaacuagcauuagauaauauuguaauguuacauacaaccgaacguggcggucgagcguaucaacacgcgcuuaacgaacuuccugaaagccuagaaacacuuauguugguagcacuacuaggcgccaugaccgcaggcauauuucuauuuuucaugcagggaaaaggcauaggaaaauuaucaaugggauuaaucacaauagcugucgcaucagguuuacuuugggucgcagaaauacaaccacaauggauugccgcuucaauuauucuagaguucuuccucaugguauuguugauaccagaaccugagaaacagcgcaccccacaggauaaucagcuaauauaugucauacuaacuauauugaccaucauaggauuaaucgcagcuaaugaaaugggccuuaucgagaaaacaaaagccgauuuuggauucuaucaaguaaaaacggaaacuacuauuuuagaugucgaucuccgacccgcaagugcauggacucuuuaugccguagcaacgacaauucucacccccauguugaggcauacaaucgaaaauacaagugcgaaucuuagccuagcagcgauagcuaaucaagcggcaguucuaaugggacugggaaaaggauggccguuacauaggauggauuuggguguaccuuuguuagcaaugggauguuacagccaagucaauccuaccacucuaacugccaguuuaguuaugcuacuuguacauuaugcgauaauaggcccugguuuacaggccaaagcgacucgugaggcucaaaagcguacagcagcaggcauuaugaagaauccaacggucgacggaaucacuguaauugaucucgaaccaauaucguacgacccgaaguucgagaaacaacugggacaaguaaugcugcuuguacuuugugcaggacaacuauuacuuaugagaacuacaugggcuuucugugagguacuuacauuagccacaggaccuauccuaacuuugugggagggaaaccccggcagauuuuggaauaccacuaucgcuguaagcacugccaauaucuucagaggcaguuaccuggcgggggcagguuuagcauucucacugauuaaaaaugcacaaacaccacgaagaggaacaggaaccacuggcgaaacccucggggaaaaauggaagagacaauugaacucuuuagauagaaaagaguucgaagaguacaaacgcucagggauccuugagguggauagaacagaagccaaguccgcauuaaaagacggaucuaaaauuaaacacgcugucagccggggaucgaguaaaauacguuggauaguagaacgggggaugguuaaaccaaaagggaaaguaguagaucuaggguguggaagaggagguuggucauauuacauggcuacuuuaaagaacguaacugagguaaaagguuauacaaaaggagggccuggacaugaagaaccgauuccaauggcaaccuacgguuggaaucuggugaagcuccauucagggguagauguauuuuauaaacccacagagcaaguagauacguuguuaugugauauaggagagaguagcucaaauccuacgauagaagaaggacggacgcuaagaguauugaagaugguagaaccauggcuuucaucuaaaccagaguucugcaucaaaguucuuaauccauacaugccgacgguuaucgaggaacuggaaaaacuccaaagaaaacauggaggcaauuuaguaagaugcccauuaaguagaaauucaacucacgagauguacuggguaucaggcgcgucgggaaauauugugagcucagugaauacaacaucuaaaaugcugcucaaccgguuuacaaccaggcaccguaagccgacuuaugaaaaagacguggauuuaggugcgggaacucguucuguuucaacagaaacagaaaagccagauaugacgauuauaggacgcagauugcagagguugcaagaagaacacaaggaaacuuggcauuacgaucaagaaaauccauaucguacaugggccuaucaugggaguuaugaggcuccaucuaccgguagugcgucaagcaugguaaaugguguaguuaaacucuuaacgaaaccuugggacgugauucccauggugacgcaguuagcuaugacugauacgacucccuucggccagcaacgaguuuuuaaagagaaaguagacacgagaacuccgcagccaaaaccagguacaagaauggucaugacaacaacagcgaauuggcuaugggccuuacuaggcaagaagaaaaacccgcgucuaugcacccgugaagaauuuaucucgaaaguaagaucgaacgcugcgaucggugcuguguuucaagaagaacaaggcuggaccagugcaagcgaagcaguaaaugacaguagauucugggagcuggucgauaaagaaagagcacuccaucaagaggggaaaugcgaaucauguguuuacaauaugaugggaaagcgugagaagaaacuuggagaauuuggucgagcuaaaggaaguagagcuauuugguacauguggcuuggugcaagguuccuagaguucgaagcauugggguuucucaacgaagaucacugguuugguagggaaaacucuuggucaggagucgaaggugaaggcuuacaucgccucggguauauucuagaagagauugauaaaaaggauggugacuuaauguaugcggaugauacugccggcugggacacacguauuacagaagaugaucuucaaaacgaggaacugaucacagagcagauggcaccgcaucauaagauauuagcaaaggcuauauucaaacuaacauaccaaaauaaaguaguaaaaguucuccguccaacaccgagaggugcuguaauggauauuaucucucggaaggaucagagagggucaggccaaguaggaacuuacggauuaaauacuuucaccaauauggagguacaacuaauccgacaaauggaggcagaagguguuauaacacaagaugauaugcaaaacccuaaaggauuaaaagagagaguagagaaaugguuaagagaauguggugucgaucgucucaaacgaauggcuauaucuggugacgauuguguaguaaagccuuuagaugagagauuuggaacaucacuacuuuuccuaaacgauaugggcaaaguacgaaaggauauaccacagugggaacccagcaaaggauggaagaacuggcaggaggugccauuuugcucacaucauuuccacaaaauuuucaugaaggaugggagauccuuaguugugccaugucgaaaucaagaugagcuaaucgguagagcgcgcauaucacaaggggcuggauggagucuaagagaaacagcguguuuaggaaaggccuaugcgcaaaugugguccuuaauguacuuucaucgaagagacuuaagauuagcaucaauggccauuuguucagcugugccaacagaaugguuuccaacgucucgaacuacauggucaauacaugcacaucaucaauggaugacaacagaagauauguugaaagucuggaaccggguguggauugaagauaacccuaacaugauugauaagacaccaguacacaguugggaggauauaccuuauuuaggcaagcgagaagaccuuugguguggaucacuaaucgguuuaucaagucgugcuaccugggccaaaaacauucacaccgcaaucacucaaguucguaaucuaauagguaaagaagaguauguugacuauaugcccguaaugaagagguacucagcgccuucugagucagaaggaguccuauag

SEQ ID NO: 23627 - RNA, 9867 nt, Artificial Sequence
  derived and/or modified CDS sequence (opt6) from DENV-4__FJ182017__SS-prME
aguaccauaacccuacuuuguuuaauacccacuguaauggcuuuucaucucucuacacgagacggcgaaccacugaugauaguugcaaaacaugaaaggggaagaccacuacuguuuaaaacuacugaagguauuaauaaauguacccuaaucgcaauggauuuaggagaaaugugcgaagauacgguaacauauaaaugcccucuauuaguaaacaccgaaccagaagauauagauugcuggugcaaucuuacgucugcaugggucauguaugguaccugcacucagucgggagaaagaagacgugaaaaacgcucgguugcuuuaacuccucacucagggauggguuuagaaacucgggcagaaacguggaugucaucggagggagcauggaaacacgcucaaagagucgagagcuggaucuugcguaauccagguuucgcacucuuagcagguuuuauggcuuauaugauuggacaaacuggcauacaaaggacgguguucuuugucuuaaugauguuggucgcaccuucguacggcaugcgcugcguggggguagguaaccgagauuucguggaaggcguuagugguggagcauggguagaucuuguucuugagcauggugggugugucaccacuauggcgcaaggaaaaccuacacucgacuuugagcuaacaaaaaccacggcaaaagaaguugcgcuucuaagaacauauugcauagaagcguuaauaucaaauaucaccacugcaaccagauguccaacucagggagaaccuuaccuuaaagaagaacaagaucaacaauacauaugucgccgcgauguaguggacagaggaugggguaaugguugcgggcuuuuuggaaaaggaggggugguaacaugugcaaaauucucauguagugguaaaaucaccggaaaucucguccaaauagagaaccuagaauauacgguaguaguaaccguacacaacggugacacgcaugcgguagguaacgauacaaguaaucauggagugaccgcaacgauuacaccaaggucaccaucaguugaaguuaaacuaccagacuacggagaacuuacacuugauugcgaaccccgaagcgguauagacuuuaaugagaugauacucaugaaaaugaagaagaaaacuuggcucguacacaaacaaugguuccuagaccuaccgcuaccauggacaaccggugcugacacgucagaaguacauuggaauuauaaagaaagaaugguaaccuuuaaaguuccucaugccaaacggcaagaugugacagucuuaggaagccaagaaggagcgaugcauucagcuuuagcgggagccacagagguggauucaggagauggcaaucauauguucgcaggucaccuaaaauguaaaguuagaauggaaaaacuuaggauuaaagggaugaguuacaccaugugcucugguaaauuuucgauugacaaagagauggcagaaacacagcaugguacaacagugguaaaaguaaaauacgaaggagcaggagcaccuuguaaaguacccaucgaaauucgggacgugaauaaagaaaaaguaguuggacgagucauaagugcgacaccgcuagcugagaacacuaauagcguaacuaacauagaacuggaaccuccguuuggagauaguuauaucgucauuggaguuggaaauucugcgcugacucuccauugguucagaaagggguccaguauugguaagauguucgaaucaacauauaggggagcaaagagaauggcaauucucggugaaacagccugggauuuuggauccguaggaggacuauucacgucacuugggaaagccguacaucaaguuuucggcucugucuauaccacgauguucgguggcguuucauggaugauuagaauuuugauaggcuuuuuaguacucuggaucggcaccaauucaaggaauacgucaauggcaaugacuugcaucgcuguuggaggcauuacucuguuuuuaggauucacaguucaggcagauaugggaugcguagugucguggucagggagagaacucaagugugggucagguaucuucgugguagauaauguacacacguggacugaacaauacaaauuucaaccggaaaguccggcuaggcuugcuuccgcaaucuugaaugcucauaaagacggcgugugcgggauucgaucuaccacacgauuagaaaauguaauguggaaacaaaucacaaaugaauugaauuauguacuuugggaagggggacaugaccuuacgguuguagcaggcgauguuaagggaguacuuaccaagggaaaaagagcacuaacuccuccggcuucggauuuaaaauauaguuggaaaacauggggaaaggcaaagauuuuuacgccagaagcccgcaauagcacauuucugauagauggacccgacacaucugagugcccaaaugagagacgagcguggaacucauuugagguggaggauuauggauuuggcauguuuacuacuaacaucuggaugaaauucagggaagguagcuccgaagugugugaccauagguuaaugucugcggcaauuaaggaccaaaaggcgguacaugcugauauggguuacuggauugaaucaucgaaaaaucaaacuuggcaaauagaacgugcaucacucauugaaguaaaaacuugucuuuggccuaagacacacacgcugugguccaacgguguguuagaaucacaaauguuaaucccaaaaucauaugcgggaccuuuuagucaacauaauuauagacaaggauaugcuacacaaacaguggggccuuggcaccucgguaagcuagagaucgauuuuggagaauguccaggaacgacuguuaccauucaagagaacugcgaucauagaggaccaagucuacggacuaccaccgcaucuggcaaauuaguuacucaauggugcugcagaucguguacaaugcccccacuccgauuccuuggagaagauggauguugguacggaauggaaauucguccgcuaagcgagaaggaagaaaauaugguaaagucccaagucacugcaggccaagguacgagugaaacauuuaguaugggguugcugugucuuacacuguucguagaagaaugucuuagacggagaguaacgcgaaaacacaugaucuuagcuguggucauuacacuaugugccauuauuuuagggggacuaacguggauggaucuucuccgagcccugauuauguuaggggacacaaugaguggacgaauagguggccaaacacaccucgcaauaauggcaguauuuaaaaugucuccggguuaugugcuggggguguuccuaagaaaauuaacgucuagagaaacugcccugauggucauaggaauggcgaugacuaccacucucucaauaccgcaugaccuuauggaacuaauugauggaauuagucuuggcuugauacuauuaaaaauugucacacaauuugauaacacucaaguggguacuuuagcuuuaucauuaacauucauccguaguaccaugucauuagugauggcuuggagaacaauuauggcaguguuguucguagucacccugauuccacucuguagaacuucguguuuacaaaaacaaucacauuggguagaaaucacagcauuaauacuaggagcgcaagcacuuccaguguaucucaugacauuaaugaagggagcaagcagaagaaguuggccccugaaugaagguaucauggccguaggccuaguuagccuguugggaucugcacuacugaagaacgauguaccacuugccggcccgaugguagcggguggauuacuacucgcagcauacguaaugaguggaaguagcgcagacuuaaguuuggaaaaggcagcaaacguccaaugggaugaaauggcugauauaacaggcagcagcccuauuauugaaguaaagcaagacgaagauggguccuuuaguaucagagauguugaagaaaccaauaugaucacacuacuggucaaauuagcccugauaacugucagugggcuguacccccuagcgauuccuauuacuaugacacuaugguauauguggcaaguuaaaacccagagauccggagcucugugggauguaccuucuccagcugcgacacagaaagcagcacugagugaaggcguguaccgaauaaugcaacgagguuuauuuggcaaaacacagguuggaguaggcauacauauggaaggugucuuucacacaauguggcaugugacuagagguucaguaauaugucacgaaacuggaagauuagaacccucuugggcagacgugcggaacgauaugaucucuuacgggggcggauggcgucuuggagauaaaugggauaaggaagaagacgugcaaguucuggcaauagaaccuggcaaaaauccuaaacauguccaaacaaagccaggacuauucaagacuuuaacuggcgaaauuggcgcaguaacccuugacuucaaaccgggaaccuccggcucgcccauaauaaauagaaaaggcaagguaauaggucuuuauggaaauggcgugguaacaaaaaguggggacuauguaagcgcuaucacgcaggcagagagaaucggcgaaccugauuacgagguugaugaggacauuuuccgcaagaaacgacuaacgauaauggaucuacauccuggagcuggcaaaaccaaacgcauucuacccucaauaguuagagaggcauuaaaaaggcgucuucgcacauuaauauuagcucccacgaggguaguugcagcagagauggaggaagcguugagaggguuaccgauuagauaccaaacgcccgcaguaaaaucagaacacacugguagagagauagucgauuuaaugugccaugcgaccuucacaaccagguuauugaguucuacucggguacccaauuacaaucugaucguaauggacgaagcucauuuuacagacccuucuucaguggcugcaagaggguauauaucuacuagaguagaaaugggcgaggcggcagcgauauucaugacagccaccccaccaggugcgacugacccuuucccacaaucuaacaguccaauagaagauauagaaagagagauuccugaaagaagcuggaauaccggauucgauuggauuaccgacuaucaaggaaagaccguaugguucguaccaagcauuaaagcagguaaugauaucgcuaauugucucagaaagaguggcaagaaagucauacaacuuagcaggaaaacauuugauacugaguauccuaaaacuaaacuaacagauugggauuucguaguaaccaccgacauaucagaaaugggugccaacuuuagggcugggcgaguaaucgacccgcggagaugccugaagccgguaauauugacggauggacccgagagaguuauacuugcaggaccgauuccagugacacccgcuucagcagcgcaacgcagggggcgaauuggaagaaacccagcucaggaagacgaccaauacguauucagcggagauccacucaaaaacgaugaggaccacgcacauuggacugaagcaaaaaugcuacuugacaacauauauacuccggaaggaauaauacccacauuauuuggaccggaaagggagaaaacccaagcgaucgauggagaauuuagacuucgaggagagcaaaggaaaaccuucguggaacugaugcgaaggggagaccugccugucugguuaucauauaaaguagccucggccggaauaaguuauaaagaucgggaaugguguuucacgggugaacggaacaaccagauacuugaagaaaacauggaaguggagaucuggacgcgagaaggagagaagaagaaacugagaccgaaguggcuagaugcuaggguauaugcugauccaauggcacuaaaagauuucaaagaauuugccaguggaaggaagucaaucacauuagauauacugacagagaucgcgagccuaccgacauacuuaaguucuagagcaaaguuagcauuagacaauauaguuaugcuacauacuacugaacgaggcggucgagcguaccaacacgcgcuaaacgaacugccagaaucuuuagaaacguuaaugcugguugccuuacuuggagcaaugaccgcagguauuuuucuauuuuucaugcaaggaaaaggcaucgguaaauugucaauggggcuaauuacaauagcaguagcguccggauuacuauggguugcugaaauacaaccacaauggauagcagccaguauaauacuagaguucuuucuaauggugcuauuaauaccagagcccgaaaaacagagaacgccccaagacaaccaauuaaucuauguuauacuaacuaucuuaacaauaauaggucuuauagcagccaaugaaaugggauuaaucgagaaaacuaaaacagauuucggguuuuaccaagugaaaacagaaacgacgauauuggauguugaucuaagaccugcguccgcauggacacuauaugcaguagccaccacaauauuaacuccuaugcugagacauacuaucgagaacacaucggccaacuuaucgcuugcagccauugcaaaucaagccgcuguguugaugggucuggguaaaggauggccacuacaucgaauggaucugggaguacccuugcuagcgaugggcuguuauucacagguuaauccgacaacuuuaacugccagcuuaguaauguuauuaguccauuaugcaauaauaggaccaggauugcaggcaaaagcuacuagggaagcacagaaaaggaccgccgcaggcauaaugaaaaaccccacgguagacggaaucacuguaauugaucuagagccaauaucauaugacccgaaauuugagaaacaacuuggacaaguaaugcuacuagcacuuugcgcaggucagcuacuuuuaaugagaacaacaugggcuuucugcgagguacugacacuagcaaccggacccauacuuacauugugggaagguaauccugggagguuuuggaacacgacuauugcagucucaacugcgaauauauuucgggggucguaccuagcgggcgcaggcuuagccuucucacuuauuaaaaaugcucaaacaccgcgucgagggacugggacuaccggagaaacucuaggggaaaaauggaaacgacaacuaaauucuuuagauaggaaagaguucgaagaguacaaaagaucgggaauacucgaaguugacaggacugaagcuaaaagcgcuuuaaaagauggaucaaaaauaaaacacgcagucaguagaggauccaguaaaauuagguggauuguugaaaggggaaugguaaaacccaaaggaaaggucguggauuuaggaugcgggagaggcggauggagcuauuacauggcaacucucaaaaacgucaccgaagugaagggauacacgaaaggagggccggggcaugaagaaccgaucccuauggcaacauauggcuggaaccuugucaaauuacacagugguguagacguauuuuauaagccgacggagcaaguugauacacuucuuugugacauaggugagucaucaucaaacccuacuaucgaagaaggaagaacuuuacguguucuaaaaaugguagaaccaugguuaagcaguaaacccgaauuuuguauuaagguucugaauccauacaugccaaccguuaucgaagaacucgaaaaacuucaacgcaaacacggaggaaauuuaguaagaugcccgcuaagucgcaauaguacgcacgaaauguauuggguuucaggugcgagugguaauaucguauccaguguuaauacgacaaguaagaugcucuugaauagauucacaacacggcauaggaaaccaacguacgaaaaagaugucgauuuaggagccgguacacgaucagugucgacagaaacggaaaaaccugauaugaccaucauaggacgaagauuacaacgucuacaagaagaacauaaggaaacuuggcauuaugaucaagaaaaccccuaucgaacaugggccuaccauggcuccuacgaggcaccaucaacggguucagcaucaagcaugguuaauggcgucguuaaguuauugacgaaaccaugggauguaauuccaauggugacccaacuagcuaugacagauacaacuccauuuggucaacagagaguguuuaaagaaaaaguagacacuagaaccccacagcccaagccaggcacuagaauggucaugacuacaacagcaaacuggcucugggccuuacucggcaagaagaaaaacccaaggcuuuguacaagagaagaauuuauuucaaagguuagaucaaacgcagcuauaggugccgucuuucaagaagaacaaggguggacaagcgcuuccgaggccguuaacgacagucgguuuugggaauuaguagacaaggagagggcuuuacaucaggaaggcaaaugugaauccugcguauauaauaugauggggaagcgagagaagaaacuaggagaauuugguagagcuaaagggucacgcgcaauaugguacaugugguuaggagcccgauuuuuagaguucgaagcauuaggauuucuaaaugaagaccauugguucgguagagagaacuccuggucuggaguagaaggggagggguugcaucguuuaggguauaucuuagaggaaaucgacaagaaggauggagauuuaauguaugcagaugacaccgccggaugggauacgagaauaacugaagaugaccuacaaaacgaagaacuuaucacugagcagauggcaccucaccacaaaauuuuagccaaggcaauuuucaaguuaacauaucaaaacaaaguuguaaaaguauuacgaccaacaccaagaggagcaguaauggacauuauaucaagaaaggaccaacgagguucggggcagguagggacauauggacucaauaccuuuaccaauauggagguucaacuaauaaggcagauggaggcggaaggagucauaacccaagaugacaugcaaaaccccaaggggcuaaaagaaagaguggaaaaaugguuacgcgaauguggaguugaucgauuaaaaaggauggcuauaucuggcgacgauuguguggucaaacccuuagaugaaagguucgguacaagccuucuauucuuaaaugauaugggaaaaguucgaaaggauauuccucaaugggaaccuucuaaggguuggaagaauuggcaagaaguuccguuuuguucucaucauuuccacaagauuuucaugaaagauggaagaucacucguaguuccaugcagaaaucaagacgaauuaauaggacgcgcaagaauaucucaaggcgcaggcuggucccuaagagagacugcuuguuuagguaaagcauaugcucaaauguggucccuaauguauuuccaccgucgggaucuucgucuggccucaauggcaauuuguagcgcaguaccgacagaaugguucccaacuucaagaacaacauggaguauacaugcacaccaucaauggaugacaacagaggauaugcuuaaagucuggaaccgaguuuggauugaggauaauccaaacaugaucgauaaaacaccuguacauagcugggaagauauaccguacuuaggaaagcgagaagacuuaugguguggaagucuaauaggcuuaaguucacgcgcgacgugggccaagaauauacacaccgcuauuacucaagugaggaauuugauaggaaaggaagaguacgucgacuauaugccaguaaugaaacgcuauagcgcuccaagugaaucagaaggugucuuauga

SEQ ID NO: 23628 - RNA, 9867 nt, Artificial Sequence
  derived and/or modified CDS sequence (opt6) from DENV-4__EU854301__SS-prME
aguacuauaacuuuacuaugcuuaauuccaacgguuauggcauuccauuugucaacgagggauggagaaccgcuaaugauaguugcuaaacacgaaaggggaagaccccuccuuuuuaaaacaaccgaaggaauaaacaaauguacguuaauagcaauggaucuuggugaaaugugcgaagacacaguuacguauaaauguccucuccuaguuaauacagaaccagaagauauagauuguugguguaaucugacgagcacaugggucauguaugggacgugcacgcagagcggugaaagacgaagagagaaaagaagcguagcucuaacuccgcauucugggaugggacucgaaacacgagcugaaacauggaugucuuccgaaggugcguggaaacacgcgcagcggguggaaucauggauucucagaaauccugguuucgcgcuucuugcaggauuuauggcauauaugauuggacagacaggcauucaaagaaccguauucuuuguccuuaugaugcucgucgcucccaguuaugguaugcggugugucggcguuggaaaucgugacuuuguugaaggaguaucgggaggugcauggguugaucuggugcuugaacauggaggaugugugacaacuauggcccaaggaaaaccaacauuagauuucgaacuaacaaaaacuacagcgaaagaaguugccuuguugagaacuuauuguauagaagccucaaucucaaacauaacuaccgcgacccgauguccaacucaaggggaaccauauuuaaaagaagaacaggaccagcaguauauaugccgaagagacguaguggaucgaggguggggcaauggaugcggauuauuugggaaaggagguguaguaacaugcgccaaauucucuuguucagggaaaauuacaggcaauuugguucaaauagaaaacuuagaguacacaguggucguaaccguucacaauggugauacucacgcggucgguaacgauacuuccaaucacgguguaacagcuacgauaacgccucgaucaccaagcgucgaaguaaaacuaccagauuacggugaacugacguuagacugcgaaccacguucuggcauugauuuuaacgaaaugauacucaugaaaaugaagaagaaaacuuggcugguccauaaacaaugguucuuggaucucccuuuaccauggacaacaggggcggacacuagcgaaguucauuggaauuauaaagaaagaaugguaacauuuaaaguuccacaugcaaaacgucaggauguaacuguacuuggaucucaagaaggggcaaugcauagcgcuuuagcuggugcaacggaagucgacaguggcgauggcaaucauauguucgcuggacaucuuaaaugcaaaguacgaauggagaaacuuaggaucaaaggaaugaguuacacaauguguucaggcaaguuuucaauugauaaagaaauggccgagacacaacauggcacgacaguagucaagguaaaauacgaaggagcaggcgccccuuguaaaguaccaauagaaauucgagauguaaacaaagagaaagugguuggacgcguuauauccgcgacaccgcuagccgaaaacacaaacucaguaaccaauauugagcuggaaccuccuuuuggagacaguuacauaguuauuggaguuggaaacagugcuuuaacacuucacugguuucggaaaggaaguucaaucggcaaaauguucgaaucgacauaucggggugcaaaacguauggcgaucuuaggugaaacagcaugggacuucggcucaguaggaggauuauuuaccucacuugggaaggcuguucaccagaucuuugguucuguauauacgacuauguuuggagggguuucauggaugauuagaauuuugauuggguuucuaguauuauggaucggaacuaacuccaggaauaccaguauggcgaugacauguauugcaguaggaggcauuacucuuuucuuagguuucaccguucaagcggacaugggguguguuguaucuuggucugggagagaacuaaaaugcgggagcgguauauucguuguugacaacguucauacguggacagaacaauauaaguuucaaccagaaucaccagcgcgauuagcaucugcgaucuuaaacgcacauaaagacgguguauguggcauucgcucgacgacgagauuagaaaaugucauguggaaacagaucacaaaugaauuaaauuacguucuuugggaagguggacacgauuugacaguaguagccggugauguaaaaggagugcucacuaaaggaaaacgugcccugacuccacccgcauccgaccuaaaguauucuuggaaaaccuggggaaaagcuaaaauauuuacgcccgaagcucguaauagcacauuucugauagauggcccugauacuuccgagugcccgaaugagaggcgugcguggaauagcuucgaggucgaagauuacggcuucggaauguuuacaacuaacauuuggaugaaauuccgggaaggcucgucugaaguaugcgaucacagacuuaugagcgcagcaauuaaagaccagaaagcaguacacgcggacaugggauauuggauagagagcucgaaaaaucaaacauggcaaauugagcgagcaucguuaaucgagguuaagacguguuuguggccgaaaacucacacuuuauggucaaacggcguauuagagucacaaaugcuuauaccaaaaagcuaugcggguccauuuucucaacauaauuacagacaagguuaugcuacacaaaccguuggccccuggcacuuaggaaaacucgaaauugauuucggagaaugccccgguacgaccguaacuauucaagaaaacugcgaucaucgugguccgucucuucgaacaacaacagcgagcgggaaauuagucacacaauggugcuguagauccugcacuaugccaccacuccgauuccuuggagaagaugggugcugguacgggauggaaauuagacccuuaagcgagaaggaagaaaacaugguaaaaagccaaguaacagccgggcaaggaacgucugaaaccuucagcaugggccuauuaugccucaccuuauucguagaggaaugucuaaggagacguguaacaagaaaacauaugauccuagcgguaguaauuacauugugcgcaauaauuuuaggaggauugaccuggauggauuuacuacgugcuuuaauuaugcuaggagacaccaugagcggaagaauuggaggucaaacucauuuggcgauaauggcuguguuuaaaaugaguccugguuacguacuagggguauuuuuacguaaguuaaccagucgugagacagccuugaugguuauagguauggcaaugaccacgacauuaagcaucccucaugaccuaauggaauugauugacgguauaagucuaggacugauacuucuaaaaauugucacgcaguuugauaacacacaggugggcacauuggcucuaucacucaccuucauucguaguacaaugagucuaguaauggcauggaggacuauuauggccguauuauuuguaguuacauugauaccacuuuguagaaccucaugucuccagaaacaaagccauuggguagagauuacagcccucauacuuggugcucaagcccuuccaguuuauuuaaugacgcuaaugaagggagcgagccggcgaagcuggccauugaaugaaggaauaauggcaguugguuuagugucacucuuagguagcgcucuuuugaaaaaugacgugccuuuggcaggaccgaugguagcuggaggguuacuauuagcagcauacguaaugucgggauccagugcagaucuaucauuagagaaagcugcgaauguacaaugggacgagauggcagacaucaccggcagcucuccgauaauagaggucaaacaagaugaagacggaucuuucucaauuagagacgucgaggagacaaacaugauaacgcuacuuguaaaauuggcacuuauuacagucagugguuuguauccacuugcaauaccuauuacaaugacacuaugguauauguggcaaguaaaaacacagcgauccggggcguuaugggauguuccuagcccugcagcaacgcagaaagcagcauugucugaaggaguuuauagaauaaugcaaagagguuuauucgguaagacacagguaggcgucgguauccauauggagggaguuuuccacacgauguggcacguaacuagagguucgguaauaugucacgagaccgguagauuagaacccucaugggcagacguuagaaacgauaugauaaguuacgguggagguuggcgucucggagauaagugggauaaggaagaagacguccaaguauuagcuauagaaccggggaagaacccaaagcacguccagacaaaaccuggucuuuucaaaacacugacuggagagauuggagccguaacacuugauuuuaaaccugguacaagugguagccccaucauuaauaggaaagggaaagugauaggacuauauggaaacggaguuguaacaaaaagcggagauuauguaagcgcuauaacucaggcagagagaaucggugaaccagauuaugaagucgaugaagacauauucaggaagaaaagauuaacaauaauggaucuacauccaggugcugggaaaacuaagaggauccugccauccauaguccgagaggcuuugaagcgaagauuacgaacccuuauucuggcgccaacucguguuguggcugcagaaauggaggaagcacugcguggacuuccuauacguuaccaaacgccugcuguaaagagugaacauacagggagggagauaguagaccucaugugccaugcuacauuuacaacaagacuccuaagcucgacaagaguaccgaauuauaauuuaauaguaauggacgaggcgcacuuuacggaucccagcagcguugcugcaagaggauacauuucaacgcguguggaaaugggagaagcagcagcgauauucaugacugccacuccaccgggggccacagauccuuucccucaaaguaacaguccgaucgaagacaucgaaagagaaauuccagagcgcucguggaauaccggcuuugauuggauaaccgauuaucaaggaaaaaccgugugguucguuccuagcaucaaagccgguaaugacaucgcaaauugcuuacgaaaaaguggaaagaaaguaauacaacuuucgaggaaaacuuuugauacagaauacccaaaaacaaaacucacggacugggacuuuguaguaacaaccgauauuagugaaaugggagcaaauuuuagggcagguagaguaauugauccaagacgauguuuaaaaccaguaauacuuacugacggcccugaacgcgugauauuggccgguccaauuccagugacuccagcuucggcagcgcagcgucgugggaggauuggaagaaaccccgcacaggaggaugaucaauacguguucucuggugacccucuuaaaaacgaugaagaucaugcacacuggacagaagcaaaaauguuacuagauaauaucuauaccccagaaggaaucauacccacucuauucgggccagaaagggagaaaacucaggcaauagacggugaauuucgacugcgaggggaacagcggaaaaccuuuguggaacuaaugcguaggggugauuuacccguaugguuauccuacaaaguggcgucagcaggcauuucguauaaagacagggaguggugcuucacuggggaaaggaauaaucaaauuuuagaggaaaacauggaaguggagauuuggacaagagaaggcgagaagaagaaacuaaggccuaaauggcuagaugcgagaguauacgcagauccgauggcacuaaaagauuuuaaggaauuugcauccggaagaaaaucaauaacccuagauaucuuaacagaaauagcuagccugccgacauacuuaagcucccgagccaaguuagcacuggacaauauaguaauguugcauacaaccgaaagaggaggucgggcauaccaacaugcccuaaacgaacuuccagaaucccuagaaacacuaaugcuaguugcccuauuaggugcuaugacagcugguauauuccuauucuucaugcaagggaagggcaugggaaagcuaucgaugggauuaauaacaauugcuguugcaagcggguuacuuuggguugcggagauacaaccgcaguggauagcggcaaguauaauucuagaauuuuuccuaaugguacucuuaaucccagagccagaaaaacagagaaccccgcaagacaaucaacuaauuuaugugauucucacaauucuaacuauaauaggacuaauagcugcaaaugagaugggacuaauugagaaaacuaaaaccgauuuuggguuuuaccagguaaaaacagaaacaacaauacuugauguagauuuacggccagcuucagcauggaccuuguacgcaguagcgacaacaauauugacuccaaugcuacgucauacuauagaaaacacaagcgcaaaucuaucgcuggcagccauugcaaaucaggcagcaguauuaauggggcucggcaaagguuggccguuacauagaauggaucuugggguaccuuuauuagcuaugggcuguuauucacaaguaaacccaacaacuuuaacugcgagccuaguaauguuauuaguccacuacgcgauaauagguccaggauuacaagcuaaagccacucgggaagcgcagaaaagaacugccgcgggaauuaugaaaaauccaacuguagauggcauaacgguaauagaucuagaaccgauuucauaugacccaaaguuugaaaaacaacuaggucaaguaaugcuauuaguccuaugcgcaggacagcuauuuuuaaugcguaccaccugggccuuuugcgaaguccuaacccuagcaacugguccgauucuaacauugugggaaggaaacccuggcagauuuuggaauacuacaauugcagugagcaccgccaacauauuucggggaagcuaucuugcaggggcuggauuagcauucagucucauaaagaaugcucaaacucccaggcgaggaaccggaacaacuggugaaacuuuaggagagaaguggaagcgacaauuaaauagucucgaccgaaaggaguuugaggaguacaagaggucugguauacucgagguggaucgaacagaagcaaaaucagcacuuaaggauggcagcaaaauaaaacacgcaguaucuagaggaucgagcaaaauaagguggaucguagaacgggguauggucaagccaaaaggcaaagugguagaucuugguugcggucguggugguugguccuauuauauggcgacauugaaaaauguaaccgaaguaaaaggcuacaccaaaggaggucccggacacgaggagccaaucccaauggcaacauacgguuggaacuuaguaaaacuacacagcgguguggauguauuuuauaaacccacugaacaagucgacacguuauuaugcgauauuggcgaaaguucauccaaucccaccauagaagaaggacguacauuaagagucuuaaaaaugguggaaccauggcuuuccucuaagccagaguuuuguaucaaaguauuaaacccuuacaugccuacugucauagaagaauuagaaaaacuccagcggaaacacgguggaaauuuaguaagauguccacucagucgaaauucaacacacgaaauguauuggguaucgggcgcuucaggcaacaucguaucaaguguaaauacgacauccaaaaugcuccuaaauagauuuacuaccaggcaucgaaagcccacauacgaaaaagauguugaccucggugcaggaacaaggagugucagcacagagacugaaaaaccugauaugacuauuaucggcagaaggcuacaaaggcugcaagaagaacauaaagagacauggcacuacgaccaggagaacccauauagaacaugggcuuaccauggaucauacgaggcgccgagcacugguagcgcgucaaguaugguuaauggaguagucaaauugcuaacaaaaccaugggacguaaucccuaugguaacucaauuagcgaugacggauacuacacccuucggccaacaaagaguauuuaaagagaaagucgacacuagaacaccacaaccaaaacccggaacucguauggugaugacaacaacagcaaacugguuaugggcucuauuggggaagaagaaaaacccaagauuauguaccagagaggaguuuauuucaaagguucgaucaaaugcagcaauuggugcaguauuucaggaagaacaaggauggacaagugcuagcgaagcagugaaugauagucgguucugggaauugguugacaaagagagagcuuuacaucaagaaggcaaaugcgaaaguugcguauacaauaugaugggcaaacgagagaagaaauuaggagaauuugguagagcaaaagggagucgagcuaucugguauauguggcuuggagcucguuucuuggaguucgaggcccuuggauuucuuaaugaagaucauugguuuggacgagagaacaguuggagcggaguagaaggagaaggucugcaucgacucgguuacauuuuagaggaaauugacaagaaagacggugauuugauguacgcagaugacacggcgggcugggacacacgcaucacagaggacgauuuacaaaacgaagaauuaauaacagaacagauggcgccucaccacaaaauacuagcaaaagcaaucuucaaauuaacguaccaaaauaaggucguuaaaguauuacgcccaaccccaagaggagccguaauggauauaauaucaaggaaagaucagaggggguccggccagguaggaacauacggccugaauaccuuuacgaauauggaaguucaauuaauccgucagauggaagcggaaggagucauuacucaggacgacaugcagaauccuaaaggccuuaaagaaagggucgagaagugguuaagagaaugugguguagauagacuaaaaaggauggcgauuaguggggaugacugugugguaaaacccuuagaugagagauucgggaccucucuauuguuuuuaaaugauauggguaaagugcguaaagauauaccucaaugggagccgaguaaggguuggaaaaacuggcaagaaguaccuuuuuguucccaucacuuucauaaaauuuuuaugaaagacgggagaucuuuaguaguaccuugcaggaaucaggaugaacucaucggacgcgcuaggaucucacaaggggcuggauggucucugagggaaacagcuugucuuggcaaggcuuaugcacaaauguggagccugauguauuuucaccgucgcgacuuaagacuagcaaguauggccauauguucugcaguuccaacggaaugguuuccuaccagcagaacaacauggucaauucacgcucaucaucaauggaugacaacagaagauaugcuuaagguguggaaccguguauggauagaggauaacccgaacaugauagauaagacaccaguacauaguugggaagauauuccuuaccuagguaagagagaagaucucuggugcggaaguuuaauaggauuguccuccagggcaacaugggccaaaaauauucacacugcaauuacacaaguaaggaauuuaauuggaaaagaagaguauguggacuauaugcccgcuaugaaacgauauuccgccccaagugaaucagaagguguuuuguaa

SEQ ID NO: 23629 - RNA, 9867 nt, Artificial Sequence
  derived and/or modified CDS sequence (opt6) from DENV-4__FJ639736__SS-prME
ucuacuaugacccuauugugucuuauaccaacugcgauggcuuuucaucuuucaacucgcgacggugaaccauugaugauuguugcaaaacacgaacgaggacggccauuacuuuuuaaaacaacagaaggaauuaauaaauguacgcugauagccauggaccugggagaaaugugugaagacacaguuacauauaaauguccauuguugguuaauaccgaaccggaagacauagacugcuggugcaauuuaacuucuacuuggguuauguaugggacauguacucaaucaggagaaagacguagagaaaaacgaagcguggcauugaccccgcauagcgguaugggacuugagacuagagcugagacuuggauguccucagaaggagcauggaaacaugcacaacguguugaaucuuggauauuaaggaaucccgguuucgcacuucuugcugguuucauggcuuacaugauuggacagacagggauacagaggacaguauucuuuguguuaaugaugcuaguugcuccuaguuacggcaugcgcugcguaggugucggcaacagagauuuuguugaaggcguuucaggaggagcuuggguggaucucguuuuggagcacggaggaugugucacaacaauggcccaggguaaaccaacauuagauuucgaauuaaccaaaaccaccgcgaaagaaguagccuuguuaagaacauauuguauugaggcauuaauuagcaauaucacgacggcgacacgguguccuacucagggagagccauacuugaaagaagaacaggaucaacaauacauuugucgacgggauguaguagauaggggcugggguaacggaugugguuuauucgguaaaggcgggguggucacuugcgcgaaauucagcuguuccggaaaaauaacaggaaaccuuguacaaauagaaaauuuagaguacacggucguaguaacaguacauaauggugauacucacgccguggggaaugauacaagcaaucauggaguuacagcaaccauuacaccuagaucaccuaguguugaagugaaguuacccgacuauggagaacuaacacuagacugugaaccuagaucagggaucgacuuuaacgaaaugauuuugaugaaaaugaagaaaaagacuugguuagugcauaaacaaugguuccuugaucuuccauugcccuggacagcgggugcugacacaucggaaguucauuggaacuauaaagagagaaugguaacuuuuaaagugccucacgcaaaacgacaggacguuacgguucuagguucacaagagggagcaaugcacucagcucuagcaggggcuacagaaguugauuccggcgacggaaaccauauguuugcugggcauuuaaaauguaaaguuaggauggaaaagcucagaauaaagggcaugucauacaccaugugcucgggaaaauucuccauagauaaagaaauggcugaaacacaacaugggacuaccguugucaaggugaaauaugagggagcaggggcucccuguaaaguuccuauugaaaucagagacgugaauaaagaaaaaguaguagguagaguuauuaguucaacgccuuuagcugaaaacacuaauuccguaacgaauauugaauuagaaccgcccuucggagacaguuauauuguaaucgggguuggcaauagcgcgcuaacauuacauugguuucggaagggaucgucaauaggcaaaauguuugaaucuacauauagaggugcgaaaagaauggcaauucuuggggaaacggcaugggauuuuggaagcguagggggauuguucacaaguuuagggaaagcagugcaucaaguauuuggaucaguauauacaaccauguuugguggaguuucuuggaugauacgaauccuuauaggguuuuuaguucuuuggauugguacuaacagcagaaauacaagcauggcaaugacaugcauagcggucggagguaucacucuguuucucggauuuacggugcaggcagauaugggguguguaguuaguuggaguggccgagaguuaaagugugguuccgguauuuucguaguugacaauguacauacauggacagaacaguacaaauuucaaccugaaucuccugcccgcuuagcaucagcuaucuugaaugcacauaaggacggagugugcgggauuagaucaacaacucgauuagaaaacguaauguggaaacagaucaccaaugaguuaaacuacguacugugggaagggggucaugaccuaacaguggucgcaggagauguuaaggggguuuugacgaaagguaagagggcauuaacuccaccgguuucugauuuaaaauacaguuggaaaacaugggguaaagcaaaaauauucacuccugaagcacguaacuccacuuucuuaauagauggaccggacacgucggaguguccgaacgaaagacgagcauggaacucacuagaaguagaagauuauggauuuggaauguucacuaccaauauauggaugaaauuuagagagggcaguucagaggugugcgaucaucgcuugaugucagcggcgauaaaagaccagaaagcuguucacgcagacaugggguauuggauugagagcagcaaaaaucaaacguggcaaauugagcgagcuuccuuaaucgaggugaaaacuugcuuauggccaaaaacacauacgcuauggucgaauggaguauuggaaucucaaauguuaauaccgaaaucauaugcaggacccuuuagucaacauaacuaucgucagggguaugcgacacagacagucggaccuuggcaucucgggaaauuagagauugacuucggagaaugcccaggaaccacagucacgauccaagaagacugcgaccacagagggcccagcuuaagaacuacaacggcgagcggaaagcugguuacccaauggugcugccgaucuugcacaaugccacccuugcgauuucuaggagaagacggaugcugguacggaauggaaauuagacccuugucagaaaaagaagagaauaugguuaaaagucaaguaacugcgggccaagggacguccgagacuuuuagcaugggccucuugugccuaacacuauucguugaagaaugucugcgaaggagaguuacgaggaaacauaugauuuuggcaguaguaaucacacucugugccaucauccuaggaggccuaacauggauggauuuauugagagcacuaauaaugcugggugacacaaugucaggacggauugggggucaaacgcaucuugccaucauggcaguauucaaaaugaguccaggauacguacuaggcguuuuccuaagaaaauugacuucaagggaaacugcuuuaaugguuauagguauggcaaugaccacaacuuuaucaaucccacaugaccugauggaauugauagacggcauaucucuagggcugauacugcucaagauuguaacacaauucgauaacacacaaguuggcacgcuggcguugucccucacauuuauaagaaguacuaugagucugguaauggcuuggcgaacuauuauggcuguucuauuuguaguaacauuaaucccguuaugccguacaucgugccuucaaaaacaaucccauuggguagaaauaacagcauugauauuaggcgcccaagcucuaccuguauacuuaaugacgcuaaugaaaggugcgucccguaggaguuggccuuuaaacgaagggauaauggcaguaggccuaguaagucuacuagguagugcgcuacugaagaaugauguaccacuugcagguccuaugguugcggguggguuauuauuagcagcguacguaaugucaggaaguucagcagaccuuaguuuagaaaaagcagcaaaugugcaaugggaugaaauggcagauaucaccgguaguagcccgauaaucgaagugaaacaggaugaagauggcucguucucaauuagggauguagaagaaacuaauaugauuacguuacuuguuaaacuugcucugauaacaguaucuggucuauauccacuugcgauaccaguaacuaugacgcuaugguauauguggcagguuaagacucagagaaguggcgcacuuugggauguccccucgcccgcugccacucaaaaagcagcauuaucggagggaguguauagaauaaugcagagaggauuauucggaaaaacucagguaggcguuggaauacauauggagggaguauuccacacgauguggcaugugacuagaggaagugugauuugccaugaaacaggcagacuagagcccucgugggccgaugucaggaacgauaugauaaguuacgggggaggauggaggcucggggauaagugggauaaagaggaagauguucaagucuuggcaauugagccuggcaaaaauccgaagcacguacaaacgaaaccuggacuuuuuaaaacauuaacaggggaaauuggugcugugacccuugacuuuaaaccuggaacaagugguuccccaauaauuaaccgcaagggaaaaguaauaggucuguacggaaaugguguugucacgaagaguggagacuacguuagugcgauaacacaagcagaaagaauaggcgagccagacuaugaaguagaugaagacauauuucgaaagaaaaggcugacuauuauggacuuacauccaggcgcugggaaaaccaaaaggauauuacccucgauaguccgagaagcucugaagagaagauuaaggacgcuaauucucgcacccacgcgugucguugcagcggaaauggaagaggcacuuagaggauuaccaauuagauaucaaacaccagcuguaaaaagugaacacacaggcagggaaauugucgacuuaaugugucacgccacauuuacuacaagacuacuuagcagcacacgaguaccaaauuauaacuuaauaguuauggaugaagcgcauuuuacagaucccucuagcguagccgcuagaggguacauuucuaccagaguggaaaugggugaagcagcagcgaucuuuaugaccgcgacaccacccggagcuacggauccguucccacaaaguaacagcccaauagaggauauagagcgugaaauccccgaaaggagcuggaacaccggguuugauuggauaaccgacuaccaaggaaaaacaguaugguuuguaccaucaauaaaagcgggaaacgauauugcaaauugucuucgaaaaucagguaaaaaggucauacaacuaucacgaaaaaccuuugacaccgaguacccuaagacaaaacuuacagacugggauuucgucguaaccacagacauaagugaaaugggcgccaauuuucgugcaggccgggucaucgauccaaggagauguuuaaaaccuguaauuuuaacugauggaccagagagaguaauuuuagcagguccuaucccugucacccccgcuucagccgcccagagacggggaaggauuggcaggaauccagcgcaggaagacgaucaauauguauuuucaggagacccauugaaaaacgacgaggaucaugcacauuggacggaagcuaaaauguuacuggacaacauuuacacaccggaagggauaauaccuacacuauucgguccugagcgagagaaaacucaagcgauagauggugaauuucgguugagaggugaacagcgaaagacauuuguagaacuaaugcgcagaggagaucucccuguauggcucucauauaaaguggcuuccgcaggaaucaguuauaaagaccgagagugguguuucacuggagaacgcaacaaucaaauucuugaagagaacauggaagucgaaauuuggacgagagaaggggagaaaaagaaauugcguccaagaugguuggaugcaagaguauaugccgauccuauggcccuaaaagacuucaaggaguucgcaaguggaagaaaaucuaucacgcuugacauacuaacugaaauagcaagccuaccaacuuaccugucuucaagagcuaaguuggccuuggacaacauaguaauguuacauacaacggaaagaggugguagagcuuaccaacaugcccucaaugaauuaccggaaagucuggaaacguuaaugcuaguggcuuuguuaggagcaaugacggccgggauauuccuauucuuuaugcaaggaaaaggaauagguaaauuaucaaugggcuugauuacuauagcaguagcaaguggcuuauuguggguagcagaaauacaaccccaauggauagcagcuucaauaauccuagaguucuuccuaaugguguuauugauuccagaaccagaaaaacaacgaacaccucaagacaaccaacuuauuuauguaauauuaacaauuuugacaauuauaggacugauagcagcgaacgaaaugggacuaauagagaagacgaaaacggauuuuggauucuaucagguuaaaacagaaacgaccauacuagauguagaccuucgaccagcuagugcauggacucuuuacgcaguagcuacaacaauucuuacacccauguuacgacacacuauagagaauacgucagcuaaccuaagucuagcugcgauugcgaaucaagcagcaguauuaaugggauuaggaaagggauggccauuacaucgaauggaccugggcguuccacuguuagcgaugggguguuauucucagguaaacccaacaacauuaacggcauccuugguaauguuauugguacauuaugcgauuauuggacccgguuuacaggccaaggcaacuagggaggcacagaaaaggacggcugcaggcauuaugaaaaauccuacuguggaugguauaacggugauugaucuugagccaauuaguuaugacccaaaauuugaaaaacaauuaggucaaguaaugcuacuuguauuaugugcaggacaauuauuacuaaugagaacaacaugggcauuuugugaagucuugacuuuagcgacgggcccaauauuaacgcuaugggaagggaaccccggacgauucuggaauacuacgauugcagugagcacagcaaacauauuucgcgggucuuauuuagcuggcgccggguuagcguuuucacucaucaaaaaugcucagacaccucgaagggggacuggaacuacaggagaaacauuaggagaaaaauggaagagacaauugaacucacuugacaggaaggaguucgaggaguacaaaaggucaggcauauuagagguagaucgcacagaggccaaguccgcauugaaagacggcuccaaaaucaaacaugcgguuagucgcggaaguucaaagauucgauggaucguugaaagagguaugguaaagccaaagggaaagguuguggacuugggaugugggcgaggaggguggucauauuacauggcaacccuuaaaaauguaacggaaguuaaaggguauacaaaagguggaccaggucacgaagaaccaauuccuauggcuacauauggauggaaucuggugaaacuacauucuggcguagauguauuuuauaaaccuacugaacaagucgauacauugcuuugugacauuggggaaaguucuucaaacccuacuauugaagaaggacguacuuuacguguccugaaaaugguagaaccguggcuuuccaguaaaccggaguucugcauaaaaguauugaaucccuacaugccaacgguaauugaagaauuggaaaaacuccaaaggaagcauggagguaacuuaguccgcugcccguugucaagaaacagcacgcacgagauguauuggguuaguggugcaagcggaaauaucgugaguagcguaaacacaacaucaaaaaugcuguuaaauagauuuacaaccagacaccgaaaaccuacauaugaaaaagauguggacuugggagccggaacccgaucagucuccacagaaacagagaagccugauaugacaauuauaggcagaagacugcagcgguugcaagaggaacauaaagagacuuggcauuaugaccaggaaaacccguaucgcacgugggcauaucacggaagcuacgaggcuccaaguacggguucugcaucgaguaugguaaacggagucgugaaacuucugaccaaaccaugggauguuauacccauggucacgcaacuagcgaugacagauacgacuccuuuuggacaacaacgaguauuuaaagagaagguagauacucgaacuccccagccuaagcccgggacuagaaugguaaugacaacaacugcaaauugguuaugggcauuacuaggcaagaagaaaaaccccagacuuuguacacgcgaagaguucauuaguaaaguacgaaguaacgccgcaaucggugcuguauuccaggaggaacaagguuggacuucagcaucagaagcuguaaacgauagccgguucugggaacugguggacaaggagcgagcauuacaucaagaaggaaagugugagaguuguguauacaauaugaugggaaaaagggagaagaaauuaggagaauuugguagagccaagggaagucgagcaauuugguauaugugguuaggagcaagauucuuggaauuugaagcguuagguuuucuaaacgaagaccauugguuuggaagggaaaacagcuggagcggcguggagggggagggcuuacauagacuuggauauaucuuagaagaaauugauaagaaagauggagauuuaauguaugcagaugacacagcgggaugggauaccagaauaacggaagacgaccugcagaaugaagaguuaauaacggagcaaauggcgccacaccauaaaauucuggcaaaagcgauuuucaaacucacauaucaaaacaaaguuguuaagguauuaagaccaacaccacguggagcggucauggacauuauaucacggaaggaucaacgugguucaggacaaguagguacauacggucuaaacacauucaccaacauggaaguccaguugauuaggcaaauggaagcggaaggcgugauuacacaagaugauaugcaaaauccaaaaggacucaaggaacgggucgaaaaaugguugagggaaugcggcguagauagauugaaaaggauggcuauuagcggagaugacugugugguaaagccacuagaugagcguuucgggacguccuuacuauuucugaaugauauggggaagguaagaaaggacauaccacaaugggaacccuccaaaggauggaaaaacuggcaagaaguaccauucuguagucaucauuuccacaaaaucuuuaugaaagaugggcgaucacuuguaguccccugcaggaaucaagaugaacugauaggcagagcaaggauaagccagggagcaggauggucauuacgagagaccgcaugucuaggcaaagcguaugcucaaauguggucauugauguauuuccacaggcgcgaccuuagguuagcuucaauggcaaucugcucagcugucccgaccgaaugguucccgacguccagaaccaccuggucaauacacgcucaucaucaauggaugaccacggaagacaugcuaaaggucuggaauagaguuuggauugaagacaaucccaacaugauugacaagacuccaguucacucaugggaagauauucccuacuuaggcaaaagagaggaucuuuggugcggaucgcugauaggccugagcagcagagccacaugggccaaaaacauacauaccgcaaucacacaagugcguaauuuaauaggaaaagaagaauauguugacuauaugcccguaaugaagagauacucagcaccaagcgaaagcgaagggguguuguaa

SEQ ID NO: 23630 - RNA, 9867 nt, Artificial Sequence
  derived and/or modified CDS sequence (opt6) from DENV-4__FJ639737__SS-prME
ucgacuauaacucuacuuugccuaauaccaaccguaauggcauuucacuugaguacuagagauggggaaccucuaaugauaguagccaaacaugaacgugguaggccauuacuauucaaaaccacugaagggauaaauaaauguacccuaauagcaauggacuuaggugaaaugugcgaagauacgguaacuuauaaaugcccauuauuaauaaacacagaaccggaggauauugacuguugguguaaucuuacaaguacguggguaauguacgguacaugcacucaaucaggugaaaggcguagagagaaacgaagcguugcguuaacuccacacucagggaugggauuggaaacucgagcagagacauggaugucuagcgaaggugcuuggaaacacgcccaaagagucgaaucauggauccuacgcaaucccgguuuugcacuacucgcugguuucauggccuauaugauaggacaaacuggaauacaacguacugucuucuuugugcugaugaugcucguagcaccaagcuacggaaugagauguguaggaguggguaaucgagacuucguagaaggaguaucaggaggggcuuggguggaccuuguguuggagcauggugguuguguaacaacaauggcgcaaggcaaaccuacccuggauuucgagcugacaaaaacuacagcaaaagaaguggcauuacuccgaacguacugcauagaggcguugauaucaaauauaacuaccgcaacaagauguccaacacaaggagagccuuauuuaaaagaagaacaagaucaacaauauauauguaggcgcgauguuguagauaggggaugggggaacggcuguggacuuuuuggcaaaggaggaguaguaacuugcgcaaaauucucaugcucaggcaaaauuacaggaaacuuaguucaaauugagaaccuugaauauacaguuguggugacaguacacaacggggauacccaugcuguggggaaugauacaucaaaucauggcguuaccgcuacgauaacuccacgaagucccagcguagaagucaaauuaccagauuacggugaacugacgcuugauugcgaaccaagauccgguauugauuucaacgaaaugauauuaaugaaaaugaaaaagaaaacuuggcuugugcauaaacagugguuccuugaccuaccguuaccuuggacagcaggagccgauacuuccgagguucacuggaauuacaaagaaagaaugguaacauuuaaagugccccacgcaaaaagacaagauguaacagugcuaggaucacaggaaggagcuaugcauucagcacuugccggagcgacugaaguagacaguggagacggaaaucauauguucgcagggcaccuaaaaugcaaagugagaauggaaaaacuccguauaaaagguaugaguuacacaauguguucgggaaaauuuucuauagacaaagaaauggcagaaacccagcacggaacuacagucguaaaagucaaauaugaaggugcaggcgcuccuugcaaagugccaauagaaauaagagaugucaauaaagaaaaagucgugggucggguaaucuccucaaccccacuugcagagaauacaaauucagugacaaauauagaacuagaacccccuuucggugauucuuauauagucaucggagucggaaauuccgcacuaacauuacauugguuuagaaaaggcucgagcauugggaaaauguucgaaucaacuuauaggggagcgaagcgaauggcgauuuuaggggagacagcaugggacuucggguccguaggagggcuuuucacaucacuggguaaggcuguacaccaaguauuuggaucuguauauacuacaauguucggagggguaaguuggaugauuaggauucuaauaggauucuuagucuuauggauaggcacaaauucuagaaacacuucaauggccaugacuugcauagcugucggugguauaaccuuauuucuaggauuuacaguccaagcagauaugggaugugugguaucauggucgggaagggaacugaaguguggaagcgguaucuucguaguggauaauguacacacauggacggaacaauacaaauuucagccugaaucuccagcaagacuggccucagcuauauuaaacgcgcacaaagauggagucugcggcaucagaucgaccacuagauuagaaaauguuauguggaagcagaucacgaacgaacugaacuauguucuuugggagggaggacaugauuuaacagugguagccggggauguuaaagggguauuaaccaagggaaaacgagcccucacgccaccagugucggauuuaaaauacucuuggaaaacgugggguaaggcaaagauauucaccccagaagcccguaauuccacuuuucuuauugacgggccugauacaagcgaguguccgaaugaacgccgagcuuggaauaguuuggaggucgaggacuauggcuuuggaauguuuacaaccaauauuuggaugaaauucagagaaggaucgucagagguuugugaccaucgccuaaugucugcagcaauuaaggaccaaaaggcuguccacgcugauaugggguacuggauagaauccagcaaaaaucaaacauggcaaauugaaagagcaucauuaauagaaguaaaaaccugcuuauggccgaagacacauacccuuugguccaauggaguauuagaaagucaaauguugauaccaaaauccuaugcaggccccuucagccagcauaauuaucgucaaggauaugcaacccaaaccgugggacccuggcauuuaggaaaacuugaaauagacuucggggaaugcccuggaacuacaguaacuauacaagaagauugcgaucaccgcggcccaucucuacguacuacuacggccucagguaaauugguuacgcaauggugcugcagaucgugcaccaugccaccacuacgauuccuuggcgaagacggcugcugguacgggauggaaauacgaccccucagugagaaagaagaaaacaugguaaagucgcaagugaccgcaggccaaggaacuucugaaacguuuagcaugggguuacuauguuuaaccuuauuugucgaggaaugucuuagaaggcgggucacgcgaaaacacaugauauuagcaguaguaaucacacugugcgcgauaauccuagggggacuaacguggauggacuuauugagggccuuaauaauguuaggagauacuaugucagggcgaauaggaggucaaacacaccuugcgauaauggccgucuucaagaugaguccugguuaugucuugggaguauuccucagaaaauuaacaucaagggaaaccgcucuaaugguuauugguauggcaaugaccacaacucuaaguauuccacaugaucuaauggaauuaauagaugguaucucuuugggguugauacuauugaaaauaguaacacaauucgacgauacucagguagguacauuagcacucagucuuacauuuauacguagcacuaugaguuuaguaauggcauggaggacaauaauggcaguauuauucgucgugacacuaaucccauugugcaggaccucaugucuucaaaaacaaucucacuggguggagauaacagcacucauucuaggugcacaggcucucccggucuaccuaaugacccucaugaaaggagcuucacgaagaagcuggccauugaaugaaggaauaauggcaguagguuuaguuucuuuauuagguucagcauuacucaaaaaugacgucccguuagcagguccuaugguugcuggagggcuguuauuagcagcguaugugaugaguggcuccagcgccgaucucucauuggagaaagcagcauccguacaaugggaugagauggcggauaucaccggcagcuccccuauaauagaaguuaaacaggaugaagacgggaguuuuuccauuagagauguugaagaaacaaauaugauaacacuucuugugaagcucgcacuuauaacaguaagcggacucuauccacuggcgauaccaguaacuaugacuuuaugguauauguggcaaguaaaaacacagagguccggagcacucugggaugucccaucuccugcagcuacacagaaggccgcacuaucugaagguguuuaccggauuaugcaaagaggucuauuuggaaaaacacagguugggguaggaauccauaucgaaggcguauuucauacaauguggcauguuacacguggaucuguuauuugccaugaaacgggucggcuugaaccgaguugggcugauguucgaaaugauaugauuaguuaugggggcggauggagguugggcgauaagugggauaaagaagaggauguucaaguauuagcaauugaaccaggcaaaaauccgaaacacgugcaaacuaaacccgggcuauuuaagacccuaacgggagaaauaggcgcugucaccuuagauuucaaaccagguacaaguggcucuccaauuauuaaucguaaagguaaaguaauaggauuguaugggaauggcgucgugacaaaaucaggggauuauguauccgcaauuacucaagcagagagaauaggugaaccagacuacgaagucgacgaagacauuuuuagaaagaaacgacuaacaauaauggaccugcauccaggagcgggcaaaacaaaacgaauacuaccaucaauugugagggaggcuuuaaaacgaagauugcggacccuuauacuagcuccuacacgaguaguagcugcggaaauggaagaagcacuucgaggcuuaccgauucguuaucaaacuccugcuguuaaaagugaacauaccggaagggagauuguagaccugaugugucaugcaacauuuacgacaaggcuacuaucauccacacguguaccaaauuauaaccuaaucguaauggacgaagcccauuuuacggauccaucguccguagcggcaagaggcuauauaucaacccggguggaaaugggcgaagcugcagcaauauucaugacugcuaccccuccaggugcuacagaucccuucccucagucaaauucaccuaucgaagauauugaacgcgaaauccccgaaagaaguuggaacacaggauuugacuggauaacagauuaccaggguaaaacuguuugguuugucccaucgauaaaagcaggcaacgauauagccaacugcuuaagaaaaagcggcaagaaagugauucagcuaaguagaaaaacuuuugacacugaguauccaaaaacaaaacucacugauugggacuuuguagucaccacggauauaagcgaaaugggggcgaauuuuagggcaggacgaguaauagacccucgcagaugucuaaaaccaguaauauuaacggauggacccgaaaggguaauauuagcuggaccaauaccaguaacacccgccucagccgcucagagacggggcaggauugggagaaacccagcacaagaagaugaucaauauguuuuuaguggugauccacuuaagaaugacgaagaucaugcacacuggacagaagcaaaaauguuguuagacaauaucuauacgccggagggcaucauaccuacucuauuuggaccggaaagagagaaaacccaggcaaucgacggagaguuuagguugcggggagaacaacguaaaacguuuguagaacuaaugagacgaggugaucuuccaguauggcucucguauaaaguggcgagcgcugggauaaguuacaaagaucgagaauggugcuuuaccggggaaaggaauaaccagauucuugaggaaaacauggagguagaaauuuggacacgcgagggugagaagaagaaauuaagaccacgaugguuagacgcgcgugucuacgcagaucccauggcuuuaaaggauuucaaagaauuugcuagcggacgaaaaucuauuacccuugacauucucacagaaauagcgagucuaccgacuuaccuuucuaguagagcgaaacuagcguuagauaacauuguuaugcuucauacaacagagcgugguggcagagcauaccagcaugccuugaacgaauuacccgaaucguuagagacucuaauguuaguugcauuguugggugccaugaccgcaggaauauuucuauucuuuaugcaaggaaaagguauugguaaacuuucaaugggacucaucacgauagcuguagcaucgggacugcucuggguugcggagauacaaccacaauggauagcugcuucaauuauacucgaauuuuuccuaaugguucugcugauuccugaaccugaaaaacagcguaccccucaagauaaucaauuaaucuauguaauauuaacaauuuuaacuaucaucggacuaauagcagcaaaugaaaugggucuaauagagaaaaccaagaccgacuucggcuuuuaccagguaaaaacagaaacaacaauacuagauguggaucuacgaccagcgagcgccuggacguuauacgcuguagcaacuaccauccuuaccccgauguuaaggcacacaaucgaaaauacgagcgcuaauuuaucucucgcagcgauagcaaaucaagccgcgguacugaugggucuggguaaaggguggccacuccacagaauggaccuugguguaccuuugcuagcaaugggaugcuacucccaaguaaaucccacaacacuuacagcuagccuagugauguuauugguucacuaugccaucauaggaccaggacuucaagcaaaggcaacuagagaggcccagaaaaggacggcagccgguauaaugaaaaauccgacaguagaugggauaacggucauagaucucgagccgauaaguuaugaccccaaauuugaaaagcaacuuggacaaguaaugcuacuuguauuaugugccgggcagcuauuauugaugagaaccacaugggcuuucugcgagguccugacguuagccacuggaccuauacucacacuuugggaaggaaacccaggaagauucuggaauaccacaauugcagucucaacugccaauaucuuucguggauccuaccuagcuggggcaggacucgcguucagucuaauaaagaaugcacagacaccuagacgagggacagguacuacaggggaaacacuaggagaaaaguggaaaagacaauuaaacagcuuagauaggaaagaauuugaagaauacaagcgaagcgggaucuuagaaguugaccguaccgaagcaaaaagugcucuuaaggacggaucaaaaauuaagcaugcaguuagucguggaucuucaaagauucgcuggauuguagaacgcggaaugguuaaaccaaaagguaaaguugucgacuuaggguguggccgaggaggguggagcuauuauauggcaacuuugaaaaaugucacggaggugaaaggauacacgaaagggggaccugggcacgaggaaccuauacccauggcaacauauggauggaauuuaguuaaauuacauucaggaguugauguguucuauaagccuauagagcaaguugacacccuuuuaugugauauaggagaaucaucaucaaacccaaccauagaagaaggucgcacuuugagaguauuaaagaugguugaaccaugguuaucaaguaagccggaauuuuguauuaaaguacuaaauccauacaugccaaccguaaucgaagaauuagagaaacuacaaagaaaacacggugguaauuuagugaggugcccuuugucuaggaauagcacucaugagauguauuggguuaguggagcgagcggcaacauugugagcucuguuaacacgacguccaagaugcuguuaaaucguuuuacaacacgccauagaaaaccuacauacgaaaaagacguagacuuaggugcaggaacgagaaguguaucaaccgaaaccgaaaaaccagauaugacgauuauuggacgaagguuacaaagacuucaggaagaacauaaagaaacauggcacuaugaucaagaaaauccauacagaacgugggcguaucaugguuccuaugaagcgccaaguaccgguagugcgagcaguaugguuaacgguguagugaaacucuuaaccaagccuugggauguuauaccuauggucacacaguuagccaugacggacacaacgccauucggucagcaacgaguuuucaaagaaaaaguagauacacgaacuccucagccaaaaccagggacgagaauggucaugacgacaacggcaaacugguuaugggcauuguugggcaagaagaaaaacccgcggcucuguacgcgagaggaauuuauauccaaagugagaucgaaugcugcuauaggggccgucuuucaagaagaacaaggcuggacaucugccucagaagcggucaacgacucaagauuuugggagcuagucgauaaagaaagggcauuacaccaagaagggaaaugugaaucguguguuuauaacaugaugggaaagagggagaagaaacucggagaauuuggccgugccaaagguucaagagcuauuugguauaugugguuaggggcgcgauuucuugaauuugaagcgcugggcuuuuuaaaugaagaccacugguuuggucgagaaaacaguuggucugggguugagggugaaggcuuacaccgacuuggcuauauacuagaagagauagacaagaaagacggagauuugauguaugcugacgauacagcaggaugggauacgcgaauaacggaggaugauuugcaaaaugaagaauugauuacggagcaaauggccccgcaucauaaaauacuagcuaaggcaaucuuuaaacugacguaucaaaacaaaguagucaaaguacuuagaccuacgccuagaggagcuguaauggauauaauaucuagaaaagaucagcgagguucgggacaagucgggacauacgggcuaaauacauuuacaaauauggaaguucaacuaauaagacaaauggaggcagagggcguaauuacacaggaugauaugcaaaauccgaaagguuuaaaagaaaggguggaaaagugguuaagagaauguggcguugauagauugaaacguauggcaauaaguggcgaugacuguguagugaaaccccuagacgaacgauucgguacaaguuuauuauucuuaaaugauauggguaaaguaagaaaagauauaccucagugggaaccaucgaaagguuggaaaaauuggcaagaaguacccuuuugcagccaucauuuccacaaaauauucaugaaggacggaagauccuuaguuguaccuuguagaaaccaggacgaauugaucggccgagcuagaaucagucaaggugccggcuggucguuacgugagacagccugccuagguaaagcauacgcgcagauguggagucuuauguauuuccaccgucgugaucuaagguuagcaucaauggccauuuguucggccguaccuacagaaugguuuccaacaucaagaacuacauggaguauccaugcucaccaucaauggaugacaacagaggauauguugaaaguguggaauagaguuuggauagaagacaaucccaauaugauugauaagaccccagugcauucuugggaggacaucccauauuuagggaaacgagaggauuuauggugcgguucgcucaucggacucucaucgagagccacgugggccaaaaauauacauacagcuauaacucaaguuagaaaucuuauuggaaaggaagaguaugucgauuacaugccgguaaugaaaagauauagcgccccaagcgagagugaaggaguacuauaa

SEQ ID NO: 23631 - RNA, 9867 nt, Artificial Sequence
  derived and/or modified CDS sequence (opt6) from DENV-4__FJ639738__SS-prME
ucgaccauuacacuuuuauguuuaauuccgacaguuauggcuuuucauuugaguacacgagauggugaaccauuaaugauuguugcgaaacacgaacgaggacggccacuuuuguucaaaacaacagaaggaauuaauaaaugcacccuuauagcuauggauuuaggagaaaugugcgaagauacugucacuuacaaauguccccugcugguaaauaccgaaccagaggacauugacugcugguguaauuuaacaucaacaugggugauguacggaaccugcacacagaguggcgaacgacgaagagagaaaagaucagucgcguuaaccccucauaguggaaugggccuagaaacgcgugcugaaaccuggaugucaucggagggagccuggaaacaugcccaacguguagaaaguuggauccuucggaauccaggauucgcacucuuagcgggauuuauggcauacaugaucggccagacggguauacaaaggacaguauucuuuguuuugaugauguuggucgcgccaaguuauggaaugagauguguaggaguugguaaucgggauuuugucgaaggaguuucaggcggggcuuggguagaucuagucuuagaacacgguggaugcguuacaacaauggcucaagggaaaccaacacuugacuucgaguuaacuaaaacaacugcaaaggaaguagcauuacuuagaacauacuguaucgaagcauugauuuccaauauaaccacagcgacaagauguccaacccagggagaaccuuaucuaaaagaggaacaagaucaacaauauauauguagaagagaugucguugauagaggcuggggaaacggguguggacuauucgguaaggguggggucgugacaugugcaaaauucucauguagcggcaaaauaacggggaaucuaguucagaucgagaaccuagaauacaccguggugguaacgguucauaacggcgauacacaugcgguugggaacgauacaagcaaucauggagucaccgcaacaaucacaccucgaucaccaagcguggaagugaaauuaccagauuacggggaacugacucuugauugcgaaccccgaucggguaucgacuuuaaugaaaugauacuaaugaaaaugaagaagaaaaccuggcuuguccacaaacagugguuucuagacuuaccgcuuccauggacagccggcgcggauacuucggaaguacacuggaauuacaaagaacgaaugguuacauucaaaguaccucacgcgaaaagacaagauguuacgguacugggaucucaagaaggagccaugcauagcgcacuagcaggggcaacagaagucgacaguggcgauggaaaccacauguucgcuggacaccuaaaauguaaagugagaauggaaaaacuaagaauaaaagguaugucuuacacuaugugcucagguaaauucucaaucgauaaagaaauggccgaaacacaacaugguacgacuguuguaaaaguuaaauaugagggugcaggggcuccuuguaaagucccgauagaaauaagagauguaaacaaagagaagguagucggccguguuauauccucaacuccguuagcagaaaauacuaauucuguaaccaacauagaguuagaaccaccauuuggcgacuccuacauugugauaggcguagguaauucugcauugaccuugcacugguuucgaaaagguaguucuaucggaaaaauguuugagucaacauacaggggugcuaagcguauggcuauacuaggagaaaccgccugggacuucggaaguguuggaggacuauuuacgucacuuggcaaggccguacaucaaguuuucgguagcguauacaccacaauguuugguggaguaucuuggaugauuaggauucugauaggauuucucgugcuauggauaggaaccaauucaagaaacacuucaauggccaugacuuguauagccguagggggaauaacacuauuucuaggcuucaccguucaagcugauauggguugcguaguaucguggagugguagggagcugaagugcggaucugguauuuuuguagucgauaauguucauacguggacagagcaguauaaauuucagccggaaucgccagcuagacuagcaagcgcuauacuaaacgcccauaaagacggaguuuguggaaucagaagcacaaccagauuagaaaacgugauguggaaacaaauaacuaaugagcuaaauuacgucuugugggaaggcggacaugacuuaacaguuguggcaggcgacgugaaggggguguuaacaaaagguaaacgagccuuaaccccaccgguaagcgacuuaaaauauaguuggaaaaccugggguaaagcgaaaauauuuacaccagaggcaagaaauucgacauuccuuauugaugggccugauaccagugaauguccaaacgagagacgagcauggaauaguuuagaaguagaagacuauggauucggaauguucacaacuaauauuuggaugaaguuucgugaaggcuccucagaagugugugaucaucgacucaugagugccgccaucaaggaucaaaaagcaguucaugcggauaugggcuacuggauugaauccuccaaaaaucaaacguggcaaauugagcgggccucauuaauagaaguaaaaaccugcuuauggccaaaaacucacacacuuuggucaaaugggguucucgagucucaaauguuaauccccaaauccuacgcaggaccauuuucacagcacaacuaucgccaaggauacgcaacgcagacaguaggacccuggcacuuggguaagcuagaaaucgacuuuggagaauguccaggaaccacagugacgauacaagaagacugugaccauagagggccaucccuaaggacaacgacagcuucaggaaaacuugugacacaaugguguugucgcucauguacaaugccgccguuacguuucuugggggaagacggauguugguaugguauggagauucgcccucuaagcgagaaggaagaaaacaugguaaaaagucaaguaacagcuggacaagggacaucagaaacguucagcaugggacuacucugcuuaacauuguucguugaagaaugccuaagaagaagagugacgcgaaagcacaugauacuagccguagugaucacuuuaugcgccaucauucucggaggacuaacauggauggaccuauuaagggcccucauuauguuaggcgacacuaugaguggcaggauagguggacaaacgcacuuggcaauuauggcaguuuucaaaaugaguccuggauacguccucgggguuuucuuacguagacuaacgucacgagaaaccgcucuaaugguaauagguauggcaaugacgacgacacuuucuauuccgcaugacuugauggaauuaauagaugggauaucauuagggcugauuuuacugaagauuguuacccaauuugauaauacacaaguagguacacucgcauuaucacuaaccuuuauucguaguacuaugagccuagucauggccuggagaacuauaauggcgguuuuguucguuguaacguugauaccauuaugucgcacuucuugccuucagaaacaaagccauuggguagagaucacagcuuuaauauuaggggcacaagcacuaccaguguauuuaaugacacugaugaaaggugccagccgaaggucauggccauuaaaugaaggcaucauggccguaggauugguuucacuucuuggcucugcauugcuuaagaaugaugugccccucgcuggaccaauggucgcaggaggccuacuuuuagcagcuuacgugaugucagguucuagugcagaccugucgcuugagaaagcagccaaugugcaaugggacgagauggcggacaucacaggcuccucgccuauaauagaagugaaacaagacgaagacggaucauucucaauacgugaugucgaagaaacuaacaugauuacauugcuagucaagcuggcacuuaucacaguuagcggacucuacccacuagccauaccgguaacuaugacacugugguauauguggcaaguaaaaacacaacgaucaggggcguugugggacguaccaaguccagcggcuacacagaaagccgcauugucagagggaguauacaggauuaugcaacguggacuuuucggaaaaacccagguugguguagggauucacauggagggaguuuuccauaccauguggcaugucacuagggggagugugaucugucacgaaacaggucgauuggagccuucaugggcugauguucgaaacgacaugauaucguacggugguggguggcgguuaggugauaagugggacaaagaagaggacguacaagugcuggcaguagaaccagguaaaaauccaaaacacguucagacgaaaccugggcucuuuaagacaauaacaggagaaaucggugcugugacuuuagauuuuaaaccagguacaagugguucaccgauaauuaacaggaaagggaaagugauugguuuauaugguaacggaguaguaacaaaaucaggagauuacguaucagcaauuacacaagcagaacgcauuggggagccugauuaugaaguagacgaggacaucuuuaggaagaaaagauugaccauuauggacuuacauccuggcgcuggcaaaacuaagagaauccugccaucgauaguaagagaagcauugaagagaagacuacggacacuaauucuagccccaacacgcguugucgcugccgaaauggaagaggcacuucguggauugccaauacgcuaccaaacucccgcuguuaaaucagaacacacuggucgagaaauaguugacuuaaugugucaugcgacauuuacaaccagacuacuuucuucuacaagggucccuaauuacaaucugauaguaauggacgaagcacacuuuacagauccuaguucaguugcagcaagaggcuauauauccacgcgaguagaaaugggcgaagcugcugcgauauuuaugacagcgaccccgccaggugcaacugauccauuuccccagaguaacagcccaauagaagacauugaaagagaaauacccgagaggaguuggaauacagguuucgacuggauaacugacuaucaaggaaaaacaguuugguuuguaccauccauaaaagcagguaacgacauugccaauugucugcgcaaaucuggcaagaaagugauacaguugucacgaaaaaccuuugacacggaauaccccaaaacaaaauuaaccgacugggauuuuguuguaaccacugauauuucagaaaugggagcaaauuuucgcgcuggucgaguaaucgauccgagaagaugccuaaaaccagugauauugacagacggcccggagagggucauccuggcggguccaauuccagucaccccggccagugcugcgcaacgaagaggccguauaggacgaaacccugcacaagaggaugaucaauacgucuucaguggggauccccucaaaaaugaugaagaucaugcgcauuggacugaagcaaaaaugcuucuggauaacaucuacacgccggaagguauuauaccuacauuauucggcccggagcgcgaaaagacucaagcaauagacggcgaauuucgucuccgaggagaacaacgcaagaccuuuguggaauuaaugaggagaggagaccucccaguguggcucaguuacaaggucgcaagugccggaauaaguuacaaagauagagaaugguguuucacgggggagagaaauaaccaaauauuggaagaaaauauggaaguugaaauauggacacgagaaggagagaaaaagaaacuucgaccuagaugguuagaugcgcgcguauaugcggauccuauggcacugaaagauuucaaagaauuugccuccgguagaaaaucaauuacgcuugauaucuuaaccgaaauagcauccuugccaaccuauuuaaguucaagagcaaaacuagcuuuagauaacaucguuaugcuacauacaacugagcgagguggcagggccuaccaacaugcacuaaaugaauuacccgaaagucucgagacuuuaauguuaguggcccucuuaggcgcuaugacugcggguauuuuccuuuucuucaugcaaggaaaaggaauaggcaaauuaaguaugggauuaaucacaaucgcgguugcuucuggacuccuuuggguggcagaaauacagccgcaauggauugcagcuaguauuaucuuagaguuuuucuugauggugcuacucaucccagagccagaaaaacaaagaacaccccaggauaaucaacuuaucuacguaauuuuaacgaucuuaacaauaauaggauugauagcugcaaacgaaaugggacuuauugagaaaacgaaaaccgauuucggauuuuaccaggugaaaacugaaacaacgauauuagacguagacuuaagaccggccuccgcauggacacuauacgcuguggcuaccacaauucuuacaccaauguugaggcacacgauagaaaacacgagugccaacuuaucccuugccgcaauagcuaaucaagcagcuguacugauggguuugggaaaaggcuggccucuacaucggauggaccuaggcgugccucuuuuagcgauggguugcuauucacaaguuaacccuacuacuuuaacugcgagccugguuaugcuucuaguacauuacgcuauaauaggaccaggacuccaagcgaaagcaacuagagaagcacagaaaagaaccgcagcagguauaaugaagaauccuacuguagaugguauaacggugauugacuuagaaccuauuuccuacgacccaaaauucgaaaaacaacuagggcaagugaugcuucuuguucucugugcaggccaacuucuauuaaugagaaccacaugggcguuuugugaaguccuuacgcuagccacuggaccaauacugacacuaugggaagguaauccagguagauuuuggaacacaaccauagcugucuccacugccaacaucuuuaggggaagcuauuuagcuggagcuggccucgccuuuaguuuaaucaaaaacgcucaaacaccaaggagggggacuggaaccacaggagaaacccuaggagaaaaauggaagcgacaauuaaacagucucgaucggaaagaauuugaagaauacaaacguagcgguauccucgagguagacaggacugaagccaagagcgcauuaaaagauggcuccaaaauaaaacaugcaguuucaagagguucaucaaagauacgauggauuguagaaagagggaugguaaagccgaaaggaaaagugguagacuugggauguggcagagggggauggucuuauuauauggcaacucuaaagaacguaaccgaagugaaaggauacacgaaaggaggaccuggucaugaagaacccauuccgauggcuacauacggcuggaacuuaguaaaauuacacagcgggguugauguauuuuacaaaccaacagaacaaguagacacacucuuaugugacauaggagaaaguucaucuaaucccacaauagaagagggaaggacgcugcguguacuaaaaauggucgaaccuuggcuaagcuccaaaccggaguuuuguauuaaagugcuuaacccauacaugccgacgguaauagaagaguuagagaaguuacagaggaagcacgggggcaacuuaguucguuguccgcuaucacgcaauagcacucaugaaauguauuggguaaguggagcgucagggaauauagugaguagugucaacacaacaaguaaaaugcuauugaaucguuuuaccaccagacauagaaaacccaccuacgaaaaggacguugaucucggggcgggcacuagguccguguccacagagaccgagaagccugacaugacaauaauaggaagaaggcugcagcgucuccaggaagaacauaaagaaacauggcacuaugaccaggaaaauccuuauaggacaugggcguaucauggauccuacgaagcaccuucaacuggcagcgcaucaucaaugguaaauggagucguaaaacugcuuaccaaaccgugggacguaauaccaauggugacgcaacucgcuaugaccgauacuacuccuuuuggucagcagaggguguucaaagaaaaaguugacacuagaacuccacaaccuaaaccaggaacaagaauggugaugacaacuacagcaaauugguuaugggcacuauuaggcaaaaagaaaaauccgagauuaugcacaagagaagaauuuauaucuaagguaagaucuaaugcugcuauuggugcagucuuucaagaggagcaagguuggaccagugccagugaagcggugaaugacaguagguuuugggagcucguagacaaagaacgagcucuacaucaagaagggaaaugugaaucuuguguauacaauaugauggguaaaagagagaagaaauuaggagaauuuggcagagcaaaagggagcagagcaauaugguauauguggcuuggggcaagguuccuugaauuugaggcauuaggauuuuuaaaugaggaucacugguuuggacgugaaaacagcuggaguggcguggaaggugaaggucuucacagauuggguuacauucuagaagaaauagauaagaaagauggagacuugauguaugcagacgauacugcugggugggacacaagaauaacugaagaugaccuacaaaaugaggaacuuauaacggaacaaauggcuccacaucauaaaauucucgccaaagcaauauuuaagcuaacauaccaaaacaaagugguaaagguguuacgaccgacuccaagaggugcaguaauggacauuaucucuagaaaggaucagagaggaagugggcaaguaggcaccuauggacuaaauacguuuaccaauauggaaguccaauuaauuagacaaauggaggcagaagguguaauaacgcaagaugauaugcaaaacccuaaaggauuaaaggagagaguagagaaauggcuacgugagugcgguguagacaggcuaaaacgaauggccauuucuggggacgauuguguuguaaaaccacucgacgaaagauucgggacgucuuugcucuuuuuaaacgauaugggaaaaguucggaaggauauuccacaaugggaaccuucaaaaggauggaaaaauuggcaagaaguaccuuuuuguucacaucacuuccauaaaauuuuuaugaaagaugggcguucacugguuguacccugccgaaaccaagaugagcuuauagguagagcuaggauaagccaaggcgcaggauggucuuuacgagaaaccgcuugucuaggaaaagcauaugcccaaauguggagucucauguauuuucaucgacgugaccucagacuagcaaguauggcgauauguagcgcuguuccgacugaaugguucccaacuucuagaacgacuuggaguauucacgcacaucaucaguggaugaccacagaggauauguuaaaaguauggaauagaguauggauugaggauaaucccaauaugauugauaaaacaccaguucacucgugggaagacauucccuauuuagguaaaagagaagaccuauggugcggcagcuuaauuggauuguccucucgagcgacaugggcgaaaaauauccauacagcuauuacucaaguacguaaucuaauuggcaaagaagaguacguggacuacaugccaguaaugaaaagauauucggcaccaucugagagugaggggguauuauaa

SEQ ID NO: 23632 - RNA, 9867 nt, Artificial Sequence
  derived and/or modified CDS sequence (opt6) from DENV-4__FJ639739__SS-prME
ucgacgaugacucuacugugucuuauccccacagcaauggcauuccacuuaucuaccagagauggugaaccucugaugaucguagcgaaacaugaaagaggaaggccacucuuauuuaaaacuacugaagguauaaauaaauguacgcugauagcuauggauuuaggagaaaugugcgaagauacgguuaccuacaaauguccacuucugguuaacacugaaccagaagacaucgauugcuggugcaaucuaacguccaccugggucauguaugggacguguacucaaucaggggaaagaagacgagagaaaagaaguguggcacuaacaccucauagcggaaugggauuagaaacgcgagccgaaaccuggaugucuucugaaggcgcauggaaacacgcgcaacguguugaaagcuggaucuuacggaacccuggguuugcauuacuagcuggguuuauggccuauaugauaggacaaacaggaauccagcguacggucuucuuuguauugaugaugcucguggcgccuaguuaugggaugcgcugcgucggaguuggaaauagagacuuugucgaaggaguauccgguggagcauggguagaccuaguacuagaacacggcggcuguguuacuacaauggcacaaggaaaaccaacacuugacuuugaacuaacgaaaacgaccgcaaaagaaguagcgcuauugaggacauauuguaucgaagcccucauaucaaauaucacaacugcaacccgaugcccuacacaaggugaaccuuaccuaaaagaagaacaagaucaacaguauauuugcagacgcgacgucguugauagaggcugggguaacgguuguggacuauuuggaaaagggggaguagucacaugcgcaaaauuuaguugcagcggaaaaauaacagguaauuuaguccaaaucgaaaaccuagaauauacgguaguugugacgguucacaauggcgauacacaugcagugggcaacgauacaaguaaucauggaguaacagccacgaucacaccacggucaccaucuguagagguaaaacuaccugacuauggugaacuaacucuagacugugaaccaaggucaggaaucgacuuuaaugagaugauauuaaugaaaaugaagaagaaaacuuggcuuguacacaaacaaugguucuuggaucugccacugccguggacggccggggcagauacaagcgaggugcauuggaacuauaaagaaagaaugguuacguucaaaguaccgcaugcaaaacgacaagacgucaccguacugggaagucaagaaggagcuaugcacucggcguuagcaggggcuaccgagguagacucaggggauggcaaccauauguucgcaggucauuuaaaauguaaaguuagaauggaaaaacuaagaaucaaaggaaugucuuauaccaugugcucggguaaguucuccauagauaaagaaauggcagaaacacagcacggaacaaccguaguuaaaguaaaguacgagggagcgggcgccccgugcaaaguuccaaucgaaauaagggaugugaacaaggaaaaagugguuggaaggguuauaaguaguacaccacuugcagagaauacaaauagcgucacaaacaucgaacuagaaccucccuuuggggauagcuauauagugauuggugucgguaacucagcucuuacguuacauugguuuaggaagggauccaguauuggaaaaauguucgaaucaacuuacagaggugcaaagcguauggcaauucugggagaaacagcaugggacuuugguagcguagggggucuauucacuucgcucgguaaagcgguucaucagguauucgggagcgucuacacaacgauguucgggggagugagcuggaugauacguauauugauaggauuuuuaguguuauggauaggaacaaauucuagaaacacaucuauggcaaugacuuguaucgcuguagguggcauuacgcuauuuuugggguuuacaguucaagcugauauggguuguguagucucauggaguggacgugaauuaaaaugcggcucgggcaucuucguagucgacaauguucauacguggaccgagcaauacaaauuucagccugaaucacccgccagauuagccuccgcgaucuuaaaugcucauaaagauggaguaugcggcauccgaucuacgacaaggcuggagaacguaauguggaaacagauuacaaacgaacuaaacuauguuuuaugggaaggugggcaugaucuaaccguuguagcuggcgacguaaaaggaguguugacuaaagguaagagagccuuaaccccaccgguaucagaucuaaaauauucguggaagacauggggaaaagcaaaaauauuuacaccugaggcucgcaauucaacauuccuaaucgacgguccugauaccagcgaaugcccgaaugaaaggagagcguggaacucauuagaaguagaagauuacggauuugguauguuuacaacaaacauauggaugaaauuuagagaggguucuuccgaagugugugaccauaggcuuaugagugcugccaucaaagaucaaaaggccguacacgcagacaugggguauuggauugaaaguucgaaaaaucaaacauggcaaaucgagagggcuucauuaauagagguaaagacauguuuauggccgaaaacccacacacuuuggucgaacggugugcuugaaagccagaugcugauuccgaaaucauacgcggggcccuucucucaacauaacuaccgacaaggcuacgcuacucaaacgguaggcccuuggcaucuaggcaaacuagagauugauuucggagaaugcccagguacaaccguaacuauacaagaagauugugaucauagagggcccuccuuaagaacaacgaccgcgagugggaaacuggugacccaaugguguugcagaaguuguacaaugccuccucucagauuucuaggugaagacggauguugguaugguauggaaauaaggccccuaagugaaaaagaagaaaacauggugaaaagucagguuacagcaggacaagggacaucugagacuuuuuccaugggccuuuuaugucuuacgcuuuuugucgaggagugcuugcgaagaaggguaacgagaaaacauaugauacuugcuguugucauuacccuaugugcaauaauacuaggcggucuaaccuggauggacuugcugagagcacucauuauguuaggagacacuaugucuggaagaauuggcggacaaacacauuuagcuauaauggcuguauuuaaaaugagcccagguuaugugcuuggaguauuucuuagaaaauuaacaagccgcgagacggcauugaugguaauugggauggcgaugaccacuacacucucaaucccccaugauuuaauggaacucauugaugggauaucacugggcuugaucuuacuuaaaauaguaacacaguuugauaauacacaagucggcacucuagcacucaguuuaacauuuauaagaucaacuaugucacuuguuauggcauggcguacuauaauggcugucuuauuuguuguaacucuuauaccucuuugccggaccucaugccuacaaaaacaaagucauuggguugagauaaccgcacuaauacuuggcgcucaggccuuaccaguuuaucugaugacacuuaugaaaggagcgucacggagaagcuggccuuugaacgagggcauaauggcuguuggccuagugagccucuuaggaucagcuuuacugaagaacgaugucccucuugcaggaccuaugguggcaggaggacuacuucuagcugcauacgucaugucuggaucaagcgcggaucucucucucgaaaaggcagcuaacgugcagugggacgaaauggccgauaucacaggaucuuccccgauaauagaggucaagcaggacgaagacgggagcuuuucaauccgggauguggaggagacgaauaugauaacguuauuagugaaacucgcauugaucaccguaucaggacuauauccguuggcuauaccggugacaaugacauuaugguacauguggcaaguaaaaacucaacgcagcggggcacuuugggauguacccaguccggcagccacucagaaagcagcuuuaucugaaggaguguaucgcauaaugcagaggggacuauuuggcaaaacgcaaguuggagugggcauucauauggaaggugucuuucacacuauguggcacguaacuagagggaguguaauuugccaugaaacgggucgucucgaaccuucgugggcugacguuagaaacgacaugauaagcuauggaggaggauggagacuaggggauaaaugggauaaggaagaagauguacaaguauuagcaaucgagccgggcaaaaauccuaaacauguccaaacuaaaccaggauuauuuaaaacacuugccggugaaaucggagcugugacacuugacuucaagccuggcacaucgggaaguccgauaauaaaucguaaggguaaagugauaggacuauacgguaauggugucguaacuaaaucaggugacuauguuagugcaauaacgcaagcugagcguaucggcgagccggacuaugaggucgaugaggacauauuuagaaagaagagauuaacaauaauggaucuacauccgggugcugggaaaacaaagcgcauccuaccaaguaucguaagagaggcuuuaaaaaggcgguugcgaacucucauccuugcuccaacucgaguuguagcagcagaaauggaagaggcauuaagaggguugccaauaagauaucaaacgcccgcaguaaaaucugaacauacgggcagagaaauuguggaccuaaugugccaugcaacuuucaccacaagauuacuaaguucaacgcgagugccuaauuacaauuuaaucguaauggaugaagcucauuuuacggacccgaguucaguagcggcacgcggauacauuucaacgagaguagaaaugggugaagcggcagcaauuuucaugacggcaacuccacccggagcaacagacccuuuuccacaaucuaauaguccgaucgaagauauugaacgagagauccccgaaagaucuuggaauacgggauuugauuggauaacugauuaucaaggaaagacagucugguucguuccuucaauaaaagcaggcaaugacauagcaaauugcuuacgaaaaagcgguaagaaaguaauacaauuaaguagaaaaacauucgacacugaauauccaaaaacaaaauugacugacugggauuuuguaguaacaacugacauuucggaaaugggggcaaauuuucgggcuggaagaguaauagacccucgaagguguuuaaaaccggucaucuuaaccgacgguccggaacgaguaauuuuagccggacccaucccaguuaccccagcaucugcugcucaacgucgcggacguauugguaggaauccagcucaggaagacgaccaauauguauuuaguggggacccacuaaagaacgaugaagaucaugcucacuggacagaagccaaaaugcuauuggauaauaucuauacuccagaagggaucauuccaacauuguuugguccagaacgugagaaaacucaagccauagauggagaauuucgacuacguggcgaacaaaggaaaacuuucgucgaauugaugagacguggcgauuugcccguaugguuaaguuauaaaguggcaagcgccgggauuucuuacaaggaucgugaaugguguuucacaggggagagaaacaaucaaauauuagaggaaaauauggaaguagaaauuuggacacgugaaggggagaaaaagaaauuaaggccaagguggcucgaugccagaguauaugcagauccgauggcacuaaaagacuuuaaggaauuugcaucuggaagaaaaucaauuacguuagacauauuaacagagaucgcaucguuaccgaccuauuuaagcagucgagcaaaauuagcauuagauaauauuguaaugcuacauacaaccgaaagaggcggccgugcuuaucaacaugcauugaaugaguuaccagagucauuagaaacuuuaaugcugguugcguuauuaggagccaugacagcuggaauuuucuuguucuucaugcaaggcaaaggcaucggcaaacuuuccauggggcuuauaacuauagcgguugcgucaggucuuuuauggguagcagaaauccaaccucaauggauugcugcaucaauaauacuagaauuuuuccuaaugguacuucuuauccccgaaccagaaaagcaaagaacuccacaagauaaucaacuaauauauguaauccuaacaauccuaacaauuauugguuuaauagccgcaaaugaaaugggcuuaauagagaaaacuaagacagauuucggguuuuaucaaguaaagacagaaacuacuauccuggaugucgaucuccggccagccagcgccuggacauuguaugcaguagcaaccacaauauuaacacccauguuacgacauacuauagaaaauacaucggcaaaucuuaguuuagcugccauugcuaaucaggccgcaguauugaugggucuagguaaaggauggccucuccaccgaauggacuugggugugccucuacucgcuauggguuguuauagccaaguuaauccaacaacucuaacagcuucauuagugaugcuguugguacacuaugcuauaaucggaccaggucuucaagcgaaagcaacuagagaggcucagaaaaggacagcagcuggcaucaugaaaaacccgacuguagaugguauaacgguaauugauuuggaaccaauaagcuaugauccuaaauucgaaaaacaauuaggucaagucaugcuacugguacuaugugcaggccaacugcugcucaugcguacaacuugggccuuuugcgagguacucacauuggcuacagguccaauucuaacacuaugggaagguaacccuggcagauucuggaauacaacuauugccgucaguacagcaaacaucuuuagagggagcuauuuagcuggggcuggacuagcuuucagccugauuaaaaaugcacagacgccaagaaggggcacagguacaacgggcgagacauugggugaaaaauggaagcgacaacuuaauagcuuagacagaaaggaauuugaagaauauaagagaucagggaucuuagaaguugaucguaccgaagcuaaaucggcacugaaagauggaucaaaaauaaaacacgcaguuucaagaggguccucgaaaauuagguggauuguugaacgagguaugguaaagccaaaaggaaagauaguugaccucgguuguggaagaggagguuggucuuacuauauggcaacacuuaaaaacguaacggagguaaaaggcuacacaaaagguggaccugggcaugaggagccaauuccgauggcaacauacggguggaacuuggucaagcuacauuccggaguugauguguucuauaagccgacagagcagguugauacccuauuaugugauauaggggaaaguucaaguaauccgacaauugaagaagguagaacguuaaggguauuaaaaaugguugaaccauggcuuaguucuaaacccgaauuuugcauuaagguuuugaaccccuacaugccaacugucauagaagaacucgaaaaauugcaaagaaaacacggaggaaauuuagugagauguccccuaucaagaaauucuacacacgaaauguauuggguuaguggagcgagcgguaauauuguaucaaguguuaacacaacuucaaaaaugcuucuuaaucgauuuacaacacgacaucgaaaacccacauaugaaaaggacgucgaucuuggagcagguacaagaagcguaaguacugaaacggagaaaccagauaugacgaucauaggcagacgauuacagagauuacaagaagaacauaaagaaacuuggcacuaugaucaagaaaaccccuauagaaccugggccuaucacggcucuuacgaagcaccuagcacuggcucagcaucuucaaugguuaaugggguggucaaauuacuuacaaagccaugggacguuauaccuaugguaacucaauuggcuaugaccgacaccacgccauucggacaacaaagaguuuucaaggaaaaaguugauacacgaacgccucaaccgaaaccaggcacacguauggugaugacaacuacagcuaacuggcucugggcauugcuaggaaagaagaaaaacccacgacuaugcacgagagaagaguucaucucuaaaguaagaucgaaugcagcaauaggggcaguguuccaggaagaacaaggcuggacgagugcgagugaagcuguaaaugauucccguuucugggagcuaguugacaaagaacgagcuuugcaucaagaggggaaaugcgaaagcugcguauauaauaugaugggcaaaagagagaagaaacuaggagaauuugggcgugcaaaaggaucaagagcaauaugguauauguggcuaggugcaagguuuuuagaauuugaagcucucggauucuugaaugaagaucauugguucggcagagaaaacucgugguccggggucgaaggggaaggucuccacagacuaggcuacauacuagaagagaucgauaagaaagacggagaucuaauguaugcugaugauacggcagguugggauacaagaauuacggaggacgauuugcaaaacgaagaauugaucacagagcagauggccccucaucauaaaauauuggcaaaagcaauuuuuaaauuaacauaucaaaacaagguuguuaagguacucaggccaacuccucgaggagcugugauggacaucaucucucgcaaggaucagagggggucuggucaagucgguaccuauggacuaaauacuuucacuaauauggaagugcaacuuauaaggcaaauggaagcagaaggcgugauaacacaggaugauaugcaaaacccaaagggguuaaaagaacgaguagaaaaaugguuaagggaaugcggaguugauagacuaaagcggauggccauuucaggagacgauugcguugugaaaccucucgacgaacguuuuggcacuucacucuuauuucuaaaugacaugggaaaggugcggaaagauauuccacagugggaaccgucaaagggauggaaaaacuggcaggaagugccguuuuguucacaccauuuccauaaaauuuucaugaaagauggaagaucgcuaguaguccccuguagaaaccaagaugaacuaauuggcagggcacgcauaucacaaggggcaggauggucgcuacgugagacggccugcuuggggaaggcuuacgcgcaaauguggagucuaauguauuuccaucgcagggaucuacgauuagcaaguauggcaauaugcagcgcaguaccgacagagugguuaccaacaagucguacaacuuggaguauacaugcacaccaccaauggaugacaacagaggacaugcuaaaagucuggaaucgcguguggaucgaagauaauccaaauaugaucgacaagacacccguacauaguugggaagauauaccauaccuaggcaagagggaggaucuuuggugugguagccucauaggacucaguuccagagcuacaugggcuaaaaauauucauacugcaaucacacaggucagaaacuuaauagguaaagaagaauacguagauuacaugccaguaaugaaaagauacucugcuccguccgaaagcgaggggguuuuguga

SEQ ID NO: 23633 - RNA, 9867 nt, Artificial Sequence
  derived and/or modified CDS sequence (opt6) from DENV-4__JN819409__SS-prME
uccacaauuacguuauuaugucugaucccuacaguaauggcguuccaccuuucaacgcgugauggagaaccacugaugauaguagcgaaacacgaacggggaagaccgcuauuauucaaaacaacugaaggaauuaauaaaugcacgcuaaucgcaauggauuuaggagaaaugugugaagauaccgucacauauaaauguccacuucuugucaauacagaacccgaggauauugacugcugguguaaccuuacugcuaccugggucauguaugggaccuguacucaguccggagaacgaaggcgagagaaaagaucugucgcauuaacuccacauagcgguaugggucuggaaacaagagcggagacauggauguccagcgagggagcauggaaacacgcucaaagaguagaaucuuggauacugaggaaucccggguuugcacuauuagcggguuuuauggcuuauaugauaggucaaaccggcauucaacguacgguguuuuucguucuaaugaugcugguagcuccauccuaugggaugcguuguguagguguuggaaauagagacuuuguugaagguguuuccgggggagcaugggucgaucucguauuagaacauggcgguugcgugaccacaauggcucaaggaaaaccaacacucgacuuugaauugacaaaaacaacugcuaaagaaguagcauugcuucgcacuuauugcauagaggcccuaauuagcaacauaacaacagcaacuagauguccaacacaaggggaacccuacuuaaaggaagaacaagaccagcaauacauuugccgcagagaugucguugaucgagguuggggcaacggauguggacuuuucggaaaaggaggaguugugacaugcgcaaaauuuucauguucaggaaagauaacagggaaccugguucaaauagaaaauuuagaguacaccguuguaguaaccguacauaauggagauacacacgcgguaggaaaugacacuucuaaccacgguguaacagcaacuauuacgccucgaucuccaucagucgaagugaaacuuccugacuauggugagcugacacuagauugugaacccagaucagggauagauuuuaacgaaaugauacucaugaagaugaagaagaaaacuuggcuaguccacaaacaaugguuucucgauuugccacuaccuuggacggcuggugccgacacuucggaaguacauuggaacuauaaagaacgaaugguuacauuuaaggucccgcaugccaaaagacaagacgucaccgugcuaggaagucaagaaggggccaugcauagugccuuagcuggagcaacugagguagacaguggagacgguaaucauauguuugcaggacauuuaaaauguaaaguuagaauggaaaaacuccguaucaaggguaugagcuauaccaugugcaguggaaaauucucuauagacaaagagauggcagagacucagcauggaacuacuguuguuaagguaaaauaugaaggcgccggggcgccuuguaaaguuccuauugaaauccgcgacguaaacaaagaaaaaguuguagguagagucauaucaaguacuccauuggcagaaaauacaaaugguguaacuaacaucgaauuggaaccaccguucggugauagcuacauuguaauagggguuggaaacagugcuuugacacugcacugguuccggaaagguaguucaauaggcaaaauguuugaaaguaccuauagaggagcaaaaaggauggccauauuaggagaaaccgcaugggauuucgguagcguagguggguuguucacaaguuuagggaaagcaguucaucaaguauuugggucaguauacacaacuauguucgguggugucagcuggaugauuagaauccuuauaggauuucuaguccuauggauaggaacuaauucacguaacacaucaauggcuaugacauguauugcagugggaggcauaacccuauuuuuaggauuuaccguacaagccgacaugggcuguguaguuucuuggucggggagggaacuuaaaugcggaagcgggauauucgucgucgauaauguacauacguggacugagcaguauaaauuucaaccugagagccccgccagacuagcuucugcuauacugaaugcacacaaagauggcgucugcgggauacguucuacuacaagacucgagaaugucauguggaagcaaaucacaaaugaacuaaacuacguacugugggaagggggucaugauuugacaguuguagcaggcgauguaaaaggaguuuuaacaaaagggaaaagagcacugacaccucccguuagcgaccuaaaauauucauggaaaacuugggggaaagccaaaauauuuacgccagaggcuagaaauaguaccuucuuaaucgauggacccgauacaucugaguguccuaaugagagacgagcguggaacucauuagaaguggaagauuacggauucggaauguucaccacaaauauauggaugaaauuccgggaaggaagcagcgaaguaugugaccacagacugaugagugcggcuauuaaagaccaaaaagcagugcaugccgauaugggauauuggaucgaaucaaguaaaaaccagacauggcaaauugaaagggccagcuugaucgaagugaaaacguguuuauggccuaaaacacacacauuguggagcaacggaguacuugagagccaaaugcucauuccuaaaaguuaugcagguccauucucacaacauaacuauagacaaggguacgcuacacaaacaguugguccuuggcaccuaggaaaacuugaaaucgacuuuggcgaguguccggguacuaccgucacaauacaagaagacugcgaccauagaggaccgucacuaagaacaacgacagcaagcgggaaauugguaacucaguggugcugcagaaguuguacgaugccaccgcuacgauuucuuggcgaggacgggugcugguaugggauggaaauucgcccuuuaucagaaaaggaagagaauaugguaaagucacaaguuacugcaggacaaggaacgagugagaccuuuaguauggguuuauugugucuaacccuuuuugucgaggaaugccugcgacgucgaguaacccgaaaacauaugaucuuggcugugauuauaacuuugugugccauaauacuagguggguuaacguggauggacuuauuaagggcccuuauuauguuaggugauacaaugucaggucggauagguggacaaacacaccuggcaauaauggcaguauuuaagaugucaccgggauacguucucggugucuuucuaagaaaauuaacuucaagggaaacagcauuaaugguaaucggaauggccaugacaacuacacucaguauaccccaugaccuaauggagcugaucgaugggauauccuuaggacuaauuuuacuaaaaauagugacucaguucgacaauacacaaguugggacacuugcauuaaguuugacuuucauaaggucaaccaugucauuaguaauggcauggagaaccauaauggcaguuuuguuuguagugacucuuauaccauuaugcagaacgagcugccuacaaaaacagucgcauuggguugagauaacagcauugauuuuaggagcucaagcacuuccagucuauuuaaugacauugaugaaaggggcaaguaggagaagcuggccucuaaacgaaggaauaauggcaguaggauuaguuucgcuauuggggucggccuuauugaaaaaugacguuccucuugcagggccaauggucgcaggcgggcuauugcuugcugcuuaugucaugucaggcuccucugcugauuuaagucuugagaaggcugcuaauguucaaugggaugaaauggcagauauuaccgggaguucaccgaucauagaaguaaaacaagacgaagacgggagcuuuucaauaagagauguagaagaaacaaauaugauaaccuuguuaguaaaauuggcgcuaauaacaguaagugguuuauauccgcucgcaauuccugugacgaugacucuaugguauauguggcaaguaaaaacacaaagaaguggcgcucugugggauguuccaagcccugcugcaacccaaaaggccgccuuaagugaaggaguauauagaaucaugcagcgaggucuguucgguaaaacucaaguaggaguagggauacauauggaaggaguauuucauacgauguggcacguaacgcgggguaguguaauaugucaugaaacgggcagacuagagccaaguugggcagauguuagaaacgauaugaucucauacggaggagguuggagauugggagacaagugggauaaggaagaggacguucagguauuagcuauugaaccgggaaagaacccgaagcacguacagacuaagccuggguuauuuaaaacacugacuggugagauuggggcugucacauuagauuuuaagccaggcacaaguggcagcccgauuauuaaucguaaagguaaagucaucggacucuacgguaacggaguaguaacaaaaucuggcgauuacguaucagccauuacccaagcagaaagaauaggcgaaccagauuaugaaguugaugaagauauauuccgcaagaaaagauuaaccauaauggaucuucacccaggagcuggaaaaacaaaacguauccugccaagcaucgugagagaagcucuaaagcgaagauuaagaacucuaauucuggcacccaccagagugguugcagccgaaauggaagaagcgcuuagaggccugcccaucagguaccagacuccggcaguuaaaagugaacacacugggagagagauuguggaucuaaugugucacgcaacguuuacuacaagauugcugaguaguacacggguaccaaacuacaacuuaaucguaauggaugaggcgcauuucacugauccaagcuccgucgcagcccgcgguuacauaucaacaaggguagaaaugggagaagcggcugcuauuuucaugacagcaacaccacccggagcgacugacccauuuccacaaagcaauucaccuauugaagacauagagagagaaauuccugaacgcucauggaauacagguuuugauuggauaacugauuaccagggaaaaacugucugguuuguaccuucuauaaaagcaggaaaugacauagccaauuguuugagaaaaucaggcaagaaaguaauccaacuuucuagaaagacguuugacacugaauaucccaagaccaagcuaacagacugggauuuugucguaacaacagauaucagugaaaugggugccaauuuucgugccggaagaguuauagauccaaggcgauguuugaaaccaguuauuuuaacagacggaccagaaagaguaauuuuagcaggucccauaccaguaacuccugcauccgcagcucaacgaagggggaggaucgguaggaauccugcgcaagaagacgaccaauauguauuuucaggcgacccauuaaagaaugaugaagaucacgcccauuggacagaggccaagauguuacuugacaauauauacacccccgaaggaaucauaccgacccuauuuggaccagaacgagagaaaacgcaagcuauagauggggaguuccgccuccgaggcgaacaaagaaaaacuuuuguugaauuaaugcggagaggugaucuuccggucugguuaagcuacaaaguugccagugcuggaauuucauauaaagauagggaaugguguuucacaggagagcgaaauaaucaaauuuuagaagaaaacauggaggucgaaauuuggacccgcgagggggagaagaagaaauugcgcccucguugguuggaugcacguguauacgcugauccgauggcauuaaaagauuuuaaagaauuugcuucaggacgcaagucgauaacacuagacauccuaacagaaauugccagcuuaccaacauaucuaagcaguagggcgaaauuggcguuagacaauauagucaugcuucauacaacugaaagaggagguagggcguaccaacacgcguuaaacgaauugccggagucacuugaaacauuaaugcuuguugcauuacuaggagcgaugaccgccggaauauuuuuauucuuuaugcaagguaaggggauaggcaaacuuucaaugggcuuaauaacgauagcgguugccucgggccuauuauggguugcagaaauccaaccacaauggauagcagccaguaucauucuggaauuuuucuugaugguauuguugaucccugagccagaaaagcagagaacgccucaggauaaucaguugaucuauguaauuuugacaauccuaaccauaauuggguugaucgcagcuaacgaaaugggauugauagagaaaacgaaaacggacuuuggcuuuuaucaaguaaaaacugaaacuacuauauuagaugucgaccuuaggccggccagugcauggacgcuuuaugcgguggcuacuacaauacuaacaccgaugcuuagacauacaauagaaaacacaucagcgaacuugagucuagcagcgauagcaaaucaagcagcagugcuaaugggacuaggaaaaggauggccucuccacagaauggacuuaggggugccuuuacuggcaaugggauguuacucccaaguuaauccaacuacccuaacugcuucauuagucaugcuucugguacacuaugcuauaauagguccaggacuacaggcgaaagcgacccgagaagcgcaaaagagaacagcagcuggaauuaugaagaaccccacuguggauggaaucacagucauagaucuagaaccgauuaguuaugauccgaaauuugaaaaacaacuaggacaagucauguugcuuguauuaugugcgggacagcuacuccugaugaggaccaccugggcauucugcgaaguauugacauuggcaacaggucccauacuuacccucugggaaggaaaccccggcagguuuuggaauacgacaauagcgguaagcacagcaaacauauuuagaggaaguuacuuagccggugcaggguuggcauuuaguuuaauuaagaaugcgcaaacaccucgacgugguacuggcacgacuggcgaaacucugggagaaaaauggaaaagacaacuaaauucacuagauaggaaagaauuugaagaauauaaacguagugggauucuggaaguagaucgcacggaggcuaaaagcgcauuaaaagacgguucuaaaauuaaacaugcaguaucuaggggaucgucuaagaucagguggauaguugaacguggaaugguaaaaccuaaaggaaaaguuguugauuuaggaugcgggagaggagguuggucauacuauauggcaacucuuaaaaaugucacugaggucaaagguuacacuaaaggaggaccaggucacgaagaaccaauaccaauggcgaccuacggauggaaccuagugaaacuacauucuggcguggacguuuucuacaagcccacagagcaagucgacacacuacugugugauauaggagagagcucaaguaacccaacuauagaagaaggccguacuuuacgaguucucaaaaugguggaaccaugguugucaucaaaaccagaauuuuguaucaaagugcuaaacccguacaugccaacaguaauugaagaacucgaaaaauuacaaaggaaacauggagggaaccuaguuagaugccccuuaaguaggaacaguacucaugaaauguacugggucaguggagcaucaggaaauauagugucgucaguaaacaccaccagcaaaaugcuuuugaauagauucacaacuagacaucguaaaccaaccuacgagaaagauguugaucuaggugcggggacucguucuguuaguacagagacagagaaaccugauaugacuauaaucgggagaaggcuccagcguuuacaagaggaacauaaagaaacguggcauuacgaccaagagaauccauauaggacaugggcauaccacgggucauacgaagcuccaaguacgggcagugcaucuucuaugguaaauggcgucguuaaacuguugacgaagccaugggaugucauccccauggugacacaacuggcgaugacggauacuacaccguuuggucaacaacgaguuuuuaaagaaaaaguugacaccagaacaccacaaccaaaaccggguacgcgaauggugaugacaacuacagcaaauugguugugggcauuauuagggaagaagaaaaauccacgacuaugcacuaaagaagaguuuauuucaaaaguuagaucaaaugcggcaauuggagcagucuuccaagaggaacagggauggacaucugcuagcgaagcaguuaacgauucccguuucugggaguuaguugauaaagagcgugcauuacaucaagaggguaaaugcgaaaguuguguauacaauaugauggguaaaagagagaagaaguuaggagaauuugggagagcaaaaggaagccgagcgauaugguacauguggcugggagccagguuucucgaguuugaggcgcuuggauuuuuaaaugaagaucauugguuugguagagagaacucguggucggguguugaaggggaagguuuacauagauuaggauacaucuuagaggaaaucgacaagaaagacggcgacuuaauguaugcugaugauaccgccgggugggacacucguauuacugaagaugacuuacaaaaugaagaacugauuacugaacaaauggcaccccaccauaaaauauuggcuaaagcuauauucaaguuaacauaucaaaauaagguagucaaaguauuacgccccacuccuagaggagcuguuauggacauuauaucacgaaaggaccaaagaggaucgggccaagugggcacuuauggacuuaacacguucacaaacauggagguccaacucauucgucaaauggaagccgagggugugauaacacaggacgauaugcaaaaucccaaagguuugaaggagcgcguggagaaaugguuaagagaaugcggagucgaucgucuuaaaaggauggcgauaaguggggacgacugcguggucaaaccacuugacgagagauuuggcacgagccuauuauuuuuaaacgauauggggaaagugagaaaagauauuccacagugggaaccuaguaaagguuggaaaaacuggcaagagguaccauucugcucacaucauuuucauaaaauauuuaugaaagauggccguucucuagugguaccuuguagaaaucaagaugaacuuauaggcagagccagaaucucacaaggagcuggguggagcuuacgcgaaacagcaugucuaggaaaggcuuaugcgcaaauguggagucucauguauuuucaucgacgggauuuaagguuagcuucuauggcaauaugcagugcaguaccaacggagugguuuccgacaaguaggacuacuuggucaauucaugcccaccaucaguggaugacuacugaagacaugcucaagguuuggaaucgcguuuggauugaagauaaucccaauaugaccgacaagacaccuauacauucaugggaagacaucccuuauuuagggaaacgggaagauuuauggugcggcagcuuaaucgggcuaucuucgcgcgcuaccugggcuaaaaauauacauaccgccauaacccaaguaaggaauuuaauugggaaagaagaguauguagacuauaugccuguaaugaagcgauacucggcucccagcgaaagugaaggcguauuauag

SEQ ID NO: 23634 - RNA, 9867 nt, Artificial Sequence
  derived and/or modified CDS sequence (opt6) from DENV-4__FJ639742__SS-prME
agcacuaugacguuacugugucucauacccacagcaauggcauuucaccugucuacuagagauggggaaccacuuaugaucgucgcgaaacaugaacguggaagaccccuacucuuuaaaacaacggaagggauaaacaaauguacguugauagcuauggacuuaggggaaaugugugaagacacaguaacauauaaaugcccuuugcuagucaauacugaaccugaagauauagauuguugguguaaccuuacaucuaccugggugauguacggaacauguacucaaucgggggaacgacgaagagaaaaacgcaguguugcucuaaccccgcauagcgguaugggauuggaaacacgcgccgagacuuggaugucuagcgaaggggcuuggaaacaugcgcagagagucgaauccuggauacuaagaaauccgggauucgcuuuauuagcuggauucauggccuauauggugggacaaaccggcauucaaagaacuguauucuuuguauuaaugauguuaguggcuccaucguacggaaugagauguguaggaguagguaaucgcgauuucguagaaggaguuagugggggagcauggguggaucuagugcucgaacacggcgggugcguaaccacuauggcccagggaaaaccgaccuuggacuuugaacugacuaaaacaacagcaaaagaaguagcgcuacuaagaacguacugcauugaagcccuaaucaguaauauaaccacagcaacacgcugccccacacagggagaacccuaucuuaaagaagaacaagaccaacaguacauuuguagacgugacguaguugauagaggcuggggaaauggauguggucuauucgggaaagguggaguaguaaccugugcaaaauuuucaugcagcggaaaaauaaccggaaauuuaguucagauagaaaaucuagaauauacaguaguagucacgguccauaauggugauacucaugcaguaggaaacgauacaucuaaucaugggguuacugcaacgauaacaccacggucaccaagcguagaagugaaauuaccugauuauggagaguuaacucuagacugcgagccuaggaguggcaucgacuuuaaugagaugauauuaaugaaaaugaaaaagaaaacauggcuuguccauaaacaaugguuucuugacuuacccuuaccauggacagcuggugccgacacaucagaagugcacuggaacuacaaagaaaggaugguaacuuuuaaaguaccucaugccaagcggcaagauguaacuguucucgguagccaagaaggagcuaugcauucagcgcucgcaggagcuacugaaguugacucuggagacgguaaccacauguuugcaggccacuuaaaaugcaagguacgcauggaaaaauuacggauuaaagggaugucuuacacuaugugcaguggaaaauuuucaaucgacaaagaaauggcggaaacucagcaugguacaacgguuguaaaaguuaaauaugaaggugcuggugcaccuugcaaaguacccauugaaauacgcgauguuaauaaagagaaaguuguaggaaggguaauaagcucaacaccacuagcggagaauacgaauagugugaccaacauugaguuagaaccaccuuuuggugauuccuauauaguaaucgguguuggaaacagcgcccucacacuucacugguuuaggaaagggucaaguauugguaagauguucgaguccacuuaccgcggagcaaaacgcauggcuauauugggagaaacagcaugggauuucggaagcguugggggacuauucaccagucuaggaaaggccguacaucagguuuucgguucugucuacacaacgauguuuggggguguaaguuggaugauacggauucuaauuggcuuucuuguccuguggauuggaacuaauagccgcaacacaucuauggcuaugacaugcauagcuguugggggaauaacccuauuuuuaggauuuacaguccaagcggacaugggauguguaguaaguuggucaggacgagaauuaaaaugugggaguggaauauuuguaguagauaaugugcacaccuggacagaacaauacaaguuucaaccugaauccccagcccgcuuggcuucagcaaucuugaacgcccauaaagauggcgugugcgguauucgaucuacaacaagauuagaaaacguaauguggaagcaaauuaccaacgaacugaauuacguucuuugggaagguggacacgacuugacgguaguagcaggagaugugaaaggcguacugacuaaagggaaacgugcacucacuccuccagugucagaucucaaauacucauggaaaacguggggaaaagcgaaaauauuuaccccagaagcgcgaaacucaacuuucuuaaucgaugguccagauacaucugaauguccuaaugagcgucgagcuuggaauaguuuagaaguugaagacuacggguuuggaauguuuaccacuaauauauggaugaaauuuagagaagggucuuccgaggugugcgaucauagauuaaugagugcugcaauuaaagaucagaaggccguacacgccgacaugggauauuggauugaaaguaguaaaaaccaaacuuggcaaauugaaagggccagcuuaauagaggugaaaacgugccuauggccgaaaacccacacgcucuggucaaacgguguuuuggaaucccagauguugauuccgaaaaguuaugcagguccauucagccagcacaacuacagacaagguuacgcaacucaaacggucggaccauggcacuuaggaaaacuagagauagacuuuggagaauguccagggacaacaguuacuauccaagaagacugcgaccacagaggaccuucguuaaggacaaccaccgcgaguggaaagcuagugacacagugguguugucguuccuguacaaugccuccacugagguuuuugggugaggauggauguugguacgguauggaaauccguccccucagugaaaaagaagagaauaugguaaaaucacaaguaacugcagggcaaggcacuucagaaacuuucagcaugggauuacucuguuuaacuuuauucguagaggaauguuuaaggagaaggguuacucgaaaacacaugauacuagcaguugugauaacccuuugugcuauaauucuaggaggcuugaccuggauggaccuccugagagccuugauaauguugggagacaccaugucuggucgcaucggaggacaaacucacuuagcaaucauggcagucuuuaaaaugagcccuggguauguccuuggggucuuuuugcgaaaacucacaucaagggaaacggcucuuauggucauagguauggcuaugacgacaacauugucaauaccacaugacuuaauggaauuaauugaugguauaucuuuaggauuaauucuucucaaaaucgucacacaauuugauaacacgcaaguagggacucuugcacucucacuaacauucaucagaucuacaaugucacuuguaauggcauggcgcacaauaauggccguauuauuuguugucacuuugaucccucuguguagaacaaguugcuuacaaaaacagagucacuggguggaaauuacggcacugauauugggagcacaggcacuuccgguuuaucugaugacacuaaugaaaggagcuagcaggagaucauggccacucaaugagggcauaauggcuguaggcuuagucagccuacuggguagcgcacuucuuaaaaaugacguaccccuagcaggaccaaugguagcugguggauugcuacucgcagcguauguuaugucugggucaucugcagaccucucuuuggaaaaagcugcuucaguucaaugggaugaaauggcugauaucacagguucaucaccgauuaucgaagugaaacaagacgaagaugguaguuucucaauaagagauguagaagaaacaaacaugauuacacuuuugguuaaguuagcguuaauuacugugucaggacuauauccauuagcgauaccugucacgaugacacuaugguauauguggcagguuaagacgcaaagaaguggugccuuaugggauguacccucacccgcggcuacacaaaaagcagcauuaagcgaaggugucuauagaauaaugcaaagaggauuguuuggaaagacgcaagucggaguagguauacacauggaaggagucuuccauaccauguggcauguuacuagaggaucggugauuugccacgaaacgggucgacuagaaccaucaugggccgacgugcguaacgauaugaucucauauggcggaggauggcgacuuggagauaaaugggacaaagaagaagacguacaaguauuagcuauagaaccagguaaaaauccuaaacacguucaaacaaaaccugggcuauucaaaacacuaacaggugaaaucggagcgguaacgcuagauuucaagccagguacgucggguaguccgauuauaaaccggaagggaaaagugauaggucuauacggaaaugguguuguuaccaaaagcggggacuauguuagcgccauaacgcaagcggaaagaauaggggaaccugauuaugaagucgaugaggacauauuuagaaagaaacgacugacaaucauggaccuacaccccggugccggaaaaacuaaaaggauacugccuuccaucguacgagaagcgcucaagagaagacuucgaacacuaauauuggcuccuacaagaguuguugcagcagaaauggaagaagcauuacgaggauugcccauaagguaucaaacuccagcugucaaaucagagcauacaggcagagaaauaguugauuuaaugugucaugcuacauuuacuacacgucuacugucgucgacccgcguaccuaacuauaaccuaauaguuauggaugaagcacauuucacugauccuaguagcgucgcugcaagaggauauauuagcacuagaguagaaaugggggaagcggcagcgauauuuaugacagcaacaccucccggagccacugauccauuuccacagaguaacucaccuauagaagacauagaacgagaaauaccagaaagauccuggaauacaggcuucgauuggauaacggauuaucagggcaagacgguaugguuuguaccgucuaucaaagcugguaaugauaucgcuaauugucuacguaaauccggcaagaaaguaauacaacugucaagaaaaacuuuugacacagaguacccaaaaacaaaauugacagauugggauuucgugguuaccaccgacauuagugaaaugggugccaauuuuagagccgggcgagugauagauccacguagauguuugaaaccugugauucuaacggacgggcccgagagaguaauucuagcagguccuauaccuguaaccccagcauccgcugcucaaagaagaggcagaauuggaagaaauccagcacaagaagacgaucaauacguauuuuccggugacccgcuuaaaaaugacgaggaucacgcucacuggacugaggcaaaaauguuauuagauaauauauacaccccagaaggcauaauucccacauuauucggcccagaacgugagaaaacacaggcuaucgauggcgaauuuagauugcguggugaacaaaggaaaacauuugucgaauuaaugcgacgcggcgaucuuccagucuggcucagcuacaaaguagcaagugcaggaaucaguuacaaggaucgggaaugguguuucacuggggaacgaaauaaucaaauccucgaggagaauauggagguugaaauuuggacacgcgaaggugaaaagaagaaacuucgcccaagauggcuagaugcacgugucuaugcugaucccauggcccugaaagacuucaaagaauuugcuucgggccgcaagucuauaaccuuagauauacuaacagaaauagcuucguuaccaacuuaucugucuucaagggcaaaacuugcucuggauaauauugucauguuacauacaacggaaagaggcggacgcgcauaucaacaugcguuaaaugaauuaccagaaagccucgaaacacuaauguuaguagcccuauuaggugcgaugacagcaggcauauuuuuauucuuuaugcaaggcaagggaauaggaaaauugucaaugggauuaauuacaauugcgguugcgucuggcuuacuuuggguugcagaaauacaaccacaauggauagcugcaucgauaauuuuagaguucuuucuuaugguccuccuaauacccgaaccagaaaaacagagaacaccgcaagauaaccaacugauuuaugucauucuaacaauuuuaacaauuauuggguugaucgcagcuaacgaaaugggccuuauagaaaagacaaaaacugacuuuggauuuuaccaaguaaaaacagaaacgacuauucuagacguugauuugaggccugcuagugcauggacacuguaugccguagcgacaacuauacugacuccgaugcuacgacauacaaucgaaaauacgagugcaaauuuaaguuuagccgcuauugcaaaucaggcugcaguucuuaugggauuaggcaagggauggccuuuacaucgaauggaucuugguguuccuuuacuugcaauggguuguuauucccaaguaaauccuacaacauuaacugcuaguuuaguaaugcuacuuguucauuaugcgauuauuggaccagguuuacaagcgaaagcaacgagagaagcacagaaaaggacagccgccgggauaaugaaaaauccuacaguagacggaauuacggugaucgauuuagaaccaauauccuacgauccuaaauuugaaaaacagcucggccaagucaugcuuuuaguacuaugugcagggcaauuguuacuuaugagaacgacuugggcuuuuugugagguacuaacauuggccacagggccaauccuaacguuaugggaaggaaaucccggaagguuuuggaacacaacuauagcaguuaguaccgcaaacauauuccgcgggagcuauuuagcgggugcuggauuagcuuuuucacucauuaagaaugcgcaaacgccuaggagagggacaggaacaacuggcgaaacauugggggagaaauggaaaagacaacugaauaguuuggacagaaaagaauuugaagaauacaaacgauccggcauauuagaaguugaucgaacagaagcuaaaagugcucuaaaggacggguccaaaauaaagcaugccguuucacgagguuccucaaaaauuagauggaucguugaaagggguauggugaaaccaaaaggcaaaguuguagaucuagguugugguagaggugguuggucuuacuauauggcaacucuaaagaauguaacugaaguuaaagguuauaccaaaggaggcccuggucaugaggaaccaauacccauggcaacguauggauggaaucuggucaaguuacauucagguguugacguuuucuauaaaccgaccgaacagguagacacacuacuuugugauauuggagaaagcagcagcaauccuacuauugaagaagguagaaccuuaaggguauuaaaaaugguagaaccauggcuuagcucaaaaccagaauuuugcaucaaaguccucaauccauacaugccuacuguaauagaggaauuagaaaaguuacaacgaaaacauggugguaauuugguacguuguccccucucgagaaauucgacacaugaaauguauuggguaucaggagcaucagggaacauaguaagcucggugaauaccacaucaaagauguuguuaaauagauucacgacacgacacagaaagccaacauacgaaaaagauguagauuugggcgcuggaacacgaucaguuaguacagagacugagaaaccugauaugacuauaauuggcaggaggcuacagagacuccaggaagaacauaaggagacauggcauuaugaucaagaaaauccuuacaggacuugggcauaucaugguaguuacgaggcaccaaguaccggcucugcuagcucaaugguaaacggcguaguaaaauugcuuacaaaaccgugggauguuauaccgaugguaacccagcuggcuaugacugauacaacaccuuucggacaacagagaguauuuaaagaaaaaguugauacgagaacaccccaaccaaaacccggaaccagaauggucaugacaacaacagccaacuggcuaugggcacuauuagggaagaagaaaaaucccagauuauguacucgugaagaauuuauuaguaaaguacgaagcaaugcagcuauaggagcuguauuccaggaggaacaagguuggacuucagcuagugaagccgucaaugauucgagauucugggaauuaguagacaaggaaagagcccuccaucaagagggaaaaugugaaucaugcguguauaauaugauggguaaacgugagaagaaacucggagaguucggucgagccaaagguucucgagccauuugguauauguggcucggggcgcgcuuucuagaguucgaagcgcugggauucuuaaaugaagaucauugguuugguagagaaaauagcuggucuggaguggagggugaagguuuacaucgacucggauauauacucgaggaaauugacaagaaagauggugacuuaauguaugcugaugauacggcaggaugggauacuaggauaacagaagaugaucugcaaaacgaagaacuuauaaccgagcaaauggcaccacaucacaaaauucuagcgaaagcuauuuuuaaacucacauaucaaaauaaaguaguuaaaguacucagaccaacgccuaggggugcaguaauggauauuauaagcagaaaagaucagagagguucgggccagguaggcacuuauggacucaauacguucacgaauauggaagugcaauugauacgucaaauggaagcagaaggcguuauaacgcaagaugacaugcaaaacccgaaaggacuaaaggaaagagucgagaaauggcuacgugaauguggcguugaucgccuaaaacguauggcaaucucuggagacgacugugucgucaaaccccuagacgaacgauuugguaccucauuacuauuucugaacgauauggguaaaguaagaaaggauauuccgcaaugggaaccaucaaaaggauggaaaaacuggcaagaagugccuuucuguucccaucacuuccauaagauuuuuaugaaggauggacggaguuugguggugccuuguaggaaccaagacgaauuaaucggucgugcucguauaagucagggugcaggauggaguuuaagagaaacugcgugccuugguaaagcauaugcucaaauguggucccuaauguauuuccacaggcgagaccuaagacuagcaucuauggcaauuugcucggcuguaccgaccgaaugguuucccacaagcagaacuacauggagcauucaugcacaucaucaauggaugacgacggaggauauguuaaaaguauggaacaggguauggauagaagauaaucccaauaugauagauaaaacacccguucauagcugggaagauauacccuaucuuggcaaaagagaagaucuguggugugggagcuuaauaggucuuaguucccgugcuaccugggccaagaauauacauacugcaaucacacaaguaagaaauuugauagguaaagaagaauauguagacuacaugccagugaugaaacgauauucugcccccucagagucggaaggcguucuguag

SEQ ID NO: 23635 - RNA, 9867 nt, Artificial Sequence
  derived and/or modified CDS sequence (opt6) from DENV-4__FJ639745__SS-prME
ucgaccaugacgcuucugugucuaauaccgacugccauggcauuucaccuuuccaccagggauggagaaccauuaaugauuguugcgaaacacgaacggggaagaccauuauuguuuaaaacuacugaagggauaaauaaaugcacacugauagccauggaucucggugaaaugugugaagauacagugaccuacaaauguccacuauuaguuaauacagagccugaggauauagauuguugguguaaucuuacaagcacuuggguaauguacgguacaugcacccaaucaggugaacguagaagagaaaaacguagcguugcacugacaccgcauucagguaugggauuagaaacucgagcagagacuuggaugucaucugagggagccuggaaacacgcgcaacgcguagaauccuggaucuuacgaaacccuggguuugcguuguuggcuggauucauggcauauaugauuggucaaacaggaauacaaaggacgguauucuuuguucucaugaugcuaguagcaccuuccuauggaaugagaugugucggcguugguaacagagauuuugucgaaggugugagcggaggagcaugggucgacuugguauuggaacaugguggaugugugacaacaauggcacaaggcaaacccacucuagacuucgaguuaaccaaaacuacagcaaaagagguugcuuuauuaagaacuuacuguauugaagcauugauauccaacauaaccaccgcuacaagaugcccaacacaaggugagccguaccucaaagaagaacaagaccaacaauauauaugccggagagauguuguagauagaggaugggguaacgguugcgguuuauucgguaaagguggagucguuacuugcgcuaaguuuaguuguagcggaaagaucacggguaauuugguucaaauugaaaacuuagaauacacaguugucgugaccgugcacaacggugauacacaugcuguagguaacgauacuagcaaucacggaguuacugcaacuaucacgccgagaucuccuucaguugaaguaaaguugccggacuacggagagcuuacauuagauugugaaccaagaagugguaucgauuuuaaugaaaugauacuaaugaagaugaaaaagaaaacauggcugguacacaaacaaugguucuuagaucuuccguugccauggacagcaggcgccgacacaucggaaguacauuggaauuauaaagaacgcaugguaacguucaaaguaccacaugccaagagacaagaugugacaguuuuagguucucaagaaggugcgaugcauucagcccuagcaggagcuacugagguugacagcggggauggaaaccauauguucgcgggccaucucaaaugcaagguaagaauggaaaaauuaagaauuaaaggaaugaguuacacuauguguaguggcaaguuuagcauugacaaagagauggccgaaacccagcauggaacaacuguaguaaaaguuaaauaugaaggagcgggggcgccauguaaggugccaauagaaauccgagaugugaauaaagagaaaguaguugguagaguuaucaguaguacaccucuagcugagaacacaaacucaguaacuaauauagaguuggaaccaccguuuggugauucguacauaguaauagggguagggaauagugcccuaaccuuacauugguucagaaagggaucuucgauaggaaaaauguucgagucgaccuaccgaggagcuaaacggauggccauucugggugaaacagcaugggacuuuggaucaguggguggauuauuuaccagucuaggaaaagcuguacaccaaguauuuggaagcguauauacaacaauguucggggguguuuccuggaugauaaggauccuuauaggauuguugguucuauggauaggaacgaacucacggaacacgucaauggcaaugacaugcauugcgguaggaggaauuacucuauuucuugguuucaccgugcaagcagacauggguugcguagugaguuggucggguagagaacucaaauguggcagugguauuuuuguaguugacaauguacacacauggaccgaacaauauaaauuucaaccagaaucuccggcacgacuagcuagugcaauacuaaaugcacauaaggacggaguauguggaauuaggucaacuacgaggcuagaaaauguaauguggaaacaaauaacaaacgaauuaaauuacguguugugggagggaggucacgauuuaaccguaguagcgggagaugucaagggaguucuaacuaaaggaaaaagggcucugacuccaccugucucagaucuaaaauauucauggaagacuuggggcaaagcaaagaucuucacccccgaggcacgaaacaguacauucuuaaucgauggaccagauacaagcgaauguccaaaugaacgcagggccuggaacucauuagaaguggaggauuauggcuucggaauguucacuacuaauaucuggaugaaguucagagaagguagcuccgaaguuugugaccauagauuaaugucugccgccauuaaagaccaaaaagcaguucacgccgauauggguuauuggauugagaguaguaaaaaucaaacuuggcaaauugagagagcaucauuaauugaagugaaaacuugucucuggccaaagacacauacacuuuggucaaacgguguauuagagucacagaugcuaaucccaaaaagcuacgccggaccauuuucucaacauaauuaccgacaaggauaugcuacacagacuguagggccguggcaucucggcaaacuagagauagauuucggggagugcccuggaacuacaguaacaauccaggaagauugugaucaucgaggcccuucacugcguacuacuacagcuucaggaaaguugguaacccaguggugcugcagaaguuguacuaugccuccucugagguuucuaggagaagacggaugcugguacggcauggagauaaggccuuuaucugagaaagaagaaaacauggucaaaucgcaggucacugcaggacaaggaacaucagaaaccuucagcaugggauuauuaugucugacacuauucguggaagaaugucuacgacgaagaguaacaagaaagcacaugauccuagcugugguaaucacccugugugcuauaauacuaggaggcuugacauggauggacuuauuaagagcgcuaauaaugcuuggagacaccaugucagguagaauaggaggacaaacacauuuagcaauaauggcaguguucaaaaugaguccaggcuacgugcuugggguauuuuuaagaaaacugacaucaagagaaacugcauugauggugauagguauggcgaugacuacgacacuuucaaucccacacgauuuaauggaauugauugacggaauuaguuuaggauuaauauuacuaaaaauaguaacucaauucgacaacacacaaguagguacauuagcuuuaucacuaaccuuuauaagaucuacuaugucacuuguuauggcuuggcgaaccauuauggccguucuuuucguagucacguuaauaccucuuugccgaacaaguugccuacaaaaacaaagucacuggguugaaauaacugcacuaauauuaggugcucaggcuuuaccuguguacuuaaugacacugaugaaaggggcgucaagaaggagcuggccccuuaaugaaggaauaauggccguggggcucguuaguuugcuagguucagcauuacuaaagaacgacguaccauuagccgguccaaugguugcggguggacuuuuauuagcugcuuacgucauguccggaagcucagcagacuuaagccuagaaaaggcggccaacgugcaaugggaugaaauggcugacaucaccggaucgucaccuaucaucgaagugaagcaagaugaggacgggaguuucucaauucgggauguagaagaaacaaacaugauuacgcuacucgucaaauuagcauuaauaacgguaucugggcuauauccauuggccauaccagugacuaugacacuuugguacauguggcagguaaaaacucaaagauccggggcacuaugggauguuccgagcccugccgcuacccaaaaagcagcucuauccgaaggcguauaucgaauaaugcagaggggacucuucggcaaaacucagguuggcguugguauacauauggaaggcguuuuucacacgauguggcauguaacacgaggcucuguaauuugucaugaaacugguagauuggaaccaaguugggcugauguucgcaaugauaugaucucuuacgguggggguuggagacuuggcgauaaaugggacaaggaagaagauguucaaguacuagcaauugagcccggcaagaauccaaagcauguccaaacgaaaccgggauuauucaaaacacuaaccggagaaauuggugcuguaacauuggauuucaaaccaggaacgucaggaagcccuauuauaaaccggaagggaaagguuauuggauuauaugguaauggaguagugacuaaaagcggagauuacgucagcgcaauuacacaggcagagcgaauuggugagccugacuaugaaguagaugaagauaucuucaggaaaaagagacugacuaucauggauuuacacccaggagcagguaaaacgaagagaauacucccaucaauagugagagaagcgcugaagcggagguuaagaacauuaauacuggcacccaccagagucguagcugccgagauggaggaagcauugcgaggucuaccaauuagauaccaaacgccugccgugaaaucagagcauacaggcagggaaauagucgaccuaaugugccaugcaacuuuuaccacccgacuuuuaagcagcacgagaguaccaaacuacaaccugaucgucauggacgaagcacacuuuacugacccaagcaguguugcggcgagaggauauaucucuacaagaguugaaaugggugaagccgcggcaauauuuaugacagcuacuccaccaggugcuacugacccuuucccccaaucuaacaguccaaucgaggauauugaaagggagauaccagaaagaucguggaacaccggcuuugauuggauaacagacuaccaagguaaaacugugugguuuguacccaguauuaaggcugguaaugacaucgcaaauugccuucgaaaaucaggcaaaaagguaauacaacucagucggaagacauuugacaccgaauauccuaaaaccaaguuaacugauugggacuucguggucacuacggauauaucagaaaugggagcgaauuucagggcuggacgagugauagacccaagaagauguuuaaaaccggucauacugacugaugguccggaacgagucauauuagcaggccccauaccgguuaccccugcauccgcagcacaacguagagguagaaucgggcgaaaucccgcacaagaagaugaucaauauguguucaguggugauccacucaaaaaugaugaagaucaugcccauuggaccgaggcuaaaauguuacuagauaacauauauaccccugagggcauaauuccaaccuuauucgggccagaaagagagaaaacccaagcuauagacggagaguuuagauuaagaggagaacagaggaaaacguuuguagaauuaaugcgaagaggggaucugccuguauggcuaucauacaaaguagccucagcaggcauaucauauaaggaucgugaaugguguuucacgggugaaagaaauaaucagauuuuagaagaaaauauggaaguggaaaucuggacacgcgagggcgagaagaagaaauugagaccaagauggcuggaugcccguguguacgcggaucccauggcccucaaagauuuuaaagaauuugcaucgggucguaagucaauuaccuuagacauauuaaccgaaauugcaagucugccaacauacuuaucaaguagggcaaaacuugcucuggacaacauaguuauguuacacacaacugaacgaggcggcagagcauaccaacacgccuuaaacgagcuaccagaaaguuuagaaacauuaaugcuuguagcacuucuuggugcaaugacugcggguauauuuuuauucuuuaugcagggaaaaggcauagggaaacuaucaaugggucuaauaacaauagccguugcaagcgggcuacuauggguugcagaaauccagccgcaauggauagcugcgagcauuauuuuagaguuuuucuuaaugguauuauugauaccagaaccugaaaagcaaagaacuccacaagacaaccaacuuauauauguuauccuuaccauucucacgauaauuggauugaucgcugcaaaugaaaugggacuuauagaaaagacuaaaacggauuuugguuucuaccagguaaaaacagaaacaaccauauuagacguagaccuacgaccugcuuccgccuggacauuauaugccguggccaccacaauauugacaccuaugcucagacacacaauagaaaacacaagugcuaaccuaucccuagcugcaauagccaaccaagcagcaguccuaauggggcuaggaaaaggauggccccugcacagaauggaccuuggcguaccacugcuggccauggguuguuacucccaaguaaacccaacgacauugacagcaagccuuguuauguuguuaguacauuaugcgauaauaggcccuggucuacaagccaaagcaaccagagaagcacaaaagaggacggcugcgggaauaaugaaaaacccgacaguggauggaauuaccguuauagaucuagaaccgauauccuaugacccaaaauucgaaaaacaauuaggacaagugaugcuucuaguacuaugugccggacaguugcuacuuaugcgaacaacaugggcauuuugugagguccuaacucuggcuacuggaccaauauugacgcuuugggaagguaacccaggucgauuuuggaauaccacgauugcaguuaguacggccaacauuuuuagaggaucauaucuagcuggugcaggacuugccuuuagucuaauuaagaacgcucaaacaccuaggagggguacaggcaccacuggggaaacacuuggagaaaaguggaaacgacaguuaaauuccuuggacaggaaggaauuugaggaauacaagcgcucaggaauuuuggaaguagauagaacugaagcgaagucggcguuaaaggacggaucaaagauaaagcaugcaguaucaagagggaguucgaagauuagguggauaguagaacgaggaaugguuaaaccaaaagguaaaguuguugaucuugguuguggucgcggugggugguccuauuauauggcaacucuaaagaaugugacagaggucaaaggcuacaccaagggagguccaggacacgaagaaccuauaccaauggcgacguaugguuggaauuuagugaaauuacauagcggaguugaugucuuuuauaaaccuacugaacaaguagacacauuacugugugacauaggugaaagcaguaguaaccccacaauugaagaaggacguacccuacguguguuaaagaugguggaaccaugguuguccucaaaacccgaauuuuguauaaaaguucuaaauccauauaugcccacuguaauagaggaauuagaaaaauuacaaagaaagcacggaggcaaucugguacgauguccacucagcagaaacagcacacaugagauguauuggguaaguggagccucuggcaauauaguuucgaguguaaauacaacuucaaaaaugcuacugaaccgauucacaacuagacaccguaaaccuacguaugagaaagacguugaccuaggagccgggacaagaagcguuagcacugagacggagaaaccugauaugacaauaauuggaagaagacuccaaagacuacaagaggaacacaaggaaaccuggcacuaugaucaggaaaauccguauaggacuugggcuuaucacgguaguuaugaagcaccaucaacuggaagugcaaguucaauggucaaugguguagucaaacuccucacgaaaccuugggauguuauacccaugguaacccaacuugcaaugacagauacaacucccuuuggucaacagcgaguauuuaaggagaagguagacacaagaacgccacaaccaaagccggguacaagaauggucaugacaacaacagcuaauuggcuaugggcguuauuagguaagaagaaaaauccacgccuuuguacuagagaggaauuuauuucaaaaguuagaucuaaugcugcuauaggagcagucuuccaggaagaacaagguuggacgagugcaagugaagcaguuaaugacucucguuucugggagcuuguugauaaggaacgugcccuacaucaagaagguaaaugugaaucaugugucuacaacaugaugggcaagcgagagaagaaauuaggugaauuuggaagggcaaagggauccagagcaauaugguauauguggcuaggugcaagauuccucgaauuugaagcacuaggauucuuaaacgaggaccauugguuuggacgagagaacaguuggucagguguggaaggggagggacuccauagacuaggguacaucuuggaggaaauagacaagaaagacggagaccuaauguacgcagacgauacugcgggaugggauaccaggauuacggaagaugaucuccaaaacgaagaauugauuacagaacaaauggccccacaccacaaaauucuagcuaaggccaucuuuaaauuaaccuaucaaaacaaaguaguaaaaguacugagaccgacaccucgaggagcggucauggacauuaucucacggaaggaccaacgaggaucaggccaagucggcacuuaugguuugaacaccuuuacaaauauggaaguucaguuaauacgucagauggaagcugaaggaguaauaacgcaggacgauaugcaaaauccuaaaggacucaaagaaagaguggaaaaaugguuaagggagugcggaguagauagacucaaacguauggccauaucgggcgaugacugcgucguuaaacccuuagacgaaagguucgcaacaagucuauuauuccuaaaugauaugggaaaaguacguaaagacauaccccaaugggaaccaucuaaagguuggaaaaacuggcaagaaguuccuuucuguagccaccacuuccauaagauauucaugaaagacgggcgauccuuaguagucccuugcagaaaucaagaugaacugauuggcagagcacguauuagccaaggagcgggauggaguuuaagagagacugcuugucuuggcaaggccuaugcucaaauguggagucuaauguauuuucacagacgagaucuccguuuagcaucaauggcaaucuguagcgcaguuccgaccgaaugguucccuacguccagaacaaccuggaguauucacgcccaccaccaauggaugacuacugaagacaugcugaaaguguggaaucggguguggauagaggacaaucccaacaugauagacaaaacuccaguacauagcugggaagauauuccauaccucggaaaacgggaggauuuauggugcggcagcuuaauaggauuaucaagccgagcaacaugggcgaaaaauauacauaccgcaauaacgcagguaagaaaucuuauuggcaaagaggaguaugucgauuauaugccuguaaugaaacgauacagugcgcccucggaaucugaagggguuuuauag

SEQ ID NO: 23636 - RNA, 9867 nt, Artificial Sequence
  derived and/or modified CDS sequence (opt6) from DENV-4__FJ850095__SS-prME
ucaacgaucacccuguuaugucugauaccgaccguaauggcuuuucauuugaguacaagagauggugaaccucuaaugaucguagcaaaacacgaacgagggcgcccacuauuguucaaaacaacagaagguauaaauaaauguacucugauagcaauggaucuuggugaaaugugcgaagacaccgugacuuacaaauguccccuauuaguaaauacagaaccggaagacauugauuguugguguaaucuaaccaguacauggguaauguauggaacuugcacccagucgggugagaggagaagagaaaaacgcucaguagcacuaacaccacauucuggaaugggacuagagacacgugcagagacauggaugucauccgaaggcgcauggaaacacgcacaacgaguugaauccuggauauuacggaaccccggauucgcacuccuagccggcuuuauggcuuacaugauaggucagaccggaauccaaagaacaguguucuuuguucuuaugaugcuagucgcaccuucguacggcaugcgaugcguaggaguugguaacagagauuucguggaaggcguaucgggaggggcauggguagauuuaguauuagaacauggagguuguguuacaacaauggcacagggaaaaccaacacuugauuucgaauuaaccaaaaccacugcuaaagaagucgcguuauuaagaacauauuguauagaagcgcuaauaagcaacaucaccacagcgacuaggugcccaacacaaggagagccauaucucaaagaagaacaagaucaacaauauauuuguagaagagaugucguggacaggggaugggguaacgguuguggauuauucgggaaaggaggcguuguuacaugugcaaaauucaguugcucuggaaaaaucacagggaauuugguucaaauugaaaauuuggaauacacuguaguuguaacuguucauaauggagacacucaugcaguuggaaaugauacuucaaaccacgguguuacugcaaccauuaccccaagguccccuucagucgagguuaaauugcccgacuauggugagcucacauuagauugcgaaccacguucaggaauagacuuuaacgaaaugauauuaaugaaaaugaagaagaaaacauggcucguacacaaacaaugguuucuagaucucccauugccuuggaccacuggggcagauacaucggaagugcauuggaauuacaaagagcgaaugguuacauuuaaaguaccccaugcaaaaagacaggacguaacagugcuagggagccaagaaggagcuaugcauagugcucuagccggagcgaccgaaguagacaguggagauggcaaccacauguucgcgggccaucuaaaauguaaaguuagaauggaaaagcuacguauuaaaggaaugucguauacuauguguucaggaaaguucaguaucgauaaagaaauggcggagacucaacacggaaccacuguaguuaaaguuaaauacgaaggagcaggagccccgugcaaaguaccaauugaaauuagagacgucaauaaagagaaggucguuggucguguaauaagugcaacgccauuagcagaaaauacaaauucaguuacaaacauagaacuagaaccaccguuuggcgacucauacaucguuauugguguagguaauuccgcauuaacauuacauugguucagaaagggaucaucaauuggaaaaauguuugagucgacauacaggggagcaaaaagaauggcaauauuaggugagacagcaugggauuucgguucaguaggaggucuuuuuaccucacucggcaaggccguucaccaagucuuuggaucaguuuauacaaccauguuugguggggugaguuggaugauaagaauccuaauaggauuuuuaguucuguggaucggaaccaauucccguaacacuucgauggccaugaccugcauagcagucgggggaaucacauuauuccugggauucacuguucaggcagauauggggugcguuguuucauggaguggucgcgagcucaagugcggaucgggaauuuuuguagucgauaacguacacacauggacagaacaauauaaauuccaaccagaaucuccagcacgauuagccagcgcaaucuuaaaugcacauaaggauggaguuugcggaauacguagcacuacacggcuagagaacguaauguggaaacaaauaacuaaugaacuaaauuauguacuuugggaagguggacacgacuuaacuguggucgcgggugaugucaagggaguacuaacuaaagguaaacgugcccuuacaccgccagcuagugaucugaaguauaguuggaaaacgugggguaaagcuaaaauuuuuacaccugaagcacgaaauaguacauuuuuaauagacgguccagauacaucggagugcccaaaugaacggagagcuuggaacucguuugaaguggaagacuacggauucgggauguucacaacaaacauauggaugaaauucagagaaggaaguucagaagucugcgaccaccggcuaauguccgcugcaauaaaagaucagaaagcaguacacgcagacaugggguacuggauagaaucgucuaaaaaucagaccuggcaaauugaaagagcgagucuuauagagguuaaaacauguuuguggccaaaaacucauacauuguggucuaaugguguauuagaaucacaaaugcugauaccuaaaagcuacgcuggcccuuuuucccagcauaauuacagacaaggauaugccacacagacaguggguccuuggcacuugggcaaacuggaaauagauuuuggagaauguccggguacaaccguaaccauucaggaagacugcgaucacagggggccaucccugcgcacgacuacagcgagugguaaguuaguuacgcagugguguugccggagcugcacgaugccaccgcucagauuccuaggggaagauggcuguugguacggaauggaaauaaggccacuuagcgaaaaagaagagaauauggugaaaucgcaagucacugcuggacaaggaaccagcgaaacauuuagcaugggauuacuaugccuaacauuauucguagaagaaugucuuagacgaagagucacacgaaaacauaugauauuagcgguuguuauuacgcuaugcgcuauuauacuuggaggauuaacauggauggaccuacugcgagcuuuaauaauguuaggagauacuaugucuggaaggauugggggucaaacucaucuugcgauuauggcaguauuuaaaaugucuccaggauauguacuaggaguguucuuaagaaaauuaacuucuagggagacggcuuugauggucauugguauggcaaugacaacuacucuauccauaccgcaugauuugauggaauuaauugacggaaucucucugggacuaauucuauuaaagauaguuacacaauuugauaauacacaaguaggcacauuagcucugucuuuaacauucauuaggucaacuauguccuuggucauggcauggcggaccauuauggcugugcuauuuguugugacucucauaccccuaugucgaacaaguugccuucaaaaacaaucccacugggucgaaauaaccgcauuaauacucggagcucaagcgcucccuguauaccugaugacuuuaaugaagggcgcuagcaggagaagcuggccucuaaacgaaggaauaauggcagucggccuagucuccuuacucgguagcgcacuacuuaaaaaugauguaccucuugcugggcccaugguagccggugguuuguugcuugcagccuacguaaugucaggaagcucugccgacuuaucuuuagaaaaagcugcaaacguucagugggaugaaauggcggauaucacugggucuaguccuaucauugaaguaaaacaagaugaggacgguucuuucuccauaagagauguggaggaaacaaacaugauuacccuccuaguuaaacuagcucuaauaacaguaagcggauuauauccauuagccauacccguaacuaugacucuaugguauauguggcaagugaaaacacagaggagcggggcauuaugggacgucccaucucccgcugcaacccaaaaggcagcgcuaagcgaaggaguguaccgcauaaugcaacgaggucuguucggcaaaacacagguagguguugggauccauauggagggagucuuucauacuauguggcacguuacacgaggaaguguuauaugucaugaaacgggacgucucgaaccauccugggcggacgucagaaacgacaugauuucauauggaggaggguggaggcuuggggauaaaugggauaaagaggaagacguacaaguucuagcaauagaaccagguaaaaauccgaaacacguucaaaccaagccuggacuuuucaaaacacucacaggagaaauaggagccgugaccuuggacuuuaaaccuggaaccagcggaaguccaauaaucaaucguaaaggcaagguuauuggauuauauggaaauggcguugugacaaagagcggggacuauguaagcgcuauaacacaagcagagagaauaggugaaccagauuacgaagucgaugaagacauauuuagaaagaaaaggcugacuauuauggacuuacauccuggugcagguaaaacaaagagaauauuaccaaguauaguuagagaagcacuaaaacggcguuuacguacauuaauauuggcacccacacgagucguugcagcggagauggaagaggcauuaagagguuuaccuaucagguaucaaacuccugcaguaaaaucagagcacacaggucgagaaauuguugaucuaaugugucaugcuaccuuuacgacaagacuacugucuaguacucgcguacccaauuauaacuugauuguuauggaugaagcccacuucacagacccaucaagugucgccgcaagaggauacauauccacacgcguagaaaugggcgaagcagcagcuauauuuaugacagcaaccccuccuggugcgacugaccccuucccccaaucaaacaguccaauagaagauauagagagagaaauuccggaaaggagcuggaauacagguuucgacuggauaacagacuaucaagguaagacggugugguuuguaccgagcauaaaagcggggaaugauauugccaacuguuuacguaaguccgggaaaaagguaauucaauuaagucguaaaacauuugacacagaauauccuaagacaaaauuaacggauugggauuuuguggugacuacggacauuagugaaaugggagccaauuuucgagcaggcagaguuauagauccccgaaggugucuaaagcccguaauacuaacagauggcccggaaagagugauacucgccggcccaaucccugugacgccagcaagcgccgcgcaacgaagaggacgaaucggacgcaacccagcacaagaagacgaucaauacguauuuaguggugauccccucaaaaaugaugaggaucacgcucacuggaccgaagcuaaaauguuauuggauaauauauacacuccugagggaauuauaccgacauuauucggaccggaaagagagaaaacucaggcaaucgacggagaauuuagauugaggggagagcaacgaaagaccuuuguugaguuaaugagacggggagaccucccaguuuggcugaguuauaagguagcaagugccggaauaucauauaaagacagagaauggugcuuuaccggggagagaaauaaccaaauauuagaagagaacauggagguagaaauuuggacgagagagggagagaagaagaaacucagacccaaauggcuggacgcaagaguauaugcagacccgauggcuuuaaaagacuucaaagaauuugccucagggcguaaaucuaucacuuuagacauucugacggaaauagcuucacugccaacauaccuaaguucaagagcaaaacuagcuuuggauaauauagucaugcuccacacgacggaacggggugggagagcauaucaacacgcucucaaugaguuaccugagagccuagaaacgcuaauguuggucgcccuguuaggagcaaugacugcagggauuuuccuuuucuuuaugcaaggcaaaggcauagggaagcuaucuaugggacucauuacuauugcgguagcuagcggucuauugugggucgcggaaauucaaccacaguggauagcggcuaguaucauuuuagaguuuuucuuaaugguucuacugauacccgaaccagaaaaacaacgaacaccacaggauaaccaguugauauauguuauucucacaaucuuaacgauaauaggauuaauagcagcaaacgaaauggggcuaauugaaaagacuaagacugacuucggauucuaucaagugaaaacagaaaccacuauacuagauguugacuuacgacccgcuucagcauggacauuauaugcaguugcaacuacgauacuuaccccgauguugcgacauacgaucgaaaacacaagugccaaccucucauuggcagcaauagcuaaucaagcagcuguacugaugggauuagggaaaggauggccacuacaucgaauggaucuagguguuccauuacucgcuaugggaugcuauucgcaaguuaacccaacaacguugacagcuucauuagucauguuauuaguacauuacgcuauaaucgggccaggauuacaggcgaaagcuacgcgagaagcgcaaaaacguacugcagcugggauuaugaaaaacccaacaguggaugggauuacugugauugacuuagaaccaaucaguuaugacccaaaguucgaaaagcaauuaggucagguuaugcuccuaguuuugugugcuggacaguuacuccugaugagaacuacaugggcauuuugugagguacuuaccuuggccaccggcccaaucuugacucugugggagggcaaucccggacgcuucuggaauacuacuauagcaguuucaacagcuaauauuuuuagaggaaguuauuuagccggugcgggccucgcuuuuagccuuauaaagaacgcacaaacuccgcgucgugggacaggaacgacuggcgaaacgcucggcgaaaaauggaagaggcaauuaaacagucuugaucggaaagaauuugaagaauacaaaagaagcggcauccuugaagucgauagaaccgaagcgaaguccgcgcucaaagacggaaguaagauaaagcacgccguaagcagaggaagcaguaaaauucgauggauuguggaaagaggaaugguuaaaccuaaagggaaaguuguggaucuagguugcgggagagguggcuggucuuacuacauggcaacuuugaaaaauguuacagaagucaagggauauacaaaaggugguccaggccaugaagaacccaucccaauggcaacguacggcuggaacuugguaaaacugcauaguggcguugauguauuuuauaagccuacggaacaaguagauacauuacuuugugacauuggggaaucaucuuccaacccuacaauagaagagggucgcaccuuacgcguucuaaaaaugguagagcccuggcuaagcagcaaaccugaauuuugcauaaaaguauuaaauccauacaugccaacggucaucgaagaauuagaaaaacuacaaaggaaacauggggguaaucugguuagauguccacucagccguaauuccacucacgaaauguauuggguuuccggcgcaucggguaauauaguuagcucaguaaauacgacgaguaaaauguuacuuaaucgauuuacaacaagacauagaaaaccgacguaugaaaaagacguugauuuaggagcgggaacuagaagcguuagcacagaaacggaaaagccggauaugaccauaauaggcagacgacuacaacgccuacaggaagaacauaaggaaacauggcauuacgaucaggaaaauccguacagaaccugggcuuaccacgguaguuacgaagcgcccaguaccggaucagcuucaaguaugguaaacggaguuguuaaauuacuaacaaaaccaugggacgucauaccaaugguaacucaacucgcuaugacggauaccaccccguucggucagcagagaguuuuuaaagaaaaaguugacacccggacaccgcaaccuaaacccggcacaagaauggucaugacaacuacagcaaacuggcuaugggcacucuuaggcaagaagaagaacccuagguugugcacgcgagaagaauuuauaucaaaaguaagaucuaaugcugcgauaggcgcuguguuccaagaagaacagggauggacaagcgcgagugaagcaguaaaugacucuagauuuugggaauuaguugauaaggaacgagcucuacaccaagaaggcaaaugcgaaaguugugucuacaacaugaugggcaagagggagaagaaauuaggggaguucggaagggcuaaaggaucucgugcaaucugguauauguggcuaggagcaagauuccuggaauuugaggcucuaggguucuugaaugaagaucacugguuuggacgagagaauaguuggucgggcgucgaaggggaaggauuacauaggcugggauacaucuuagaggaaauagauaaaaaggacggugacuuaauguaugcagaugacacugcaggaugggacacgcgaauaaccgaggaugacuuacagaacgaggaguuaauuacggaacaaauggcuccacaccauaaaauccuggcuaaggcaauauuuaaacuuaccuaucagaacaagguuguuaagguuuuacgaccuacuccaagaggagcuguaauggauauaauaucaagaaaggaccaacgagguucagggcaagucggcaccuacggacuaaacacuuuuacaaacauggaagugcaauuaauaagacaaauggaagcagaggguguuaucacucaagacgauaugcaaaauccaaaaggauuaaaagaacggguagaaaaauggcuaagagagugcggaguggaucgcuugaaaagaauggcaauauccggagacgacugugucgugaaaccacuagacgaaagguucgggacauccuuacucuuucuaaaugauauggggaaaguuaggaaagauauaccgcaaugggaaccaaguaaggguuggaagaacuggcaagagguacccuucugcucucaccauuuccauaaaauauuuaugaaagauggucguagccucguaguuccuuguaggaaucaagaugaauuaaucgggagagcucgaauaucucaaggagcuggcuggucccuaagagagacagcaugccuuggaaaagcauaugcucagauguggagcuuaauguauuuccacagaagggaucuucggcuugcaaguauggcgauauguucugcaguaccaacugaaugguuuccgacuagccgaacaacguggucaauacacgcacaccaucaauggaugacuaccgaagacaugcugaaaguguggaaccgaguauggauagaagauaaccccaauaugaucgauaagacuccaguacauagcugggaagacaucccauauuuagguaaacgugaagauuuguggugcggaagccucauagggcuaucaucacgagccacuugggcuaagaauauucauacagccaucacucaagugcgaaaccuaauuggaaaagaggaauaugucgacuauaugccagucaugaagagguauagugcaccuucagaaagugagggaguauuauaa

SEQ ID NO: 23637 - RNA, 9867 nt, Artificial Sequence
  derived and/or modified CDS sequence (opt6) from DENV-4__FJ639748__SS-prME
aguacuaugacucuacugugucuaauaccgacugccauggcauuucaccuuagcaccagggacggugaacccuugaugauaguagccaaacaugaacguggaagaccuuuacucuucaaaacaacagaagguauaaauaaauguaccuuaauugcaauggaccuaggagaaaugugugaagacacugucacauauaaauguccauugcuggucaauacagaaccagaagacauagauugcugguguaacuugacaagcacgugggugauguauggaacguguacgcaaagcggugaacguagacgugaaaaacgauccguggcucuuacaccccauagugggaugggacuagaaacaagagcggaaaccuggaugagcagugaaggagccuggaaacaugcacaaaggguugaaaguuggauacucagaaauccuggauucgcacuuuuagcaggauuuauggcguauaugauaggccagaccgguauucaaagaacgguguucuucguauuaaugaugcuuguggcaccuucauacgguaugcgaugcguuggcguaggcaacagagauuucguugaaggugugucaggaggagcguggguugacuuagugcuugaacauggggguugcguaacuacaauggcacaaggcaaacccacucucgauuuugaauuaacaaaaacaacggcaaaagaaguugcucuacuacguacauauugcauugaggcuuuaauaucgaacauaacaacugcaacgagaugccccacacaaggggaaccauaucuaaaagaagaacaggaucagcaauacaucuguagaagagacguuguagaucguggaugggguaauggaugcgguuuguuugguaaaggaggaguagugacuugugcuaaauucuccuguaguggcaaaauaacaggcaaccuaguacagaucgaaaaucuggaauacaccguagugguuacgguucacaauggagacacacacgcuguaggaaaugacacaucuaaucacggcguuacagcgacgauaacuccaagaaguccaagcguagaaguucaacuuccagauuacggagagcucacgcuggacugugaacccagauccggcaucgauuuuaaugaaaugauucuaaugaaaaugaagaagaaaacuuggcuuguucacaaacaaugguucuuggauuugccacuucccuggaccgcaggagccgauacgucggaggugcauuggaauuacaaagaacgaauggugaccuuuaaaguuccacaugccaaacgacaggauguaacaguacuuggaucgcaggaaggagcaaugcauagcgcccuagcuggugcuacugagguugauuccggagacgguaaucauauguucgcaggccaccugaaaugcaaaguccguauggaaaaacucagaaucaaaggaaugucuuauacaauguguuccgguaaauucucgauugauaaagaaauggcagaaacacagcaugggacuacaguggugaaaguaaaauaugaaggugcgggugcacccugcaaggucccaaucgaaauuagggacgugaacaaagaaaagguugucggacgaguuauaucaucaacgccguuagcagaaaacacuaauucagucacaaauauugaacuugagccuccguucggugauucguacaucguuauuggcguuggaaacucagcauuaacucuucauugguuucgaaaagguucaucuauuggaaaaauguuugaaucaacauacaggggcgccaaacgaauggcuauauuaggggagaccgcaugggauuuuggaucaguagguggacuuuucacaagccuugguaaagcuguucaccaaguuuuuggguccguauauaccacaauguuugguggggucaguuggaugauaagaauacugauaggauuauugguucuguggauaggcaccaacagucgaaauacuagcauggccaugacaugcauagccguaggagguauaacauuguuucuuggguucacagugcaggcggaugugggauguguuguaucguggucuggacgggaauuaaaauguggaucagguauuuucguuguagauaacguccauacauggaccgaacaauacaaguuucaacccgagucgccugcucgucuugccagcgcgauuuugaacgcacauaaggaugggguguguggcauucgaucgacuacuaggcuagagaacgucauguggaaacaaaucacuaaugaauugaacuacguccuaugggaaggcggucaugauuuaacaguggucgcaggagauguaaaagguguacuuacgaaagggaaacgggcucuuacucccccagucagugacuugaaauauuccuggaaaacguggggcaaagcaaaaauuuuuacaccagaagcucggaacucaacguuuuuaaucgacgguccagacaccagugaauguccuaacgagcggagagcauggaacagcuuagaaguagaggauuauggauuuggaauguuuacgacaaacauauggaugaaauuucgagagggaucuagugagguuugugaucauaggcugaugagcgcugcuauaaaagaccaaaaagcuguacaugcugauaugggcuauuggauugaaucuagcaagaaccaaaccuggcaaauugagagagcauccuuaauagaaguaaagacuugucuauggccaaaaacacauacacuguggucaaauggaguguuagaaucacaaaugcuuauaccgaaguccuaugcagggcccuuuucccaacacaacuaucgucaaggauaugcaacucagacaguuggaccuuggcacuugggaaaacucgagauagauuucggggagugcccaggcaccacuguaacuauacaggaagauugugaccaucgaggaccuuccuuaaggacaacaacagccucaggcaaacucguuacucaguggugcugcagaagcugcacaaugccaccauuacgauuccuuggagaagauggguguugguauggcauggaaauaagaccuuuaagcgaaaaagaggaaaauaugguaaaaucacaaguuacugcgggccagggaacaagcgaaacuuucucaaugggccuacuuugcuuaacacuuuucguggaagaaugucuaaggagacgaguaacuaggaaacauaugauauuagccguaguaauuacacuaugugcgauaauauugggaggucugacuuggauggaccucuuaagagcucuaauuaugcuuggcgacacgauguccggaagaaucgguggacaaacacaucuggcgauaauggcaguauuuaaaaugagcccaggauaugucuugggugucuuuuuaaggaagcucaccucgcgagagacagcauuaaugguuauaggcauggcaaugacaaccacgcuaucaauaccccacgauuuaauggaacuuaucgaugggaucucguuagguuuaauauuacuaaaaauuguaacacaauucgauaauacgcaaguaggaacguuggcauuaagucuaacuuuuauacgaaguacgaugagccucguuauggcauggcguacuauuauggccgugcuguuuguuguaacauuaaucccauuaugcagaacuucuugccuacaaaaacagucacacugggucgaaaucacugcacuuauuuugggcgcucaagcucugcccguauacuuaaugaccuuaaugaaaggagcuaguagaagaagcuggccauuaaacgaaggaauaauggcugugggcuuaguaucuuuauuagguucggcauuguugaaaaacgacguaccgcuagccgguccuaugguagcagggggacucuuacuggccgccuacguuaugucgggaucgucggcagaucugucucuagaaaaagcagcuaauguacaaugggacgagauggcagauauaacaggcaguaguccaauaauagaaguaaagcaggaugaagacggaucauuuucuauaagggaugucgaggaaaccaacaugauaacacugcuaguuaaauuagcgcugauuacagucaguggauuguauccucuagcaaucccuguaacgaugacacugugguauauguggcaaguuaagacucaacgcucaggugccuuaugggaugucccaucgcccgcugcaacacaaaaggcggcacuaagugagggcguuuacagaaucaugcaaagaggauuguucgguaaaacgcaaguaggcguugguauacauauggaagggguguuccacacuauguggcauguuacgcgaggaucagugaucugucaugagacagggcguuuagagccaaguugggcggaugugcggaacgacaugauuucguaugguggcggguggcgacugggagauaaaugggacaaagaagaggaugugcaaguccuugcgauagaacccggcaaaaaccccaaacauguucaaacgaaaccaggacuauuuaaaacguugacuggugaaauaggagccguaacauuggauuuuaaaccaggaaccagcgguucaccgauaauaaacagaaaagguaaaguaauagggcuauacggaaaugguguagugaccaaaaguggagauuauguaagugcaauuacacaagcagaacgaauuggugagcccgauuaugaaguagaugaggauauauucaggaagaaacgucuaacuaucauggaucuacauccuggugcaggcaaaacuaaaagaauacuaccuagcauaguucgagaggcuuugaaacgccgucuacgaaccuugauacuagcaccuacuagaguaguggcagcagaaauggaagaagcacuucgaggucugccaauuagauaccaaaccccagccguuaaaagcgaacauacaggaagagagauaguugaccucaugugccaugcaacuuuuacaacaagauugcucaguagcacuagagugccuaauuauaaucuuauuguuauggaugaagcucacuuuacagacccaucaucaguggcagccagggguuauauuagcacaagaguggagaugggcgaagccgcagcgauauuuaugaccgccacuccaccaggagcgacggaucccuuuccucaauccaauaguccgauugaagacauagagagagaaauaccagaacggagcuggaacacuggauuugacuggauaaccgacuaccaaggaaagacagucugguuugucccaucgauaaaggcuggaaaugauaucgcaaacuguuugcgcaaaagcgguaagaaaguaauacaauuaucgaggaagacuuuugauacugaguauccaaaaacuaaacuaacugacugggauuuuguagugaccacugauaucucagaaaugggggcuaauuuuagagccggacgaguuaucgacccaagaagaugucuuaagccugucauauuaacagacgguccagagaggguaauucuagccgggccaauaccaguaaccccagcuucagcugcccaaagaagaggacggauaggaaggaacccggcccaagaggacgaucaauaugucuucucaggugacccacucaaaaaugaugaggaucacgcccacuggacagaagcaaaaaugcuccuagacaacaucuauacaccagaaggaauaauacccaccuuauuugggccggaacgggagaaaacacaagccauagacggggaauuuagacuaagaggggaacaaagaaaaacguuuguagaacugaugcgaagaggugaccuaccgguauggcuuaguuauaaagucgcgagcgcugguaucagcuauaaagaucgagaaugguguuuuacaggagaaagaaauaaccaaauucuggaagaaaauauggagguagaaauauggacaagagaaggggagaagaagaaacuacgcccacguuggcuagaugcuaggguauaugccgacccaauggcauuaaaagacuuuaaagaguuugccaguggacgaaaaucaaucacauuagauauacuaacugaaauugcaaguuugccuacauaucuuuccagcagggcaaaauuggcuuuggacaauaucgugauguuacauacaacugaacguggagguagagcauaucaacaugcccuuaacgaguugccagaaucccuggaaacgcucauguugguggcauuacuaggugccaugacggccggcauauucuuguucuucaugcaaggcaaagguauaggaaaauuaaguaugggacuaauuacaauagcgguagcaaguggauuauuguggguggcagagauccaaccgcaauggauagcagcaagcauuauacuagaguucuuucuuaugguacuacuuauaccagaaccagaaaagcaacguacgccccaggauaaccaauuaauauaugucauuuuaaccauuuuaacaauuauaggacuaauagcagccaacgaaaugggauuaaucgagaaaacaaaaacugauuuuggauuuuaccaaguaaaaacggagacaacgauacuggauguugacuuacgaccggcuagugcauggacacuauacgccguggcuacgacaauauugacuccaaugcuuagacauacaauagaaaacacgagugccaaccugagucuagcagcaaucgcuaaucaagcagcuguauuaaugggcuuagguaaaggauggccacuacauagaauggaucuaggggucccucucuuagcuaugggaugcuauagccaaguuaaucccaccacacuuacagcaucauuaguaaugcuucuuguacauuaugcgauaaucggaccagggcuacaagcgaaagcaacaagagaagcucaaaaacgcacagcagcaggcauaaugaaaaacccaacggucgauggcauaacgguaauugaucuugaaccuauaaguuacgacccaaaauucgaaaaacaacugggucaaguuaugcuucucguuuuaugcgcuggucaacuucuauuaaugcguacaacaugggccuucugugaaguacugacuuuagcaaccggucccauacucaccuuaugggaagggaaucccggucguuuuuggaauaccacuauugccgucucaacagcaaauaucuuuagagguaguuacuuagcaggagcagggcuggccuuuagcuuaauaaagaaugcucagacaccaagaagaggcacggguacaacaggagaaacacuaggcgagaaauggaaaagacaauuaaacagcuuagaucguaaagaauuugaggaauauaaaagaucagggauacuagagguagacaggacugaagcgaaaucugcuuuaaaagauggcuccaagauuaaacacgccgugucuagagguuccagcaaaauccgauggauaguugaacgaggaauggucaaaccaaaaggcaaaguaguagauuuggggugugguaggggagguugguccuacuauauggcuacucugaagaacgugacagaagucaagggauacacgaaaggcggcccaggacaugaagaaccaauaccaauggcuacauauggauggaaucuagucaaacuacacagcggaguugacgucuuuuauaaacccacugaacagguggacacucuuuuaugcgacauuggagagucaagcagcaacccaacuauagaagaagggcggacacuaaggguauuaaagauggucgaaccauggcuaucaucuaaaccagaguucuguauaaaaguccuuaacccguauaugccaacagugaucgaagaacuggaaaaacuucagcgaaaacacggaggaaauuugguuagaugcccccucucaagaaauucaacucaugagauguauuggguuucuggagcgucuggaaauauaguaaguucuguuaacacaacuagcaaaauguuacuaaaccgcuucaccacuaggcauagaaaaccuacuuaugaaaaggacguugacuuaggugcugguacacgaaguguaucuacagaaacagaaaaaccugacaugacuaucauaggcagaagauuacaacgccuacaagaagaacauaaggaaacauggcauuaugaccaagaaaaucccuauagaacaugggccuaucauggcucguaugaggccccgucaacgggaucagcuucaaguauggucaauggaguuguuaaguuacucacgaaaccaugggauguaauucccaugguaacucagcuagcaaugaccgauacuaccccauuugggcaacaacgaguauuuaaagaaaaaguagauacucgaacaccucaaaguaaacccggaaccagaaugguuaugacaacuacugcuaacugguuaugggcauuauuagggaagaaaaagaaucccaggcuauguaccagagaagaguuuauuuccaaaguacgguccaacgcugcuauaggagccgucuuccaggaagaacagggauggacgagcgccagcgaggcaguuaaugauagucguuuuugggaauuaguggacaaagaaagggcguuacaccaagaagguaaaugugaaucauguguuuacaacaugaugggaaaacgugagaagaaauugggagaguucgggagagcaaaagguucccgagcaaucugguauaugugguuaggggcucgauuucuagaguucgaggcacuugguuucuuaaaugaggaucacugguucggacgcgagaauaguuggucagguguugaaggagaaggauuacacagauuaggauacauuuuagaggaaauugauaagaaagacggggauuuaauguaugcggaugacacggcaggcugggacacgcgaauuaccgaggaugaucuucaaaacgaagaacuuauaacagaacaaauggcgccucaucacaaaauccuugcuaaggccauauuuaaauuaaccuaccaaaauaaaguaguaaaaguacuaaggccaaccccaagaggagcuguaauggacauaauaucaaggaaagaucaaagaggaucagggcaaguagggaccuacggauuaaauacuuucacaaauauggagguacaauugauaaggcagauggaggcugaaggcgucauaacgcaagaugauaugcagaacccgaagggucuaaaggaaagaguggaaaaaugguugcgggagugcgguguggauagacuaaaaagaauggcuauaucaggcgaugacuguguggugaaaccucuagaugagcgcuucgcuaccucuuuauuauuccuaaacgauaugggaaaaguaaggaaagacauuccucagugggagccgucgaaaggauggaaaaauuggcaagaagucccauuuuguagucaccauuuccauaaaaucuuuaugaaagauggaagaucacuugugguaccuugccggaaucaagaugaacuaauaggacgagcaagaauaagucagggugcagguuggagcuuaagagagacugcuugccuugguaaagcauaugcacagauguggucccuaauguauuuucaccggcgagauuuaaggcuugcaagcauggcuauaugcucggcaguaccuacugaaugguucccuacaucgagaacgacauggucaauacaugcacaucaccaauggaugaccacagaagacauguuaaaaguguggaauagaguauggauagaggauaaucccaacaugauagacaaaacaccuguacacagcugggaagauauuccguaccuaggcaagagagaagaucuguggugugggagucugaucggauugucaucaagagcaacaugggcgaaaaacauucauacugcuaucacucaaguucgaaaccugauagguaaagaagaauacguugauuacaugccaguaaugaagcgauauagugcuccgagcgagaacgagggcgucuuauag

SEQ ID NO: 23638 - RNA, 9867 nt, Artificial Sequence
  derived and/or modified CDS sequence (opt6) from DENV-4__FJ639764__SS-prME
ucuacgauaacucuauuaugucugauaccaacagucauggcuuuccaucugucaacuagagauggagaaccacuaaugauaguugcaaaacaugaaagaggacggcccuuacucuuuaaaacuacggaagggaccaacaaauguacuuugauugcuauggaucugggagaaaugugugaagacacgguuacauacaaaugcccccuauuaguaaauacugaaccugaagacauugacugcuggugcaaucucacgucaacauggguuauguaugggacauguacacaaagcggagaacggagaagagaaaaacguaguguagcucuaacuccacauaguggaaugggauuagaaacacgugcugaaacauggaugaguucggaaggagcuuggaaacacgcacaacggguagaaagcuggauacuacguaacccugguuucgcuuuauuggcaggauuuauggcauacaugaucggacaaacuggaauccaacgaaccguauuuuucguccugaugauguuaguagcaccauccuacgguaugcggugcguaggaguuggcaaucgcgacuuuguugaagguguaucagguggagcuuggguggauuuaguauuagaacauggcggcugcgucacuacuauggcucaaggaaaacccacucuggauuucgaacucacuaaaacaacagccaaagaaguagcucuacuacgcacuuauugcauugaagcucuaauaucaaauauuacaacugccacuagaugccccacgcaaggagaaccuuauuuaaaagaagaacaagaccagcaguauauaugccgacgugauguuguggaccgagguugggguaauggcugcgggcuguucggcaaagguggaguaguaaccugugcuaaauuuucaugcuccgguaaaauuacuggcaauuuagugcaaaucgaaaaccuagaauacacgguugugguaacgguacauaacggagacacacaugcagugggaaacgauacauccaaucaugguguaacugcgaccauuacaccccgaucuccgaguguggaggucaaauugccugauuauggggaacuaacgcuugauugugaacccagaagcgggauagacuuuaaugaaaugauccuuaugaaaaugaagaagaaaacguggcuaguacauaaacaaugguuccuugaucuaccacuaccauggacagccggugcugacacaagugagguccauuggaauuauaaagaaagaaugguuacuuuuaaagucccacacgcuaaaagacaagacguuacuguauuaggaagccaagaaggugcuaugcauucagccuuggcaggagcgacagaagucgacucuggagauggaaaccauauguuugcaggccaucuaaaauguaaagugagaauggaaaaauugaggauaaaaggcauguccuauacgauguguucuggcaaauucaguaucgacaaagaaauggcggagacacaacaugggaccacuguaguaaaaguuaaauaugaaggagcaggggcccccuguaaaguuccgauagaaauaagagacgucaauaaagagaagguuguagggagggugauuaguucaacaccccuagcagagaacacaaauucaguaacuaacauugaguuggaaccuccauuuggcgacucguauauuguaauagguguagguaauagugcacuaacuuugcacugguuuagaaaagguuccucuauaggaaaaauguucgaaaguacauaccgcggggcaaaaaggauggcaauuuugggcgaaacugccugggacuuuggcagugucggaggucuauuuacaagucuagggaaggcaguacaccaagucuuuggaaguguuuauacaaccauguuugguggcguaucuuggaugauaagaauuuuaauaggguucuuaguucuauggauuggaacaaauagcagaaacacaaguauggcuaugaccugcauagcgguagguggcauaacacuguuccuuggauuuacagugcaggcugauaugggcugcgugguaucauggucuggcagagaauuaaaaugcgguucgggcauauuuguaguagauaauguacauacuuggauagaacaauacaaauuccaacccgaaucgcccgcuagauuagcuagcgcgauacuuaacgcacacaaagacggaguaugugguauaaggucaacaacucgguuagaaaacgugauguggaaacaaauaacaaacgaacuaaauuauguucuaugggaagguggucacgacuuaacuguuguggcuggagacgucaagggaguuuugacuaaggguaaaagaacauuaacacccccuguaucugaccuaaaauauucuuggaagacauggggcaaagcaaagauauucaccccagaggcacguaauucuacauuccuaauagaugguccagacaccagcgaaugcccaaacgagagaagggcauggaacucgcuagaaguggaggacuauggauucggaauguuuacaacaaauauuuggaugaaguuuagagagggaaguagugaaguaugugaccaccgucugaugucugcggcaauuaaagaccagaaagcagugcaugcugauauggguuauuggauagaauccagcaaaaaucaaacauggcaaauugaaagagcgucgcuaaucgaagucaaaaccugucuauggccuaagacccauacauuauggagcaacggaguccuugaaagccaaaugcuuauaccuaaaucguacgcaggaccuuuuagucagcauaauuauagacaaggauacgcuacccaaacaguuggaccuuggcacuuaggaaaguuagaaaucgauuuuggggagugcccuggaacaacagucacaauacaagaggacugcgaucaccguggaccgucgcuacgaaccacaacagcgucuggcaaguuaguuacacaaugguguuguaggaguuguacgaugccgccauuaagguuccuuggggaagacgggugcugguacggaauggaaauaaggccucugucggaaaaagaggagaauaugguaaagagucagguaacagcaggacaagguacaucagaaaccuucuccauggguuuacuaugucuaacuuuauucguggaagaaugucuuagacgacgggucacacguaaacauaugauacuagcaguaguaauuacauugugcgccauaauacugggaggacucacauggauggaucuccuaagagcgcuuauuaugcuuggcgauacaaugaguggccgaauaggaggacaaacccauuuagcaauaauggcaguauuuaaaauguccccgggguauguauuggguguauuucuuaggagauugacuucucgugagacagcgcuaaugguaauuggaauggcaaugacaacaacuuuaagcaucccucacgaucucauggaauuaauagauggaauaagccuaggauuaauuuuacugaagaucguuacacaauucgauaauacccagguuggaacuuuagcuuuaucauuaacauuuauucguaguacuaugucccuggucauggcguggaggaccauaauggcuguccuuuuuguaguaacauuaauaccucuaugccgcacuucaugcuugcaaaaacaaucacauuggguagaaauaacggcacuuauucuaggugcucaagcauugccaguuuauuuaaugacauuaaugaaaggagcgucaagacgcuccuggccucuaaacgaaggaauuauggcgguugggcucguaagccuccuagguagcgccuuacucaaaaaugacgugccucuagccggcccaaugguggcuggaggauuauuguuagcugcauaugucaugagugguucaagugcugacuuaucgcuagaaaaagcagcuaacguacaaugggacgagauggcugauaucacugguaguucaccuauuauugaaguuaagcaagaugaagauggaaguuucucgaucagagacgucgaagaaacaaacaugauaacguuacuggucaaacucgcccuaauaaccguaucuggauuauacccuuuagcgaucccuguaacgaugacucuaugguauauguggcaaguaaaaacgcaacggagcggggcucuaugggauguaccaagccccgcugcuacgcagaaagccgcauuaucagaaggcguuuaucgaauuaugcagagggggcuguuuggcaaaacucaagugggagucggaauccacauggaagggguguuccauacuauguggcacguuaccagaggaucagugaucugucaugaaacugguagacucgaaccaagcugggccgaugugcgaaacgauaugauaucauacggagguggguggaggcugggugacaaaugggacaaggaagaggacguucaaguuuuggccguugaacccggaaagaauccaaaacauguacaaacgaaaccaggucuauucaagacgauaacuggggaaauuggugccguaacacuagacuucaaaccaggaacuuccggaucaccaaucauuaaccgcaagggaaaaguuauuggccuauacggaaaugguguaguuacgaagucaggagacuauguuucagcaauaacucaagcugaacgaauaggggaaccagacuaugaaguagaugaagacauauuuaggaagaaacgauugacuauaauggauuugcauccgggcgcagguaagacuaaaagaauacuuccaucaauaguucgugaagcacuaaaaagaagguuaaggacucuaauacuggcaccgacgagaguuguagcagcugaaauggaggaagcacuacguggcuuacccauacgauaucaaacacccgcagugaaaucugagcacacagguagagaaauugucgauuuaaugugucacgcaacauucacaacacgauuauugaguucaacucguguuccaaauuauaacuuaauugucauggacgaagcgcacuuuacugaucccaguaguguagcagcgagaggauauauaagcacucgugucgaaaugggagaagcagcagcaauauucaugaccgcuacaccaccuggggcuacagauccguuuccucaaucgaauagcccaauagaagacaucgaaagagaaauuccagaacggucuuggaauacuggcuucgacuggauuacagacuaucaaggaaagacaguuugguuuguaccaaguauuaaagccgguaaugacauagcaaauugccuaaggaaaucaggcaagaaagucauccagcuuaguaggaaaacauucgacacagaguauccaaagacaaaacugacagauugggacuuugucguaaccacagauauaucugaaaugggggcaaacuuucgagcuggacgaguaauagaucccagacgaugccuaaaaccaguaauauugaccgacgguccugagcgaguaauacucgccgguccuauaccagugacuccggcaucggcagcccagagacgaggaaggauaggacguaacccugcacaagaagacgaucaauauguuuucucuggagauccguuaaagaacgaugaagaccaugcacauuggacugaggcuaaaaugcuauuagacaauaucuauacaccagaagguauaauaccaacguuauuuggacccgagagagagaaaacgcaagcaauagauggagaauuucguuuaagaggugaacagagaaaaacauuuguagaacucaugcgacgaggugaucuuccagucugguuaucuuacaaaguugccagugcgggaauaagcuauaaagauagagaguggugcuuuacaggcgaaaggaauaaucaaauacuugaagaaaacauggaaguagaaauuuggacuagggaaggagagaagaagaaauugcgaccaagauggcuugaugcaagaguauaugcugauccuauggcuuuaaaagauuucaaagaguucgcauccgggcgaaaaucgauaacacuagauauuuuaacugaaauagcuuccuuaccgacauauuuguccaguagggcuaaauuagcauuagauaacaucguuaugcuucacacgacggaacgcggcggucgcgcuuaucaacaugcccuuaaugagcuaccagaauccuuggaaacccucauguuaguagcucuauuaggggcaaugacagcaggaauauuccuuuucuucaugcaagggaaggggauuggaaaauuaucuaugggauuaaucacuaucgcuguagcuagcggccuguuguggguggcagagauccagccacaauggauagcagccuccauaauuuuagaguucuuccucaugguauuauuaaucccugaaccagagaaacagaggacaccgcaagauaaucaacuaaucuacgugauucuuacuauauuaaccauaauuggucucauagcggcaaaugaaaugggccuuauagaaaagacaaaaacugauuuuggauucuaucaagugaaaacugaaaccacgauauuagauguugaucugaggccugccagcgccuggacauuauacgcuguugcaacuacuauacugacuccaaugcucaggcacacgauagaaaauacaagugcuaaccuaagucuugcugccauagcuaaccaagcugcgguauugaugggacuaggaaaaggcuggccgcuucaucgcauggaucucgguguaccucuauuagcuaugggcuguuauucccaaguuaauccaacaacucucacagccagcuuagugaugcuauuaguacacuaugcuauuaucgggcccgguuugcaagcgaaagcaacccgagaggcucagaagcguacggcugcuggcauaaugaagaauccaacaguagaugguauaacuguaauagaucucgaaccaauuuccuacgaucccaaauucgagaagcaauuaggacaaguaauguuacucguccucugugcagggcaguugcuacuuaugagaacaacgugggcauucugugaaguacuuacucuugcgacuggacccauuuuaaccuuaugggagggcaauccagggcgauucuggaacacgacaauagcaguaucuacugcaaacauauuuagaggcucguauuuagcgggggcaggucuagcuuuuaguuugauuaaaaaugcacaaacaccuaggagggguacggguacuaccggcgaaacacucggggaaaaguggaagagacaacuaaauaguuuagauaggaaggaguuugaagaauauaaacgaagcgguauacuggaaguagauagaacggaagcaaaaagcgcacuaaaggaugguucaaagauaaagcaugcgguaagccgagguucaucuaaaauaagauggauagucgaaagaggcaugguuaaaccuaaagggaaaguaguggacuuaggguguggccgcggagguuggucguauuacauggcgacauugaaaaacguaacagaagucaagggguauaccaaaggaggaccuggccacgaagaaccuauuccgauggcaacauacggauggaaucuagucaaauuacacaguggagucgauguguuuuacaaaccaacugaacagguugauacacugcuuugcgacauaggggaaaguuccucaaauccaacaauugaagaagguagaacccuaagaguacuuaaaaugguugagccgugguuaucaucuaaaccggaguucugcaucaaaguuuuaaacccguauaugcccacuguaaucgaagaacuugagaaacuucaaagaaaacauggugggaaucuaguacgauguccauugucucgcaauucaacucaugaaauguauugggugaguggggcaucagggaauaucgugucaagcguaaacaccacaaguaaaaugcuuuuaaacagguucacgacucgacaccgcaagccuacauaugagaaagaugucgauuuaggugcuggcacacgcuccguaucgacggaaacugaaaaaccugauaugacgauaaucgggagacgacuucaaagacuacaagaagaacauaaagaaacuuggcacuacgaccaagaaaaucccuacaggacaugggcauaucaugguucauacgaagcaccgucuacggggucugccaguucgaugguaaacgggguuguaaaguuacuaaccaagccaugggauguuauuccaauggugacacaacuggcgaugacagauacuacuccauuuggccaacagcggguauuuaaagagaaaguggauacucguacaccacaaccuaagccuggaacuagaaugguaaugacaaccacagcaaauuggcucugggcauuacuuggcaagaagaaaaacccaagacuguguacacgagaagaauuuauaucuaaaguuagaaguaaugcugcuauaggagcuguuuuucaagaggagcaagguuggacgucagcaucagaagcuguuaaugauagccguuuuugggaauuaguagauaaagaaagagcauuacaucaagagggcaagugugaaucuuguguuuauaacaugaugggcaaaagagaaaagaagcugggagaauuuggaagggcaaagggaucgcgggcaauaugguauaugugguuaggagcccgauuucuugaauuugaagcgcuaggguucuuaaacgaagaucauugguucggucgugaaaauucauggaguggcguagagggugaaggacuucauagguuaggcuauauacuugaagaaauugacaaaaaggauggugauuuaauguaugcagacgacacugcagggugggacacgcguauuacagaagaugauuuacaaaaugaagaacucauuacagaacaaauggccccucaucacaagauacuagcgaaagcgaucuucaaacuaaccuaccaaaacaaaguaguaaaaguguuaaggccaacccccagaggcgcgguaauggauauuauaucgcgcaaagaucaacgaggaucuggucagguagguacuuacggauuaaacaccuucaccaacauggaaguccaacucauucgccaaauggaagcagaaggaguaauaacccaagaugauaugcaaaauccuaaagguuuaaaggaaagaguagaaaaauggcuccgagaauguggaguagauagacuuaagcguauggcaauuucuggggacgauuguguaguaaagccauuagacgaacgauucggaaccagucucuuauuuuuaaacgauaugggaaaggugcguaaggauauaccccaaugggaaccaagcaaaggauggaaaaauuggcaggagguuccguucuguucucaccacuuccacaagauauucaugaaggauggacgaaguuuaguagugccauguagaaaucaagacgaauuaauaggcagagcacgaauaagccaaggggcaggauggagccuaagagagaccgccuguuuaggcaaggcuuaugcucaaauguggucacuuauguacuuccacagacgggaccuacguuuagcaaguauggcaauauguucagccgugccaacagaaugguucccuacuagccguacuacuuggaguauacaugcccaucaccaauggaugacuacggaagauauguuaaaaguuuggaauagaguguggauagaggauaaucccaauaugauugacaagaccccuguacauucaugggaggauauaccauauuuaggcaaaagagaagauuuauggugugguucuuuaauuggauuaaguaguagagcgacuugggcgaaaaauauucacacugccauuacacaaguuaggaaccuuauagggaaagaagaguacguugauuauaugccugugaugaaaagguacucugcgccaucagaaucggagggaguacuguaa

SEQ ID NO: 23639 - RNA, 9867 nt, Artificial Sequence
  derived and/or modified CDS sequence (opt6) from DENV-4__FJ639773__SS-prME
ucaacaauaacccuuuuaugucuuauuccaacugugauggcguuccacuuguccaccagagacggggaaccacuaaugauaguagcgaaacaugaaagggguagaccucuucuuuuuaaaacaaccgaagguauuaacaaaugcacauuaaucgcaauggacuugggggaaaugugugaagacacgguuacauauaaauguccgcuauuaguuaauacagaacccgaagauauagacugcugguguaaucugacuuccacuuggguaauguacgguacuuguacgcaaucgggggaacgacgacgcgagaaaagaucuguggcauuaacaccucauucuggaaugggacuagaaacgagggcggaaaccuggaugucuucagaaggagcuuggaaacacgcacaaagaguagaaucauggaucuuaagaaacccaggauucgcgcuacuugcuggauuuauggcauauaugauaggacaaaccggcauucaaagaacuguauuuuucguguuaaugaugcuuguagcuccuucuuacgggaugcggugugucggaguaggaaauagagauuucguagaaggagugaguggaggagcauggguagaucuaguguuggaacauggagguugcguuacuacgauggcucaaggaaaaccaacguuagauuucgaauuaacuaaaacaacagcgaaagaaguggcuuugcuuaggacauauugcauugaagcgcugauaucgaauauaacaaccgccacacguugcccaacccaaggcgaaccguaucucaaagaagaacaagaccaacaauacauuugccgaagggacguuguugauagagguuggggcaacgguugcgggcuuuucggaaaaggcggcgucguuacaugugcaaaauucucguguucaggcaaaauuaccgguaauuuaguucagauagaaaaucuagaauacacugucgucgucacgguucacaauggugauacucacgcaguggguaaugauacuucgaaucauggugugacggcaaccauuacuccccgguccccuucaguagaaguaaaauugccagacuauggagaacuaacauuggacugcgaaccaagaucaggaauagauuuuaacgaaaugauacuaaugaaaaugaagaagaaaacguggcugguacauaaacagugguuucuagaucuuccccucccauggacaacaggagcagauacaucggaaguccauuggaauuacaaagagagaauggucacuuuuaaaguaccacacgcaaaacggcaagauguuaccguauuggguagucaagaaggcgcuaugcauagugcucucgcuggugcgacggaaguugacucuggugacgguaaucacauguuugccggacauuuaaaaugcaaaguuagaauggaaagauuaaggauaaaaggcauguccuacacuauguguucaggaaaauuuucuauugacaaagaaauggcagaaacacaacacgguaccacaguggucaagguaaaauaugaaggagccggggcaccauguaaaguaccuauagaaauucgcgaugucaauaaagaaaaagucgugggccgagucauaagugcaacuccacuggcagaaaauacuaauuccguuaccaacaucgaacuagaaccuccauucggagauaguuacaucguuaucgguguaggaaauucagccuuaacucuucauugguucagaaaaggaucaaguauaggcaaaauguuugaaucaacauaucguggagcaaaacgaauggcaauuuuaggagaaacagcuugggauuucgggucggucgggggcuuauucacaagccuuggaaaagcgguacaccaaguuuuuggauccguuuauaccacuauguucgggggaguaaguuggaugauacguauacucaucggguuucugguccuguggauaggcacaaauucuagaaauacgaguauggcuaugacuuguaucgcaguuggaggaaucacucuuuuccucggcuuuaccguacaagcagacaugggaugugugguuucauggucaggucgagaguuaaaaugcggcucaggaauauuugucguagacaaugugcacacuuggacagaacaauacaaauuucagccagaaagcccugcaagacuggcuagugcgauacucaaugcccacaaagacggaguaugugguauaaggaguaccacacgacuagaaaacgucauguggaaacaaauaacaaacgaauuaaauuauguauugugggaaggcggccacgaucuaacugucguggcuggagauguuaaaggcguccugacgaaaggaaaaagggcguugacacccccugcauccgacuuaaaauauucguggaaaacaugggguaaagcaaaaauauuuaccccagaagcgagaaauaguacauuucuaauagauggaccagacacaucugaaugcccuaaugaacgacgugcauggaacucuuucgaaguggaagauuaugguuucgguauguuuacuacgaauauuuggaugaaauucagggaaggauccucagaagucugcgaucaccgacuaaugagcgccgcuauuaaagaccaaaaagcaguacaugcagacaugggcuacuggaucgaaucuagcaaaaaccaaacauggcagaucgagagagcauccuugaucgaaguaaagacaugucuauggccuaaaacacacacauuaugguccaaugguguuuuagaaucccaaaugcuaauaccaaaaagcuacgcuggcccauucagccaacacaacuaucgucaaggauacgcgacucaaacugucgggccauggcauuugggcaaauuagaaaucgauuuuggugaaugucccggaaccaccgucacaauacaagaggacugcgaucaucgagguccuagccuuagaacuacaacagcuaguggaaagcuaguaacacaaugguguugcagaagcugcacuaugccaccucugagauuuuuaggcgaggauggaugcugguacgguauggaaauuaggccacucucagaaaaagaggaaaauaugguuaagucccagguaacagcugggcagggaacaucagaaacauucucaaugggucuuuuaugucuaacuuuauuuguugaagaaugucucaggagaagggugacacggaagcacaugaucuuggcugucguaauuacccucugugcaauaauucuuggaggccugacguggauggaucucuugcgagcuuugauaaugcuuggcgauacaaugagugggaggaucggcggccagacucaucuggcaauaauggcuguguucaaaaugucuccgggauacguacuaggaguguuccuccgaaaauuaacaagucgagaaacggcauuaaugguaaucggaauggcuaugacaacgacauuauccauaccgcaugaccuuauggaguuaauugaugguauaucuuugggacuaauccuucucaagauaguaacucaauucgauaacacucaagucggaacucuugccuuaucccuuacauuuauacgaucuacaaugagcuuaguaauggccuggagaacaauaauggcgguauuauuuguuguaacacuuauaccucucugucgaacuucaugcuuacagaagcaaagucacugggucgagaucacugcauuaauacuaggagcccaagcacugccuguuuacuuaaugacuuugaugaaaggugcaucccgaagaucauggccacugaaugagggaauaauggcuguaggccuagugagccuacuuggaagcgcucucuugaaaaaugacgucccauuagcuggaccgauggucgccggaggcuuauuacuagcggcauauguaaugaguggaaguagugccgaucuaucuuuagaaaaagcugcgaacgugcagugggaugaaauggccgauauuaccgggucuuccccaaucauagaggucaagcaagaugaggaugggaguuucucaauaagggaugucgaagaaacaaacaugauaacucugcuagucaaacucgcacuaauaacaguaagcgguuuauauccuuuagcaaucccuguuacaaugacucuaugguacauguggcaagucaaaacucaaagaagcggugcuuuaugggaugucccgagcccagcaacuacucaaaaagcugcucuaucggagggugucuauagaauuaugcaacgcggcuuguuuggaaaaacccaaguuggaguagguauccauauggaaggaguauuucacacaauguggcaugugacacgaggaucggugauaugucacgaaacaggaagacucgaaccaucgugggcagaugugcgaaaugauaugauuucauauggcggaggcuggagacucggagauaagugggauaaagaagaagaugugcaaguuuuagcgauagaaccuggcaaaaauccaaagcaugugcaaacuaaacccggccuguuuaagacacucacaggcgaaauaggagccgugacuuuagacuucaaaccuggcacaagcggcuccccuauuaucaaucguaaagggaaaguaauuggguuauauggaaauggagucguaacaaaaagcggggacuacguuucggcuauuacucaagcagaaaggauuggugaaccugacuaugagguugacgaagauauauuuaggaaaaagcgcuugacuaucauggaccuacacccaggggccggaaaaacuaagagaauacuccccaguauuguacgagaagcauuaaaacgacgccuaaggacucuaaucuuagcgccgacaagaguuguugcggcugagauggaagaagcauuaaggggucuaccaauaagauaucagaccccugccguaaaaucagaacauacagggcgugaaauagucgacuuaaugugucacgcuacauuuacaacucgauugcuaucuucgacaagagucccaaacuacaauuuaauaguuauggacgaagcucauuuuaccgacccauccucgguugcagcucgcgguuauauaucaaccagaguugaaaugggugaagcugccgcuauauuuaugacggccacaccuccuggugccacagauccauucccgcagucuaacagcccuauagaagacauugaaagagagauuccagaaagaaguuggaacacaggauuugauuggauaacagauuaucaaggaaaaacaguaugguucgucccaucaauaaaagccggcaacgauauagcaaacuguuuaagaaaaucaggcaagaaagugauucaacuaagucgaaaaacuuuugauaccgaauauccaaaaacaaaacugacugacugggauuucguaguuacuacugauauaucagaaaugggagcgaacuuucgugcugguagggugauugauccacggcgcugccuuaagccuguaauacucacugauggaccagaaagaguaauucuggcugguccuauaccuguuacuccagcaagugcagcucagcgcagagguagaauaggcagaaauccagcucaagaagaugaucaguacguguuuaguggggaucccuuaaagaaugaugaagaccacgcgcauuggacugaagcaaaaauguuacuggauaacauauauacucccgaaggcauuaucccaacucuauuuggaccagaaagggagaaaacccaagccauagauggagaguucagacuacguggagaacagagaaagacguucgucgaauugaugcgaagaggagacuuaccaguuuggcucucauauaaagucgcaagcgcagggauaucauacaaagacagagaaugguguuuuaccggcgaaagaaauaaucaaauauuggaagaaaacauggagguagaaauuuggacuagagaaggcgagaagaagaaauugcgcccaaaaugguuggaugcucgcguguaugcugacccaauggcacuaaaagauuucaaagaguucgcuucaggcaggaagucuauaacauuagacauuuuaacagagauagcgagucuacccacauaucuaucgagucgugcuaaauuagcacucgauaacauagugaugcuccauacaacggagagaggaggccgcgcauaucaacaugcucuuaaugaguuaccugaauccuuagaaaccuuaauguuaguugcuuuauuaggugcaaugacugccggaauuuuucucuucuucaugcaagguaaagggauuggaaaguugaguauggggcuuauaacaauugcgguagcuuccggauuguuauggguugccgaaauacaaccacaauggauagcugccucaaucauauuagaguucuuccuaauggucuuauugauaccagaaccugagaaacagaggacaccucaagacaaucaacuaauauauguaauacuuacaauauuaacuauaauuggccuaauagcugccaaugaaaugggcuuaauugaaaagacuaaaacggauuuugguuuuuaccaagagaaaacagagacaacaauccuagauguggauuugcgcccagcauccgccuggacguuauaugcugucgcgacuaccauucuuacgccaaugcuaagacauacaauagaaaacacaucugcuaaucuauccuuagcugcgauagcgaaucaagcagcaguacugaugggacuaggaaaaggauggccauugcauaggauggauuuaggaguuccguuauuagcuaugggcuguuacucucaaguaaacccaacuacucuaacagcuagcuuaguuauguuauuagugcacuaugcgaucauaggaccaggauuacaggcaaaagccacucgggaagcacagaaaaggacugcagcaggaauaaugaaaaaucccacuguagaugguaucacgguuauugaucuugaaccaauaagcuaugacccaaaguucgagaaacaacugggucaagugauguuauuaguuuuaugugccggacaacuucuacugaugcgaacgacaugggcguuuugcgagguuuuaacuuuggcuaccggaccaauauuaacuuuaugggagggcaacccaggacguuucuggaauaccacaaucgcuguaagcacagcaaacaucuuuagaggcucauaucuagcuggagcagguuuagcauucucacuaauaaagaacgcgcaaacaccgaggagagggacuggaacgacaggcgaaaccuugggggaaaaguggaaaagacaacuaaauucacuggaucgaaaagaauuugaggaauacaagcgcaguggaauauuagaaguagaucggacagaagccaaaucggcauuaaaagaugggucuaaaauaaaacaugcuguuagucgcggaagcucgaagaucagauggaucguagaacgugggaugguaaaacccaagggaaagguaguagacuuaggauguggucgaggcgguuggucauacuauauggcgacucuuaaaaacguaacagaaguaaaaggauauaccaagggcggucccggucacgaagaacccauaccuauggccacauacggauggaauuugguaaaacuacauucaggcguagauguauucuacaagccaacggaacaaguggacacuuuauuaugugacauaggugaaagcuccuccaauccgacuauugaagaagggaggacacuuagaguucuaaaaaugguggagccauggcuuagcucuaagccugaguucugcauuaaagucuuaaaccccuauaugcccacggugauagaagaacuugaaaaacuacaacguaaacauggcgguaaucuaguacgauguccauugucucguaauuccacacaugagauguacuggguuucaggcgcaucuggcaauaucgucaguagcguaaauacuacaucaaaaaugcuauuaaaucgcuucacgacucgacauagaaaaccaaccuaugagaaggacguugaccuuggggccgguaccagaaguguaagcacggagacggagaaaccggauaugacgauuauuggaagacgcuuacaaagguuacaggaagaacauaaagaaacuuggcacuaugaccaggagaauccauaucgcacaugggcauaucacggcagcuaugaagcgccaucuacugguucagcaucgucuauggugaacggaguugugaaacuuuuaacgaaaccaugggauguuaucccaauggugacacaacucgcuaugacugacacaacaccauucggacaacaacgaguuuucaaagaaaaggucgacacuagaacaccacagccaaaaccgggaacccgcaugguuaugacuacgacagcaaauugguuaugggcauuacuugguaaaaagaaaaaucccagacucugcacuagagaagaguucauaucaaaaguacgcucaaaugcggcaaucggagcaguuuuucaagaagaacagggauggacaagugcuucagaagcuguaaaugauucaagauuuugggagcuuguugauaaagaacgugcacuucaucaagaagguaaaugugaaucaugcguauauaauaugaugggcaaacgggagaagaaacuaggugaguucggacgggcuaaaggaucgcgcgccaucugguacaugugguuaggagcaagauuucuagaauuugaagcucuuggauuuuuaaacgaagaucauugguucggucgugaaaacucguggucagguguagaaggugaagggcuucauagauuaggauauauacuagaagaaaucgauaagaaagauggggaccuaauguaugcugacgacacagcagguugggauacacgcauuacugaagaugaucuacaaaaugaggagcucaucacagaacaaauggcaccgcaucauaaaaucuuagcuaaagcgauauucaaacugacuuaucaaaacaaaguuguaaaaguacucagaccaacuccgagaggggcagugauggauauaauaaguagaaaagaccagagaggcagcgggcaaguggggacauaugguuugaacacauuuaccaacauggagguacagcugaucagacaaauggaagcggaaggaguaauaacgcaagaugacaugcaaaauccgaaaggguuaaaagaacgcguagaaaaauggcuccgagaaugugguguggaucgacucaaaagaauggcgauuucaggagaugacugcgucguaaagccccuugaugagagguucggaaccucacugcuauuuuuaaacgauauggguaaaguucgcaaggacauaccacagugggaacccagcaagggauggaaaaauuggcaagaaguaccuuucuguucgcaccauuuucauaaaauauucaugaaggauggccguagcuuagucguuccaugcagaaaccaggaugagcuuauagggagagcucgaauaucucagggugcaggauggucucuccgugaaacugcaugucuaggaaaagcguacgcacagauguggucauuaauguauuuccauagacgagacuuaagauuggcauccauggcaaucuguuccgcgguaccgaccgaaugguucccgacgagcaggacgacauggucuauucaugcucaccaccaauggaugacgacagaggauaugcuaaaaguuuggaauagaguuuggauugaagacaacccaaauaugauugauaaaacgccaguucacuccugggaggauaucccauaucucggaaaaagggaagacuuauggugcggaucccuaauuggguugucaucccgagcaacuugggccaaaaacauacauaccgcuauaacacaaguccgaaacuugauaggaaaagaagaguauguagauuacaugccuguaaugaaaagguauucagcuccgagugaaucagaagguguucucuaa

SEQ ID NO: 23640 - RNA, 9867 nt, Artificial Sequence
  derived and/or modified CDS sequence (opt6) from DENV-4__FJ882580__SS-prME
ucaacgauaacacuuuuaugcuuaaucccaacugucauggcuuuucaccuaucuaccagagacggagaaccuuuaaugauaguugcaaaacaugaaagagggcguccacuuuuauuuaaaacgacagaagggauuaacaaauguacacuaauugcgauggauuuaggagaaaugugugaagacacuguaaccuauaagugcccucucuuaguaaacacugaaccggaagauaucgauugcuggugcaaucuaacgucaaccuggguuauguaugguacauguacccaaaguggugaaaggcgccgagagaaaagaucaguugcauuaacuccgcacucaggaaugggacuugaaaccagggcggaaacguggaugucaucagaaggagcauggaaacaugcucaaaggguugaaaguuggauucuaagaaauccgggguuugcauuacuagcuggcuuuauggcuuacaugauuggacagacgggcauacagagaacgguuuucuucguauugaugaugcuaguugcacccucuuauggaaugaggugugucggugucggaaaccgagauuucguagaagguguaucugguggggcauggguugaucuuguauuagaacacggcggaugugugaccaccauggcccaagggaaacccacauuagacuuugagcugaccaagacaacggcgaaagagguagcacuacuucgaacguauuguauagaagcguuaauaucaaacauaacaacggcuacccgcugcccaacccaaggagagccuuauuugaaagaagaacaagaucaacaauauauaugucgccgugauguuguagauagaggaugggggaacgguuguggcuuguucggcaaagggggagugguaacaugcgcaaaauuuucuuguucaggcaaaaucaccgguaaucucguccagaucgaaaaccuugaauauacagucguaguuacaguacauaauggagauacgcaugcaguagggaacgauacgucaaaccacggcguaacagccacaaucacaccucguucaccaaguguggaaguuaaguugccugacuauggggagcuaacccuagacugugaacccaggucaggaauagacuucaacgaaaugauccugaugaaaaugaagaagaagacuugguuaguucauaagcagugguuccuagaucuaccacuaccauggacaacgggagcugauacgucugaaguacauuggaacuauaaggaacgaaugguaacuuuuaaagugccucacgccaaaagacaggauguaacagucuuaggaagccaagaaggggccaugcacucugcccuagcuggagcgacagaaguagauucaggcgauggaaaucacauguuugcaggacaccugaaauguaaaguccguauggaaaaacuaaggauaaaaggaaugagcuacaccaugugcagugguaaguuuucaauugacaaggaaauggcagaaacccaacauggaacaacgguaguaaaaguaaaguaugaaggagcgggugcaccguguaaagugccaauugagaucagagacguuaauaaagaaagaguagugggacggguaauaucagcaaccccacuagcagaaaauacaaauucggugacaaacaucgaauuagagccacccuucggagacaguuauauuguaauuggcguuggaaauuccgcacugaccuuacacugguuuagaaaaggaagcaguauagguaaaauguuugaaucgacauaucgaggagcaaaacgaauggcuauauuaggugaaacugcaugggacuuuggaucaguagggggacuauuuacuagcuuaggaaaagcuguucaucaaguuuuuggaucaguuuacaccacuauguuugggggcgucucuuggaugauaagaauacugauaggauuuuuaguauuguggaucgggacaaauuccagaaacacguccauggcaaugacaugcauugcgguagggggaaucacgcuauuuuuagguuucaccguacaagcggacauggguugugugguguccuggaguggucgugaacuaaaaugcggcucugggauuuuuguugucgauaacguacauaccuggacagaacaauacaaauuccaaccggaaucuccagcccguuuagcaucagcaauacucaacgcccauaaagauggaguuugcgguauacgcagcacaacucgauuggagaauguaauguggaagcaaauuacaaacgaguuaaacuaugugcugugggaaggaggccacgaucuaacuauaguagcuggagacgucaaagguguauuaacaaagggaaaaagagcauuaaccccgccagcaagugacuuaaaauacaguuggaagacuuggggcaaagcaaagaucuucaccccggaagcgagaaacucgacauuucuaauagauggucccgauacaagugaaugcccuaacgaacguagagccuggaacucuuucgagguugaagauuauggauucgggauguuuacgaccaauauauggaugaaauuccgugagggcaguucagaaguaugugaccaucgguugaugagcgcagcaauaaaagaucagaaggcuguucaugcugacaugggauacuggaucgaaucuucaaagaaucagaccuggcagauagaacgggcaaguuuaauugaaguuaaaacuugcuuauggccuaagacccacacauuauggucaaauggaguucuugagagccaaaugcuaauuccgaaaucauacgcagguccuuucagucagcauaauuacagacaaggcuacgcgacgcaaacuguggguccauggcaucuugguaaacuagagauugauuucggggaaugucccgggacuacagugacaauacaagagaauugugaccacagaggaccgucacuccguacaaccaccgcaucagggaaguuagucacucaaugguguugcagguccuguacaaugccaccguugcguuuucuaggggaggauggauguugguaugguauggaaauucggcccuuaucagaaaaggaagaaaacaugguaaaaagucagguuacggcuggucaaggaacuucagaaacauuuucgauggggcuucucugccucaccuuguuuguagaagaaugccuaagacgaagaguuacaagaaaacauaugaucuuagccguuguaauuacuuugugcgcuaucaucuugggagggcucacuuggauggauuuacuucgagcccuuauuaugcucggugacacaauguccggaaggauugguggacaaacgcauuuagcgauaauggcaguauuuaagaugaguccugguuauguccuagguguuuuccuucgaaaguugacgucaagggagacugcguuaaugguaauaggaauggccaugaccacuacauugucuaucccgcaugaccuuauggaauuaauagauggaauaucauuagggcuaauacuacucaaaauugugacacaauuugauaacacucaggucggaacauuagcacuaucgcuaacauucauaagaucaacaaugucauuagucauggccuggcgaacaaucauggcaguacuauuuguuguuacauuaaucccucucugcagaaccaguugucuacagaaacagucacauuggguugagaucacagcccuaauucuaggagcacaagcacuuccugucuacuuaaugacauuaaugaaaggugccaguagaagaucauggccuuuaaaugaagggauuauggcgguaggguuaguaaguuuauuggggucggcccuccugaaaaaugacguuccacuagccggaccaaugguagcugguggucuacuacuagcagcauacguaaugucugguucauccgccgacuuaaguuuagagaaagcagcaaauguacaaugggacgaaauggcggauauuacaggcuccucaccgaucauagaagucaaacaagaugaagauggcucauuuuccauaagagauguugaggagacaaauaugauaacauuguuagucaaacuagcguugauuacaguaucaggguuauauccacuggcaauaccgauaacaaugacguugugguacauguggcaaguaaagacccagcggaguggagcuuugugggacgugccaagucccgcggcaacucaaaaagcugcauugucagaagguguuuaccguauuaugcaaagaggucucuuugguaaaacccaggucggaguggggauacauauggaaggggucuuucauacuauguggcaugugacuagagguaguguaaucugucacgagacaggucgauuagaaccgaguugggcugauguaagaaaugacaugaucagcuauggaggaggcuggaggcuaggcgauaaaugggauaaggaagaggacguucagguauuagccauugaacccgguaagaaucccaaacacguucaaacuaagccgggauuauucaagacauuaacgggagaaauaggagcugugacucuagacuuuaaaccggguacaucaggaagcccaauuauaaauaggaaaggaaaagucauaggacuauaugguaacgguguuguaacaaaaucaggggauuacgugucugcaauaacacaagccgaacgaaucggagagccagauuacgaaguagaugaagauauauuccggaaaaagagacuaaccauaauggauuuacauccuggcgccgggaaaaccaagagaauuuuaccuaguauagucagagaggcacuaaaaagaagacuccggacauuaauauuggccccuacgagagucguagcugcagagauggaggaagcguuacgagguuuaccaauaagauaucaaacucccgcuguaaaaagcgaacauacuggcagagaaauuguagaucuuaugugccacgcaacauuuacaacccgacuccuaaguuccacucgcgucccaaacuacaaucuaauugugauggacgaagcacauuucaccgaccccucaaguguagcugcgaggggcuauauuucaacccgaguggagaugggagaagccgcagcuauauucaugacggcaacacccccaggugcuacagacccguuuccacaaaguaauucuccaauugaagauauagaacgggaaauucccgaaagaucguggaauaccgguuucgauuggaucacggauuaucaagggaagacgguaugguucguuccgagcauuaaagcggguaacgauauugcgaauuguuuaagaaaaagugguaagaagguaauccagcucucgcgcaaaacauucgauaccgaauauccgaagacuaaacuuacggauugggauuucguagugacaacugauauaucggaaaugggagcuaacuuucgagcuggaagaguuauagauccgcgaagaugucuaaagcccgucaucuuaacugauggccccgaacgagugauacuagcaggcccuauaccaguuacgcccgcaucggcggcacaacgaagggguagaauagggagaaauccugcacaagaagaugaucaauacgucuuuucgggggauccgcucaaaaaugacgaggaccacgcucauuggacggaagcaaaaaugcuucuugacaacauuuauacaccugaagguauuauaccuacguuguuuggcccagaaagagagaaaacucaggcuaucgacggugaauuuagacugagaggugaacaaagaaagacguuuguggaacuaaugaggcguggagaucuaccggucugguuaagcuacaaaguagccucagcaggaauaagcuacaaagacagagaguggugcuucacaggggaacgcaacaaucaaauucuugaagaaaauauggaaguggaaaucuggacucgggaaggagagaagaagaaacuacgaccaaaauggcuagaugcuagaguuuaugcagauccuauggccuugaaagacuucaaagaauuugccagcggaagaaaaaguauuacauuggacauccucacagaaauagcuaguuugccgacguaucuaucauccagagcaaaacuggcacuugauaauauuguaauguugcauacaacagaacggggaggcagagcuuaccaacaugccuuaaaugaacuacccgaaucuuuagaaacauuaaugcugguagcucuauuaggagccaugacugcgggcauuuucuuauuuuucaugcagggaaaaggaauugggaaacugagcauggggcuaauaaccauagcagucgcaucuggucuuuuauggguugcagaaauucagccucaauggauugcagcaagcauaauacuugaguucuuucucaugguucuauuaauacccgaacccgaaaaacaaagaacaccacaggauaaucaauuaauauacguuauuuuaacuauucugaccauaauuggucuuaucgcggcaaacgagauggggcuuauagagaaaacuaaaacagauuucggauuuuaccaaguaaaaacggaaacaacuauauuggaugucgaccuacgucccgcaagcgcuuggacacuguaugcaguagccaccacaauucugacgccaaugcuaagacacaccauagaaaacacuucugcaaauuuaagccucgcagccauagcaaaccaagcagcgguacuuaugggauuggguaagggauggccuuuacacagaauggaucuaggcguuccuuuacuugcgaugggcugcuauucucaaguaaacccaacaacacuaacugcuucauuaguaaugcuauuagugcauuaugcuaucaucgggccaggucuucaagcaaaagcuacucgagaagcacagaaaagaaccgccgcuggaauaaugaaaaacccaaccguagacggcaucacagucauagaucuagagccaauaaguuaugauccaaaguucgagaaacaauuaggucaaguaaugcuauuagucuugugugcaggacaacuguuauuaaugagaacgacaugggcauuuugugagguauugacacuagcuacagggccuauauugacuuugugggaaggcaaucccggaagauucuggaauacgaccaucgcagucaguacugccaacauauuuagaggcucguaucuagccggggccggucucgcauucucauugauuaaaaaugcccaaacaccaagacggggaacugguacuacaggagaaacuuuaggcgaaaaauggaagagacaacuuaauucccuagauagaaaagaauuugaggaauauaaacgaagugguauauuagaaguugauaggacggaagcuaagagugcgcuaaaggauggaucaaagaucaaacaugcagucucuagaggaaguuccaaaauccgauggauaguagaaagagggaugguuaaacccaaggguaaagucguagaucuagguuguggaagagggggcuggucuuauuauauggcuacgcuuaaaaauguaacagagguaaaaggauauacaaaagguggaccaggucaugaagaaccuauaccgauggcaaccuauggauggaaucuaguaaaacuacauucuggcguugacguauucuacaaaccgacagaacaaguggauaccuuauuaugugacauaggcgagucaucaaguaacccaacaauagaagaaggucguacacuucggguuuuaaaaaugguagagccaugguuaucaucgaaacccgaauuuugcauaaagguguuaaaucccuauaugccuacugugauagaagaguuagaaaaacuucaacguaagcaugguggcaacuuaguacgaugcccccuuucgcguaacaguacucaugagauguauuggguaucuggagcaaguggcaauaucguaucuucagugaauacuacuuccaagauguuauuaaauagauuuacuacaaggcauaggaagccaacguaugaaaaggauguugaucuaggggcaggaaccaggagcgugaguacagagacagagaaaccagauaugacuaucauuggaagacgccuacagcgauuacaagaagaacauaaagaaacuuggcauuaugaccaagagaacccauaucgcacaugggcauaucacgguucuuacgaggcacccuccacugggagugcaagcucuaugguaaaugguguagugaaauuacuaacgaaaccuugggacguaauuccuaugguaacucaauuagcaaugacggauacaacaccauuuggacagcagcgugucuuuaaagaaaaagucgacacccgcaccccucaaccuaaaccuggcacaagaaugguaaugaccacaacugccaauugguugugggccuuauugggcaaaaagaaaaacccaagacucugcacaagggaagaauuuauuucgaaagucagaagcaaugcagcaauuggugccguuuuccaagaagaacaaggguggacauccgcuuccgaagccgugaacgacagccgauucugggaacugguagacaaagaaagagcguuacaccaggaaggcaaaugugaaucuuguguauauaacaugaugggcaaaagagaaaagaagcuaggugaguuugggagagcuaaagguucccgugcaauuugguauauguggcugggcgcgagguuucuggaguuugaggcuuuaggauuccuuaaugaagaccacugguuuggaagagaaaauucguggucgggcguagaaggagaaggacuacauagacuuggguauauacuggaagaaaucgauaagaaagacggcgaccuaauguacgcagacgauacagcgggaugggauacaagaauaacagaggaugaccuucaaaaugaggaacuaaucacggaacagauggcaccucaucacaaaaucuuggcaaaagccaucuuuaaauuaacguaccaaaacaaaguggucaagguauuaagaccuacuccaagaggggcaguuauggauaucauaucacggaaagaucaaaggggauccgggcaggucgggacauacggacuaaauacguuuacuaauauggaaguacaauugauccgucagauggaggccgaagggguaauaacacaagacgauaugcagaacccuaagggacuaaaagaaaggguugagaagugguuacgugaauguggagucgaucgccuuaaaagaauggcaauaucaggugacgacuguguaguaaagccgcuggaugaaagauucgguacaucauuauuauucuuaaaugacaugggaaaagugagaaaagacauaccacaaugggaaccaagcaaaggauggaaaaauuggcaagagguaccguuuuguucacaccauuuccacaagauuuuuaugaaagauggacggaguuuaguuguaccgugcagaaaccaagacgaauuaauugggagggcgagaauaucacaaggcgccggguggagucuacgggagacagcuugcuuggggaaggcuuaugcccagauguggucccuuauguauuuucauagaagagacuuacgguuggcauccauggcaauaugcagcgccguuccaacggagugguuuccaacaagucgcaccacauggucaauacacgcacaccaccaguggaugaccacagaggacaugcuaaaaguuuggaaccgcguuuggauagaagacaaccccaacaugauagacaaaacacccguccauucaugggaggauauaccauaccuagguaaaagagaagauuuauggugugguucucucauagguuuguccaguagagcgacaugggccaaaaauauacauacugcuauaacucaaguaagaaaccuaauaggaaaagaagaauauguagauuauaugccuguuaugaaacguuacucugccccuucagagucggaaggaguacuuuaa

SEQ ID NO: 23641 - RNA, 9867 nt, Artificial Sequence
  derived and/or modified CDS sequence (opt6) from DENV-4__FJ882581__SS-prME
agcacgauuacuuuauuaugccuuauaccaacugugauggcguuucaucucucuacgagagauggagaaccacuuaugauagucgcgaaacaugagcgcggaagaccauuacuauucaaaacuacagaaggaauuaacaaaugcacauuaauagcaauggaucuaggagaaaugugugaagauacuguuacauauaaauguccccuucuuguuaauacugaaccggaagauauagauuguugguguaaccugacaaguacguggguuauguacggaaccuguacucaaaguggggaaagaagacgagaaaaacguucaguugcccugacgccgcauucagguauggggcuagaaacuagagcagagaccuggaugaguagcgaaggagcauggaaacaugcgcaacgagucgaaagcuggauacuucgaaacccuggguuugcacuauuagccggauucauggccuacaugauaggacagacggggauucaaaggacaguauucuuuguuuuaaugauguuaguugcaccgucguacgguaugaggugcguuggagugggcaacagggacuuuguagagggggucucagggggcgcauggguugauuugguuuuagagcaugguggguguguuacaacaauggcacaaggaaaaccgacauuagacuucgaacuaaccaaaaccacugccaaagagguagcacugcuaagaaccuacuguauagaagcccuuaucucuaauaucacgacugcuacucguugucccacccaaggcgaaccauauuuaaaagaagaacaagaccaacaauauauaugucgcagagauguggucgauagagggugggggaacggaugcgggcuuuuuggcaaaggugggguuguaacaugcgcaaaauuuucuuguagcgguaaaauuacaggcaauuugguacaaauagaaaaucuggaauauacaguagucguuaccguucacaauggugauacgcaugcugugggaaaugauacaaguaaucauggaguuacagcgacaauaaccccaagaagcccaagugucgaagugaaauuaccggauuauggcgaauuaacccuagauugcgaaccaagauccggaauagauuucaaugaaaugauauuaaugaaaaugaagaagaaaacuugguuaguccacaaacaaugguuccuugaucuaccacuaccauggaccacaggugcugauacaagcgagguucauuggaacuauaaagagcgaauggucaccuucaaagucccacaugcgaaaagacaagacgugacaguucuuggcagccaagagggcgcaaugcacagcgcgcuugcgggugcgacagagguggauuccggggauggaaaucauauguuugcaggacaucuuaaauguaaaguaagaauggaaaaacuucgaauaaagggcaugucauauacaauguguagugggaaauuuuccauugacaaagaaauggcagaaacgcagcauggaacaaccguggucaaaguuaaguacgaaggugcaggcgcaccauguaaaguacccauagagauaagagauguaaacaaggaaaagguagugggccguguaauuucugcaacaccuuuagcagaaaacacaaauucaguaacaaauauagaacuugagccuccuuucggagacaguuauauaguaauugguguaggcaauuccgcucuaacucuccacugguuuagaaaagguagcagcauugggaaaauguuugaaucaacguauagaggcgcuaagagaauggcaauucugggagagaccgcgugggacuuugggagcguugggggccuuuuuacguccuuggguaaggcugugcaccaggucuuuggcagcguauauacaaccauguucgggggaguaaguuggaugauccgaauacuaauaggauuuuuaguucuguggaucggcaccaauuccagaaacacgaguauggcaaugacauguauagcgguagguggaauaacauuauuccucggauuuacaguucaagcggauaugggaugcguuguuucauggaacgggagagaacuuaaaugugggucugguauauuuguaguagauaauguacauacauggacugaacaauauaaguuucaacccgagucaccagcuagacucgcuucggccauccuaaacgcacacaaagauggaguuugugggauaagaucgaccaccagacuggaaaacguaauguggaaacaaauaacuaacgaacuaaauuaugucuugugggaaggaggucaugaucuuacaguaguugccggcgaugugaaagggguacucacuaaagguaaacgcgcuuuaacuccuccagcuagcgacuugaaauacucuuggaagacauggggaaaagcaaaaauauuuacuccugaggcgagaaauuccacuuuccucauugauggaccggauaccagcgaaugcccuaacgaaagacgagccuggaacucauuugaaguagaagauuaugguuucggcauguuuacaacgaauauauggaugaaauucagggaagguagcucagaaguuugcgaccauagacuuaugagcgcggcuauuaaagaccaaaaagcggugcaugccgauauggguuauuggauagaaucuucuaaaaaccaaacauggcaaauagagagagcgucgcucauagaaguaaaaacuugcuuauggcccaaaacacauacauuauggucgaacggaguucuagaaucacaaaugcuuauccccaagucguaugcggggccguucucucaacauaauuaccgccaaggauaugcaacacaaacuguuggaccuuggcauuugggcaaauuagaaaucgacuucggugagugcccuggaaccaccguaacaauacaagaaaacugugaucaccggggaccaucguuaagaaccacgaccgcuucggguaaacucguaacucagugguguuguagaucuuguacuaugccuccgcuacguuuccuaggugaggacgguuguugguacgguauggaaauucgaccucuuagcgaaaaagaagaaaauauggugaaaagccagguaacggcuggucaaggaacuucagagacuuuuaguaugggcuugcuuugccuaacccuuuuuguggaagaaugucuaaggagaagaguaacuaggaaacauaugauuuuggcagucgugaucacucuaugugcgauuauucuaggaggguuaacauggauggauuuacuuagagcuuuaaucaugcuuggcgauacgauguccgggcgaauugguggacaaacgcauuuagccauuauggccgucuuuaagaugucccccggauauguucuggggguauuccuccgaaaacuuacaaguagagagacugcguugauggucauaggaauggcaaugacaacaacguuaaguauaccacaugaccucauggaauuaaucgauggcaucagccuuggcuuaaucuuauugaaaaucguaacgcaauuugauaacacccagguugggacacuggcguuaucucuuacguuuauacguagcacuaugucgcuaguaauggccuggcgcacuaucauggcgguauuauuuguugugacacuaauaccccugugucgaacaaguugccuacaaaaacaaucacauuggguggagauaaccgcgcuuauauuaggggcacaagcacuuccgguauauuuaaugacauuaaugaagggugccucuaggagaucuuggccgcuuaacgaaggaauaauggccgucggccucgucucacuucuuggcucagcucuacuaaagaaugacguaccauuagcuggcccaaugguagccggaggacucuuacuagcugcauacguaaugucagguucaagcgcugaucuaucacucgagaaagccgcaaauguucaaugggaugaaauggcagauauuaccgggagcucaccaauuauagagguuaaacaagaugaagacggauccuucucuauacgcgauguagaggagaccaauaugauaacuuuacuggucaaacuagccuuaauaacaguuucuggguuauacccacuagccauaccgauaacaaugacucucugguauauguggcaaguuaaaacccaaagguccggagcauuaugggacgucccaucucccgcagccacucaaaaagcagcuuuaucugaaggcguauauagaaucaugcaacguggacuuuucgguaaaacacagguggggguaggcauccauauggaggguguauuccacaccauguggcauguaacacguggauccguaauuugccaugaaacgggucguuuggaacccucaugggcggaugugcguaaugacaugaucaguuacggugggggauggcgacuaggcgauaaaugggauaaagaagaagacguucaaguauuagccauagaaccagggaaaaacccaaaacacguacaaacgaagccagguuuguuuaaaacucuuaccggggaaauaggggcaguaacacuagacuuuaaaccuggcacaucaggauccccuauuauaaaccgaaaagguaaaguaauuggucuuuacggcaacggaguagugaccaaauccggagauuauguaagugcaauaacccaggcagaacggauaggagaaccggacuaugagguugaugaagauauuuucagaaagaaaaggcuaaccauaauggaucuccauccaggugcaggcaaaaccaaaaggauuuuaccauccauaguaagagaagcacuuaaaagacgcuuaagaacgcuaauauuagcgccuacucgaguuguugcagcggaaauggaagaagcacuacgggguuuaccgaucagguaccaaacacccgcaguuaagucugagcauacaggacgagaaaucguagaucugaugugccacgccacuuuuaccacccgccugcuaaguucaacucgaguaccgaacuauaaccugauugucauggaugaagcgcacuuuaccgaccccaguucaguagcggcucgaggauacaucucuacaagagucgaaaugggggaagccgcugcuauauuuaugacagcgacaccaccaggugcuacagacccauuuccucaaucaaacucuccgauugaagacauagaacgggaaauaccagaacggucauggaauacgggguucgacuggauaacagauuaccaagguaaaaccguaugguuuguaccgagcauaaaagcuggaaacgauaucgccaauugucuacgcaaaucagggaagaaaguaauacaguuaaguaggaaaacauucgauacagaguauccaaaaacuaaguuaacagacugggauuuuguaguaacaacugacauuucagaaaugggggcgaauuuccgcgcuggaagaguaauugaucccagacgaugccucaaaccuguaauccugacugaugguccggaacgaguaauacuggcgggaccaauuccugugaccccugcuuccgcugcgcaacguagaggacguaucggacguaauuuagcgcaagaagaugaccaauauguauuuucgggggaucccuuaaagaacgaugaagaccacgcacauuggacugaagcaaaaauguuacuggauaacauuuauacuccagagggaauaauaccaacauuauuuggaccggaaagagagaaaacucaagcaauagacggagaauuucgauuaagaggggaacaacgcaaaacauuugucgaauuaaugaggcguggcgaucuuccugugugguuaaguuacaaaguagcaucugccggaauuaguuacaaagauagggaaugguguuuuacaggagaacgaaauaaccaaauuuuagaggagaacauggagguagagaucuggacgagagagggugaaaagaagaagcuacggccuaaaugguuagaugcacggguauaugcggauccaauggcacuaaaagauuucaaagaauuugcuagcggccggaaaaguauaacccuggacauucucacugaaauagcgucgcucccaaccuaccugucgagcagggcaaaauuggccuuagauaauauaguaauguuacacacaacggaacgcggcgggcgagcuuaucaacaugcacuaaaugaguuaccggaaucacuagaaacauuaauguuaguugcucuacuaggugccaugacagcugguauauuuuuguucuucaugcaggguaaggggauagggaaacuguccaugggacucauaacgauagcuguagcuuccggauuauuguggguggccgagauucaaccucaguggauagcugcuagcauuauucuagaguucuuuuuaaugguguuguuaauaccugaaccggaaaagcaacguacaccacaagauaaucaguuaaucuaugucauauugacaauauuaacaauuauaggucuaauugcagcaaacgaaauggggcugauugaaaagacuaaaacagauuuuggguucuaucaagugaaaacugaaaccacaauauuggacguugauuuacgucccgcaagugcuuggacgcuguaugcaguagccacuaccauauugacaccaaugcugagacacacaauagaaaauacuucggccaaccuuaguuuagccgcaauugcaaaucaagcggcugucuuaaugggcuuggguaaaggauggccacuacaucggauggauuuagguguaccacuccuagcuaugggcuguuauucccagguaaacccaacaacucuaacugcaucacucguuaugcuauugguucauuacgcuaucauagguccuggauugcaggcgaaagcuacucgugaggcacaaaagcgaacagccgcaggaauaaugaaaaauccgacuguugaugguaucaccguuauugaucuugaacccauuaguuaugacccuaaauucgaaaagcaguuaggacaaguaauguuauugguccuuugcgcaggacagcugcuguugaugagaacaacuugggcauuuugugaaguacugacacuggcaacagggccgauucucacacuaugggagggcaauccaggccgguucuggaacacaacaauagccguguccaccgcuaacauuuucagagguagcuauuuagcaggagcuggacuggcguuuucacuaaucaaaaaugcacaaaccccuagacgagggacaggaacaacuggugaaacucucggagagaaauggaaaaggcaacuaaauucauuagaccgaaaagaauuugaagaauauaaacguagcggaaucuuagaaguggauagaaccgaggccaaaucagcacuuaaagauggaaguaaaauaaagcaugcaguuaguagagguucuaguaaaaucagauggauagucgaaaggggcaugguaaaaccaaaaggcaaaguaguggauuuagggugugggcguggugguuggucuuacuauauggcaacucuuaaaaauguaacugaagugaaaggcuacacgaaaggugguccggggcacgaagaaccaauuccuauggcgacauaugguuggaaccuaguaaaauuacacagcggcguagaugucuuuuacaagccuacggaacaggucgacacguuguuaugcgacauuggggaaucaaguucuaauccaacgauagaggagggcagaaccuugcgagugcuuaagaugguugagccauggcuuaguaguaagccagaauuuuguauuaaggucuuaaauccauauaugcccaccgugauagaagaauuagaaaaacugcaacguaaacauggaggaaaucuagugaggugcccacucucacgaaacaguacgcacgaaauguauuggguaaguggagcguccggaaauauaguuucaagcgucaacaccacuagcaaaauguuauuaaacagauuuacaacacgccauagaaagcccacauaugagaaggauguugaucuuggcgcaggaacaagaaguguaucgacagagaccgaaaaaccagauaugacuauaaucggcagacgguuacaacgacuccaggaggaacacaaggaaacuuggcauuaugaccaagaaaauccauaccgaaccugggcauaucaugguucguaugaagcaccaaguacaggaucugcgagcagcaugguaaauggaguaguuaaauuacucacaaaaccaugggauguaauacccauggucacucaacuagcaaugacagauacuacgccauucggucaacaaaggguauucaaagagaaaguugauacccgaacaccucaaccaaagccaggcacucguaugguaaugacaaccacagcaaacugguuaugggcacuuuuaggcaagaagaaaaauccucgcuuauguacuagagaagaguucauuucaaaggucagaaguaaugcagcaauuggagcagucuuccaagaagaacaaggauggacaagugccucagaagcgguuaaugacucccgauucugggaacuuguggacaaggaacgugcguuacaucaagaagguaaaugcgagagcugcguauacaauaugauggggaaaagagagaagaaacuuggggaguucgggcgagccaaaggaucgagagcaauaugguauauguggcuaggagccagauuuuuagaguuugaagcccuagguuucuugaaugaggaucacugguuuggaagagaaaauucuuggucuggcguagagggagaaggauuacacaggcuuggguacauuuuggaagaaauagacaagaaagauggagaccuaauguaugccgaugauacugcgggaugggauacgcguaucacggaagaugaucuccaaaacgaagaauugauaacagaacagauggcgccucaucacaaaauucuagccaaagcgauauuuaaauuaaccuaccaaaauaaaguuguuaaagucuuacgacccacacccaggggagcggugauggacauaauaagccgcaaagaucaaagaggaucaggucaagucgguacauacggucuaaauacuuucaccaauauggaaguacagcuuauaagacagauggaggcggaaggggucauaacacaagaugacaugcagaauccaaaaggcuuaaaagaaagggucgagaaauggcuaagggaauguggaguggaucgacuaaaaagaauggccauaucaggcgaugauugcgucgucaagccguuagaugaacgauucggaaccucucuucuguuuuuaaaugauaugggaaaaguccguaaagauaucccucagugggaacccucaaaaggauggaaaaauuggcaagaaguaccauuuuguagucaucacuuccacaaaauauuuaugaaagacgggagaucacucgucguuccaugccgaaaccaagaugaacuuauagggcgagcucguauaucgcaaggcgcgggauggagcuuaagagaaacggccugucucggaaaagcguaugcacaaauguggagccuuauguacuuucacagaagagaucuacgucucgccucaauggcgauuuguagugccgugcccacggaaugguuucccacaucaagaacaacuuggagcauacacgcgcaucaucaguggaugacgacugaagauauguuaaaaguguggaaccguguguggauugaagacaacccaaauaugauagauaaaacaccuguacacucaugggaagauauaccauauuuaggaaaaagggaggacuuauggugcggaucacugauuggacuguccucuagagcuacuugggcaaagaauauacacacugccaucacgcagguucgaaaucuuauugguaaagaagaauacguagauuacaugccagucaugaaacgauauucagcaccgagcgaaucagagggcguauuguaa

SEQ ID NO: 23642 - RNA, 9867 nt, Artificial Sequence
  derived and/or modified CDS sequence (opt6) from DENV-4__FJ882582__SS-prME
ucgaccauaacuuuauugugccuaauaccgacugugauggcuuuucauuuaagcacacgggauggugaaccacuaaugauaguugcaaaacaugaaagaggacgaccacugcuuuucaaaacaacagaaggaauaaacaaauguacacuuauagcuauggaucuaggagaaaugugugaagacacugucacauacaaauguccccuacucgucaacacugaaccggaagacaucgauuguugguguaacuuaaccucaacaugggucauguacggaacauguacacaaucaggagaacguagacgggaaaaacguucuguagcauuaaccccacauaguggaaugggauuagaaacgagagcagaaacguggaugucuagugaaggagcuuggaaacacgcgcaacgggucgaaaguuggauacuucguaacccaggguuugccuuacucgcugguuucauggcguacaugauugggcaaacaggcauucaaagaacaguauucuucgucuuaaugaugcuuguagcgccaaguuaugggaugagguguguaggaguugggaaccgcgacuuugucgaagggguaucugguggagcuuggguagaucuaguacuugaacauggaggcuguguaacaacgauggcucaaggaaaaccaacacuugacuucgaauuaacgaaaacaaccgccaaagaagucgcccuauugcgaacauauugcauugaagcauuaauaucuaacauaacaacggcaacccgcuguccuacucaaggugaaccauauuuaaaagaagaacaggaccaacaauauaucuguagaagggacgugguagaccgagguugggggaauggguguggucuauucggaaaaggugguguugugaccugcgccaaauucagcuguucaggaaaaauaacuggaaacuugguccagaucgaaaacuuagaauauacaguugucgugacuguucacaauggagacacccaugcaguaggcaaugacacaucuaaccacgguguuacagcaacaauuaccccacgaaguccauccguugaaguaaaacuaccagacuacggagaauuaacacuagauugugaaccaagauccgggauugacuuuaaugaaaugauucuuaugaaaaugaagaagaaaaccugguuaguacauaaacagugguuucuugauuuaccacuuccuuggacuacaggagccgauacaagugaaguucacuggaauuacaaagaaaggaugguuacauucaaagucccacaugcuaaacgacaagauguaacuguauuaggaagccaagaaggagcaaugcacucugcucuagccggugcuacagaaguugacagcggcgauggaaaccauauguuugcaggccauuuaaaauguaaagugagaauggaaaaacuuagaauuaaagguauguccuacacaauguguucaggaaaauuuucaauugauaaagaaauggcugagacucagcacgggacgacaguuguuaaaguaaaguaugaaggagcaggagcuccaugcaaaguaccuaucgaaauacgugaugucaauaaagaaaagguaguaggaagaguaaucucugcaacacccuuagcugaaaacacuaacagcguaacaaacauagagcucgaaccgccauuuggagauucauauauagucauugguguuggaaacucggcuuuaacccuccacugguuuagaaaagguuccucgauugguaaaauguuugaaucaacuuacagaggagcgaaaagaauggccauacuaggcgagacggcaugggacuuuggcucuguagggggauuauuuacaucucuagguaaggcagugcaccaagucuucgggucaguauauacaaccauguucggaggagugucauggaugauuagaauacuuauuggguuuuuaguacuuuggaucggcaccaauaguagaaauacaucaauggccaugacuuguauugcaguagguggcauuaccuuguuucuuggauuuacaguucaagcugacauggggugugugguuagcuggaacgguagagaacugaaaugugggaguggcauuuuuguuguugacaacguacauacauggaccgaacaguacaaguuccaaccagaauccccggcuagauuagcguccgcgauacuaaacgcacauaaggauggagugugcggcauccgaucgacaaccagacuugaaaauguaauguggaaacaaaucacaaacgagcuuaacuaugugcuaugggagggaggacacgaucuaacaguugucgcgggugacgucaaagguguacuuacgaaaggcaaaagggccuuaacaccuccugcuucugaucuaaaauacucuuggaagaccugggggaaagcuaaaaucuucacgcccgaggcuagaaacucaaccuucuuaauagauggaccugauacaucugaauguccgaaugaacguagagcguggaacucauuugagguugaagauuauggauucggcauguuuacaacuaauauauggaugaaauuccgggaggguaguucggaaguaugugaccaucgcuuaaugagugcugcuauuaaagaucaaaaggcuguacaugccgacaugggguauuggauagaaagcucuaaaaaccaaacuuggcaaauugaacgagcuucuuuaauugaaguuaagacuugucuguggccaaagacacacaccuuauggucaaacggaguucuagaaucucaaaugcucauaccgaaaagcuacgcugguccauucagucaacauaauuacagacaaggcuaugcuacgcagaccguuggaccauggcacuuaggaaagcucgaaauagacuucggagaaugcccggguacaaccguaacuauccaggaaaacugcgaccaccgagggccgucauugaggacuacaacagcuagugguaaacuuguaacacagugguguugcaggucaugcacgaugccaccguugagguuucugggugaggauggauguugguauggcauggaaauaaggccauuaagcgaaaaggaggagaauaugguuaagucacaagucacagcaggacaaggaacgucggaaacguuuagcauggguuuguugugucucacguuauuuguugaagaaugucuacgucguagaguaacaagaaaacacaugauauuagccguaguuauaacuuuaugcgcaauuauauuagguggccuaacauggauggauuuacuaagagcccuaauuaugcuuggcgauaccaugaguggcaggauuggcggccagacacaucucgcuauaauggcaguguuuaaaaugaguccagguuacguuuuggguguuuuucuacggaaauuaacgaguagggaaacagcguuaauggugauuggaauggcaaugacaacaacacuaucaauuccucaugaucuaauggaauuaauagacgguauaagucuaggauuaauucuccuaaaaaucguuacacaauuugacaauacucaaguagggacgcuggcucugagucuaacuuuuauaaggagcaccaugucguugguaauggcauggagaaccaucauggcugucuuauuuguaguaaccuuaauacccuuaugcagaacauccugccuacaaaagcaaagucacuggguagaaauaacggcguugaucuuaggagcacaagccuuaccgguguaucugaugaccuuaaugaaaggugcuucgaggcgaucguggccauugaaugaggguauuauggcuguaggccuuguaucccuacuaggaagugcccuuuuaaagaaugacguaccacuagcgggaccaaugguagcaggaggcuuacuguuagcugcauacgugaugucagguaguucagcagauuuguccuuagaaaaggcagcuaauguucagugggaugaaauggcagacauuacaggaucgucuccgauaauugaaguaaagcaagaugaagacggaucauucucuaucagggauguugaagagacaaacaugauuacacuacuuguuaaguuagccuugauaacaguaucuggauuauaucccuuggcaaucccuauuacaaugacacuaugguauauguggcagguaaaaacgcaaagaucaggggcacuuugggaugucccgucaccagcugcgacgcagaaggcagcccuuucugagggaguauaucgcauaaugcaacgaggcuuauucggaaaaacacaaguaggcgucggcauccacauggaaggaguguuucauacuauguggcacgucaccagaggauccguuauuugccaugaaacugggagacuagagccaucaugggcagauguuagaaaugauaugaucucauacggcggaggauggagguuaggugauaaaugggauaaagaagaagacguucagguucucgccauagagcccgguaaaaauccuaaacaugugcaaacuaaaccugggcuuuuuaaaacauugaccggagagaucggcgcugugacacuugauuuuaagccagggacaucagguuccccaaucaucaaucgcaaaggcaaagucauaggccuuuaugggaacggcguggugaccaaaucuggggacuacguaagugcuaucacacaagcagaaaggauuggagaaccagacuaugaaguagaugaagauauauuccguaagaaacguuuaaccauaauggaucuacauccaggcgccggcaaaaccaaacguauccugcccaguauaguuagagaagcgcucaaaagaaggcuaagaacauugauuuuagcacccacgagaguaguagcagcugaaauggaagaagcccucagagguuuaccuauaagauaccagacccccgcagucaaaucggaacacacaggacgagagauaguggaucuaaugugucacgcuacauucaccacacgccuucuaagcaguacucgagucccaaauuacaaccugaucguaauggaugaagcacacuuuacagaccccuccagcguugcggcuagaggguacauaaguacacgcguggaaaugggagaagcagccgcgauauucaugacagcaaccccaccuggugcaacagaucccuuuccacaaaguaauaguccuauagaagacauagaacgagaaauucccgaacgaucuuggaacacuggcuuugacuggauaacagacuaccaagguaaaacuguaugguuuguaccauccauuaaggcaggcaacgauauugcaaacugccuucgaaagucggguaagaaaguaauacaacucuccagaaaaacauuugauacggaguauccgaaaacgaaauugacugauugggacuucguugucacaacggauauaucugaaaugggugccaauuuucgggcgggucgaguaauagauccaagacgcugucugaaaccuguaauucuuacugaugguccugaaagagugauacuggcuggaccgauaccgguuacacccgcaagcgcugcccaacgacguggucgcauagguagaaaucucgcucaagaagaugaucaguaugucuucucuggcgauccacucaaaaaugacgaagaucaugcucauuggacagaggcuaaaauguuauuagacaacauuuacacuccggaggggauaauaccaacauuauuuggucccgaacgagaaaagacucaagcaauagacggggaguuuagacuacgaggcgaacaacgaaaaacauuuguagaacuaaugagaagaggcgaccuaccuguuuggcuauccuacaagguugccagugccggcaucagcuauaaagaccgagagugguguuuuacaggcgaaagaaauaaucagauuuuagaagaaaauauggaaguagaaauuuggacccgagaaggagagaagaagaaacuaagaccaaaaugguuggaugcaagggucuacgcagaccccauggcguuaaaggauuuuaaagaguucgcaagcggucgcaagucaaucacccuugauauauugaccgaaauugcaucccuaccuacauaccugagcucuagagcaaaacucgcacuagauaacauaguaauguugcacacuaccgaaaggggaggacgcgcauaucagcaugcauuaaacgaacuaccagaaaguuuggaaacauuaauguugguugcccugcucggcgcaaugacagccgguauauucuuguucuuuaugcaagguaaagggauuggaaaacucaguaugggucugauaacaauugccguagcuuccggucuauuguggguggccgaaauacaaccucaauggauagcagcaucaauuaucuuagaguuuuucuuaaugguauuacucauuccagagcccgaaaaacaaagaacuccgcaggauaaucaauugaucuacguuauccuaacaauuuugacaauaauuggucuaauagcagcgaaugaaaugggucuuaucgaaaagacuaaaaccgauuuuggcuucuaccaaguaaaaacagagacgacuauuuuggauguggaccuccgaccugcaagcgcuuggacacuguaugcagucgcaaccacaauauugacacccauguuacgacauacaauagaaaauacaagcgcgaaucugagucuagcugccauugcgaaccaagcggcuguguuaaugggauuaggcaaagguuggccacugcaccgcauggaucuaggaguuccacuacuugcgauggggugcuauagucaaguuaauccgacaacauuaacggcuagucuuguaaugcuuuugguucauuacgcaauuauagguccuggacugcaagcaaaagcuacaagagaggcucagaagagaacagcugccggcauuaugaaaaauccuaccgucgauggaauaaccgugauugacuuagagcccaucagcuaugauccaaaguuugaaaaacaacucggccaaguaaugcuucugguccuaugugcaggacaacuacuacugaugagaacaacaugggcguuuugcgaaguuuugacauuagcgacaggaccaauucuaacauugugggaaggaaauccuggaagauucuggaauacaacuauugcaguuucuacagcgaauauauucagggguaguuaucuugcgggcgcgggacuagcguuuagucuaauuaagaaugcucaaacuccucgucgagguacggguacgacaggugagacgcugggcgaaaaauggaaacgacagcuuaauucacuagaucguaaggaguuugaagaauauaaaagaagcggaauauuagaaguagauaggacugaagcaaaaucagcacuaaaagauggaucgaaaauaaaacaugcuguaagucgaggauccucgaaaauaagauggauuguggaacgagguaugguuaaaccuaagggaaaaguaguagaucuuggauguggaagaggggguuggucauauuacauggcaacgcugaagaacguaacagagguaaaagguuauacuaaaggaggaccaggucacgaagaaccuauaccuauggcaacauauggauggaaucuaguaaaguuacauucuggugucgacguauuuuacaaaccaacggagcagguagauacuuuacuaugugauauaggagaaucuuccucaaauccuaccauagaagaaggacguacacuuagagucuugaagaugguagaaccuuggcucuccucuaaacccgaauuuugcauuaaaguccuaaacccguacaugccaacugucauagaagaauuagagaaauuacaaagaaaacauggagggaauuuaguaagauguccgcuaucgaggaauaguacucaugaaauguacugggucuccggggcuuccggaaauauaguguccagcgugaauacaaccuccaaaaugcugcugaaccguuuuacgacacggcacaggaagccaacuuacgaaaaagacguagacuugggggccgggacacggucggucucgacagaaacagagaaaccugacaugacuauuauaggaaggaggcugcaaaggcuucaagaggaacacaaagaaacauggcauuacgaucaagaaaacccguauagaacaugggccuaucauggaagcuaugaagcaccuucgacgggauccgcaagcucuaugguaaauggagucguaaaguuauuaacaaaaccaugggacguuaucccaaugguuacgcaguuagcaaugacagauacaacaccauuuggccagcaaagaguuuuuaaggaaaaaguagacacgagaacuccucaaccaaaaccagguacaagaaugguuaugacaacuacggcgaacugguuaugggcauuguuagguaagaagaaaaauccccgauuaugcaccagagaggaauuuaucaguaaaguacgcaguaacgcagcgaucggggcgguuuuccaagaggaacaaggauggacaagcgcaucagaagcaguaaacgacucacguuucugggaauuaguagauaaagaaagggcacugcaucaagaagggaagugcgagagcuguguguauaauaugauggggaagcgcgagaagaaauuaggugaauuuggcagggcuaaagguagccgagcuauaugguacaugugguuaggcgcaagauuuuuagaguuugaggcuuuaggcuuuuuaaaugaggaccacugguucgggagagaaaauucguggagcggaguagagggggaaggcuuacacagauuaggcuacauuuuggaagaaauagauaagaaagauggagauuugauguaugccgacgauaccgcagguugggauacccgaaucacugaagaugacuuacagaacgaggagcucauuacagaacagauggcuccccaucacaaaauucuugccaaagcaaucuuuaaauugacuuaucaaaauaaagucgugaaaguacuaaggccaaccccacgcggagcgguaauggauauaauaucaagaaaagaccaacgcgguuccggucaaguuggcacguacggauuaaauacauucacaaacauggagguacaacuaauacgccaaauggaagcagaagggguaauaacucaagacgacaugcaaaauccuaaaggcuuaaaagaaagaguagaaaaauggcuacgcgaauguggcguagacagauuaaaacgaauggcaauuuccggagacgauugcguagugaaaccucuagacgagagauuuggaacauccuuauuauuucucaacgauauggggaaagugcgaaaggauauuccacaaugggagccuaguaaaggcuggaagaacuggcaagaagucccguuuugcucacaucauuuucauaaaaucuuuaugaaggacggacguucacucguuguuccaugcagaaaccaagaugagcuaaucggcagagcacgaauaagccagggggcgggguggucauugagggagacugcguguuuaggaaaggcuuaugcacaaaugugguccuuaauguauuuccaccgacgggaccuaagguuggccuccauggcaaucuguucggcaguaccaacggaaugguuuccgacgucaagaacuaccuggucaauucaugcgcaucaucaauggaugacaacagaagauaugcuuaaagucuggaaucgggucuggauugaagauaaucccaauaugaucgacaaaacaccuguacacuccugggaagauauuccauauuuagguaaaagagaagauuuguggugcgggucguugauaggucuuucaucccgggccacaugggcuaaaaauauacacacagccauuacacaaguuagaaaccuaauuggaaaagaggaauacgccgauuacaugccaguuaugaaaagauacagugcuccaagugaaucagagggagugcucuaa

SEQ ID NO: 23643 - RNA, 9867 nt, Artificial Sequence
  derived and/or modified CDS sequence (opt6) from DENV-4__FJ882584__SS-prME
ucgaccauaaccuugcuaugucuaauaccaacuguuauggcauuucacuugaguacccgcgauggagaaccacuaaugauuguagcgaaacaugaaagagguaggccacuucuauucaaaacaacugaaggaauaaauaaauguacacuaauagccauggaucuaggugaaaugugugaagauacaguaaccuauaaauguccacuauuagugaacaccgaaccagaagauauagacugcuggugcaacuuaacuucgacauggguuauguauggaaccugcacccaaucaggugaacgaaggagagagaagaggucaguagcauuaacgccacauucaggaaugggucuagaaacucgagcggaaacguggaugucuagugaaggagcuuggaaacacgcacaaagaguagaaucguggauccuaagaaauccaggcuuugcauuguuggcaggguuuauggccuacaugauaggucaaacuggaauacagaggacuguauucuuuguccuaaugaugcuagucgcaccgucauauggaaugaggugcguaggaguugguaacagagauuuuguggaagguguaagugguggagcauggguagacuuaguauuagagcacggggguuguguuacuacaauggcacagggaaagccuacguuagauuuugaacugacuaaaaccacggcuaaggaaguugcauuguuacgcacguauugcaucgaagcgagcauaagcaacauaaccacggccacgagaugccccacacagggagaaccauauuuaaaagaagaacaagaccagcaauacauuugcaggcgcgaugugguagaucggggguggggaaauggauguggccuuuuuggaaaagguggcguggucacaugcgccaaguuuucaugcagcgguaaaauuacggggaaucuaguacaaaucgagaacuuagaauauaccgugguaguaaccguucauaauggggacacucaugccgugggcaaugauacuucaaaucauggaguaacagcuaccauaacaccuaggucaccgucuguugaaguuaaauuacccgacuauggagaacuaacacuugacugugaaccucgcaguggaauagacuucaaugaaaugauuuugaugaaaaugaagaagaaaacaugguugguacacaaacagugguuuuuagacuugccccugccauggacgacuggcgcagauacaucagaaguucauuggaauuauaaggaacggauggugaccuuuaaagugccacaugcaaaacgccaagauguuacgguacuugguagucaggaaggagcaaugcacucugcuuuagcuggggccaccgaaguagauucgggagacggaaaucacauguucgccgggcaucuaaaauguaaagugaggauggaaaaacuacgaauaaaagggauguccuacacgaugugcaguggcaaauuuuccauugauaaggaaauggcugaaacucagcaugguaccacagugguuaaaguaaaguaugaaggggcuggugcaccuuguaaaguccccauugaaauaagagacguuaauaaagaaaagguaguagguaggguaaucucagcaaccccuuuagcagaaaauacgaacucgguaaccaacaucgaacuggaacccccauuuggagauaguuauauagucauuggugugggcaacucagcuuugacuuuacauugguuuaggaaaggcagcaguaucgguaaaauguuugaaucaacauacagaggagcuaaaagaauggcaauccugggugaaacagcuugggauuuugguucuguuggagguuuauucacuagccuagguaaagcgguucaucaaguguucggaucagucuacaccacaauguucgggggcguuaguuggaugauccguauccuaauuggauucuugguacucuggauaggaacuaacucacgaaacacaagcauggcaaugaccugcauagcagucggagguauaacauuauuucucggcuucacggugcaagcugauaugggcugcguuguaucuuggucaggaagagaauugaaaugugggagugguauauuuguaguagacaacguacacacauggacggagcaauacaaauuucagccugagagcccagcacguuuagcuucugcaauauuaaacgcacauaaagauggcguaugcggcauucguagcacaacacgguuagaaaauguaauguggaaacaaaucaccaaugagcuaaauuauguauugugggaagguggacacgauuuaaccguagucgcaggcgauguaaagggaguucugacuaagggcaaaagggccuuaacacccccugcauccgauuuaaaauacucauggaaaaccuggggaaaagcaaagauauuuacacccgaggcaagaaacaguacauucuuaauagaugggccagauacgucggaauguccgaacgaacgacgagcauggaauagcuucgaagucgaagauuacggauuuggaauguucacuacaaacauauggaugaaauuucgggaagggucgucagaagucugugaccauagacuaaugagugcagcgauaaaagaccaaaaagcaguacacgcugauaugggauacuggauugagaguucuaagaaccaaaccuggcagauugaaagagcuagccugauugaaguuaaaaccugucuguggccaaaaacgcauacauuguggaguaaugguguguuagaaagccaaauguuaauuccgaaaucauaugcaggaccauuuagccaacacaauuaucgccaaggauacgcgacacagaccgucgguccauggcacuuagguaaguuggaaauugacuucggagagugcccaggaacuacuguaacaauccaggaaaauugugaucacagagggccaucuuuaagaacuacuacggcauccgggaaguuggugacacagugguguugucgaagcugcacaaugccuccucuaagauuucucggugaggauggauguugguacggcauggagauaagaccgcuaucugagaaggaagaaaacauggucaagucgcaaguuacagcagggcaagggaccagugaaacuuuuucaaugggguuacuauguuuaacauuguuuguugaagaauguuugcgacgccggguaacgcguaagcauaugauacuugccguuguuauuaccuuaugcgcaauaauccuaggagguuugacuuggauggaccuacuaagagcguugaucauguugggcgauacaaugagcggaagaaucggaggucaaacacacuuagcgauaauggcaguuuuuaaaaugucuccuggauauguacuagggguuuuccugaggaaacugacaaguagagaaacugccuuaaugguuauaggaauggccaugacaaccacauuaagcaucccucaugaccucauggaacugaucgacgggauuuccuuaggguugauauugcugaaaauagucacacaauucgauaauacacaaguaggcacgcuugcgcuaucauuaacauuuauaagguccaccaugagcuuaguuauggccuggcgaacaauaauggcugugcuuuucgugguuacgcucaucccucuauguagaacaucuugcuuacagaaacaaagucauuggguagaaauuaccgcucugaucuuaggggcacaagcacuaccaguguaccuuaugacucuaaugaaaggugcgagcagacggaguuggccauuaaacgaggggauaauggcagugggucuuguaucccuauugggaucugcccuccuaaagaacgaugugccauuagccggaccuaugguggcugguggacuguugcuagcugcuuauguaaugagcggcagcagugccgaucucagccuugaaaaagccgcaaacguccaaugggaugaaauggcggacauaaccggaucuagcccuauuauagaagugaaacaagacgaagauggauccuuuaguauacgugacguagaagaaacaaacaugauaacguuguugguaaaauuagcauuaauaacggucucaggacuuuauccacuugcaauuccuauaacuaugacccuaugguacauguggcaggucaaaacacaaaggucuggagcauuaugggaugucccaucuccggcagcaacgcaaaaagcugcguuaucagaaggcguauacaggauaaugcaacgaggacuguuuggcaaaacucaaguuggcguaggaauacauauggaaggaguauuccacacuauguggcaugucacccgcgguaguguaaucugucaugagacagguagacuggaaccaagcugggcugacguacgcaacgauaugaucucauacggagguggauggagguuaggggacaaaugggauaaggaagaagauguucaggugcucgcuauugaaccaggcaaaaacccuaaacauguucaaaccaagccaggacuauuuaaaacccuaacgggggaaauaggcgcgguaacuuuagauuuuaaaccuggaacuagcggaucaccuauuaucaauagaaagggaaaaguaaucggacucuaugggaacggaguagucaccaaguccggagauuauguguccgcuauaacucaagcugaaagaauuggggaaccggacuacgagguagaugaggauauauuuagaaagaaacgcuuaacuauaauggaucuacauccuggggcagggaaaaccaaacguauacucccgucaauagucagagaggcgcuaaagagacgacuuagaacuuuaauucuugcaccaacuagaguaguggccgcugaaauggaggaagcccuuagaggacuaccuauccgcuaccaaaccccagcaguuaaaagcgaacacacagggagggaaauuguagaucucaugugucaugcaacauucacaacaagauugcucucaucgacacgaguaccuaacuauaacuugauaguaauggaugaggcccauuuuaccgacccaucaucuguggcggcccgcggauauauaaguacacguguagagaugggcgaggcugcugcaaucuucaugacagcaaccccgccuggagccacagacccguuuccucaaucuaacucuccaauagaagacauagaaagggaaauaccggaacgguccuggaacacgggauuugauuggaucacagauuaucaaggaaaaacaguuugguuuguuccgucuaucaaagcagggaacgauauugcaaauugucuucgaaaaucgggaaagaaagugauccaauuaagcagaaaaacauucgacaccgaauauccuaagacuaaacuaacagauugggauuucguaguuacaacagacauuuccgaaaugggggcaaauuuucgagcagguagaguuauagaucccagaagaugccuaaagcccguaauccugacugacgguccugaaaggguaauacuagcgggaccaauaccagucacuccugccucggcagcucaaaggagaggcagaauuggaaggaacccugcgcaggaagaugaccaguaugucuucaguggcgacccccucaaaaacgacgaagaccaugcacauuggacagaagccaaaauguuguuggacaauauauauacuccugaagguauaauaccaacacuauuuggaccugagagggaaaagacgcaggcaauugacggugaguuuaggcuuaggggagaacagagaaagacuuuuguggaacuaaugagacgcggcgacuugcccguuuggcuuuccuacaaggucgcgucugcagggauauccuacaaagacagagaaugguguuuuacaggagaaagaaauaaccaaaucuuagaagaaaauauggaaguggagauuuggacuagggaaggcgaaaagaagaagcuaagaccaaaaugguuagaugcacgaguauacgcagaucccauggcgcuuaaagacuucaaagaguucgcuagcggacggaagucuauuacacucgauauucuaacagagaucgccucacucccaacauauuuaucauccagagcuaaauuagcauuagacaacauugucaugcuccauacuaccgagcgcggagguagagccuaucaacaugccuuaaacgaauuaccagaaaguuuagaaacacuuaugcuaguagcuuuacuuggugcuaugacagcagggauauuccuauuuuucaugcaagggaaaggaauaggcaaguuauccauggguuuaaucacuauagcggucgccucagguuuauuguggguugcugagauacaaccucaauggauugcugcaaguauaauauuggaguucuuccuuaugguauugcuaauaccggaacccgaaaaacaaagaacaccccaggauaaucaguuaauauacguaauacucaccauauuaacaauaauagggcuuauugcggcgaacgagaugggacucaucgagaaaacgaaaacagauuuuggauuuuaucaggucaagacagaaacaacuauacucgacguagaucuucguccggcgagugcauggacauuguacgcugucgcuacuaccauacucacacccaugcuaagacauacgaucgaaaauaccucggccaaccuuagucuagcggccauugcgaaccaagccgcaguuuugauggggcuugguaaaggauggccucugcauaggauggaucuuggaguaccucuacuagcuaugggguguuacucacaagucaaccccacaacauuaacagcaaguuuagugauguuacuggugcacuaugcgauaauaggcccuggauuacaggcgaaggccaccagggaagcacagaaaaggacugcugcggggaucaugaaaaauccuacaguagaugguauaacagucauugauuuggaaccuauaucauaugacccaaaguucgagaaacagcuaggacaagugauguuguuaguacuaugugcuggacagcuccuacuaaugcgaacgacaugggccuuuugugagguacuaacauuagcuacuggaccaauacucacucucugggaaggaaacccaggaagguuuuggaacacuacuauagcuguaucuacugccaacauuuuuaggggcaguuauuuggcaggcgcaggcuuggcuuucuccuuaauaaagaaugcccagacuccacgacgaggcaccgguaccacuggcgagacccuuggcgaaaaguggaaacggcagcuaaauucacuagaucguaaagaguuugaagaauacaagagguccgguauacuggagguagauagaacagaggcaaaaucagcuuugaaagaugguucaaagauaaaacacgccgucucaagagguuccucaaaaauucgcuggauaguugaacgggguaugguaaaaccuaaaggaaagguuguagacuuaggauguggucgaggcggauggagcuauuauauggccacacuaaagaauguuaccgagguaaaaggguauacaaaagggggaccaggacacgaggagccaaucccuauggcaaccuacggauggaaccuuguaaaauugcacagcgguguagauguauuuuacaaaccgaccgaacaaguggauacacuauuaugcgacauaggcgagucuaguaguaauccuacgauugaggaaggccgcacucucaggguauuaaaaaugguagaaccaugguuguccagcaaaccagaguucuguaucaaaguuuuaaacccuuauaugccaacaguuauagaggaguuagaaaaauugcaacgaaagcacgguggaaaucuaguaagaugucccuuaucgcggaauaguacgcaugaaauguauugggugucgggcgcaaguggaaacauugucucauccgugaauacuacaucaaaaaugcuccugaaucgguuuaccacucggcaccguaagccaacguacgagaaagacguagacuugggagcaggaacccgaucuguaaguacagagacagaaaagccagacaugaccauaauaggaagacggcuacaaaggcuccaagaagaacauaaggagacguggcauuaugaccaggaaaauccauaucgaacgugggcauaucauggcucauaugaagcuccuucaacugguucugcuucauccaugguaaauggaguaguaaaauuguuaaccaagccuugggaugugauucccauggucacccaacuagcuaugaccgauacgacgccauucggucaacaacguguuuucaaagaaaagguagacaccagaacuccacaaccuaagccaggaacaagaaugguaaugacgacuaccgcaaauuggcuaugggcauuacuuggcaaaaagaagaacccccgacuuuguacaagagaagaauuuauaucaaaaguaagaucaaacgccgcuauaggugccgucuuucaagaagaacaaggauggacaagugcuucugaagccguaaacgauagcagauuuugggaacucgucgacaaggaaagagcacuucaucaagaagguaagugugagucguguguauauaacaugauggguaaaagagagaaaaaguuaggagaauuugggagagccaaggggucgcgagcaauuugguauaugugguuaggugccagguuuuuagaguucgaagcgcugggauuuuuaaaugaagaucacugguuugggcgcgagaacaguuggaguggcguagaaggagaaggauuacaccgucucggguauauauuagaagaaauagauaaaaaggauggagaucuaauguaugcggaugauacagcagggugggacaccaggauaacagaagaugaccuucaaaacgaagaacuaauaaccgagcaaauggcaccacaucauaagauuuuagcuaaggcaauauucaaguugacguaucagaacaaaguagucaaaguauuacgaccaacucccagaggggcgguuauggauauuauaagucggaaagaucaacgagggucagggcaagugggcacauacgguuuaaacacuuucacaaacauggaaguucaauuaauaagacaaauggaagcagaaggagucauaacccaagaugauaugcaaaauccaaagggccuaaaggaaaggguagagaaaugguugagagaaugugggguugaucgucuaaagagaauggccaucaguggagaugacugcguuguaaagcccuuggacgaaagauuuggaacgagccuuuuauuccucaaugacauggguaaaguuagaaaagauauaccacaaugggaaccuagcaaggguuggaaaaacuggcaagaaguaccauucuguagccaccacuuccacaaaaucuuuaugaaagacgguagaaguuuagugguuccgugcaggaaccaagaugagcugauagguagagcacgaauaucccaaggggcgggauggucauuaagagaaacagcgugccugggaaaagcauaugcccaaauguggagucuaauguauuuccacagaagagauuuacgacuagcgucgauggcaaucugcucggcaguaccaacugagugguuuccuacgucuagaacaacauggucgauacaugcacaucaucaauggaugacgacagaggauaugcucaagguguggaauagaguguggaucgaagauaacccuaauaugauagauaagacaccaguacacaguugggaagacauaccauaccuggggaaaagggaggauuuaugguguggaaguuugauaggacuuucgagucgcgcgacuugggcgaaaaacauacauacagcaauaacucaaguacggaacuuaauagguaaagaagaguacgucgauuacaugcccguuaugaagagauacucugcaccaucagaauccgaaggcgugcuauga

SEQ ID NO: 23644 - RNA, 9867 nt, Artificial Sequence
  derived and/or modified CDS sequence (opt6) from DENV-4__FJ882585__SS-prME
agcacuauaacauuauuauguuugauaccuacaguuauggcuuuucaccuuucuacucgagauggagaaccgcuuaugauuguagcuaaacacgaaagaggcagaccccuccuuuucaaaacuacugaaggaauaaauaaaugcacgcuuauagcaauggaccuaggugaaaugugugaagauacgguuacauauaaauguccacuuuugguuaacacagaaccagaagauauugauugcuggugcaaccuaaccaguacgugggucauguauggaacauguacccaaaguggcgaaagaagaagagagaaaaggucuguugcacuuacaccacauaguggaaugggauuggaaaccagagcggaaacuuggaugucaucagaaggugccuggaagcacgcacaacguguggaaucuuggauucugcguaaucccgguuuugcguuacuagcaggguucauggcuuacaugauuggacaaaccggcauccagaggacgguauucuuugugcuaaugaugcuuguugcuccaaguuacggaaugcgaugcgucggaguggguaaccgagacuucgucgaagguguuucuggaggagccuggguagauuuaguguuagaacauggaggaugugucaccacuauggcccaaggaaagccgacacuagacuuugaacucacaaagacuacugcuaaagaaguggcgcuccuuagaacauauuguauagaagcacugauuagcaacauaacuacagcaacucguuguccuacucaaggagaaccauaucuuaaagaagaacaagaccaacaauauaucugucggcgugaugucguugauagggguugggguaauggcugcggucuauucggcaaaggcgguguggucacuugugcaaaauuuagcugcagcggaaaaauaaccggcaacuuaguucaaauagaaaacuuggaauacaccguggugguuaccguucauaacggagauacacaugcagugggaaaugacaccucaaaccauggaguaacggcuacgaucacaccacgguccccaaguguagaagugaaacuucccgauuauggcgagcuuacgcuagacugcgaaccacguucugggauagacuucaacgagaugauacuaaugaagaugaagaagaaaacuuggcuagugcauaaacagugguuucuagaucuaccuuuaccuuggacaacaggugcagacacgagugagguacacuggaacuacaaagaacggaugguaacguuuaaagucccacacgcaaaaagacaagaugucacggucuuagguagccaagaaggcgcaaugcauucagccuuagcaggagcaacggaagucgauuccggcgacggaaaucauauguuugcagggcauuuaaaguguaaaguaagaauggaaaaguuaagaauaaaagggaugucuuauacaauguguucagguaaauuuucuaucgacaaagaaauggcugagacucaacacgggacgacagucguaaaaguaaaauaugaaggugccggagcuccuugcaaaguuccaaucgaaauaagagacguaaacaaagaaaaaguagugggaagaguaauaucagcaacaccuuuagcugaaaacacuaauucaguaacaaauauagaauuagaaccaccuuuuggcgauucauauauuguuauaggcgucggcaacagugcgcugacauuacauugguuuagaaaagguucuucaaucgguaaaauguucgaaucaacauauagaggagcgaaaagaauggcgauuuuaggggaaacugcaugggauuuuggaucggucggaggccuguucacaagucuagggaaagcaguccaucaaguguucgggaguguuuauacuacuauguucggagguguaagcuggaugauacguauuuuaauaggguucuuaguauuauggauuggaaccaauagccgcaauaccaguauggcaaugacauguauagcagucggagggauaacauuauuucuggguuucaccguucaggcagacaugggcuguguaguuucaugguccggucgagaauugaaaugugguucaggaauauucguaguagauaauguucacacuuggacagaacaauacaaauuccaaccggaaucuccugcaagguuggcgucagcgauauuaaacgcacauaaggauggagugugcggcauccgcucaacaacccgacuggagaacguuauguggaagcaaauuacgaacgaacuuaacuacguccucugggagggaggacacgaccuuacuguaguugccggcgaugugaagggaguguuaacaaaagggaaacgagcuuugacgccaccggcuucugacuuaaaguacagcuggaaaacgugggguaaagccaaaauauuuacucccgaggcaagaaauucaacauuucucaucgaugggccugacacuucggaauguccaaaugaaaggagagccuggaacucguucgaaguagaggacuauggauucggaauguucacaacaaacauuuggaugaaguuucgugagggaagcagugaaguaugugaccaccgacucaugucagcagcuauaaaagaucaaaaagcuguccaugcggauaugggcuacuggauagagagcucaaagaaccaaaccuggcaaauugaacgcgcaucacucauugaagucaagacaugucucuggccaaaaacucauacucuauggagcaacggaguacuugaaucacaaaugcucauaccuaaaucuuaugcagguccauuuucacaacauaauuacagacaaggauacgccacucagacgguugggccguggcaucugggaaaauuagaaauagauuuuggugagugucccgggacaacaguaacgauacaagaaaacugcgaccaccggggaccaaguuugagaaccacaacggcgucggggaaauuagucacucaaugguguugucgcucaugcacaaugccuccuuugcguuucuuaggugaagacggaugcugguacgguauggaaaucagaccgcuuucagaaaaagaagaaaauaugguuaaaagccagguaacagcaggccaggggacuagcgagacauucucuaugggacugcuuugccucacauuauuuguagaagaaugucuaagacguagagucacacgaaagcauaugauauuggcuguugugauaacguuaugugcuacaauauugggaggucuuaccuggauggauuuguugagggcauuaauaauguuaggagauaccaugagugggagaauuggcgggcaaacgcaccucgccauuauggccguuuucaaaaugaguccuggauauguuuuagguguauuucuaagaaaauuaaccucuagagagacugccuugauggugauagguauggccaugacaacaacucugucaauaccacacgauuuaauggaacuaauagauggaauaagccuaggacucauuuuacucaaaauaguaacccaguuugacaauacccaagugggaacauuggcauuauccuuaaccuuuauucgaaguacaaugucuuuaguaauggcuuggagaacuaucauggccguucuuuucguagugacguuaauaccgcugugcagaaccaguugucuacaaaagcaaucccauuggguagaaauaacagccuugauacuuggcgcgcaagcccuuccaguauaccuaaugacucuaaugaagggcgcaucacgaagaagcuggccucuaaacgaaggaauaauggcuguuggccuuguuucauuauuggguucagcguuauugaaaaacgauguuccucuugcuggaccaaugguagcuggaggauuacuauuagcagccuacguaaugucaggaucuucugcagaccucaguuuggagaaagcagcgaauguucaaugggaugagauggcugcuauuacuggaucuucaccaauaauagaaguuaaacaagaugaagauggaucuuucucgauacgggauguagaggagacgaacaugauaacauuacucgucaaguuggcacugauuacugucucuggacuauauccauuagcuauaccaaucacuaugaccuuaugguauauguggcaagugaagacacagcgcaguggcgcauugugggauguuccuucaccagcagcgacgcaaaaagcagccuuaucagaaggcguauauaggauaaugcaaaggggacuauuugguaaaacucagguaggcgugggaauacauauggaaggugucuuucauacgauguggcacguaacaagagggucuguaauaugccaugagaccggaagauuggaaccgucgugggccgaugugcggaacgauaugauaucauacggaggaggauggagacucggagauaaaugggauaaagaagaagauguucaaguuuuggcgauagaaccugggaaaaauccaaaacacguacaaacaaagccaggauuauuuaaaacguugacaggagaaauuggagcaguaacacuugacuucaaaccagguacuuccggaaguccaaucauaaaucgaaaagggaaaguuauaggguuauacggcaauggagucguaacaaaaaguggagauuauguaagugcuaucacucaggcugaacguauuggagaaccagauuaugagguugaugaggauauuuuuaggaagaaaagacucacgauaauggaucuccauccaggagccggcaagacgaaaagaauacuucccagcaucgugagagaagcguuaaaaagaagauugcggacucuaauucuagccccaacaagagugguagcugcugagauggaagaggcuuuaaggggccuuccgauaagauaccagacuccagcuguaaaaucagaacauacagggagggaaauagucgaccuaaugugucaugcuacuuuuacuacuagguugcucucuuccacgcgagugccuaauuauaaucucauuguuauggaugaagcacauuuuacggacccaucguccguugcugcacgugguuauaucucaaccagaguagaaaugggagaagcagcagcaaucuuuaugacugccacaccuccaggggccacugaucccuucccacaaucuaauucgccaauagaagacauagagcgagaaauuccagaaaggucuuggaauacaggguucgacuggauaacugauuaucaaggcaaaacgguuugguuugugccuaguaucaaagcagggaaugauauagcuaacugcuuacguaaaagugggaaaaagguuauucaacucaguagaaaaacguuugauacugaauacccuaaaacaaaauuaacagauugggauuuuguugugacuacggacauaucugagaugggugcuaauuucagagcuggaaggguuauagaucccagacgguguuugaaaccaguaauacucacagacgggccugaacgaguuauuuuagcagguccaauaccaguuacuccagccucagcggcccagagacgaggaagaauaggaagaaauccagcacaagaagaugaucaguauguuuucagcggugacccccuuaaaaaugaugaggaucacgcgcacuggacggaggcaaaaaugcuuuuagacaacauauauacuccagaggguauaauaccgacacuauuugggccagaaagagagaaaacacaagcaauugacggcgaauuucguuugagaggugagcagaggaaaacauuuguagaauuaaugaggcgaggagacuuaccuguaugguuaucguauaaaguugcuuccgcuggaaucaguuacaaagacagggaauggugcuucacaggagaaaggaacaaucaaauccucgaagaaaacauggagguagagauuuggacaagagaaggagagaagaagaaacuacgaccuaaaugguuagaugcaagagucuaugcugauccgauggcacucaaagauuuuaaagaguucgcgagugggcggaaaaguacaacccuggacauucucacagaaauagcaucuuuaccuacuuacuuguccucgagggcgaaguuggcacuggauaauauugucaugcugcacacaacggagagagguggucgcgcauaucaacaugcauuaaacgaacuaccagagagcuuagaaacauuaauguuggucgcccuucuaggagcuaugacggcagguauauuccuauucuuuaugcaaggaaaagguauugguaaacuaucgaugggacuuauaacgauagccguagccucagguuuacuauggguggcagaaauucaaccgcaauggauugcagcgucaauuauacuugaauuuuuccuuaugguauuacuaauuccagaaccggaaaaacagagaacaccucaggauaaccaauugauuuacgucauacuuacaauacuaacaauuaucggucucaucgcggcaaaugagaugggacuuauugagaaaacaaagacagauuuuggguucuaucaaguaaagaccgaaacuacaauuuuagacguugaccuaagaccggccuccgcuuggacauuauaugcaguagcuacuacuauucuaacuccgauguuacgucauacaauagaaaacacaucagcaaaucuaucauuagccgcaauagcaaaucaggcagcuguucuaaugggacugggaaaaggauggccauugcacagaauggauuuagguguaccccuacuugccauggguugcuacagccaaguuaauccaacaacacuuacagcuagccuugucaugcuauuagugcacuacgccaucauaggcccagggcuacaggcuaaagcaacgagagaagcacagaaaagaacagcagcagggauaaugaagaacccuacaguagacggcauaacgguaaucgaccuagaaccuauuucguaugauccuaaauucgaaaaacaauugggucaaguaaugcucuuaguccucugcgcugggcaauuauuauuaaugcgcacaacgugggccuuuugugaagugcucacgcuugcgacagggccuauccuaacucugugggaagggaauccuggaagauucuggaacacuacaauugcagucucaacagcgaauauuuucagagguuccuaccuggcgggugcgggauuggcauucucuuuaauuaaaaacgcacaaacaccgcgcaggggaacaggaacuaccggagagacauuaggagaaaaauggaaaagacaacuuaacucacuagaccggaaagaguucgaagaauauaagagaucgggcauucuugaaguagauagaacagaagcuaaaagugcacuuaaagacggaucuaaaauaaaacaugcuguaaguagagguucgagcaaaauacguuggauugucgaacgcggaaugguuaaaccaaaagguaaggucguagaccuuggcugugguagagguggauggaguuacuauauggcuacguugaaaaauguaacagaaguaaaggguuauacaaagggagguccaggacaugaggagccgauaccgauggcaacuuauggauggaaucuagucaaacuacauagcgggguagaugucuucuacaaaccaacugaacaaguugauacauugcuuugugauaucggcgaaucuucuaguaauccuacaauagaagaggguagaacacuucgaguauuaaaaaugguugagccauggcuuagcaguaagccugaguuuugcauaaaagucuugaacccauauaugccuacaguuauugaagaacucgagaaacuacaacgaaaacacggcggcaacuuaguacguuguccgcuuucaagaaauucaacucacgaaauguauuggguaucaggagccuccggcaauauuguuagcucgguuaacacgacaucuaagaugcuacuuaaucgguuuacuaccagacaccguaaaccgacguaugagaaagauguugaucuaggcgcgggcaccagaucgguaucaacugagacugaaaaaccagauaugacgauuaucgggcggagacuucaaagauugcaagaagaacauaaagaaacuuggcacuaugaucaagaaaauccauaucgaacuugggcauaucaugggagcuaugaagcuccuuccacugguucugcgucaucaaugguuaacgguguaguuaaauugcucacgaaaccuugggauguaaucccuaugguuacacagcucgcgaugaccgacacaacaccauucgggcaacagcgcgucuuuaaggaaaaggucgacacccgaacgccccagccuaaaccaggaacucgaauggucaugacgacuacagcaaacugguuaugggcauuacugggaaagaagaaaaauccaagauuaugcacaaaagaggaguucaucucuaaaguacgguccaaugcagcaauaggugcgguauuucaggaagaacaagguuggacuuccgcaagugaagcaguaaaugacucacguuuuugggaguuagucgauaaagagagggcuuuacaucaagaaggaaaaugcgaauccuguguauacaauaugaugggaaaaagagagaagaaacucggugaguucggacgugcaaaagguagcagggcgauuugguacaugugguuaggagcgcgauuccuggaguucgaagcguuaggauuuuuaaaugaggaccauugguuugguagagaaaauagcuggucugguguggaaggagaaggauugcacagguuagguuauauacuagaagagaucgauaagaaagacggagaccucauguacgcggacgacacugcaggcugggacacacgaauaacagaggacgaccuacaaaaugaagaacuaaucacugaacagauggcgccacaccauaaaaucuuagcaaaagcuaucuuuaaacuaacuuaucaaaacaaagugguaaaaguucuaagacccacgccuagaggugcggucauggacauaauaucuaggaaagaccaacgagguaguggacaagucgguacauacggauuaaacacauucaccaauauggaagugcaauuaauccgccagauggaagcugaaggugucaucacacaagacgauaugcagaauccaaaaggacugaaagaaagaguugaaaaaugguugagagaaugugguguggauagauuaaaacgaauggcaauaagcggugaugauugcguuguaaaaccauuggacgagcgcuuugguaccagccuccuauuccuuaacgauaugggaaaaguacgcaaagacaucccucaaugggaaccuucuaaaggguggaaaaacuggcaagaaguaccguuuugcucucaucauuuucauaaaauauucaugaaagauggcaggucuuuaguggucccaugccguaaucaagacgaacugauagggagagcacguauaagucaaggagcuggauggucucuuagagaaacagcaugucuugguaaagccuacgcacaaauguggucacuuauguauuuucaccgcagagaucuaagauuagccaguauggcuauauguucggcaguuccaacagagugguucccgaccucaagaaccaccuggucuauccaugcccaccaucaauggaugacuacggaagauaugcuuaaaguuuggaaccgaguauggauugaagauaaccccaacaugacugacaaaacuccaguacacuccugggaggauauaccguauuuggguaaaagagaagaucuaugguguggaagucugauuggucugucgucgcgugcaacuugggccaaaaauauucacacugccauaacacaaguacgaaacuuaauaggaaaagaagaauaugucgacuauaugccaguuaugaagcgcuacucagcaccaucggaaucugaagggguacuauga

SEQ ID NO: 23645 - RNA, 9867 nt, Artificial Sequence
  derived and/or modified CDS sequence (opt6) from DENV-4__FJ882586__SS-prME
ucuacuauaacccuccuaugucuuaucccuacuguuauggcuuuucacuuauccacaagagacggugaaccuuuaaugauaguggccaaacacgaaaggggcagaccccuuuuauuuaaaaccacggaaggcauaaauaaaugcacucuuaucgccauggacuuaggcgaaaugugugaagacacugugacguauaaauguccacuccugguaaacaccgaaccggaagacauugauugcuggugcaacuugacaucaaccuggguaauguauggcacaugcacacaaucaggagagcggcgaagagagaaaagguccguggcgcucacgccucacucgggaaugggacuagaaacaagagcggaaacguggaugagcagugagggagcuuggaaacacgcucaacgaguagaaucauggauuuugcggaauccaggauuugcccugcuagcuggauuuauggcuuauaugaucggucaaacggguauacagaggacuguauucuuuguuuuaaugaugcuaguagcgcccucauaugguaugagauguguugggguugggaauagagacuuuguugagggcguaagcgggggugcguggguugaccucguccuagaacacggugggugcgucacuaccauggcgcaaggcaaacccacacucgacuucgagcuuacaaaaacaacugccaaagaagucgcauugcugcgcacauacuguauugaagcacuuauuucaaauauaacuacagcuacgcgauguccaacccagggugagccguacuuaaaggaggaacaggaccaacaauacaucugcagaagggauguaguggaccgagguugggguaauggaugcggccuguucgguaaaggagggguagugacgugcgcgaaguuuuccuguucaggaaaaaucacugguaacuuagugcaaauagagaauuuagaauauacaguuguuguaacgguacauaauggagauacacaugcaguaggaaaugacacaaguaaucauggagucaccgcgacaauaacgcccagaucacccucuguggaaguaaagcuccccgauuauggagaacucacacuagacugugaaccuagaagcgggauagauuucaacgaaaugauccuaaugaaaaugaagaagaaaacaugguuaguacacaaacaaugguucuuggauuuaccgcuacccuggacgacuggugcagauacgagugaaguucacuggaauuacaaagagagaaugguaacauuuaaagucccucaugcaaagagacaagaugugacuguacuuggaucacaggaaggggcaaugcauagcgcacuagcuggagcaaccgaaguagauaguggugacgggaaucacauguucgcaggacaccucaaauguaagguaaggauggagaaauuaagaaucaaaggaaugucguacacgauguguucagggaaauuuaguaucgacaaggaaauggcggagacucaacacgggacuacagugguaaaagugaaauaugaaggugcaggcgcaccguguaaaguacccauagaaauucgugacguaaacaaagaaaaagugguagggcgaguaauuucugcaacuccccuggcagagaauacuaacaguguaacaaauaucgaacuagagccacccuuuggagauagcuauauaguaauaggugugggaaauuccgcccuaacguugcacugguuuagaaaaggaagcucaauugguaaaauguucgaaucaacauauaggggagcaaaaagaauggccauucuaggagaaacggccugggacuuuggauccguggguggacucuuuaccucccuaggaaaggcuguccaccaagucuucgguaguguauacaccacaauguuuggaggcgugucuuggaugauccguauacuaauaggauuccuuguguuauggauuggaacuaauagucguaacacuagcauggcgaugacuugcauagcuguaggaggaauuacauuauuuuugggauuuacugugcaagcagauaugggguguguuguauccugguccggucgugaacuuaagugcgggagcgguauauucguaguagacaauguacacacauggaccgaacaauauaaauuucaaccugaaucuccugcucguuuggcaucggcaaucuuaaaugcacauaaagaugggguauguggaaucagaucaacaacucgauuagaaaacguuauguggaagcagauaacaaaugaauuaaauuauguuuugugggaaggagggcacgauuuaacuguuguggcaggagauguuaaaggggugcugaccaaaggcaaacgagcacugacgccuccggcaucugaucuaaaauauucauggaaaacuuggggaaaagcaaagauauuuacaccugaagccagaaauaguacguuccuaauagauggaccagauacaucagaguguccaaacgagagaagggcauggaacucauucgaaguugaagauuauggauuugguauguuuacaacuaacauauggaugaaauuuagggaaggauccagcgaaguaugugaccauaggcuaaugagugcagcaauuaaagaccaaaaggcagugcacgcagacauggguuauuggauagaaaguagcaaaaaucaaacuuggcaaauagaaagagcauccuugauugaagugaaaacauguuuauggccgaaaacacauacuuuguggucaaauggaguauuagaaagucagauguuaauucccaaaucguaugccgggcccuuuucucagcacaauuaccggcaagguuacgcaacccaaacgguagggccauggcaucuaggaaaacuagaaauagacuuuggugaauguccuggaacuacuguuacaauacaagagaauugugaucauagaggaccuucauuacguacaacgacggcgucuggaaaauugguuacccaaugguguuguaggucuugcacgaugccacccuuaagauuuuuaggagaagauggauguugguacgguauggaaauuagaccauuaagugaaaaagaagagaacaugguaaaaucgcagguaacggcaggacaaggcacaucugaaaccuucaguaugggccuacuuuguuuaacauuauuuguagaagaauguuugcgacgccgaguaacuaggaagcacaugauacuugccgugguaauaacguuaugugcaauaauauuagggggucuaaccuggauggauuuacuaagggcucucauuauguuaggugauaccaugagcgggcggauagggggacagacccauuuagcgauaauggcgguguuuaaaauguccccuggcuacguacuugguguauucuuaaggaaacuuaccucacgugaaacggcucugaugguuauagguauggcaaugaccacgacauugucuauaccacaugauuuaauggaacucauagacggaauaucguugggacucauacuauugaaaauaguaacacaauucgacaauacacaaguagguacacuagcccuuucacugacauuuauaagaucaacaaugucuuuaguaauggcauggagaacgauuauggcaguauuauuugugguaacguuaauuccacucuguaggaccucgugccugcaaaaacaaucccauuggguugaaauaacagcauuaauauugggugcacaggcgcuaccaguauaccugaugacacucaugaagggggcuucacggagauccuggccccucaaugagggcauuauggcgguuggcuuagucagucuauuaggaucggcgcuacucaagaacgauguaccauuagcgggcccaauggucgcaggagggcuucuguuagcagccuacguuaugucuggaucgucggcagaccugagucuggagaaggcggcaaacguucagugggacgaaauggcggauauuaccgggucaucccccauuauagaaguaaaacaagaugaggacggaaguuucucaauuagagauguugaagaaacaaauaugaucacccuguuaguuaaacuugcgcucaucacaguuuccggucuuuaucccuuggcaauuccuauaacgaugacguugugguacauguggcaagugaaaacacaaagaagcggcgcauuaugggauguaccgucuccugcggcaacacagaaagcagcacugucagaaggaguauauaggaucaugcaaagggguuuauuugguaaaacucagguuggagucgguauacacauggaaggaguguuccacacuauguggcauguaaccagaggcuccguaauaugucacgaaacaggucgacucgaaccuucaugggcugauguccgaaacgacaugaucucauauggaggaggauggcgauugggagauaagugggacaaagaagaagauguacagguguuagcgauagaaccaggaaagaauccaaagcauguucaaacaaaaccaggauuauuuaagacuuugacaggcgaaauaggugcgguaacauuagauuucaaacccgggacauccggauccccuauuauaaaucguaaagguaagguuauaggguuauauggaaacggagucguuacgaaaaguggcgacuauguaagugcuauuacacaagcugagcgaaucggagaaccagauuaugagguggaugaagauauauucagaaagaaaaggcuaacaauuauggaucuacaucccggggccggcaaaacaaaaagaauauugccgaguaucguuagagaagcacucaaacgaagacuucguacacuaauucuggcucccacccggguuguugccgcagaaauggaggaggcauuacgaggccucccaauucguuaccaaacaccggcgguaaaauccgaacacaccggaagagaaaucguagauuugaugugccacgcuacuuuuaccaccaggcuauuaucaagcacgagaguacccaacuacaauuuaauaguaauggaugaagcacauuuuaccgaccccuccagcguagcagcgagggguuauauuucaacccgaguggaaaugggggaggcagcagcgauauuuaugacggcaaccccucccggagcuacugauccauuuccacaaucgaacucaccaauugaagauauagagagagagauaccugaacguucuuggaacaccggcuucgacuggauaaccgacuaucaagguaaaacggugugguucguacccagcauuaaagcagguaaugacauagcuaauugucuucguaagagugggaagaaaguaauacaacuuagccgaaaaacauuugacacggaauacccaaaaacuaaacucacagacugggacuucgugguaacaacagauauaucggaaaugggggcaaauuuuagagcugggcgaguuaucgauccgagaagaugucuaaagccuguaauuuugacugacggucccgaacgagucaucuuggcgggccccaucccuguuaccccagcaagugcagcccaaagaaggggacgaauuggucgaaaccccgcucaagaggacgaucaauacguauuuucaggagauccucuaaagaacgacgaggaccaugcucauuggacagaagccaagauguuauuggauaacaucuacacaccugaaggaauaaucccgacacuguucgggccugaaagagaaaagacacaagcaauugauggagaguucagacuaagaggcgagcaaagaaaaacuuuuguugaacuaaugagaagaggcgauuuaccaguuugguuaaguuacaaaguagcaagcgcgggaaucaguuacaaagacagagagugguguuucacgggagagagaaauaaccagauuuuagaggaaaacauggaagucgaaauuuggacuagagaaggggaaaagaagaaacugagacccaaauggcuagaugcucgaguuuacgcugaccccauggcacuaaaggacuuuaaagaauuugccucaggacgcaaaucuauuacccuugauauacucacagaaaucgcgucccuaccgacauaucuuucguccagagcgaaauuggcucuagacaauauaguaaugcuacacacaacugaacguggagggcgagcuuaccaacaugcauugaaugagcuaccugaaagucuagaaacacuaauguuaguagcguuacucggugccaugacugcaggaauuuuucuguuuuucaugcagggcaaaggaauuggaaaauugucgaugggacugauaaccauagcaguagcgagcggcuuacuaugggucgcagaaauccaaccacaguggauagcugcgucgauaauucuggaguucuuucuaaugguacuacuaauuccggaacccgaaaaacaaaggacgccgcaagauaaucaauuaaucuaugucauauuaacgauccuaacaauaaucggguugauagcggcuaaugagaugggacuaauagaaaagacaaagaccgauuuuggcuuuuaccaagucaaaacggaaacaacaauccuggauguagacuuaagaccagcgagcgcuuggacacuuuaugcuguagcuacaaccauacuaacacccauguuacggcauacuauugaaaacacaagugcuaaccuaagucuagcagccauagcaaaccaggcagcaguucugaugggacuuggcaaaggguggccuuugcaucgaauggauuugggagugccauugcuagcaaugggauguuauagucaaguaaacccaacuacacuaacagccagcuuagucaugcuauuaguacauuaugcaauaauagguccagguuuacaagcuaaagcuacgagggaagcucaaaaacguacagccgcaggcauaaugaaaaauccaacuguagacggcaucacgguuauagacuuagagccaauaucauaugacccuaaauuugaaaaacaguuaggacaagugauguuacuugugcuuugugcaggacagcucuuauuaaugagaacaaccugggcauuuugugaagucuuaacacuagcuacgggcccuauccuuacucuaugggaagguaauccuggucguuuuuggaacacaacaauagcggugucaacggcaaauauauuuagaggaaguuauuuagcgggagcaggucuagcauucucuuuaauuaaaaaugcccaaaccccucgaagaggaacgggcacgacuggugaaacccuaggagagaaauggaaacgacaacuaaauucacuagacagaaaagaauuugaagaguacaagcguucagggauucucgaaguagaucguacugaagcuaaaucagcacuuaaagaugguaguaagaucaaacacgcagucucucgcggcucgucaaaaaucagguggauuguagaaagaggaaugguaaagcccaagggaaagguggucgacuuaggauguggaagaggaggauggucauauuacauggcuacguugaagaacgugacugagguaaaagguuacaccaaagguggaccaggacaugaagaacccauacccauggcaacauauggguggaauuuagugaaacuacauaguggaguugauguauucuauaaaccuacagaacagguagauacauuacuaugugauauuggagaauccucuuccaacccaacuauagaagaggguaggacucucaggguuuugaaaauggucgaaccauggcugucuuccaaaccggaauuuuguaucaaaguucucaaucccuauaugccaacaguaauagaagaacuggaaaaauuacagagaaagcauggaggcaacuugguuagaugcccgcuuucaaggaacaguacacacgaaauguacuggguuuccggagcuucaggaaacauuguaucaucaguaaacaccacaucuaaaaugcuuuuaaaucguuuuacaacgagacacagaaaaccuacguaugaaaaagacguugauuugggagcagggacucguucaguuucaacagagacugagaaaccagauaugacaauaauuggaagaagacugcaaagauugcaagaggaacacaaggaaacauggcauuacgaucaagaaaaucccuaucguacgugggcauaccauggaucuuacgaagcacccucgacaggaucagccucuucaaugguuaaugggguaguaaaauuacugaccaagccaugggacgucauaccaaugguaacgcaacuagccaugaccgauacuacacccuuuggccaacaacgcguauuuaaagaaaaagucgauacucgcacuccccaaccaaagccaggcacaagaaugguaaugacaaccaccgcuaacuggcuaugggcucuacuaggaaagaagaaaaauccaagacuaugcacccgagaggaguucaucucaaagguaagaaguaaugcagcgauaggcgcgguauuccaggaagaacaaggauggacaagcgcuucugaggcgguaaaugauucacguuuuugggaauuaguggauaaagaaagagcacugcaccaagagggcaaaugugaaucuugcgucuauaauaugaugggaaaacgagaaaagaaauugggugaauuuggccgugcaaagggguccagagcuaucugguacaugugguuaggcgcuagauuuuuagaauuugaagcacuaggcuuuuuaaacgaagaccauugguuuggcagggaaaauucuuggucuggaguugaaggcgaaggacuacauagacuagguuacauucuugaagagaucgacaagaaggauggugaccuaauguaugcugaugauacugcaggaugggacacaagaauuacggaagacgaucuccaaaacgaagaacuaauuacagaacaaauggcaccccaccauaaaauauuagcuaaagcaauuuuuaaacuaacguaucaaaacaaaguaguuaaaguucugcguccaacaccacggggugcuguaauggauauaauuaguagaaaagaucaacgcgguucuggucagguaggaacuuauggguuaaauacguuuaccaauauggaaguacaacuuauaaggcaaauggaagcagaaggagugauuacucaagaugacaugcaaaacccaaaaggguuaaaagaaagaguugaaaaauggcuucgggagugcggcguagacagacuuaagcgcauggcuauaagcggagacgauugcguugugaaaccgcuagacgaacgguucggaacaucccugcuguuuuuaaaugacaugggaaagguaagaaaagacauaccacaaugggaaccaucaaagggauggaagaauuggcaagaaguaccuuucuguagucaucauuuccauaaaauauucaugaaagaugggcgcuccuugguaguaccaugccgaaaucaagacgaacuuauagguagggcaaggaucagucaaggagcgggauggucguuaagagagacagcgugcuuagguaaagcguacgcacaaauguggucacucauguauuuucacagaagagaccucagauuagcgucaauggcgauaugcuccgcugucccuacggagugguucccuacgagucggacgacguggucaauacaugcgcaucaccaauggaugaccacggaagauauguuaaaaguuuggaacaggguuuggauugaggacaauccaaauaugauagauaaaacaccagugcauagcugggaggacauuccguauuugggaaaaagagaagaucucuggugcgggucacugauugguuuaagcucaagagcgacaugggcuaagaauauacacacagcuaucgcucaaguucgaaaccuaauugguaaggaggaauacguggauuauaugccggucaugaagagguacucagcaccuucagaguccgaagguguauuauaa

SEQ ID NO: 23646 - RNA, 9867 nt, Artificial Sequence
  derived and/or modified CDS sequence (opt6) from DENV-4__JN819406__SS-prME
aguacuauaacuuuacugugcuuaauucccacaguaauggcuuuccacuuaucgacucgagacggagagcccuuaaugauaguugcaaaacaugaacgcggacggcccuuauuauuuaaaacgaccgaaggaauaaauaaaugcacacucauugcaauggaccucggagaaaugugugaagauaccguuaccuacaagugcccacuauuaguaaauacagaaccggaagacauugacuguugguguaaucuaacaucuaccuggguuauguauggaacauguacucaaucgggggaacgacgucgugaaaagagaucaguagcucuaaccccacauagcgggaugggauuagaaacacgagcugaaaccuggaugucuucggaaggugcauggaaacaugcacagcggguggaauccuggaucuuaagaaauccugguuuugcauuacuugccgguuuuauggcuuauaugauuggacaaacugguauacaacgcacuguauucuuuguauuaaugauguuaguugcaccaucguauggaaugcguuguguagguguaggaaacagagacuuuguagaaggcguuucugguggagcauggguggaccuuguccuagaacacggaggauguguaaccaccauggcucaaggaaagccgacucuagauuucgaacuaacuaaaacuacugcuaaggaagucgccuuauuacggaccuacugcauagaagcgcuaauaaguaacauaacuacagcaacuagaugcccaacucaaggagaaccuuaccuuaaagaggaacaggaccagcaauacaucugcaggagagauguaguagauagagguugggggaauggauguggacuuuuugguaaaggaggugugguaacuugugcaaaauucucaugcaguggaaaaauaacaggaaaucucguacaaauagaaaauuuagaauauacuguugucgucacuguccacaauggugauacacaugccguaggcaacgauacuuccaaccaugguguuaccgcuacuaucacgccacgaucuccaucuguugaaguaaagcuaccagacuacggagagcuaacacuagauugcgaaccgaggagugggauugacuucaaugagaugauccuaaugaaaaugaagaagaaaacgugguugguacauaaacagugguuuuuagaucuuccacugccuuggacaacaggagcggacaccagugagguucacuggaacuacaaagagcgaaugguaacauucaaaguaccacaugccaaaagacaggacgucacuguccuaggcucucaagaaggagcgaugcacagugcauuagcuggggcgacugaaguagacucaggagacggcaaucacauguuugcgggacaucuaaaauguaaaguacgaauggagaaacuuagaauuaaagguaugucuuacacaaugugcagugggaaauucucgauugauaaggaaauggcagagacucagcauggaacaaccgugguuaagguaaaauacgaaggcgccggggcacccugcaaaguaccgauagaaauacgugacgucaauaaagaaaaagugguagggcgugugauuagcgcuacaccucuugccgaaaacacaaacucugucaccaauauagaauuagaaccaccguucggugacaguuauaucgugaucggaguagguaauucagcacuuacacuacacugguuuagaaaaggaucuaguauuggaaaaauguuugaguccacguaucgcggugcaaaaagaauggcaaucuugggggaaacggcgugggauuucggaucgguaggcggacuuuucaccagcuugggaaaagcugugcaucaaguauucggaaguguuuacacaacaauguucggaggagugucauggaugauuagaauacucauaggcuuccuaguacucuggaucggaacaaauaguaggaacacaucgauggcaaugaccuguauagcuguaggcggaauaacuuuauuucuagguuucaccgugcaagcagauaugggcugugucgucucauggucggcccgugaauuaaaauguggaaguggaaucuuuguagucgacaacguucauacguggacagaacaauaccaauuucagcccgagucuccagcccguuuagcgagcgccauauugaacgcacauaaggaugggguaugcggaauuagaaguacgacaagacuugaaaauguuauguggaaacaaaucacgaacgaguugaacuauguauuaugggaagggggacacgacuuaacagucguagccggcgauguuaaaggaguucuaaccaaaggaaagcgugcauuaacgccaccagcaagugaccuaaaguauucauggaaaacuuggggaaaagcuaaaaucuuuacaccagaagcuaggaacucaacauucuugauagacggucccgauacaucagaaugccccaaugaaaggagagcauggaacucuuucgaaguagaggauuacggauucggcauguucaccacaaauauauggaugaaauuuagggaaggaucgagugaagucugcgaccacagauugaugucagcugccauaaaagaucaaaaagcaguucacgcagauaugggcuacuggauagaaucuagcaaaaaucaaacuuggcagaucgaaagagcaagucuuauugaaguuaaaacuugucuauggccaaagacgcauaccuuguggucaaauggcguacucgaaagccagaugcuaauuccuaaaucguaugcaggaccguuuagccagcacaauuacagacaagguuacgcuacucagacaguugguccauggcaccuaggaaaauuagagauagacuuuggugaauguccaggaacaacuguaacaauccaggaaaacugugaccaccguggaccgagcuuaagaacaacaacugcuucgggaaaacugguuacacaguggugcuguagaagcugcacuaugcccccacucagauuccuaggagaagacgguuguugguauggcauggaaauacgacccuuaucagaaaaagaagaaaauauggucaaaagccaaguuacagcuggacaaggaacuagcgaaacauucucuaugggccuccuaugucuaacauuauuuguugaagaguguuuaagaagaaggguaaccagaaaacauaugauccucgcgguaguuaucaccuuaugugccauaaucuuaggaggucuuacuuggauggaucuauugcgagcccuaauaaugcugggagauacaaugagcggcaggauagguggccaaacacauuuagcaaucauggcaguuuuuaaaaugagcccuggauacguuuuaggagucuuuuugagaaaacuuaccucuagagagacagcuuugaugguaauagggauggcgaugacuacuacacuuagcauaccacaugaucugauggaguugauugauggaauuucucugggucuuauauuauuaaaaauagugacucaauuugacaacacgcaaguuggaacguuagcguuaucguuaacauuuauaagaucaacaaugagccuaguuauggcguggcgcaccauuauggcaguacuguucgucgucacucugauaccucugugccguacaagcugucugcaaaaacaaucccauuggguagaaauaacagcuuuaauacuuggggcacaagcccuuccagucuacuugaugacucuaaugaagggcgccaguagacgcucuuggccccuuaacgaagguauaauggcaguaggcuuaguaagucuacuaggaucagcgcuucuuaaaaaugaugugccacuugccggaccgauggucgcugguggacuacuacuggccgccuacguuaugagcggaaguagcgcugaccucaguuuagaaaaagcagcaaauguacaaugggacgaaauggccgauauuacugggaguaguccuauaauagaagugaaacaagacgaagacggaucauuuucgauuagggacguggaagagaccaacaugauuacucucuugguuaaacuugcauuaauaaccguuucaggucucuacccguuagcaauaccaauuaccaugacacugugguauauguggcaagugaaaacacaacgcuccggagcguuaugggauguaccuagucccgcagcgacccaaaaagcugccuugagcgaagggguauaucgaauaaugcaaagagguuuauuuggaaaaacacaaguagggguagguauacauauggaaggaguguuucauacuauguggcauguuaccagaggcaguguaauuugucaugaaacaggacgacucgaaccguccugggcagaugugagaaaugacaugauuuccuauggugggggcuggcgacuuggagauaaaugggacaaagaagaagauguccaaguucuagcaaucgagcccggcaaaaauccaaagcaugugcaaacaaaaccagguuuauucaaaacacucacgggagaaauuggagcaguaacuuuggacuuuaagccgggaaccaguggcucacccauuauuaaccgcaaagggaaagucaucggacuguauggaaaugguguagugacaaaaaguggcgauuauguauccgccauaacccaagcagaacguauuggagagccagauuacgaaguggacgaagacauauuucguaagaaaagauuaacuauuauggaccuacacccgggugcaggaaagacaaaacggauacuacccaguauaguuagagaggcgcugaaacgacggcuucgaacucugauccuggcaccuacaagaguaguagcagcagaaauggaagaagccuugcgagggcuaccuauucgauaucaaacacccgcagucaagucagaacauacaggaagagagaucguugauuuaaugugucaugcuaccuucaccacaagacuauugagcagcacgagaguuccuaauuacaaucuaauagugauggacgaggcucacuucacugacccaucguccguugcagccagggguuauauaaguacaagaguagaaaugggugaggcggccgcgauauuuaugacugcuacuccacccggggcuacagauccauucccccaaaguaacaguccuauugaagacaucgaaagggagauacccgaaagaucauggaauaccggauuugacuggauuacagacuaccaggguaaaacagugugguuuguaccuuccauaaaagcaggcaaugauauugcuaacugccuacguaaaaguggaaagaaaguuauucaacuaucucggaaaacguuugauaccgaauauccuaaaacaaaacucacggacugggauuuugucguuacuaccgacauaucugagaugggcgccaauuuucgugccggcagaguuauugauccuagacgaugucuaaagcccguuauucuaacugauggucccgaaagaguaauauuagccgggccuaucccagucacuccggcaucggcagcacagaggagaggccgaauaggaaggaauccagcgcaggaagaugaucaauauguauuuucuggagauccucucaaaaacgaugaagaucacgcacauuggacagaggcaaaaauguugcucgacaacauauacacaccggaagggauaauucccacguuauucggcccagagagagagaagacccaggcaauagauggugaguucagauuacgaggugaacaaaggaagacguucguagaauuaaugcgcagaggagauuugccaguuugguuaucauauaagguggcuucagccggaauaucuuauaaggaccgagaauggugcuucacaggagagaggaacaaucaaauuuuagaagaaaauauggaaguagaaauuuggacacgggagggcgagaaaaagaaauugaggccuaaauggcucgacgcgagaguuuacgcagauccaauggcacuaaaagacuuuaaagaguucgcuucgggacggaaaucaauaacuuuagauauucuuaccgaaauagcaucacuacccaccuaucuauccucuagagcuaaacuagcuuuagacaauauuguuauguuacacacgacagagcgcggaggcagagcuuaccaacacgcacuaaacgaacuccccgaaagccuagagaccuuaaugcuuguugcuuugcuuggagcgaugacugcggguauauuucuauucuucaugcaagggaagggcaucgguaagcuaaguauggguuuaauuacgaucgccguggcuucuggccuauuauggguagcugaaauucaaccacaauggaucgcagcaucaaucauacuagaauuuuucuuaauggucuugcugauuccugagccagaaaagcaaaggacuccccaggauaaccaauuaauuuauguuauucuaaccauccuaacuauaauuggucuaauugcugcaaaugaaaugggcuugauugaaaagacaaaaaccgacuuuggauucuaccaagugaaaacagaaacgacaauacucgauguugauuugaggcccgcaucagcauggacucuauaugccguugcaacaacaauccuuacaccuauguuaaggcacacaauagagaauaccagcgcgaaucuaucuuuggcugccauagcaaaccaggcugccguacuuauggguuuagggaaaggguggccacuucauagaauggauuuaggaguacccuuguuggcgaugggaugcuacucccaagucaauccuacuacucuaaccgcaagucuagucauguuauuaguucacuacgcaauaauugggcccgggcuucaagcgaaagcaacaagggaagcucaaaaacggacugcagcuggcauaaugaagaacccuaccguagauggcauuacuguuauugaucuugaaccaauaaguuacgaucccaaguucgaaaaacaacuuggacaaguaauguuauugguucuuugcgcaggacaguuacuacuaaugcgaacaaccugggcuuucugugaaguauugacacucgcgaccggcccaauacugacacuuugggagggcaacccuggccgauuuuggaauacaacgaucgcaguaagcaccgcaaauauauucagggguucguaccuggccggugcaggacuugcauucucccuaauaaagaacgcucagacuccacgacgagguaccggcacuacuggagagacacuuggcgaaaaguggaaacgacaacuuaacucacuagacagaaaagaauuugaggaguacaaaagaagugguauauuagaaguggauaggacagaggccaaaagcgcguuaaaagauggcuccaaaauaaagcaugcaguaagcagaggaucguccaaaauacguuggauaguggagagaggcauggucaaaccgaaaggaaaggugguugauuuagguuguggaagagggggauggucuuauuauauggcgacucuaaagaauguaacggaaguuaaaggauauacaaaaggugguccgggucacgaagaaccaauucccauggcaacguauggguggaauuuagucaaacuucauagcggaguugauguauucuauaaaccaacagaacaaguggauacauuacuaugugauauaggcgaaucauccaguaauccaaccauagaagaaggucggacuuuaagaguacucaaaaugguggaaccauggcuaucuucaaaaccggaauuuugcauaaagguucuaaacccuuacaugccgacuguaauugaagaacuugaaaaguuacaacguaaacaugggggcaaccuaguccgaugcccacuuuccaggaauagcacacacgaaauguauuggguaaguggugcaagcggaaauaucgugucuucuguaaauacuacgucuaagaugcuguuaaacagauuuacuaccaggcacaggaaaccgacuuaugagaaagauguagauuuaggcgcaggaacuagguccguaucgacugagacggaaaaaccagauaugacaauaauaggaagaagacugcaacgcuuacaagaggaacacaaagaaacuuggcacuaugaucaggagaaucccuaucgcacgugggcuuaucauggaaguuaugaggccccaucgaccggaucagcuagcucaaugguaaauggagucguaaaacuauuaacgaaacccugggacguuauuccgaugguaacucaauuagcaaugacugauacgacgccauuuggucaacaacguguuuucaaagaaaaaguagacacucgaacgccacaaccgaaacccgggacaaggaugguaaugaccacaacagcuaauuggcuuugggcauuacucggcaagaagaagaauccccgguuauguacgagggaggaauuuaucaguaaagucagaagcaaugcugccauaggggcgguauuccaagaagaacaaggauggacaucagcaucagaggcaguuaaugacaguagauucugggaauuggucgauaaggaaagagcauuacaccaagagggaaaaugugaaaguugcguauauaauaugaugggaaagagagagaaaaagcuaggcgaauuuggcagagccaaagguucgcgugcaauaugguacaugugguugggagcaagauuucucgaauuugaagcccuaggauuuuuaaaugaggaucauugguucgguagagaaaacuccuggucaggaguagagggugagggauuacauagauuaggauacauccuggaggaaauagacaagaaagacggcgauuuaauguaugccgacgauacagcuggaugggacaccaggauuacugaagaugaccuacagaaugaagaauuaauaacagaacagauggcgccucaucauaaaauucuagccaaagccauauuuaaauuaacuuaucaaaauaagguagugaaaguucuaaggccgacgccacguggagccguaauggauaucauaucuagaaaggaucaaagaggaucaggacaaguugguacguauggauuaaacacauuuacgaauauggaaguccaacugauacgacaaauggaagcugagggaguaauaacucaagaugacaugcaaaauccuaagggacuuaaagagcgaguugagaaaugguuacgcgaauguggaguugaccgauugaaaagaauggcaauaagcggagaugauuguguagugaagccuuuagaugaacgguuuggcacuucauuauuguuucuuaaugacauggguaaaguucgaaaggacauaccacaaugggaaccaucaaaagguuggaagaauuggcaagagguaccuuucuguagccaucauuuucacaaaaucuucaugaaagacggccguagucugguuguacccuguagaaaucaagacgaacuuauaggacgcgcgcggaucagucagggagcuggcuggagccuucgcgaaacagcauguuuagguaaggcuuaugcacagauguggucuuuaauguacuuccauaggagagaucugaggcuagcaaguauggccauuuguucagcugucccuacagaaugguucccuacaucucggacaacuuggucuauacacgcgcaccaccaguggaugacgacugaggauaugcuaaaaguuuggaaucgaguauggauagaagauaauccuaauaugauagacaaaacuccuguucauucaugggaagauauacccuauuugggaaaaagggaagauuuauggugcggcucucuaaucggauuaaguucuagagcuacaugggccaaaaacauacacaccgcaauaacucaaguacguaaucuaaucgguaaggaagaauacguagacuacaugccuguaaugaagcgguacucugcaccuuccgagucggaagggguguuguaa

SEQ ID NO: 23647 - RNA, 9867 nt, Artificial Sequence
  derived and/or modified CDS sequence (opt6) from DENV-4__GQ199876__SS-prME
uccacuauuacucuucugugcuugaucccaacaguuauggcauuucaucucucgacucgugauggggaaccauuaaugaucguugcuaaacaugaacgcggucggccucuccuauucaaaacaacagaaggaauaaacaaauguacacuuauugcaauggauuuaggagaaaugugcgaagacaccguaacauauaaaugcccgcuauuagucaauacagaaccugaagauauugauuguugguguaauuuaacaaguacuuggguuauguacggaacauguacccaauccggugaaagaagacgagaaaaacguucaguagcguuaacaccacauaguggaaugggcuuagaaacccgagcugaaacuuggaugagcucagaaggagcuuggaaacaugcgcagaggguugaaaguuggauccuaaggaauccugguuucgcucuguuagcaggguucauggcauacaugauagggcaaacgggcauucaacgcacuguauuuuucguucuaaugauguuagucgcgccaagcuaugguaugcgcugcgugggaguugggaacagagauuuuguugaagggguaucagguggagcauggguagaucuaguucucgaacacggcggcugugugacuacaauggcacaaggcaaaccaacauuagauuuugaauuaacaaaaacgacggcuaaagaaguggccuuauuaagaacguacuguauagaagcguuaauuuccaauauaaccaccgcaacacgaugcccuacacaaggugaaccguaccucaaagaagaacaagaucaacaguacauuugucgcagggauguaguagacagaggauggggaaaugguugugguuuauuuggcaagggcggagucguuacaugugcaaaguuuagcuguagcgguaagauaacuggaaaccucguacaaauagaaaauuuagaauacaccguuguuguuacuguacauaacggagacacccaugcgguaggaaaugacacaaguaaucaugguguaacugccacaauaacgccacgcucgccuucgguagaaguaaaacuaccagauuauggagaauuaacccuagacugcgaaccaagaucagggauagacuucaacgaaaugauucucaugaaaaugaagaagaaaacguggcuuguacauaagcaaugguuucuagauuuaccuuugccguggaccaccggagcagauacaagugaaguacauuggaauuauaaagaacgaauggucacauucaaagucccucaugcuaagagacaagauguaacaguuuuaggaucucaagaaggagcgaugcauucggccuuggcgggugccacggaaguggacagcggagauggaaaccauauguuugcaggccaucucaaguguaaagucaggauggagaaauuaagaauaaagggaaugucauacacuauguguucuggcaaauuuucaauugacaaagaaauggcagaaacucagcaugguacaacaguaguaaaaguuaaauaugaaggagcuggugcuccguguaaaguccccauagaaauaagagacguaaauaaagaaaagguuauaggaagagucauuucugcuacaccacuugcagaaaacacuaacucagucaccaauauagaauuagagccaccguucggggauucuuauauagugaucggagugggaaauucugcucuaacauuacauugguucagaaagggaucgucgauugguaaaauguuugaauccacguaucgcggagcuaaaagaauggcaauacuaggagagaccgccugggacuuugguucaguugguggauuauuuacgucgcuagguaaagcuguacaccaagucuuugguucaguauacaccacaauguucggaggagucuccuggaugaucagaauacuuauuggauucuuaguauuguggauagguaccaauucacgaaacacaagcauggcgaugacuuguauagcaguuggagguaucaccuuauuucuagguuuuacaguucaagcggauauggguugugugguaaguuggucaggaagagaacuaaaauguggaucaggaauuuucguaguggauaauguucauaccuggacugagcaauauaaauuucaaccagaauccccugcuaggcuagccagcgcaauuuugaacgcgcauaaagacggaguuuguggaauaaggucuacaacccguuuagaaaacgugauguggaaacagauuaccaaugaauuaaauuacguacucugggagggaggacacgaucuaaccgugguggcaggcgauguaaaggggguauugacgaagggaaaacgagcauuaacucccccugcuagugaucugaaauacucauggaaaaccuggggcaaggcuaaaauuuuuacuccugaggcgagaaauaguacuuuucucauagacgggccugauacauccgaauguccaaaugagagacgggcauggaacagcuuugaaguugaagauuauggguucggaauguuuacuaccaauaucuggaugaaauuuagagaaggaagcucagagguuugugaccauagguuaaugagcgcggcaauaaaagaccaaaaagcaguucaugcagauaugggguacuggaucgaaucgucuaaaaaccaaacguggcaaauugaacgagcaucacucauugaagugaaaacaugcuuguggccuaaaacucauacauuauggaguaacgguguacuagagagucaaauguuaauaccaaaaagcuacgcaggaccauucagccagcauaacuacagacaagguuacgcaacucaaacaguagguccguggcauuuagggaaacuagaaaucgauuucggcgaaugcccugguacuacuguuaccauacaagaaaacugugaucaccgugguccaucguuaagaacaaccacggcuagcggaaaauuagugacucaaugguguugcaggaguuguacuaugccaccgcuacgcuuccuaggagaggacgguuguugguacggaauggaaaucagaccucucucggagaaggaagagaacaugguuaaaucacaaguaacagcgggucaagguacaucugagacguuuucaaugggauuacucugcuuaaccuuauuugucgaagaauguuugaggaggagaguaacgcguaagcauaugauauuggccguaguaauaacacuaugugcuauuauuuuaggaggacucacuuggauggaccuacuuagagcccuaauaauguuaggugauacaauguccgguaggauugggggacaaacccaucuugcaauuauggcuguauuuaaaaugucaccaggauaugucuuagguguguuccuacguaaacuaacguccagagagacagcccuuauggugauaggaauggccaugaccacaacuuuaucuauaccgcacgauuugauggaauugaucgauggcauaucauuaggauuaauuuuauuaaaaauaguuacacaauuugacaacacucaggucgguacguuagccuugagccuuaccuucauucgcagcacaaugucacugguaauggcguggagaacgaucauggcaguccuauuuguaguaacguuaauaccacuuugcagaacauccugucugcaaaaacaaagucauuggguagaaauuaccgcacuuauauuaggagcccaagcccuuccaguauaucugaugacgcuuaugaaaggugcgagccggcgcagcuggccuuuaaacgaaggaaucauggccgugggauuaguaagccuccuaggaagugccuuacugaaaaacgauguuccauuagcugguccgaugguugcaggagggcuuuuacuggcugcuuacgugaugucuggaucaucggcagacuuaagucuagaaaaagcugcgaauguccagugggacgagauggcugauaucacgggaagcaguccaauaauagaaguaaagcaagacgaagacgggaguuuuucaauccgggacguagaagagacuaacaugaucacuuugcuagugaaacuagcguuaauaacugucucggggcuauauccucuggcaauuccaaucacuaugacacuuugguacauguggcaaguaaagacacagcgcucaggagcccucugggacgucccaucacccgccgcgacgcaaaaagcagcccuaucggaaggaguauaucgaauaaugcagagaggucuguucgggaaaacucagguugguguuggcauccacauggaggggguuuuucacacuauguggcacgugacuagaggaagcguuauuugucaugagacaggcagauuagaaccuucaugggcugacguaaggaaugauaugauaucuuauggugggggauggagauugggagauaaaugggacaaagaagaagauguccagguacuggcaauagagccagguaaaaacccaaaacacgugcaaaccaaaccgggguuauuuaagacucuaacgggagaaauuggcgcaguaacgcuagauuuuaaaccuggaacaagcggaucuccgauaauaaauagaaagggaaaaguaauaggacuauaugguaacggcguaguaacaaaaucaggggauuaugugagcgccauaacucaagcagagcgcauuggcgagccggauuacgaaguagaugaagauauuuuccgcaagaaaagauuaacuauaauggaucuucauccuggcgcggguaaaacaaaaagaauauuaccaagcauagucagagaagcgcuaaaaagacgucugagaacccucauccuagcuccgacgagagucguagcagcggaaauggaggaagcucuacgaggauugcccguucgguaucaaacucccgcagugaaaucugaacauaccgggcgggaaauugucgaucuaaugugccaugcaaccuucaccacaaggcuauuauccucgaccagagugccaaauuauaaucuuauaguuauggaugaagcgcauuuuaccgauccaucaaguguggcagcuagaggauacauuucaacacgagucgaaaugggagaggcugcugcgauuuucaugacagccacaccacccggagccacggauccuuucccgcaguccaacucaccgauagaagacaucgaaagagaaauuccagagcgauccuggaacacaggauuugacuggauuacagacuaccagggcaaaacaguuugguuuguaccguccaucaaagcaggcaacgacauugccaauugucuaagaaaaucaggaaagaagguaauccaauuaaguagaaaaaccuucgacacagaauacccuaaaacaaaauuaacagacugggauuucguuguaacaacugacaucagcgaaaugggagcuaacuucagagcugguagaguuauagacccacgucgaugccuuaaaccaguaauauugaccgauggaccagagagaguaauacuugcagguccaauaccagugacuccagcaucagcugcucaaaggcgaggaagaaucggacggaauccagcucaggaggacgaucaguacgucuuuucaggggaucccuugaaaaacgacgaagaccacgcucacuggacagaagcaaagaugcuuuuagacaacaucuacacuccugaagguauaauaccaacacuguuuggaccugaacgagagaaaacccaagccauagauggagaguuucgacugagaggcgaacaacgaaaaacguuuguggaguuaaugcgccgaggagauuuaccuguaugguugucauacaaaguugcaagcgcaggaauaagcuacaaggaccgugagugguguuuuaccggagaacgaaauaaucaaauacuggaagaaaauauggagguggagauauggacaagagaaggagagaagaagaaauugagaccaaaauggcucgaugcaagagucuaugcugaucccauggcacuaaaagacuucaaagaauuugcaagcggaagaaaaaguaucaccuuggacauacuuacagaaaucgcuagccugcccacguacuugucaaguagagcuaaacuugcauuggauaacaucgucaugcuccauacuacugaaaggggcgggcgcgcguaucaacaugcguugaacgaacuaccagaaucccuagaaacuuuaauguuagucgcucugcuaggcgcaaugaccgccggaauauuuuuauucuuuaugcaagggaaaggaauagguaagcuauccaugggauugauaacuauagcaguugccucuggauuauuauggguagcagaaauacagccucaauggauagcagcaagcauuauacuagaguuuuucuuaaugguucuucucauaccagaaccugaaaaacaacguacaccccaggacaaccaauuaauauauguaauacucacgauauuaacuauaaucggauugauagcagcgaaugaaaugggacuaauugagaaaacgaaaacugauuuuggauuuuaucaagugaaaacagaaacuacgauauuagauguagauuuaagacccgccagcgcuuggacauuauaugcaguagccacaacaauacucacaccuaugcuacgacacacaaucgaaaauacaucagcgaaucuguccuuagcugcaaucgcaaaccaagcagccguccuaaugggccuagguaaaggauggccacuacacagaauggaucuaggugugccgcuucuagccaugggaugcuauucucaagucaauccaaccacgcucacagcaagccuaguaauguugcuaguucauuacgcgauaaucggaccaggguugcaagcuaaagcaacacgagaggcacaaaaacgaaccgccgcggggauaaugaaaaauccgacgguggacggaauaaccguuauugacuuagaaccuaucucuuaugauccuaaauuugaaaagcaauuaggucaagucaugcuauuaguguugugugcuggucaauugcuuuuaaugcgaacuaccugggcauucugugaagugcuaacacuggcaacgggaccaauucuaacccucugggaaggaaauccuggucguuuuuggaacacaaccauagcugugucuaccgcaaauauuuucagagguagcuauuuggcaggagccggauuagcguuuucccuaaucaaaaaugcccagacgccucgucgaggaacuggaacgacaggagaaacacuaggcgaaaaauggaagcgucaauugaacucauuagauagaaaagaauuugaagaauacaaacgaagugguauucuugaaguggacaggacagaagcaaaaucugcauuaaaagauggaucaaaaauuaaacaugcgguaucacgagguucaucaaagauuagauggauaguugaaaggggcauggugaaaccuaaggggaaagucguagacuuaggaugcggacgugguggcuggucuuacuauauggcuacgcuuaaaaacguuacagagguaaaaggguacaccaagggaggaccgggucaugaagaacccauuccuauggcaacauauggguggaaucuaguuaaacuccacucagguguugacguguucuauaagccaacagaacaaguugauaccuugcucugcgauaucggagaaaguucaagcaauccaacgauagaggaaggacguacauugaggguucuaaaaaugguugaaccuuggcuaagcucaaaaccagaguucugcauuaaggugcuuaaucccuauaugccuacagucauugaagaacuugaaaaacuucagagaaagcauggggguaaccuggugcguuguccauuaagccggaacagcacacaugaaauguacuggguuucaggugcaagcgguaacauagugaguucaguaaacacgacauccaaaauguugcuaaauagauuuaccacgaggcaccgcaaaccaacuuaugaaaaagaugucgaucuuggugccggcacucgaaguguaucaacggaaaccgagaaacccgauaugacgauaauaggacguagacuacaacgacuccaggaagaacacaaagaaacuuggcauuaugaucaagagaauccuuaucgaacaugggcauaccauggcucauaugaagcucccucaaccggaucggcuaguuccauggugaauggagugguaaaauuacuaacuaaaccgugggaugugauacccaugguaacucaacuugccaugacagauacaacuccauucggacagcaacguguauucaaagaaaagguggauacacgaacuccgcaaccuaagccugggacaagaauggugaugacaaccacagcuaauuggcuuugggcucucuuagggaaaaagaaaaauccgcgucugugcacgagagaagaguucauaucuaaaguaagaagcaaugcugcaauaggagccguguuucaagaggaacaaggauggacaucagcaucugaagcgguaaacgauaguagguucugggaacugguugauaaggaaagagcccuacaucaagaagguaaaugugagucauguguuuauaauaugauggggaaaagagagaagaaauugggcgaguucggccgcgccaaaggaaguagagccauaugguacaugugguuaggugcccgauuccuugaguucgaggccuuagguuuucuaaacgaggaccauugguuuggaagagaaaacaguuggucaggugucgaaggcgaaggauuacaucgauuaggguauauauuagaagaaauagauaaaaaggauggggaucugauguaugcugaugauacagcagggugggacacuagaauuacagaagacgaucugcaaaaugaagaauugauuacugaacaaauggccccacaccauaaaauucuugcgaaagcaaucuucaaauuaacguaccaaaauaaaguaguaaaaguauuacguccgacaccacgcggggcgguaauggacauaaucucgcguaaggaccaacgaggcucuggacaaguggggacauauggauuaaauaccuucacaaacauggagguacagcuaauuagacaaauggaagcggaggguguuauaacccaagaugacaugcaaaacccuaaggggcuaaaagaacgaguagaaaaauggcuaagagagugcggaguggauaggcuuaaaaggauggccaucagcggugacgacugcguaguuaaaccucuggaugaaagauucgguacaucucugcuauucuugaaugauauggggaaaguaagaaaagauauaccacaaugggagccaucuaaggguuggaaaaauuggcaggaagucccguuuuguagucaccacuuccacaaaauauucaugaaagauggacguucucugguagucccuuguaggaaucaagaugaacuuauuggacgcgcaaggauuagucaaggugcaggcuggucacuacgugaaacagcguguuuaggaaaagcauaugcacaaauguggaguuuaauguacuuucaucggagagauuuacgauuggcuucuauggcaauaugcucagcaguuccuacagaaugguuuccuacaucacggacaacaugguccauacaugcccaccaucaauggaugacuacagaagacauguuaaagguguggaauagaguuuggauagaagacaaucccaauaugacggauaaaacuccaguccauucaugggaggauauaccguauuuagguaaaagagaagauuuaugguguggaucgcuaaucgguuuaucgucacgagcaaccugggcaaagaauauccacacagcaauaacccaggugagaaaucuaauagguaaagaggaauacgucgauuacaugccuguuaugaaaagauacagugccccaucggagagcgaaggaguacuauaa

SEQ ID NO: 23648 - RNA, 9867 nt, Artificial Sequence
  derived and/or modified CDS sequence (opt6) from DENV-4__KP723482__SS-prME
ucaaccaugacgcuccucuguuuaauccccacuguuauggcauuucacuuaaguacaagagauggagaacccuuaaugauaguagcuaaacaugaaagagggagaccauuguuauucaaaacaacggaaggaauaaacaaauguacguugauagcaauggaucuaggagaaaugugugaagauaccgucaccuauaaauguccauuacucguuaacacagaacccgaagacauugauuguuggugcaaucuaacuucaaccugggugauguauggaacuuguacacagucaggagaacggcgcagagaaaagagauccguagcacuaacuccacacuccggaaugggucuugaaacucgcgcagaaacauggaugagcagcgaaggggcauggaaacaugcacagcgaguggaauccuggauccuucgaaaccccgguuucgcucuuuuggcaggauucauggcuuauaugauaggucaaaccggcauucaacgaacuguauucuuuguccuaaugaugcuaguugcuccuucuuacggcaugcgauguguaggugucggaaacagagacuuuguugagggaguuagugguggagcauggguagaccugguucuagaacaugggggauguguaaccacaauggcgcaaggaaaaccaacucuugauuuugaacuaacgaaaacaacugcaaaagaaguagccuuauugcgcacauauuguauugaggcuuccaucucaaauauaacuacagccacaagaugcccaacacaaggugaaccauauuuaaaggaagaacaagaucagcaauacauaugccgaagagacgucguagaucgagguugggguaacgguugcgggcuauuuggaaagggagguguagucacaugugcuaaauuucuauguucugggaagaucaccggaaaucuaguacagauugaaaauuuagaguauacaguaguaguaaccguacacaaugggaauacacaugccguaggcaacgauacuucgaaucauggggucacagcgaccaucacaccuagaucuccaucaguugaaguaaaacuaccugauuauggugaauuaacacucgauugcgaaccaagaucuggaauugacuucaaugaaaugauauugaugaagaugaagaagaaaacuugguuggugcauaaacaaugguuucuagauuuaccguuaccauggaccgcuggcgcagacacuucggagguccauuggaauuacaaagaacgaaugguuacauuuaaaguaccucaugcuaaacgucaggaugucacaguauugggaagccaagaaggagcgaugcauucagcgcuagccggugccacagaaguugauucaggggacgggaaucauauguucgcgggacaucucaaauguaaaguucgaauggagaaacuucgaaucaaagguaugucauauacaauguguaguggaaaauucaguauugacaaggaaauggcggaaacacaacauggcacaacgguaguaaaagucaaauacgaaggagccggagcgccuugcaaagugccaauugaaauaagagauguaaauaaagaaaaaguaguaggaagaauuauaagcaguaccccguuugcagaaaauacaaauagcgucacaaacauagagcuagaacccccuuucggggauucauauauaguuauaggaguaggugacucagcacuaacacuucacugguuccgaaaggguaguucuauagguaaaauguucgagaguacuuacagaggugcuaagaggauggcuauacuaggagaaacggcgugggauuuuggaucgguaggaggauuauucacgucauugggaaaggcagugcaccagguuuucggguccguguauaccacgauguucggaggaguaucauggaugaucagaauacuaauaggauuuuuaguacuuuggaucgguacuaauucaagaaauacgucuauggccaugaccuguauagcaguaggcgggauuaccuuauuuuuaggauuuacaguccaagcugauaugggguguguggugaguuggaauggcaaggagcuaaaaugcgggucagguauauuuguuguugauaacguccauaccuggacugaacaauacaaauuucagcccgagagcccugcacgauuggcaucagcaauacugaacgcgcauaaagacgguguaugcggcauaagaaguacaacgcgucuggaaaacguaauguggaaacaaauaacuaaugaacuaaauuacguuuugugggaaggaggacaugaccuaacugugguagcuggagauguuaaaggagucuuaacuaaagguaaacgagcacuaacacccccaguuaaugaucuaaaauacucuuggaagacauggggaaaggcaaagauauuuacaccagaagcgagaaauucaacauuuuuaauagauggaccggacacuucagaaugcccuaaugaaagacgggcuuggaacuuuuucgaagucgaagauuacgguuucggaauguuuacaacaaauauauggaugaaauucagggaaggaucgucggaaguaugcgaccauagguugaugagugcugcgaucaaagaucaaaaggcaguucacgcagauaugggcuauuggauagaaucaucaaagaaccaaacguggcaaauugaaaaagccucguuaauagaagugaagacaugccuuuggccuaagacucauacucuauggaguaacggaguacuugaaagucaaaugcuaauuccucgauccuaugcaggaccauuuagucaacauaauuaccgccaagguuaugcuacucagacugccggacccuggcaucuugggaaauuagaaaucgauuuuggagaauguccaggaacaacaguaacgauucaagaggauugugaccauagaggcccaucucuucgaacuacaacugccucggguaaauugguaacgcaaugguguuguagaucauguacuaugccacccuuaagauuucuuggagaagacggauguugguacggcauggagauccgaccccucucggaaaaggaagaaaauauggucaaaucacaagugacggcuggacaagggacaucagaaacauucucaauggggcuccuuuguuuaacucuauuuguggaggaaugucuaagacggcgcguaacuagaaagcacaugauuuuagcaguugucauaacauucugugcuauaauuuuggguggacuaacuuggauggacuuacuuagaguccuuauuaugcuuggugacaccaugagcggucguauaggaggacagauacaucuggcgauaauggcuguauucaaaaugaguccuggguacgugcuaggaguuuucuuacgaaaguuaacaucacgugagacggcucuaauggugaucggaauggcuaugacuacaguguuuucgauaccucaugaucugauggaacuuaucgauggcauaagccucggacuuauccuauuaaagauagucacucacuuugauaauacgcaagucggaacucuagcccuaucacuaacguucauucgcuccaccacaccgcuaguaauggcuuggaggacgaucauggcggucuuuuucgucgucacacuaauuccucuaugccgaaccucaugccuacaaaaacaaagucauuggguagagauuacagcacucauuuugggagcgcaagcacugccaguauaccuaaugacacucaugaaaggggcaagcaggagaaguuggccgcuaaaugaggggauuauggccguaggucucgugaguuuguuggguucugcgcuguuaaagaacgacguaccguuagcagggccaauggucgcuggaggucuguuguuagcugccuacgugaugucgggaaguagcgcugacuuaucucuagagaaagccgcgaaugugcagugggacgaaauggcagacauuacaggaagcagucccaucauagaaguaaaacaagaugaagauggcucauucucaaucagagauguggaagaaacuaacaugauuacccuauuagugaaauuagcacuaauuacagugucaggacuauauccuuuagcaauaccaguaacaauggcauuaugguacguauggcaagugaaaacucaaagaucuggagcuuugugggacguaccgucaccgucugcaacacaaaaagcuacauuaagugaggggguguaucgaaucaugcaacgcggauuguuuggaaaaacacaaguagggguagguauccacauggaggguguauuucauacuauguggcacgugacgagaggcaguguuauaugucaugaaacagggcgauuagagccgucgugggcagauguacguaaugacaugauuaguuauggugggggauggagauuaggugacaaaugggacaaagaggaggauguacagguucuugcuaucgaaccuggcaaaaauccgaaacaugugcagacuaagccaggucuuuuuaaaacucuaaccggugaaaucggugcaguaacauuagacuuuaaacccgguacauccgguucgccuauaauaaauaagaaaggaaaaguuauuggacuauauggaaacggaguuguaacuaaauccggagauuacguuucagcuauaacacaagccgagaggauaggagaaccagacuacgagguugaugaggacauuuuuaggaagaaaagguugaccauuauggaucuucauccaggcgcgggaaaaaccaagaggauucucccgucaauuguuagggaggcgcuuaaacgcagauuaagaacgcucauuuuggcuccuacacgcgucguugcagcugaaauggaagaagcccucagaggauuaccuauaagauaucaaacacccgcugucaaaucggaacauacuggaagagaaauaguagauuuaaugugucacgccacauucacuacaagacugcucagcaguacaagaguuccuaauuacaacuuaauagugauggacgaagcacauuuuacggauccuuguucagucgcugcaaggggauauauuucuacaaggguagaaaugggugaagcggcagcaaucuuuaugacugcgacaccaccuggaaguauugaccccuucccacaaagcaacuccccgauagaagauauagagcgggaaaucccugagagaagcuggaacaccggauuugacuggauaacugauuaucaagguaagaccguuugguuugucccgucaauaaaagcagguaaugacauugcgaauugcuuacguaagagcgggaaacggguaauccaacuaucccgaaaaacauuugacacagaauauccaaaaacaaaauugacagauugggauuuugugguuacgacagauaucagugagaugggugccaacuuccgagccggaagaguuaucgacccuagacgaugucucaagccuguaauacugacagaugggccagaacggguuauacuagcaggacccaucccaguuacaccggcuucugcugcgcaacguagaggucggauuggacgaaauccggcgcaggaagaugaucaauacguguuuagcggggacccccugaagaacgaugaagaucaugcucacuggacugaagcaaaaauguuguuagauaauauuuauacacccgagggaauaaucccaacacuauucgggcccgaacgcgagaaaacucaggcaaucgauggagaguuucguuuaagaggugaacaacgcaaaaccuuuguugaacuuaugagaagaggcgauuugccuguuugguugaguuacaaaguagcaagugcagguauaagcuauaaagacagagaguggugcuucacaggcgaaagaaacaaccaaauauuagaagaaaauauggaagucgaaauauggacacgcgaaggugagaagaagaaacuccgacccaaaugguuggacgcaagaguuuacgcugauccaauggcacucaaagacuucaaagaauuugccucaggcaggaaaucaaucacuuuggauauauuaacggagauugccacuuuacccacauaucuauccucaaaagcuaaauuagcucuagauaauaucguuaugcuacacaccacagagaaaggagguagagcauaccaacacgcuuuaaaugaauuacccgaaucgcuggagacccugaugcuaguagcuuuacugggugccaugacugcuggcaucuuccuguucuuuaugcaaggaaagggaauugguaaacuaaguaugggauugauagcgauagcgguagcgucuggguuacuguggguggccgagauccaaccccaauggauagcagcaucuaucauacuagaguucuuuuuaaugguccuacuaauaccagaacccgaaaaacaacguacaccucaagacaaccaauugaucuacguuauuuuaacuauacuaacuauaauuggauuaauagcugcuaaugagaugggccuaauagaaaagacaaaaaccgacuuugguuuuuaucagguaaaaccggaaacaacgauauuagacguagacuuacgaccagcuucugccuggacgcuguacgcuguugccacuacuauccuuacaccaauguuacggcacacaaucgaaaauaccucugccaaccucucucuagcggcaaucgcuaaccaagcggcaguauuaauggguuuagggaaagguuggccucuacaucguauggaucuuggaguaccucuuuuggcaauggguuguuauucccaaguaaauccuaccacgcuaacagccucauuaguaaugcuccuaguucauuacgcaaucauagguccaggccuacaagccaaggccacaagggaggcccagaaacgcacagcagcaggaaucaugaaaaauccaaccguggacggaaucacuguaaucgaucuggaaccgaucuccuaugacccaaaguucgaaaagcaacucggucaagucaugcuguuggugcuaugugugggccaauuauuauuaaugaggaccacgugggcuuuaugcgaaguauuaacacucgcgacgggcccaguaaugaccuuaugggaaggaaacccagguagguuuuggaacacgacaauagcagucucaacggcaaauauauuucggggcucuuaccucgcgggagcuggacuagcuuuuucguuaauuaaaaaugcgcagacaccaaggagaggcaccggaacaacuggcgagacccuaggagagaaguggaaacgacaauuaaauucacuugauaggaaagaguuugaggaguauaagagaaguggaauacuugagguagacagaacggaagcgaaaagcgcauuaagagaugggacuaaaauaaaauacgcaguaagccgagguucguccaaaauaagauggauaguggaaagagguaugaucaagccaaaagggaaaguuguggaucuaggcuguggucgcggugguugguccuauuauauggcuacucuuaaaaauguuaccgaagucaaaggguauaccaaaggagguccuggacaugaggagccuauaccaauggcaacauauggguggaauuuagugaaauuacacucagguguagacguauuuuauaaaccaaccgaacaaguugacacacuauuaugcgauauaggugaaucaucaucuaacccgacgauagaagaggguagaacgcuaagaguguuaaaaaugguugaacccugguugucgucaaaaccugaguucuguauaaaagucuugaaucccuacaugcccaccguuauagaggaauuggaaaaguuacagcguagacauggagggucauuaguuagguguccguugucacgaaauaguacgcaugagauguauuggguaucaggagcuaguggaaauauaguaucguccgugaacacgauuagcaagaugcuucucaacagauucacuacacgacacagaaaaccaacuuaugaaaaagauguugaucucggcgcgggcacgaggaguguuucaaccgaaaccgagaaaccugauaugacgguuaucggacgaagauuacaacgacugcgcgaggagcauaaagaaaccuggcauuaugaucaagaaaacccauaccgaacgugggcguaucauggaucauacgaagcuccauccacuggaagcgcaagcucaaugguuaacggugucgucaaacuucuaacaaaaccaugggauguaauaccaaugguaacucagcuugcuaugaccgacacuaccccauucggacaacagcguguauucaaggaaaagguugauacacgaacuccccaacccaaacccggcacacgaaugaucaugacaacaacugcuaauuggcuuugggcccuauuaggaaagaagaaaagcccuagguuguguacaagagaggaauuuauaaguaaaguuagaucaaaugcggcuauaggggcugucuuucaagaagaacaaggcuggaccucugcaucagaagcagucaacgauucaagauuuugggagcuaguugauaaagaacgugccuugcaucaagaagguaagugugaaaguugcgucuacaacaugaugggaaagcgagagaagaaacuuggagaauuuggacgugcuaaaggaaguagagcaauaugguauauguggcugggcgcgagauuuuuagaguucgaagcacuaggauucuugaaugaggaucauugguucagcagagaaaauucauggucaggaguugaaggagaaggacuacauagacugggauauaucuuggaagauauagauaagaaagauggugacuuaauauaugcugaugacaccgcagguugggauacgcguauaacagaagaugaccuguugaaugaagaacuaauuacugaacaaauggcuccacaucacaagacuuuggcgaaggcaaucuucaaacuuaccuaucaaaauaaaguaguuaaagugcucagaccaaccccaaagggcgcuguuauggauauaauuagcaggaaggaccaaagagguucaggacaagugggaacuuauggacuaaauacauuuacuaauauggaaguucaguuaauuaggcaaauggaagcugaagguguaauaacacaagaugacaugcaaaauccaaaaggcuuaaaagaaaggguagagaaguggcuaaaagaaugcgggguugacagacuuaaaagaauggcuaucuccggagaugacugcguaguaaagccacuagaugaaagguucaguacgucguuacuauuucugaaugauaugggcaaaguaaggaaggauauuccacagugggaaccaagcaaaggauggaagaauuggcaagaaguaccuuucuguagucaccauuuccauaagauuuuuaugaaggauggcaggagccuagucguaccaugcagaaaccaggacgaauuaauaggucgagcaagaaucucacagggagcgggguggagucugagggaaacggcuugccuagguaaggccuacgcacaaauguggagcuugauguauuuccacagaagagacuuaaggcuggcaucgauggcaauuugcucagcuguacccacggaaugguuuccaacaucuagaaccacauggaguauucaugcgcaucaccaauggaugaccacugaggauauguuaaaaguguggaacagaguauggauugaggauaauccaaauaugacagauaaaacgccaguacacucaugggaagauauccccuauuuaggaaaaagagaagauuuauggugcgguucucucauugggcuauccucaagagccacuugggcuaaaaacauucacacggcgauaacucaagugaggaauuuaauagguaaagaagaauacguagauuacaugccagcaaugaaacgauacucggccccauuugaaagcgaagguguucuguaa

SEQ ID NO: 23649 - RNA, 9867 nt, Artificial Sequence
  derived and/or modified CDS sequence (opt6) from DENV-4__JN638570__SS-prME
ucgacgaucacacuauuaugccuuauaccuacgguaauggcauuucaucuuucaacaagagauggagaaccgcugaugaucguagcgaaacaugaaagagguagaccuuuauuguuuaaaacaacagaaggaauaaacaaauguacuuuaauugcuauggaucuaggagaaaugugcgaagauaccgucacguauaaauguccacuucuuguuaauacggaaccagaagacauugauuguugguguaaucucaccucagcauggguuauguauggaacaugcacccaaagcggugaacguagacgugaaaaacgaagcguugcauuaacuccacacucgggaaugggauuagaaacaagagcagaaaccuggaugucgucugaaggagcauggaaacaugcacaaagaguugaaaguuggauucuaagaaauccugguuuugcgcuauuagcaggcuuuauggcauacaugauagggcaaacuggaauacaaagaacugucuucuucauuuuaaugaugcuaguagcaccaucuuauggcaugagauguguaggaguuggcaaccgggacuucgucgaaggagucucaggcggugccuggguugaccuugugcuggaacacggaggaugcguaacaacuauggcacaagguaaacccaccuuagacuuugaauugauuaaaacaacagcuaaagaaguagccuuauuaagaacuuacugcauugaagcgucuauuagcaauauuacaacagccaccagauguccuacgcaaggugaacccuaccuaaaagaggaacaagaccaacaauauauaugucgucgagauaugguagauagaggaugggggaauggauguggucuauucgguaaaggggguguuguaacuugugcaaaauucucaugcuuaggaaaaaucacagguaaucuaguucaaauagaaaaucuugaauauacaguagucguuacaguucacaauggggauacucacgcuguagggaaugacacuucaaaccaugggguaacggcaacaauuacgcccagaucaccuagcguagaaguuaaauuaccagauuauggagaauuaacacuagauugcgaaccuagaucagggauagacuucaaugaaaugauccugaugaaaaugaaaaccaagacauggcuaguccacaaacaaugguuucuagaccucccgcuuccauggaccacaggagcugauacauuagaagugcauuggaaccacaaagagcgaauggucacguucaaagugccucacgcaaaacgucaggauguaacggucuuagguucucaagaaggugccaugcauagugcauuagcaggcgcaacagaaguagauucaggcgauggcaaccauauguuugcaggacacuuaaaaugcaaaguaagaauggaaaaauugagaauuaagggaaugucauauacgauguguagcggaaaauucaguauugauaaagaaauggcagaaacccaacauggaacuacagucgucaaggucaaauaugaaggaacaggcgcacccuguaagguuccaauagaaauucgugaugucaacaaagaaaaaguaguaggaagaauuauuaguaguacuccauuugcugaaaacaccaacucaguaacuaacauagaacuagaaccaccuuuuggugacucauauauuguuauaggagucggggacggugccuuaacacugcauugguuucgaaaagguucuaguauuggaaaaauguuugaaucaacauauaggggcgccaagcgaauggcgauuuugggagagacagcaugggauuuugguaguguaggaggauuacucacgagucucgggaaagcaguacaucaaguauuuggaaguguuuauacaacaauguucggugguguaaguuggaugguacgaauuuuaauaggguugcuagucuuauggauaggaacgaauaguagaaauacaagcauggcaaugucuuguaucgcuguuggcggaauaacgcuguuccuaggauuuacaguacaugcagacauggguugcguugucucuuggagcggaaaagaacuaaaaugcgguucaggaauuuucguaauugacaauguucauacguggacugaacaauacaaauuucaaccugaaagcccagcaagauuagcuucagcuauacuaaacgcucauaaagaagguguaugugguauaaggaguacuacaagacuagagaauguuauguggaaacaaauaacaaacgaguugaauuauguacuaugggaaggagggcacgaucuuaccguggucgccggugaugugaagggugugcucaguaaagguaaacgugcacuggccccaccugugaacgaccuuaaauauaguuggaaaaccuggggaaaggcaaaaaucuuuaccccugaaacucgaaauaguacguuccuaguggauggucccgacacuucugaauguccuaacgaaagacgagcauggaauuuucuagaaguagaagauuacggcuucgguauguucaccacaaacauuuggaugaaguuccgcgaagggucgccugaaguaugcgaccacagacugaugucugcugcuauaaaagaccagaaagcggugcacgcagauauggguuacuggaucgaguccaguaaaaaucagaccuggcaaaucgaaaaagccaguuugaucgaaguuaagacauguuuguggcccaaaacacauacacuguggucaaauggagucuuggaaagucaaaugcugaucccuaaggcuuacgcuggaccaauuucacagcacaauuauaggcaagguuacgcaacccagacagcugguccauggcacuuaggaaaacuugagaucgacuuuggagaguguccuggcacuacgguuacagugcaagaagauugugaucaccgaggaccuagccuucgcacaacuacugccuccggcaaauuagucacacaaugguguugucggaguuguacgaugccuccacugagauuucugggggaagauggauguugguacggaauggaaauucgaccacuuaacgagaaagaggaaaacaugguuaaaucacagguaucagccggacaagggaccucagaaacguuuagcaugggauuauuaugucuaacuuuguuuguagaggaaugcuuacgaagaagagugacaagaaaacauaugauguugguaguuguuacaacuuuaugugcaaucauuuuaggaggucuaacguggauggaucuucuacgggcccuaaucaugcugggcgacacuaugaguggacguauggguggacagauacaccuugcaauuauggcaguauuuaaaaugucuccgggauacguguuaggaauauuccuccgcaaacuaacaagucgugaaacggcgcucauggucauaggaauggcgaugacgacgguccuugcuauaccgcaugacuuaauggaguucauagacggaauaucauuaggacucauucugcuuaaaaugguaacacauuucgauaauacucaaguuggaacccuggcacuagcguuaacauucauaaagucuacaaugccucuagugauggcauggcgaacgauaauggcaguacuguucguggucacucuuaucccuuugugucgaacgucaugccuucaaaaacaaagccauuggguagaaauaacggcauuaauuuuaggagcacaggcccuaccagucuaccuaaugacccuuaugaaaggugccucaaagagaaguuggccuuugaaugaagguauaauggcaguggggcuaguaucucucuuagguagcgcccuucucaaaaaugacguaccauuagcagggcccaugguggcugguggucuacuuuuggcagcauauguaaugagcggaucgagugccgauuuaagccuagagaaggcugcaaacguacgcugggacgagauggcagacaucacaggcucuaguccaauuauagaaguaaaacaagaugaagauggauccuucucaauacgugauguagaggaaacuaauaugauuacgcuucuaguuaagcuagcacuaauaaccguuagcggucuuuauccacuggccaucccagugacaaugacauuaugguauauguggcagguuaaaacacaacgauccggugcucugugggauguuccuucaccagcagccgcucaaaaggcaacauugaccgaagggguuuaucggauaaugcaacguggauuguuugguaaaacacagguugggguaggcauucauacugaaggcguauuucacacgauguggcacgucacacguggaucaguuauaugccacgaaucagggagauuagaaccuaguugggcagacgucagaaaugacaugauaaguuacgguggggguuggagguugggcgauaagugggauaaagaagaagauguccagguguuggcaauagaaccuggcaaaaacccgaagcauguacagacaaaaccuggauuguuuaaaacccuuacaggggaaauaggggcagucacguuggacuuuaaacccggcacaaguggaucuccgauuaucaauagaaaaggaaaaguaaucgguuuauauggcaacggcguugugacuaaaucgggugauuauguaagugccauaacucaagcagaaagaauaggagaaccugacuaugaaguugaugaagauauauuccguaaaaagcgguuaacuaucauggauuuacacccaggugccgggaaaacaaaaaggauuuugccuucgauaguuagagaagcacuuaaacggcgauugcguacuuuaaucuuagcuccgacucgaguggucgcagccgagauggaagaagcauuacggggccuucccauucgauaucaaacgccggcgguaaaauccgaacauacuggaagggaaauuguagauuuaaugugucaugcgacauucacuacgagacuauuaaguagcacaagggugccgaauuauaauuuaauaguuauggaugaagcgcauuuuacugacccuaguucuguagcugcccgagguuauauaucaaccagaguagaaaugggcgaagcagccgcuaucuuuaugacugcaacgccaccugggacuacugauccauucccacaaucaaauucaccaauugaagauauagaacgagaaauaccagaacgaagcuggaauacgggguuugauuggaucacugauuaccaagguaagaccguuugguucguaccgucaauaaaagcagggaaugacauugcaaacugucuacgcaaaucugguaaaaaggugauacaacuaagccgcaagacauuugacacagaauauccaaaaacaaaauuaacagauugggacuuuguaguaacgacggacauaagcgaaaugggugcuaacuucagggcuggccgaguuauagacccaagacgcugucugaaaccaguaauucugacggauggaccugaaagagugauauuagccggucccauacccguaacgccugcaucagccgcacagaggagagguagaauuggucgaaaccccgcccaggaagacgaccaauaugucuuuuccggugacccucuacgaaacgacgaagaucacgcacauuggacggaagcgaaaaugcuuuuggauaauaucuauacuccagagggcauaaucccuacuuuauucgguccugagcgcgagaaaacccaagcaauagacggugaguuuaggcuacggggcgaacaaagaaaaacauuuguagaauuaaugaggagaggcgauuuacccguauggcuaagcuacaaaguggcaagugcgggaauauccuacaaagaucgugaaugguguuucaccggugaaagaaauaaccagauccuggaagaaaauauggaaguagaaauauggacgagagagggagagaagaagaaacugagaccuaaauggcuugaugcaagaguauacgcugauccaauggcgcucaaagauuucaaggaguucgcaucgggaagaaaauccaucaccuuggauauccucacagaaauagccucuuuaccgacauauuuaaguucacgagcuaaauuagcauuagauaauauagugauguuacauaccaccgagcgugguggaaaagcauaucaacaugcccuuaaugaacuuccugagucucuggagacguugauguugguugcauuauuaggagcaaugacagcgggcauauuccuauucuucaugcaagguaaagguauaggcaaacuaucaaugggacuuauagccauugcaguagcuagcgggcuguuguggguggcggaaauacagccccaauggauagccgcuuccauuauauuggaguucuuucucaugguuuuauugguuccagaaccggaaaaacaacguacaccacaagauaaucaacucauuuacguaauacugacgauacuaacaauaauagcacuuguagcagccaacgaaaugggauuaauagagaaaacuaaaacugauuucgguuuuuaucaaguaaaagcagaaacaacuauuuuagacguugauuuacgaccugcgucugcauggacacucuaugcugucgcaacaacuauauugacgccaauguuaaggcauacgauagaaaauacaucggcuaaccuaucgcuagcagcaauagccaaccaagccgcagugcuaaugggauugggaaaaggguggccauuacaucgaauggauuuaggaguuccauuacuugcaaugggauguuauucacaagucaaccccaccacguuaacagcuagucuaguuauguuacuuguacauuaugcaauuauuggccccggccuucaggcaaaagccaccagagaagcacagaaaagaacagcggcagguauuaugaaaaaucccacuguggauggaaucacgguaauagauuuagaaccgauuucauaugauccgaaauucgaaaagcaguugggacaagugaugcuauuaguauuaugugcuggacaacuacucuuaaugcgcacaacaugggcuuuuugcgaaguacugacacuugcgaccgggccaauacuaacccuuugggaaggaaauccaggccguuuuuggaacaccacgauugcaguuucgacugccaacauauuccguggcucguauuuagcaggggcaggauuggcuuuuagccuuaucaagaaugcucaaacgcccagaagaggaacagggacaacuggugaaacgcucggggagaaguggaaacggcaacucaauaguuuagauagaaaagaguucgaggaguauaagagaaguggaaucuuagaaguagacagaacagaggcaaagagugcacucaaagacggaucaaagauaaaguaugccguuagucggggaacuagcaaaauacgauggauuguggaacguggaauggucaaaccaaaaggaaaggucguagaccuugguugcggucgaggaggauggucuuauuacauggcgacacugaagaacguaacagaaguaaaagguuacacgaaaggagggccgggacaugaagaaccuauaccaauggccacuuauggauggaaucuagugaaauugcauaguggcguagaugucuuuuauaaaccaacagagcaaguggacacauuguuaugcgacauaggcgaaagcucaucuaacccaacaaucgaagaaggacgaacuuuaaggguucucaagaugguggaaccauggcuuaguucaaaaccugaguuuuguaucaaaguuuugaauccuuauaugccaacuguaaucgaagaacuugaaaaacugcaaaggagauauggggguagucuaguccgcuguccacuuucacgaaacucaacacaugagauguauuggguuucaggggucaguggaaacaucgugucuucagugaauacgacuucgaagaugcuacucaacagauuuacaacccgacacagaaaacccacauacgaacgcgacgcagaccugggcgccgguacgagaagcguaucgaccgaaacagaaaaaccagauaugacgaucauugggcgaagacugcaaagauuacaagaagaacacaaagagacuuggcauuacgaucaugagaacccauaucgaacuugggccuaccacggaaguuaugaagcaccgucuacagggucagccucaucuaugguaaaugguguaguuaaguuacucacuaaaccuugggaugucguacccaugguaacgcaauuggcaaugacugauacaacaccauuuggacaacaacguguauuuaaagaaaaagucgauacucgaacgccacaacccaagccggguacccgaguaguuaugacuacaacagcuaauuggcuauggacacuauuagguagaaagaaaaacccgagguuguguacaagagaagaguucaucaguaaagugagaaguaacgccgcuauaggggccguauuccaggaagaacaagguuggacaucugccuccgaagcaguaaaugacagccguuuuugggagcuaguugauaaagaacgugcguuacaucaagaaggaaaaugcgaaaguuguguauacaacaugaugggaaaacgggagaagaaacugggagaguuuggcagagcaaaaggaagucgggcuauuugguacaugugguuaggcgcgagauuccuagaauuugaagccuuaggauuuuuaaaugaagaucauugguuugggagagaaaauucuuggagcggugucgaaggcgaaggguugcaccgucucggauacauacuagaggauauagacaagaaagauggagaucugauauacgcggacgauacugcagggugggauacgagaauuacugaagacgaucuauuaaaugaagaacugauaacugaacagauggcuccacaucacaaaauuuuagcaaaagcgauauucaaauuaacauaucaaaauaagguagugaaaguucuucggccaacgcccaaaggggcgguuauggauauuauaagcaggaaagaucaaagagguucaggacaagugggaaccuacggacuuaacacauuuacaaauauggaaguacaacuuauaagacaaauggaagcugaagggguaauaacuagagacgauaugcauaauccuaaagguuuaaaggagaggguagaaaagugguuaaaagaguguggugucgauagacuuaagcgaauggcaauaucaggcgaugacugcguaguaaaaccucucgacgaaagauuuucuacgucccuacuauucuuaaaugauaugggaaaaguccggaaagauaucccacaaugggagccguccaagggauggaaaaacuggcaggaaguaccguuuugcucccaucauuuucacaaaauauuuaugaaagauggaaggagcuuagucguccccugcagaaaccaagaugaacugauaggacgcgcacguauaucacagggggccgguuggagcuuaagagaaacugcaugucuugguaaagcauacgcacaaauguggagucuaauguauuuucaccgacgugaucuuagauuagcaagcauggcuauauguucagcgguacccaccgaaugguuuccaacgagucgaacaacguggucuauucaugcacaccaccaguggaugacuacggaggacaugcuaaaggucuggaaccgcguguggauugaggacaaucccaauaugauagauaaaaccccaguacauaguugggaagauauuccauaccuugguaaacgagaagaccugugguguggcagucuaauuggccuaaguagccgugccacuugggcgaaaaacauacauacagcuaucacacaagucagaaaucuaauaggcaaagaagaguacguggauuauaugccggccaugagaagauauucagcccacuuugaaagugagggcgugcuguga

SEQ ID NO: 23650 - RNA, 9867 nt, Artificial Sequence
  derived and/or modified CDS sequence (opt6) from DENV-4__JN638571__SS-prME
ucaacaauaacauuauuaugucuuauaccaacuguuauggcauuucauuuaucaacuagagauggggaaccccugaugauuguugcaaaacaugaaagggguagaccguuauuauuuaaaacaaccgaaggaauaaacaaauguacacuuauugcuauggaucuuggugagaugugcgaagauacugugacuuauaaaugcccacuucucgucaauacggaaccggaagauauugauugcugguguaaucucacuuccgcaugggugauguacgguaccugcacgcagagcggugaaagacgccgagagaaaaggucaguagcgcucacuccccauucaggaauggguuuagaaacucgcgcugaaacauggaugaguuccgaaggcgcguggaaacaugcucaacgagucgaaucuuggauacuaagaaauccagguuuugcccuacuagccgguuuuauggcuuauaugauuggacaaacugggauucaaaggacgguguucuucauauugaugauguugguagcaccaaguuauggaaugagaugcguaggaguggguaacagggauuucguugagggagugucggguggagcauggguagaccuaguacuagaacacggaggcuguguaacgacaauggcccaaggcaaaccgacauuagauuuugaacuaauuaaaacuaccgcuaaagaaguagcauuauuaagaaccuacuguauugaagcuaguaucagcaauauaacaacagcuacacgcuguccaacacaaggcgaaccguauuuaaaagaagaacaggaucaacaguacauauguaggagagauaugguggaccgaggaugggguaacggaugcggacuauucggcaaagggggaguuguaacaugugcaaaguuuucuugucuaggcaaaaucaccgguaacuuaguucagaucgaaaaucucgaauauacaguugucguaaccguacauaacggagauacacacgccgucgggaacgauacuucuaaucacgguguuaccgcaaccauaacucccaggucaccaaguguggaaguaaaauuaccagaguacggugaauugacucuugauugugaaccacguagugguauugauuuuaaugagaugauuuuaaugaagaugaaaacaaagacaugguuaguacauaaacaaugguuuuuggacuuaccauuaccuuggacaacuggagcagauacccuugagguucacuggaaucauaaagaacgaaugguuacauucaaggucccacacgcaaagaggcaagauguuacgguauuagggagccaagagggagcaaugcauucagcucucgcuggagcaacugagguagauagcggugauggcaaucauauguuugcaggacauuugaaauguaaaguuaggauggaaaaguuaagaauaaaaggaaugagcuacacaaugugcaguggaaaguuuucgaucgacaaagagauggcagaaacucaacacgguacaacaguaguuaaagucaaauacgagggaacaggagcaccaugcaaagugccuauagagauacgagauguaaauaaagaaaaagucguaggacgaauaauuucaaguacaccguuugccgaaaauaccaauuccgugacaaauauagaacuagaacccccauuuggcgauucauauauuguuauaggaguuggagacggagcgcucacgcuccauugguuucggaaaggaucuucgauaggaaagauguucgaaucgacuuaucgcggcgccaaacgaauggcgauucuaggagaaacagcaugggacuucggaaguguugguggcuuauuaacuucguuggggaaagcaguacaccaggucuuuggaucaguuuauacuacuauguuugguggaguaagcuggauggugcgcaucuuaauuggacuauuaguuuuauggauaggaacuaauuccagaaauaccaguauggcgaugagcuguauagccguaggugguauuacacuauuucuggguuuuacugugcaugcagauaugggauguguaguuucaugguccggcaaagaauuaaaauguggaucaggcauauuugugauagauaacguccacacuuggacagaacaguacaaauuccaaccagagucacccgcgagauuagccucagcaauccuaaaugcucauaaagaaggaguauguggaauaagaucaacgacuaggcuagaaaacguuauguggaaacaaauaacuaaugaguuaaauuauguccuaugggaagggggucaugacuuaacugugguggcuggugauguaaaaggagucuugucgaaggggaaaagggcauuggcacccccuguaaacgaucucaaauauuccuggaaaaccugggguaaggcuaaaauauucaccccagaaacacgaaauucaacuuucuugguagacgguccugacacgucugaaugcccaaacgaacguagggccuggaauuuucuggaaguagaagauuacggauucggcauguuuacuacaaauauuuggaugaaauuccgagagggaagcagugaaguaugcgaucauagacuaaugagcgcagcaaucaaagaccaaaaagcagugcacgcugauaugggauauuggauugaaagcagcaaaaaucaaacuuggcagaucgagaaagcaucucuaauagaaguaaagacaugcuuauggcccaaaacacauacucuauggagcaauggagugcuagaaagccagauguugaucccaaaggcguacgcuggacccauaucgcaacauaauuauagacagggauacgccacgcaaacagcuggcccuuggcauuuaggcaaguuagagaucgauuucggggaauguccaggaacuacagucaccguucaagaagacugcgaucauaggggaccgagucuacgaacaacaacagcguccggaaagcuaguuacccaaugguguuguagaaguuguacaaugccgccccuuagauuccuaggugaagaugguuguugguaugguauggagauaagaccuuuaaacgaaaaagaagaaaacauggugaagucccaaguuucagcgggucagggaacaucagaaacguuuagcaugggguuguuauguuuaacuuuguuuguagaagaauguuuacgacgaagagucacuagaaaacacaugauguuaguaguagucacaacuuuaugcgcuauuauacugggaggucuaacauggauggaucuucuuagagcccucauaauguuaggugacacgaugucugggagaauggguggacaaauucaccucgcaauaauggcuguauuuaagaugucaccaggauauguauuagggauauucuuacguaaauugaccaguagagaaacugcacuuaugguuauagguauggcuaugacaacaguauuagcaauaccucaugauuuaauggaauuuauagacgguaucucucucggauuaauauuacuaaagaugguaacacauuuugauaacacacaaguuggaacucuagcacuagcacucacguucaucaaaagcaccaugccccuuguaauggcauggcguacaauaauggccguacuuuuugugguaacucuaaucccauuguguagaacaaguugucugcaaaaacagucucacuggguagaaauuaccgcgcuaauacuuggugcccaggcacuaccaguguacuugaugaccuugaugaaaggagcuaguaagcgcagcuggccauuaaaugaggguaucauggcaguuggauuggugucuuuguuagguucggcguugcugaaaaaugauguaccccuagcgggucccaugguugccgguggccuacuucucgcugcauacgucaugagcggaucuucggccgaccuuucucuagaaaaagcagcaaaugucaggugggacgaaauggcggauauaaccggcucaucaccuauuauagagguaaagcaagacgaagaugguuccuuuaguauuagggaugucgaagaaacgaauaugauaacauugcuaguaaaauuagcauugauaacaguaucaggucuuuauccauuagccauacccguuacaaugacacugugguacauguggcaaguaaagacccaaagaagcggagcucuaugggaugugccgucccccgcagcggcgcagaaggcaacuuuaacugagggcguauaccggauuaugcaacgugguuuauuugguaaaacucaagugggcguagguauccauacagagggaguauuucacacuauguggcauguaacgagaggaucugugauuugccaugaaaguggccggcucgaaccuuccugggcagacgugaggaacgauaugauaaguuacgguggcggauggaggcucggcgacaaaugggacaaagaggaggacguacaaguguuagccaucgaaccuggcaaaaauccgaagcauguacaaacgaaaccaggcuuauuuaagacccuaacuggcgaaauuggggcuguaacauuagauuuuaagccaggaacaucugggagcccuauaaucaaucgcaagggaaaggugauuggccuauacggcaaugguguaguuacaaaaucaggagacuaugucagugcgaucacacaagcagaaagaauuggagaaccagacuacgaaguggacgaagauauuuuucggaagaaaagguuaacaauaauggauuuacaccccggugcagguaagacaaaaaggauacuaccaucaauuguacgggaagcguuaaaaagacgguuaagaacacuaauucuugcgccuacuagggugguagcagcagaaauggaagaagccuuacgcggucugccuauacgauaccagaccccugcuguaaaaucagagcacacaggacgugagauuguagaccugaugugucacgcaacguucacgacuagacuucuuucaagcacaaggguuccaaauuauaauuugaucgucauggaugaagcccacuucacagauccgagcagcguagccgcuagagguuacaucaguacacgcguagaaaugggagaggcagcugcaaucuuuaugaccgccaccccaccgggaacuaccgacccauuuccucaaucaaauucgccgauagaggacaucgaacgugaaauuccagaaagaaguuggaauacgggauucgacuggauuacagacuaucaaggcaaaacugucugguucguaccguccauuaaagcagguaaugauauagccaacugucuaagaaaaagugggaagaaagugauacaacuaucacguaagacguuugauaccgaguacccgaaaacgaaauuaacugacugggauuucguagugacaacugauauuucagaaaugggagcaaacuucagagccggaagggugauugauccccggaggugucuaaaaccggucauucuaacugauggaccagaaagaguaauccuagcuggaccaauaccugugacaccagcaucagcagcgcaacguaggggccgaauaggaagaaauccagcgcaggaggacgaucaauauguauucaguggcgauccauuaagaaacgaugaggaccacgcucauuggaccgaagcaaaaaugcuuuuagacaacauauauacgcccgaagguauaaucccaacacuauucggaccagaacgagaaaagacacaagcaauagacggugaauuuagacugcgaggggaacagagaaaaacauuugucgaauugaugaggagaggagaccuaccaguuuggcugaguuacaaaguugcguccgcaggaauuagcuacaaagacagagaguggugcuucaccggagaaaggaacaaccaaauacuugaagaaaacauggaaguagaaauuuggacaagggaaggagagaagaagaaacuccggcccaaauggcuggacgcucggguauacgcugauccuauggcacuaaaagauuucaaagaauuugccagcggacguaaaaguaucacccuugacauacuuacagaaauugcgucacuaccgaccuaccuaucuagucgcgcuaaauuagcguuagacaauauaguaauguuacauacaacagaaagaggcggcaaagccuaccaacacgccuuaaacgaacuaccagaguccuuagaaacucugaugcugguagcuuuacuuggagcaaugacugcagggauauuuuuauucuuuaugcaagguaaagguauagguaaauuaucaauggggcugauagcaaucgcaguggcuucuggucuauuguggguagccgaaauucaaccacaauggauagcugccucaauaauauuggaauuuuuccuuaugguauuauuggucccugaaccugaaaaacaaaggacgccacaagacaaccaguuaauauacgugauucucacaauacuaacaauaaucgcacugguagccgcgaaugaaauggggcucauagagaaaacaaaaacagacuucggauucuaccagguaaaagcagaaacuaccauucuugauguagaccuucguccugcaucagcauggacacuguaugcaguugcuacaaccauuuuaacgcccaugcuaagacacaccauugaaaacacuucugcuaauuuaagucuggcugcgaucgcuaaucaagcggcaguuuugaugggauuaggcaaaggguggccauuacaccguauggauuuaggaguuccacuacucgcuauggggugcuacucacagguuaauccaacaacuuuaaccgcuucguugguuauguuauuagugcacuacgcaaucauugguccggguuuacaagcgaaagcgacuagggaggcacagaaaaggaccgccgcagguauuaugaaaaauccgacugucgauggcauaacgguuaucgaucuggaacccauaagcuaugacccaaaguucgagaaacaauuaggucaagucauguuacucguacuuugugcaggacaauuguuauuaaugagaacaaccugggcauucugugaaguccuuacauuagcgacgggaccgauacuaacuuuaugggaagggaauccgggccgauuuuggaauaccaccaucgcaguaagcacagccaauauuuuucgagguagcuaucucgcgggagcaggucuagcguuuagccucaucaaaaaugcucagacuccacgacgaggaacaggcacaacuggagaaacacuuggcgaaaaguggaagaggcaauuaaauucauuagaccgaaaagaauuugaagaauacaaaagaagugggauucucgaaguagauagaaccgaagcaaaaagcgccuuaaaagaugguucaaaaauaaaauacgcaguaucccgugggacuagcaaaaucagauggauuguugaacggggcauggugaaaccaaaagggaaaguuguagaucucggcugugggagaggagguugguccuauuacauggcuacauugaagaacguuacugagguaaaagguuauaccaagggaggcccaggucaugaagaaccgauaccgauggcuacauacggauggaacuuagugaaguuacacucggguguugauguauuuuauaaaccuacugagcaaguagauacucugcuaugugauauaggugaaaguucuagcaaucccacaauagaagaaggacgcaccuuacgaguguugaagauggucgaacccuggcuuaguucaaaaccggaauuuugcauuaaaguuuugaauccuuauaugccaacuguaauugaagaacuagaaaaauugcagcggcgauacggagguucuuuaguuaggugcccgcuuaguaggaacucaacacaugaaauguauuggguuucgggaguaucagguaauauaguuagcagcgucaauacuacaagcaaaaugcucuuaaauagguucacaacgcgccaucguaaaccuaccuacgaaagggacgcugauuuaggugcgggaacucggucaguguccaccgaaacggaaaagccggacaugacaauaauaggucggagguuacaacgauuacaagaggaacauaaagagaccuggcauuacgaccacgaaaauccuuauagaacuugggcguaucacggcucauacgaggcccccaguacuggaucugccaguaguaugguuaauggcgugguuaaauuacuaacaaaaccgugggacguggucccaauggucacucaacucgcgaugacagacacaacgccauucggccagcagcgcguuuuuaaagaaaaagucgauacccggacaccucaaccgaaaccggggacaagagugguaaugacaacaacagcaaacuggcucuggacacuguugggaagaaagaaaaauccucgcuugugcacaagggaagaguucauaucuaagguaaggcuuaacgcagcaaucggcgcaguauuccaggaagaacaaggauggacaucagcaagugaagcaguaaaugacucacgauuuugggaacuggucgacaaagaacgggcccuccaucaagaagguaaaugugaauccuguguauacaauaugaugggaaaaagagagaagaagcugggggaauuuggccgggcuaaaggaucucgagcaauaugguacaugugguuaggugcaagauuccuggaauuugaggcguugggcuuucuaaaugaagaccauugguuuggacgagaaaacagcuggucgggaguagaaggcgagggguuacacagacuaggcuacauacuugaagauauagauaagaaagauggugaccuaauauacgcagaugacacggcgggaugggauacaagaauaacagaagaugauuuacuuaacgaagaauuaauaacugaacaaauggcuccacaucacaaaauuuuagcaaaagcaauauuuaaacugacuuaucagaacaaaguggugaaaguucuaagaccuacaccgaaaggcgcgguaauggacauaauuagucguaaagaucaacgaggaaguggacaaguagguacuuauggauuaaauacauuuacgaacauggagguucaauuaauaagacagauggaagcagaagguguaaucacaagggacgauaugcauaacccgaagggucugaaagaaagaguggaaaaaugguugaaagaaugcggagucgaucggcuaaaaagaauggcaauaucuggggaugauuguguuguaaaaccacucgacgaaagauucucaacaaguuuauuauuccuuaaugacauggggaaagugaggaaagacaucccacaaugggaacccucaaagggguggaaaaauuggcaagagguaccauucuguucucaucacuuccauaaaauauuuaugaaagaugguagauccuugguaguuccuuguagaaaccaagacgaacuuauuggccgggccagaauuagucaaggugcugguuggucucuacgcgaaacugcuugucuuggaaaggcauaugcacaaauguggaguuuaauguauuuucauagacgugaccuaagauuggcaucaauggcaaucuguagugcagugcccacugagugguuuccuacuucuagaacuacuuggucaauacaugcacaucaucaguggaugacaacggaagauauguuaaaggucuggaaccguguauggauagaagauaauccaaacaugaucgauaaaacaccaguccauagcugggaagauauaccuuaccugggcaagagagaagaucuaugguguggaagccuuaucggauuaaguucacgcgcaacuugggcuaagaacauacacacggcaauuacgcaaguccguaaccuuauaggaaaagaagaguauguggacuacaugccagccaugcggagauauucggcgcacuuugaaagcgaggguguguuauaa

SEQ ID NO: 23651 - RNA, 9867 nt, Artificial Sequence
  derived and/or modified CDS sequence (opt6) from DENV-4__JN638572__SS-prME
ucaacuaucacgcuacuuugccuaauuccaaccgugauggcauuccauuugucuacuagggauggugaaccacuaaugauaguagcuaaacaugaacgcggacguccacugcuguuuaaaacuaccgaagggauaaacaaauguacauuaauugcuauggacuuaggagaaaugugugaagacacgguuaccuauaaaugcccauuacucgucaacacagaaccugaagauauagauuguugguguaaucugacaagugcuugggugauguauggaacauguacccaaucaggagaacgcaggagggaaaaacgaucaguugcacuuacaccgcauuccgguaugggacucgaaacaagggcagaaacauggaugucaagugaaggagcauggaaacacgcccaaaggguggaaaguuggauuuuacgaaacccuggauuugcacuuuuagcgggguuuauggcauauaugauaggccagacuggaauacaaagaacaguauuuuucauucugaugaugcuaguugcgccuucuuaugguaugagauguguaggcgucggcaacagagacuucgucgaagguguuucagggggcgcuuggguagacuuaguacuggaacacggaggcuguguaacaacaauggcacaagguaaaccaacucuggauuucgaauuaauaaaaaccacugcuaaagaaguagccuuacuaagaacauacuguaucgaagcaucuauuucgaauauaacgacggcaacacguuguccgacucaaggugaaccauauuuaaaagaagaacaagaucaacaguacaucuguagaagagacaugguagaucgagggugggguaauggaugcgguuuauucggaaaaggagggguaguaacaugugccaaauuuucaugucucggaaaaauuacgggaaaccuuguacaaauugaaaaucuggaauauacaguaguuguaacgguacauaacggugauacacaugccguuggcaacgacacguccaaucacggaguuacugccacaauaacuccaagaagcccauccguagaagucaagcucccugaauacggugaauuaacacuugacugcgagccuagaucugguauagauuuuaaugaaaugauauuaaugaaaaugaaaacaaagacuugguuagugcacaaacagugguucuuggaccuaccgcuaccauggaccaccggcgcagauacguuagaaguucauuggaaccauaaggaaaggauggucacguuuaaagugccgcaugcaaagagacaggaugucacagugcuggggucccaggagggugcaaugcauucugcccuugcuggggcaaccgaaguggacaguggagauggaaaucauauguucgcaggccauuugaaguguaaagucagaauggaaaagcugaggauaaaggggaugucguauacgauguguagugguaaauucucgaucgauaaagaaauggcugaaacccaacacgguaccacuguggucaaagugaaguaugaggguacaggagcuccgugcaaagugcccauagagauacgagauguaaauaaagaaaaaguuguaggcagaauaauaucgucaacaccguuugcagagaacacaaauaguguuacuaacauugaauuagaaccacccuuuggcgacaguuauauaguuauuggugucggagacggagcccuuacccuccauugguuucguaaggggaguaguauagguaagauguucgaaucgacguaccggggagcgaagaggauggcgauacugggcgaaacggcaugggauuucgguucuguuggagggcucuuaacaagccuugggaaggcugugcaucaaguguucggaaguguauauacuacaauguucggcggugugagcuggaugguaagaauauuaauaggccuauugguacuguggauagggacaaauagccguaauacaaguauggccaugucuugcauagccgucggaggaauaacuuuauuccuuggauuuacgguucaugcagacaugggaugcgugguuucuuggucugguaaagaacuuaaaugcgggagcgguguauucguaauagacaacgugcacacauggacagaacaauauaaauuccaaccagaaagcccugcucgccuugccuccgcuauacucaaugcacacaaagaaggaguaugugggauucgaaguacaacacgacuagaaaauguaauguggaaacagauuacgaaugaacucaauuacgucuuaugggaagguggccacgaucuaacggucguagcuggugacgugaaaggaguacuuaguaaaggaaagagagcucuagcuccaccuguaaacgauuuaaaauauagcuggaaaacuuggggaaaggcaaaaauauuuacgccagagacacgaaacuccaccuucuuaguagauggaccagauaccucggaaugcccaaaugaaagaagggcauggaauuuccucgaaguggaagauuaugguuuuggaauguucaccacuaauauauggaugaaauuuagagaaggaagcucagaaguaugugaucacagacuuaugucggcugcuauaaaagaccaaaaagcaguacacgcagauauggguuauuggauagaaucguccaagaaccaaacuuggcaaaucgaaaaagcaaguuuaauagaaguaaaaacaugucucuggcccaagacacacacauuguggucaaacggagucuuggaaucccaaaugcuaaucccaaaagcauaugcaggcccaauaucacaacacaauuaucggcaaggauaugcaacucagacagcaggacccuggcaccuuggaaaauuagaaauagauuucggagaguguccggggacuacagucacaguacaagaagauugugaucauagggguccaucauuaagaaccacaacagcuucugggaaguuagugacgcaaugguguugcaggaguuguacuaugccaccacuacgauuuuuaggcgaagauggaugcugguauggcauggaaaucagaccgcuuaacgaaaaagaagagaauauggucaaaagccaaguuucagcaggucaagguaccucagaaacauuuuccaugggguuauuaugucuuacguuauucguugaagaauguuuaaggcggagagucacucguaaacauaugauacuggugguagugacgacccuuugugccauuauucuaggcggacuaacuuggauggaucuucuucgugcccuuauaaugcucggagauacaaugucuggucgcaugggcggccaaauucaucuagcaauuauggcaguuuucaaaaugagucccggauacguauuaggcauauuccuucgcaaacuuacaucacgggagacggcauuaaugguaauagggauggcaaugaccacuguuuuggccauuccccaugauuugauggaauuuauugauggaauauccuuaggccuaauauuacuuaaaaugguaacacacuucgauaauacacagguugguacucuagcauuagcgcuaacuuucauuaaaaguacuaugccucuuguaauggcauggagaaccauaauggcaguacuauucguagucacgcuaauccccuuaugucgaacaucguguuuacaaaaacaaagccacuggguagagauuacugcacuaauauuaggcgcccaggcuuugccugucuaucuaaugacacuaaugaaaggagcuaguaaaagaagcuggccgcuaaacgaagguauuauggcugucggccuagucagccuguuaggaucagcgcuguugaaaaaugaugucccucuagcaggacccaugguggcuggagguuuauugcuagcagcuuacguaaugaguggcagcucagcagaucuaucccuagaaaaagcagcaaacguuagaugggaugaaauggcugauauuacgggcucaucuccuaucaucgaagugaaacaagaugaggacggaaguuuuucuauacgggacguagaagaaacaaauaugauaacucuucuuguuaagcuagcgcuaaucaccguuucagggcuauacccguuggccauaccgguaacaaugacacuaugguauauguggcaggucaaaacgcagcgaucuggggcauuaugggauguuccaucccccgcggccgcccaaaaagcaacguuaaccgaaggaguuuaccgaauaaugcaaaggggucuguucggaaagacacaaguugggguuggcauucauacagaggguguguuccacacgauguggcacgugacaagagggagugucauaugccaugagagcgguaggcuagaaccuaguugggccgacgugaggaaugacaugauuuccuacgguggaggguggcgacuuggagauaagugggacaaggaggaggauguacagguauuagcaauagaaccaggaaagaauccaaaacauguccagacaaaaccugguuuauucaaaacacuaaccggugagauaggugccguaacuuuggauuuuaaaccgggcaccucgggcagcccuauaauuaauagaaagggaaaagucauuggccuguaugggaacggaguggucaccaagucaggugacuacguaucagcaauuacacaggcggaacgaaucggagaaccagauuaugaaguggacgaggauauauuccggaagaaacgacucacgauuauggauuugcaucccggagcuggaaaaacaaagcguauuuugccaaguauaguacgggaagcacugaaacgacgacuccgaacccuaaucuuggcuccuacgcgggucguagcugcugagauggaagaggcuuugagaggucugccuauaagguaucaaacccccgcugucaagagcgaacacaccggacgagaaauugucgaccuuaugugccacgcaacuuuuacaacgcgauuacuuucaaguaccagaguaccaaacuacaaucuuauaguaauggacgaagcacauuucacagauccaucaucaguagcugcaagagguuauauaagcacaagaguugaaaugggugaagccgcagcgaucuuuaugacagcuacaccaccugggacgacugauccguucccacagucaaauuccccuauagaagacaucgaaagagagauacccgaaagaucauggaauaccgguuuugauuggauuacugauuaccaggguaaaacggugugguuugugcccagcauaaaagcagguaaugacaucgcaaacugucuuaggaaaucaggcaagaagguaauacaauuaucuagaaagacuuuugacacugaauacccaaaaacaaaacuaacagauugggauuuuguaguuacuacggauauuucagaaaugggggcaaacuuucgugccggcagaguuauugacccgagaagaugccugaaacccgugauauugacagauggaccagaaagaguuauuuuggcugggccuauaccaguuacaccggcgucugcugcccaacgucggggaagaauagggcgcaauccagcgcaagaagaugaucaguaugucuuuaguggggauccuuuaagaaacgacgaagaucaugcucauuggacagaagcaaagaugcuacuagauaauauauauacucccgaaggaauuauaccaacauuauucggcccagagcgugaaaagacacaggcaauagacggggaguucagguugaggggagaacaacgaaaaacauucguagaauuaaugagaagaggcgaccuaccuguuugguuguccuacaaaguugcaucugcaggcauaucguauaaagacagagaaugguguuucacaggcgaaagaaacaaucaaauauuagaagaaaauauggaaguagagauauggacucgcgagggugagaaaaagaaauuaagaccaaaaugguuagaugcgaggguauaugcagauccuauggcccugaaagauuuuaaagaauuugcaucagguagaaaaucaauaacuuuggacauauuaacggaaauugcuagcuuaccuacauauuuaagcucgagagcuaagcuagcacucgacaauauaguaaugcuacacacaacggaaaggggaggaaaagcauaccaacacgcacuuaaugaacuaccagagagcuuagaaacucucaugcuaguugcacuucuuggagcuaugacggcagguauauuucuuuucuuuaugcaggguaaagguauugggaaauuaaguaugggacuaauugccaucgcggucgccucgggauuguuauggguagcugaaauccaaccacaauggauugcagcaucgauaauuuuagaguucuuuuugaugguuuuacucgucccagaaccugaaaaacaacgaacaccucaagauaaucagcucaucuacguaauuuuaacuauacugacuauaauagcucuaguagcagcaaaugaaaugggacucauagagaaaacgaaaacagauuuuggguucuaccagguuaaagcagaaacuacaauuuuagaugucgaccuuagaccagcuucggcauggacauuauaugcaguagcgacgacaauccuaacacccauguuacgacauacuaucgagaacacaagugcuaacuuaucuuuagcagcaauagcuaaucaggcagcaguguuaaugggccuagguaaaggguggccuuuacaccggauggacuugggcguuccacuauuagcuaugggaugcuauucacaaguuaacccaacuacucuaacugcaucauuagucaugcuccuaguccauuacgcaaucauuggacccggucuccaagcuaaagcaacacgggaagcucaaaagaggacugcugcagguauuaugaaaaacccuacuguugauggaaucacagugauugauuuagaaccaauuagcuaugauccuaaauucgaaaaacaguugggacaaguaaugcuauuggugcuuugcguaggccagcuauuauuaaugagaaccacaugggcauugugugaaguccuuacauuagcaacagguccaauuaugacucuaugggaaggaaacccgggcagguuuuggaauaccaccauagcaguaaguacugccaauauauuuagaggaucauaucuagccggagcuggacuagccuucagcuugaucaaaaacgcgcaaacaccuaggcgagguacagggacuacaggagagacgcucggugaaaaguggaaacgucagcucaauucguuagauagaaaagaguucgaggaauauaaacguagcggcaucuuagaaguagauaggacugaagcaaaaucagcacuacgugauggaucgaaaacaaaacacgccguaagucggggguccaguaaaaucagauggauaguagagaggggaaugauaaaaccuaaaggaaaagugguugauuuaggaugcggcagaggugguuggucauauuauauggcgacgcuucaaaacguuaccgaaguuaaaggguauacaaaaggggguccaggccaugaggaaccaauaccuauggcuacauacgguuggaaucugguuaaauugcacucuggaguagauguuuucuacaaaccgacagaacaaguggacacucuucugugugauauaggggagucauccucaaacccuacaauagaagaagguagaacccucagaguuuuaaaaaugguagaaccuugguuaucgucaaaaccugaauuuuguauaaaaguacuaaauccauauaugccuacuguuaucgaggaacuggaaaaacuacagaggagguacggugggagucucguacggugcccuuugaguagaaauucuacacaugaaauguauugggugucuggaguaucugguaauauuguuucaaguguuaacacaacuucaaaaauguuacuaaaucgguuuacuacgagacauagaaaaccaaccuacgaacgggacgcagauuuaggugcaggaacuagaagcguuucaacagaaacggaaaaaccugacaugacuauaauaggccgccgauugcaaagauuacaggaagaacauaaagagaccuggcauuacgaccaugaaaaucccuacagaacuugggcuuaccacgggucauacgaggcaccaagcacgggauccgcaaguucgaugguaaacggaguuguuaaauugcucacgaaaccaugggauguagugcccaugguuacacaguuagccaugacagacacaacaccuuuuggucaacagagaguuuucaaagaaaaagucgacacuaggaccccacaacccaaaccuggaacucgcguaguaaugacaaccacggcuaauuggcuuuggacacucuuaggaagaaagaaaaacccacgccuauguacacgggaggaguucauuucaaaagugagaucaaacgcagcaauaggggcaguauuucaagaagaacaaggauggaccagcgcaagugaggcuguuaaugacucaagguuuugggagcuugucgauaaggaacgugcauuacaccaggagggaaagugugaaagcuguguauauaauaugauggguaaacgugagaagaaacuuggagaguuuggacgagcaaagggcucuagggcuauaugguauauguggcugggggcacgguucuuggaauuugaagcgcuaggcuucuuaaacgaagaucacugguucgggagggaaaauaguuggucagguguugaaggcgaagguuuacaucgcuuaggauauauauuagaagacauugauaagaaagauggugauuuaaucuaugcggaugacacugccggcugggauacacgaauaacggaagaugacuuacuaaaugaagaacuaauuacagaacaaauggccccacaccacaaaguuuuagccaaggccauuuuuaaguugacguaucaaaacaaaguugucaaaguacuucgcccuaccccaaagggagccguaauggauauuauaucaagaaaagaucagcgagggagcgggcagguaggaacuuacggucucaauacauuuacaaauauggaaguccaauuaauaagacagauggaagcagaaggaguuauaaccagggaugacaugcauaaucccaaaggcuuaaaggaaagaguggagaagugguuaaaagaaugcggaguagacaggcugaaaaggauggccaucucaggagaugacugugucgucaaaccauuggaugaacguuuuucaacuucuuuacuauucuugaacgauauggguaagguuagaaaagauaucccacaaugggagccgucgaaaggcuggaaaaacuggcaagagguuccauucuguucccaucauuuccauaaaauauuuaugaaagaugguagaagccuagugguaccaugcagaaaucaagaugaacuuauuggacgagcacgcauuagucaaggugcaggcuggaguuuacgggaaacagcaugccuagguaaggcuuacgcccagauguggucgcuaauguacuuccaucggcgggaucugcgccuugccucuauggcuauuuguagcgcaguaccuacagaaugguuuccaacuucccguacaaccuggucaauacaugcacaucaucaauggaugacuaccgaagacaugcuaaagguauggaauaggguauggauagaagauaacccuaauaugacugauaaaacgccaguacauucuugggaggauauaccauaucuagguaagcgugaagauuuauggugcggaucauugauaggacuuaguucaagggcgacaugggccaaaaacauacauacggcgauaacucaaguacgaaaucuaauagggaaagaagaauacauggacuauaugccaguuaugaaaagauacucagcaccaagcgagucagaaggagucuuguga

SEQ ID NO: 23652 - RNA, 9867 nt, Artificial Sequence
  derived and/or modified CDS sequence (opt6) from DENV-4__JX024757__SS-prME
ucuacgaugacacuuuuaugcuuaauuccaacugugauggcguuccacuuaaguacgcgugacggugaaccauuaaugauaguugcaaaacaugaacgagggcgccccuuguuauuuaaaacuaccgaagguauaaacaaaugcacacuaauagcuauggaucuaggagaaaugugcgaagauacagugacuuauaaauguccauuguuggugaacaccgaacccgaagauauagauuguugguguaauuuaacuucgacguggguaauguacggaacauguacgcaaucuggugaaaggcgcagggaaaaacguucaguggcuuuaacuccucauucuggaaugggacuggaaacaagagcagaaacauggauguccucggaaggugcuuggaaacaugcacaaagaguugaaagcuggauucucagaaaccccggguucgcacuacuagcaggcuuuauggcauauaugauuggucaaaccgguauucaaaggaccgucuuuuucguauugaugaugcuuguagcaccuucuuauggaaugcguugcguaggugucggaaaucgcgauuuuguggaagguguuagugggggagcaugggucgaccuuguguuagaacacggcggauguguuacaacgauggcucaaggaaaaccaacauuagacuucgaauuaacaaaaacgacugcuaaagaagucgcuuuacuaagaacuuauugcauugaagccucgauaucuaacauuacuacagcaacacggugcccaacacagggcgaacccuaccugaaagaagaacaagaccaacaguauaucugcagacgugauguuguagaucgagguugggggaauggguguggacuauucggaaaagguggagugguuacuugugccaaauuccuguguagcggcaaaaucacgggaaaucugguacagauagaaaacuuagaauacacugugguugugacgguucacaacggagauacucaugcugugggaaaugauacgucuaaccauggaguaacagcgacuauaacucccaggucaccgagcguagaaguuaaauuacccgacuauggagaauuaacccuugacugcgaaccucgauccggaaucgauuucaaugaaaugauacuuaugaaaaugaagaagaaaaccuggcugguacauaaacaaugguuucuggauuugccuuuaccguggucagcaggcgcggauacuucagaagugcacuggaauuacaaagaaaggauggugacauuuaaagucccucaugccaaacggcaagacgugacugucuuaggcucacaagaaggugcaaugcacuccgcauuggcaggagcaacugaaguggacucaggcgacggcaaccacauguucgcaggacaucucaaauguaaaguaagaauggaaaaacuuagaauaaaaggaaugaguuacacgauguguucuggcaaauucucaauugacaaagaaauggcugaaacucaacauggaaccacagugguaaaagugaaauaugaaggugcaggagcuccauguaagguaccuauagaaauacgagaugucaauaaagagaaaguaguagggagaauaauaucaucaaccccuuucgcugaaaacacuaacucaguuaccaauaucgaauuagaaccuccuuucggggauucuuacauugucauaggagugggagauuccgccuuaacuuuacacugguuucgaaaagguaguaguaucggaaaaauguuugaaucgaccuaccggggugcaaaaaggauggcgauucuaggggaaacugcgugggauuuugggaguguaggaggacuguuuacaucgcuugggaaggcaguccaucagguauuuggcagugucuauacuacgauguuuggcgggguaucauggaugauaagaauacuuauaggauucuuaguccucuggauaggaacaaacaguaggaauaccuccauggcgaugacauguauagcagucgguggcauuacauuauuuuuaggguuuacuguacaggcagacauggguugugucguaucuuggaauggaaaagagcucaaaugcggcuccggcauauucguaguugauaauguucacacauggacagaacaauauaaguuucagcccgaaaguccggcacgacuagccucagccauacugaaugcacauaaggauggcguauguggaauacgcucuacaacucgccuggagaacguaauguggaaacaaauuacgaacgaacuaaacuauguucucugggaaggaggccaugaucucaccguagucgcuggugauguaaagggcgucuuaaccaaaggaaaacgagcuuuaaccccuccgguuaacgacuuaaaauauaguuggaaaaccugggggaaagcaaaaauuuuuacacccgaagcacguaauucuacauuccuaauagaugguccggauacaucggaguguccaaaugguagacgcgcauggaacuuuuuggaagucgaggacuaugguuuuggcauguuuacaaccaacauauggaugaaguuucgagaaggauccucugaaguuugcgaucaucggcuaaugucagcugcaauaaaagaucagaaagcaguucacgccgacaugggauacuggaucgaaucuaguaagaaucagacauggcaaauagaaaaggcuucacuaauugaagugaagacaugcuuauggccaaaaacucauacauuaugguccaacggaguauuagagucucaaauguuaaucccacgcuccuaugcuggaccauucucacaacacaauuaccgacaaggguaugcgacucaaacggccgguccauggcauuuagguaaacuugagauugauuuuggcgaguguccaggcacaacagugaccauacaagaagacugugaucaucguggcccaagccuacguacaacaaccgcuucggguaagcuaguuacccaaugguguugccgcaguugcacaaugccuccacuacgauucuugggagaggaugguugcugguaugggauggagaucagaccuuuaucagagaaggaagaaaauauggugaaaucgcaaguaacugcuggucaagggacgucagaaacauuuagcauggguuuauuaugucuaacacuauucguagaagaaugucuacgcaggagaguaacgagaaaauauaugauguuaguagucgugauuacuuuuugugcgaucauauuaggugguuuaacuuggauggacuuacugcgugcauuaauaauguuaggugauacaaugucuggccgaauuggcggacaaauucauuuagcaauuauggcaguauuuaagaugucuccagguuacguauugggaguauuucuucgaaaacugacaucccgggaaacugcacuaaugguaauagguauggcaaugacaacaguuuucucuauaccgcaugacuuaauggagcuuauugacggaauuucgcuuggacuaauuuugcuacguauaguaacacacuucgacaacacccaaguuggcacacuggcuuugaguuuaacguucauaagaaguacuacaccgcuagucauggcauggcgaacaaucauggccguauucuucguggucacacuuauaccacuuuguaggacguccugcuuacaaaaacaaucgcacuggguagaaaucacggcacucauccuaggggcgcaggcauuaccaguauaccuaaugacacucaugaaaggagcuagcagaaggagcuggccacugaaugaagggauuauggcagugggccuaguuucguuacucggaagugcauuacuuaaaaaugacgugccuuuggcaggaccgaugguagcugguggacuguuacuggcagcauaugugaugagcggaucuucugccgaucuuucacuagaaaaagcggcaaacguucagugggaugaaauggcagacauaacagguagcagcccaauaauugaggucaaacaggaugaagacggaucuuuuucgauacgagauguagaggaaacgaacaugauaacucuucuugugaaacuggcacucauaaccguaucuggcuuauacccccuggccauaccaguuaccauggcauuaugguauauuuggcaggucaaaacucaacgcagcggugcguuaugggauguaccaucuccugccgcuacacaaaaggcgacauuaagugaaggaguuuacaggaucaugcagcgcggcuuauucgguaagacccaagugggcguaggcauacacauggaaggcguuuuucauacgauguggcauguaacgaggggaaguguaauuugccacgaaacuggucgauuggagccuucgugggcagacgugagaaacgauaugauuucauaugggggaggguggcgacuaggagauaaaugggacaaagaggaagauguacagguauuggcaauugaaccagguaaaaaucccaaacacguacaaacaaagccaggcuuauuuaaaacacuaaccggugagaucggagcuguuacuuuagauuuuaagccaggaaccuccggcucgcccauuauaaauaaaaaggggaaaguuaucggacuauacggaaauggcguuguaacuaaaaguggggauuacgugagcgcuauaacccaggcagagagaauaggagaaccagauuacgaaguggaugaagauauuuuccguaagaaaagguugacaauuauggaucuccauccaggugcugggaaaacaaaacgcauccuaccaagcauuguaagggaagcacucaagcgccgacuucggacacuaauccuugcuccaacgcgaguaguugcggcugagauggaagaggcccuacgaggucucccuauuagguaucagacaccagcagugaaaucugaacacacaggaagggaaauuguagauuugaugugucacgcaaccuuuacuacacgauuauuaagcucaacucggguuccaaacuacaacuuaauuguaauggaugaagcacauuuuacagacccuuguaguguugcagcgaggggcuauauaaguacuagaguagagaugggagaagcugcagcgauauuuaugacugcaacuccuccaggcaguauagauccauucccccaaaguaacagccccauagaagacaucgagagagagaucccagagagaagcuggaacacuggguuugauuggauaacugauuaucaaggcaaaacaguaugguucguuccaucuaucaaggcgggcaacgacaucgcaaauugucuacgaaagucagguaagcgagucauacaacuaagcagaaaaacguuugacacugaauacccuaagacgaagcuaacugauugggauuucguaguaaccaccgauauuucggagaugggggcuaacuuucgcgcugguagggugauagauccccgaagauguuuaaaaccgguaauauuaacggaugguccagaaagagugauccuagccggaccuauaccaguaacuccagcaucagccgcgcaaaggagaggucguauagguagaaacccagcgcaagaagacgaccaauaugucuuuagcggagauccgcugaagaacgacgaagaucaugcgcacuggacggaagcaaaaaugcucuuagauaacauauacacucccgagggaauuauaccaacgcuauuugggccagaacgagagaaaacucaagcuauagauggagaauuucgacuucgcggcgagcaaagaaagacguucgucgaacuuaugcgccggggagaucucccagugugguuaucuuacaagguagcaucugcgggcauauccuacaaagauagagaauggugcuuuacuggagagcgaaacaaucaaauucuugaagagaacauggaaguugaaauuuggacgcgugagggggagaagaagaaacuaaggccaaaaugguuagacgcaaggguauacgcagauccaauggccuuaaaagauuucaaagaguucgcgagugguaggaaaaguauaacauuggacauauuaacagaaaucgcgacauuaccuacauaucucagcucgaaagcaaagcuggcacucgacaacaucguuauguugcacaccacggaaaaagggggccgcgcauaccaacacgcauuaaaugaauuacccgaaucccucgaaacauuaauguuaguggcccuauuaggagcuuugacagcaggcaucuucuuauucuuuaugcaaggcaaaggaauaggaaaauuaagcauggguuuaauagcaauugcaguagcaucgggcuuacucuggguagcugagauacaaccccaauggaucgcggccagcauuauucuugaguuuuucuuaaugguauugcuaauaccggaaccagaaaagcagagaacaccgcaagauaaucaacugaucuauguuauauugacaauacuaaccauaauagguuuaauagcagcgaacgaaaugggacuaauagagaaaacgaaaacugacuuuggguuuuaccaaguaaaaacagaaacuacaauacuugacguagaucuucguccugcuagugccuggacucuuuacgcaguagcaacaacgauuuugacuccaauguuacgccauacuauagaaaauacaucugcaaaccucucuuuagcagcaauagcuaaccaggcugcaguguuaaugggucuagguaaaggauggccguugcacagaauggauuuggguguaccauugcuagcaaugggaugcuacagccaagucaauccgacuacacuuacagcuagccuaguuaugcuguugguucauuacgccauaauagggccaggacuccaagcaaaagcuacccgggaagcccaaaagcggacagcagccggcauaaugaagaacccuacaguugacgguauaacggucaucgaccuugagccaaucaguuacgauccaaaauucgaaaagcaauuggggcaaguaaugcuccuaguacuuuguguuggacaacuauuacucaugaggacaacuugggccuuaugcgaggugcucacucucgcgacugguccaauaaugacguuaugggaagggaaccccggaagguuuuggaauacuaccauagccguuucaacagcaaacauauuccgagguaguuaucuugcaggggccggacuggcuuucaguuuaauuaagaacgcacaaaccccucgccgagguacaggaacaacuggcgaaacgcuuggugaaaaguggaaaagacaguuaaacucuuuagaucgaaaagaguuugaagaauauaaacgcucaggcauacucgaaguagauagaaccgaagcaaaaucagcccuucgagacgguaguaagauuaagcacgcaguaucacgaggaucauccaaaauucgauggaucguagaacguggcaugauaaagccaaaagguaagguaguagaucuaggcuguggcagaggugguuggucuuauuauauggcaacacuuaaaaaugugaccgaagugaaaggguacacaaaaggaggaccagggcaugaagaaccuaucccuauggcaacauaugguuggaaucuaguaaaguuacacucaggcguggacguauuuuacaaaccuacugaacaagucgauacacuuuugugugauauaggggaguccagcucuaauccuacaauagaagaaggucgcacucugagagugcuaaaaaugguugaaccaugguuaucuuccaagccugaguuuugcauaaaggucuuaaaucccuacaugccaacgguuauagaagaauuagaaaaauuacaacgaagacacgguggcucguuagugagaugcccucuaagccgcaacagcacacacgagauguacuggguaucaggugcgaguggcaauauugucucuagcguaaauacaauuaguaaaaugcuacuuaaucgauuuacaacaagacacagaaaaccuacguacgaaaaggaugucgaccuaggugcgggaaccagaagcgugaguacagagacugaaaaaccagacaugacaauaauaggcagacggcuucagaggcuaagagaagaacacaaggaaacauggcauuaugaccaagaaaauccauacaggacgugggcguaucaugguucauaugaggcucccucgaccggaagugcgucuaguauggucaauggagucguaaagcuauuaacuaaacccugggauguaauaccuaugguaacccaauuagcuaugacugauacaacaccguucgggcaacagcgcguguucaaagaaaaaguggacacucguacuccccagccaaaaccaggcacaagaaugauuaugacaaugacugcaaauugguuaugggcacuacuaggcaagaagaaaucaccacgguuauguacucgcgaggaauuuauaaguaagguuagaaguaacgcagcuaucggugcgguguuucaagaagaacaagguuggacuucagcuucagaagcuguaaacgacuccagguucugggaauuaguagacaaagaaagggcauuacaccaagaaggaaaaugugaaucaugcguguauaacaugaugggaaaacgagagaagaaacugggugaauuuggcagagcuaaagguucgagagcgauaugguacaugugguuaggugcgagauucuuagaguucgaagccuuagguuuucuuaaugaagaucacugguuuaguagggaaaacucuuggucagguguagaaggugaaggacugcauagacuaggguauauauuagaagauaucgacaagaaagacggugacuuaaucuacgcggaugauacugccggcugggauacaagaauaacggaagaugauuuacuaaacgaagaacuaauaacugaacagauggcaccucaucauaaaacuuuagcaaaagcgauauucaaacuuacguaucagaauaaggucguuaagguauuaagaccaacuccuaaaggagcagucauggauauaaucaguaggaaggaccagcgggguucaggccagguaggcacguacggauuaaacaccuucaccaacauggaggugcaauuaauuagacaaauggaagcugagggcguuauaacgcaagaugacaugcaaaauccuaggggccuaaaagagagagucgaaaaaugguuaaaggaaugcgggguugaucgauuaaagagaauggcuauaucuggcgacgauuguguaguaaaaccaauagaugagcgguuuucaacaagccuauuguuuuuaaaugacauggggaaaguaagaaaagacauaccacaaugggaacccaguaagggguggaaaaauuggcaagaaguucccuuuuguucacaucauuuccauaaaauuuucaugaaggauggcagaucuuugguugucccuugcagaaaccaagaugaguuaauaggucgagcgcgcauuagucaaggagcaggauggucauuaagagaaaccgcuugccucggcaaagcauaugcgcagauguggucccuaauguauuuucauaggcgugaucugagauuagcuucaauggccaucugcagugcgguaccaacggaaugguucccaacaucaagaaccaccuggucaauucacgcacaucaccaguggaugacaacagaagacaugcuaaaaguuuggaaucgugucuggauagaagacaacccaaacaugacugacaaaacuccaguucacaguugggaagauauaccauaucucggaaaacgcgaagaucuaugguguggaucauugauaggacucucgucucgugccaccugggcaaagaauauacacacugcgauaacgcaagugagaaaucuuauaggaaaggaggaauaugucgauuacaugccugcgaugaaaagguauucagcucccuuugagagugaagggguacuuuaa

SEQ ID NO: 23653 - RNA, 9867 nt, Artificial Sequence
  derived and/or modified CDS sequence (opt6) from DENV-4__JF741967__SS-prME
ucuaccaugacucuguuaugccuuauuccuacgguuauggcuuuccaucuaucuacgcgcgacggugaaccucugaugauaguggcaaaacacgaacgaggacgucccuuacuuuucaaaaccacagaaggaauaaacaaaugcaccuuaauugcaauggacuugggagaaaugugugaagacacaguaacuuacaaauguccucuucuggucaauacugaaccugaagacauagauuguuggugcaacuuaacgucuacgugggucauguaugggacauguacacaaucaggagaaagacgacgagagaaaagaaguguagcccuaacgccacacucagggaugggguuggaaacuagagccgaaaccuggaugucaagugaaggagcauggaaacaugcucagcguguugaaaguuggauucuuagaaauccaggguucgcguuguuggcugguuuuauggcauauaugauuggacagaccgggauacaaaggacugucuucuuuguuuugaugauguuaguagcgccaucauacggaaugagauguguggguguuggaaacagggacuuuguagaaggaguuuccggcggugcuuggguggauuugguguuagaacacggaggcugugucacaacaauggcacaaggaaaaccaacuuuagauuuugaacuaacaaaaacaacagcgaaagaaguagcauuguuaagaacuuacugcauagaagcaucuauauccaacauaacaaccgcaacaagaugucccacacaaggcgaacccuaccucaaagaggagcaagaccaacaauauauauguaggagggacgucguugaucguggauggggaaacgguugcggucuauuuggaaaagguggugugguaacgugcgccaaauuucucuguaguggaaagauaacugguaacuuaguacaaaucgagaaucuagaauacacaguagucguaacuguacacaauggaaacacacaugcaguaggaaacgacacaaguaaccauggggucacagcaacaaucaccccacguaguccaagcguagaagucaaacuuccggauuacggagaacuaaccuuagauugcgaaccacgguccggcauugacuucaacgagaugauacuaaugaaaaugaagaagaaaacuugguuaguucacaaacaaugguuucuggaccuuccgcuuccguggacugccggagcagauacaucugaaguucauuggaauuauaaagagagaaugguuaccuuuaaaguuccucaugcuaaaagacaagacguaacugucuuaggaucacaggaaggagcuaugcacucugcccucgcuggugccaccgagguagacagcggagacggaaaccacauguucgcuggucauuuaaaguguaaaguacguauggagaaauuaagaauuaaagguaugagcuauaccaugugcucgggaaaauuuucaauugauaaagaaauggcugaaacacaacacggaacaacggugguuaaaguuaaauaugagggcgcgggagcaccauguaaaguacccauagagauaagagacguaaauaaagaaaagguaguaggacggaucauuuccaguacuccauucgcagaaaauacaaauaguguaacaaacauagaacuugaaccaccuuuuggugauucauacauugugauaggaguaggagauagugcucuuacucuacauugguucagaaaaggaaguucgauuggaaagauguuugaaagcacauaucgcggagcuaagagaauggcaauauuaggagagacugcaugggacuucggcucaguaggcggcuuguucacaagucuagguaaggcaguucaucaaguauucggcaguguauauacaacaauguuuggcgguguaucauggaugauuagaauacuuauaggauucuuaguccucuggauaggaacaaauagccgaaauaccaguauggccaugaccuguauagcgguaggagggauaacgcuauuucuggguuuuacgguccaggcagauaugggcugugucguaaguuggaauggaaaagaacugaaguguggaaguggcaucuucguagucgacaauguucauaccuggacggagcaauauaaauuccaacccgaaagcccagcacgauuagccuccgcaauauuaaaugcgcauaaagauggagugugcggaauacgauccaccacgagacucgagaaugucauguggaaacaaauaaccaaugaauugaacuauguucugugggaaggugggcaugauuugacugucguagcuggugacgucaaaggugugcucacaaaaggcaaaagagcccuaacgcccccuguuaaugacuuaaaguacaguuggaagacauggggcaaagcuaaaauauucacaccugaggcgcguaacucuacuuuccuaaucgacggcccagauacaagugaaugcccaaaugaacgcagggcuuggaauuucuucgaaguagaggacuauggauuuggaauguucacuacaaacaucuggaugaaguuuagagagggcagcucggaagugugugaucauagauuaaugagcgccgccauuaaagaucaaaaagcuguccacgcggacaugggauauuggauugaaaguaguaagaaucagaccuggcaaauagaaaaggccucauugaucgaagugaagacauguuuguggccaaaaacacauacacuauggagcaacggaguuuuggaaucgcaaaugcuaauaccaagaucauacgcagggccauucucucaacacaauuauagacaggguuaugcaacucaaaccgcagguccuuggcaucuaggaaaacuugaaauugauuucggugaauguccuggaacaacaguuacgauucaagaagauugcgaccaucgugggccaucauugagaaccacaacugcaagcgguaagcuaguuacgcaauggugcugcaggagcugcacaaugccucccuuacgcuucuuaggugaagauggauguugguaugguauggaaauacgcccgcucuccgagaaagaagaaaacaugguaaaaucucaaguaacagcgggacaaggaacaucggaaacauucucaauggguuuacugugucugacccucuuuguagaagaauguuuacgaaggcggguaacacgcaaacauaugauauuggcggucguaauaacguuuugugcaauaauuuuagguggacugacguggauggacuuguugagaguauuaauaauguuaggagacaccaugucuggacgcaucgguggacaaauacauuuagcaaucauggccguauucaaaaugaguccaggauaugugcugggaguguuuuuacgaaaacucacaucacgugaaaccgcccuaaugguaaucggaauggcgaugacaacagucuuuaguauaccacaugaucuaauggaguuaauugaugggauaucgcuuggguuaauacuccucaaaaucguuacccauuuugauaacacccaagucggaaccuuagcucucucacuaacauucauaagaucaacaacaccauuaguuauggccuggagaacaauuauggcaguauucuuuguagucacacuuauaccguuauguaggacuucaugucugcaaaaacagucucacugggucgaaauuacugcuuuaauauuaggcgcucaagccuuaccaguauaccuaaugacgcuaaugaaaggugcaaguaggaggucuuggccacuaaaugaagguauaauggcaguaggauuggugagcuuacucggaagugccuuauuaaagaaugaugucccauuagcugguccaaugguagcuggaggauuacuacuugcagcuuacgugaugucaggaucuucugcugauuuaucacuagaaaaagcggcaaacguacagugggaugagauggcggauauaacaggaucaucucccaucauugagguaaaacaagacgaagacgggagcuuuucgauucgagaaguagaggaaacaaauaugaucacacuguuagugaaacuugcguuaauuacuguuucaggacuauauccacuggcaauuccagucaccauggcauuaugguauguauggcaagucaagacacaaaggaguggugcgcuaugggauguacccaguccugccgcaacacacaaagcaacuuuaagugaggguguauacagaauuaugcagagaggcuuauuuggaaaaacccaaguugguguaggcauccauauggaagguguauuccacacaguaggacauguaacccgcggaagcguuauaugucacgaaacaggcagacuggaaccgucuuggggagacgucagaaaugacaugauaucauauggaggaggauggagauuaggcgauaaaugggauaaagaggaggauguacaaguucuagcuaucgaaccaggcaaaaaucccaaacacgugcaaacuaaaccgggccuauucaagacgcucacaggcgagaucggagccgucacucuugacuucaagccggguacgucggguucacccauaauaaauaagaaaggaaaagucaucggucuauauggaaacggaguggugaccaagucgggugacuauguuucagcaauaacacaagcagaacgaauaggagaaccggauuaugagguagacgaagacaucuucagaaagaaacgccuaacuauuauggaucuacauccaggcgcaggaaaaacgaagagaauacuaccgucaauaguacgcgaagcguuaaagcgaagacuaaggaccuuaauacuagcucccacuagaguuguugcugcugaaauggaggaggcucucaggggauugccaauacguuaccaaacgccugccguuaaaucagaacauacgggacgagaaaucguagaccucaugugccacgcaacguuuacaacucgauuauuaucuucaacucgaguuccaaacuacaaucucauaguuauggacgaagcccauuucacagauccgugcaguguggcagcgcgugguuacauuaguacaagaguggaaaugggagaagcagcugcaauuuuuaugacugcuacaccaccuggaucaauagacccauucccgcaaucaaacagcccaauagaagacauagaaagggaaauaccggaacgaucauggaacacagguuuugacuggauaacugauuaccaaggcaaaacaguaugguucguaccgucaauaaaggcagguaacgacauugcaaacugcuuacgcaaaucgggaaaaagggucauacagcuaucgcgaaaaaccuuugauacagaauauccuaaaaccaaauuaacagauugggacuuuguggucaccaccgacaucucggagaugggagccaacuuucgagcgggucguguaauagaucccagaagaugucucaaaccgguuauacuaacagaugggccugaaagagucauauuagcugguccuauccccgugaccccagcuucagcugcgcagcguagaggccgcaucgguaggaauccagcucaggaggacgaucaguacguauuuucuggagauccauuaaagaacgacgaagaccacgcacacuggacagaggccaagauguuauuagauaacauauauacaccagaaggaauaauaccgacacuuuuuggacccgaaagagagaaaacccaggccauagauggagaauuucggcuuagaggagaacaaagaaagacauucgucgaacuaaugcgccgcggggaccugccagucugguuaucuuauaaaguagcaagcgcaggcauaucuuacaaggaccgcgaauggugcuuuacuggagaacgaaacaaucaaauacuagaagaaaacauggagguagaaaucuggacgagagaaggugaaaagaagaaauugaggcccaaaugguuagaugcccgcguauaugcugauccuauggcuuuaaaagauuucaaagaguucgcaucagguagaaaaucgauuacucucgacauacuaacugaaauagcgaccuuaccgacauaccuaaguucaaaagcaaaauuagcacuagacaauaucguuaugcuccauacgacagagaagggaggccgugcauaucaacacgcgcuuaacgaacuaccugaaucauuagaaacgcuuauguuaguugcauuacuaggugcaaugacagccgguauauuuuuauuuuucaugcaaggcaaaggcauaggaaaguuaucuaugggucuuauugccauagcaguagccucugguuugcuuuggguagcggaaauccaaccacaguggauugcugcaucuauuauacuagaguucuuccucaugguccuacuaaucccagaaccagagaaacaaaggacaccccaggacaaccagcuaauauacgucauauuaacuauuuuaacaauaauaggucucaucgcggcgaacgagaugggguuaauugagaaaacuaaaacagauuuugguuuuuaucagguuaaaccggaaacuacaauauuggauguggaccuaaggccugcgagugcuuggacuuuauaugcaguugcaacaacgaucuugacuccgauguuaagacauacaauagaaaacacgucugcuaaccuaucacuagcagcgaucgccaaucaagcugcugugcuaaugggguuagguaaaggauggcccuuacaccgcauggaccucggugucccauuacuggcaauggguugcuauagccaaguaaauccgacuacuuugacugcuucguuaguaauguuauuaguccauuaugcgaucaucggaccaggacugcaagcuaaagcaaccagggaagcacaaaagcgaacugcagcaggcauaaugaagaauccaacaguagacggaauaacaguaaucgaccuagaacccaucucauaugauccuaaauuugaaaaacaacuagggcaaguuauguuacugguguuauguguuggccaacugcuauugaugcgcacuacaugggcauuaugugagguacuuacgcuagccacaggaccuguaaugacccuuugggaaggcaaucccggccgauucuggaauacuacgauagcuguaucaacagccaauauauuccgcggguccuacuuggcaggagcaggauuagcauuuucuuuaaucaaaaaugcccagacaccuaggagagguaccgggacaacaggagaaacgcuuggagaaaaguggaaaagacaacucaacucguuagaucguaaagaguucgaagaauauaaacgcagcggcauauuagaaguggacaggacugaagcaaaaucagcacugagagacggaacuaaaaucaaguacgcaguuucucgaggaucuaguaaaaucagauggauaguagaacgaggaaugauuaaaccuaaagggaaaguuguugauuuaggauguggucgaggggguuggagcuauuauauggcaacguuaaagaacguaaccgaaguuaaaggguauaccaaagguggucccggacacgaggaaccgauaccuauggcgaccuacgguuggaaucuagugaagcuacauucagguguagauguguuuuauaagccaacggagcagguugauacucuauuaugcgauauaggagagucuagcucgaauccgacaauugaagagggcagaaccuuaagaguccuaaaaaugguggaaccauggcuuucaucaaagcccgaauuuuguauuaaaguccuuaauccauauaugccaaccguaauagaggagcuggaaaagcuacagagaaggcacggcggcucgcuaguuaggugcccauuaucaaggaacagcacacaugaaauguacuggguuucaggagccuccgguaauauaguaucauccguaaauacuaucucaaaaauguuacuuaaucgauuuacaacucggcaccgaaaaccaacuuaugaaaaagauguagacuugggagcugguacgcguagugugucuacugagacagaaaaaccugauaugacaguaaucggacgccgcuugcaacgacuuagagaagaacacaaagaaacauggcauuaugaccaggaaaauccguauagaacgugggcuuaccacgggagcuacgaagccccaaguaccgguucagcuucgucgaugguuaauggugucguuaaauuacuuacaaaaccaugggaugucauacccauggucacacaauuggcgaugacagauacaacccccuucggucaacaacgaguauuuaaagaaaagguugacacucguacaccgcaaccgaaaccuggcacuaggaugauuaugacaacgacggcgaauuggcucugggcucuccuggguaagaagaaaucuccgagauuaugcacccgagaagaauuuauaucaaaaguacguagcaacgcagcaauuggagccguuuuucaggaggaacaaggguggaccucagccagugaagcugugaacgacagcagauuuugggaauuagucgacaaagagagagcucuacaucaagagggaaaaugcgaaagcuguguuuacaacaugaugggaaaaagagagaagaaacugggagaguucgggagagcaaaagguagcagagcuauuugguauauguggcuaggugcucgauuccuagaguucgaagcacuaggguucuuaaaugaagaccacugguucaguagggaaaauucuuggucagguguagagggugaaggccugcacagauuagguuauauccuggaagauaucgacaagaaagacggggaucuaauuuaugcagaugauaccgcgggaugggauacccguauaacugaggacgacuuacuaaacgaagaauuaauaaccgagcaaauggcaccacaccacaaaacacuagcaaaagccauauucaaauuaacauaucagaauaaaguuguaaaaguuuuaagaccuaccccaaaaggagcugugauggauauuauuucacguaaagaccagagaggcagugggcagguagguacauacggccuaaacacauuuacaaacauggaaguacaguugauccgucaaauggaagcagaagguguaauaacucaagacgacaugcagaacccuaaaggucuuaaagaaagaguugaaaaauggcuuaaagaguguggaguagaccguuugaaaagaauggccauaucaggggaugacugcguaguaaaacccuuggaugagagauucucuacuucauuguuauuuuuaaaugauauggggaaaguccggaaagauauaccucaaugggaaccgucaaaaggcuggaaaaacuggcaagaagugccauuuuguagccaucauuuccauaagauauucaugaaagacggaagaucguuaguuguaccaugccguaaccaggaugaacuaauaggcagagcaagaauaagucaaggcgcgggcuggagccucagggaaacugcuugcuuagguaaagcauacgcacagauguggucauuaauguauuuucacaggagggauuuaagauuggccucuauggcaauuuguucggcaguacccacagaaugguuucccaccucuaggacgacauggagcauacacgcccaucaucaauggaugacaacugaagauaugcuaaagguguggaaccgaguuuggauagaagauaauccuaacaugacugacaaaacgccaguacacucaugggaagauauacccuaucuugguaaaagagaagaccuuuggugcggcucucuaaucggauuaaguucuagggcuacaugggccaaaaacauucacacagcaauuacacaaguacguaaccuuauugguaaggaagaguaugucgauuauaugccggcaaugaaacgauacucugcaccuuuugaaucagaagguguacuguag

SEQ ID NO: 23654 - RNA, 9867 nt, Artificial Sequence
  derived and/or modified CDS sequence (opt6) from DENV-4__JQ822247__SS-prME
ucaacaaugacuuuacuaugcuuaauuccaacuguuauggcguuccaucuuucaacacgagacggggaaccauuaaugauaguugcaaaacacgaacgagggagaccuuuauuguuuaaaaccacugaaggaauaaauaaauguacccucauugcuauggaucuaggagaaaugugcgaagauacgguuaccuacaaguguccacugcuugugaauacagaacccgaagauauagauugcugguguaaucuaacaucaacaugggugauguaugggacaugcacacaaucgggagaacggcgacgugaaaagcgauccguagcacugacaccacauagcggaauggguuuggagacucgagcagaaacauggaugucaagugaaggagcauggaagcacgcucaacgcgucgagucauggauucuccguaauccgggcuucgcacuacuggccgguuuuauggccuauaugauaggucaaaccgggauucaaagaacaguauuuuucguccugaugaugcuaguagcuccuucauacggcaugagaugugucggaguuggaaacagagacuuuguggaaggagugucugguggagccuggguagauuuaguccuagaacacggagggugugucacgaccauggcccagggaaagccaacacuagauuuugaauuaaccaaaacuacggcuaaagaagucgcgcuguuaaggacauacuguauugaggcuuccauaucuaauauaacgacagccacaagauguccuacgcaaggcgaaccguaccugaaggaagaacaggaccaacaauauauuugucgcagggauguaguggaucgaggauggggcaaugguugcggauuguuuggaaaaggaggcguggucaccugugcaaaauuccuauguucgggaaaaauaacaggcaaucuaguccaaaucgaaaaucuagaguacacuguagucguaacgguacauaacgguaauacucaugcaguugguaacgacacgaguaaucauggagucacugccacgauaaccccuagaagcccaagcguagaaguuaaacucccagauuacggugagcuuacauuagauugcgaaccccgaaguggaauagauuuuaaugagaugauuuuaaugaagaugaagaagaaaacuugguugguacauaaacagugguuucuugauuuaccacuuccguggacagcuggagcugauaccucagaagugcauuggaauuauaaagaacguauggucacuuuuaaagucccacaugcaaaaaggcaagacgucacuguacuuggcagucaagaaggggcaaugcauagcgcgcuugcuggugcaacggaaguugacucuggcgauggaaaccauauguuugcaggacaccuuaaauguaaagugaggauggaaaaauuaagaaucaagggaaugucauauacaauguguucggguaaguucucuauagauaaagaaauggcagagacucaacacgguacaacaguaguuaaagucaaauaugagggcgcgggggcaccuugcaaaguuccgaucgaaauacgggaugugaacaaagaaaagguuguagguagaaucauaaguagcacuccauucgcagaaaauacaaacucagugacaaauaucgaauuagaaccuccauuuggugauaguuauauuguuauagggguaggagauucagcacuaacauuacauugguuuagaaaagguagcucuauuggaaaaauguucgaaagcaccuauagaggagcaaaaaggauggcgauacuaggcgaaaccgcgugggauuuuggaaguguugguggucuauuuacuuccuuaggaaaagcaguucaucaaguauuugggucuguauauacgacaauguuuggaggaguuucuuggaugauucgaauacugauaggguuuuuaguucuuuggauaggcacuaacucaagaaauaccagcauggccaugaccugcauagcuguaggcgguauaacauuauuccuaggauuuacagugcaagcggauauggguugcguaguauccuggaacgggaaggaacucaaaugcgggaguggaaucuuuguaguagauaacguccauacauggacagagcaauauaaauuucagccggaaucaccagcaagacuugccucagcgauuuugaacgcccauaaagauggaguauguggaauacgcaguacaacaagguuagagaacgucauguggaagcaaaucacuaaugaguuaaauuacguucuuugggaagguggccacgaucuuacaguuguggccggagacguaaagggaguacuaacaaaaggaaaaagagcauuaacucccccgguuaaugaucuaaaauacucauggaaaacaugggggaaggccaagauuuuuacaccggaagcccgaaacagcacuuuccugauugauggucccgacacaucugaauguccuaacgagagacgagcauggaacuucuuugaaguagaagacuauggauuuggaauguuuacaacaaacauuuggaugaaauuuagagaaggguccucagaggucugcgaucaccgccugauguccgccgccauaaaagaccaaaaagccguucacgcugacauggguuauuggauagaguccucuaaaaaucagacguggcaaauugagaaggcuucccugauugaaguuaaaaccugucuuuggccaaaaacucacacauuauggucaaaugguguacuagaaagucagauguugauccccagaagcuaugcggggccguucucacaacauaauuauagacagggguaugcgacacagacugcagggcccuggcacuugggaaaacucgaaauagacuuuggggaaugucccggaacgacuguaacuauccaagaagauugcgaccauagaggacccucgcuaaggacgacuacggcuucaggcaaacuuguaacacaaugguguuguagaaguuguacuaugccaccauuaagauucuuaggagaggacggcuguugguacggcauggaaaucagaccauuaagugaaaaagaggaaaacauggugaaaucucaaguaacagcuggacaggguacaagugagacauuuucaaugggacucuuaugccuaaccuuauuuguugaagaaugucuacgucgaagaguaacccgaaagcauaugaucuuagcagugguaaucacauuuugugcgauuauccuaggugggcuaaccuggauggaccugcugagaguucuaauaaugcuaggcgacaccaugaguggccgaaucggcgggcaaauacaccuagcuauaauggcuguuuuuaaaaugucuccuggauacguccuuggaguguucuugcgcaaacucacaucacgggaaaccgcucugaugguaaucgggauggccaugacgacuguuuuuaguauaccacaugaccuuauggaguugauagacgggaucagucuugggcuuauauuauugaaaauagugacccacuucgauaauacacaagucggcacuuuagcguuaucgcuaacguucauaagaucaaccacgccacuugugauggccuggagaaccauaauggcaguauucuuugugguuaccuugauaccauuaugccgaacaagcugccuucagaaacaaucacacuggguagagauaacugcuuuaauucuuggagcacaggcccucccgguauauuugaugacacuuaugaaaggugcuucgagacguucauggccauuaaacgaggggauuauggccguuggccuaguuucacuucuaggaucggccuuacucaagaaugacguaccauuagccggaccuauggucgcaggaggauuauuauuagcggccuauguaauguccggaaguagcgcagauuuaucauuagagaaagccgcaaauguacagugggacgaaauggcugacauuacaggcuccaguccaauaauugaggucaaacaagaugaagacggaucguuuuccauacgcgauguagaagaaacuaauaugauaacacugcuuguaaaacuggcauuaauaacagucucaggacuauauccuuuagccaucccaguuaccauggcgcuuugguauguuuggcagguaaagacgcaacguaguggggcucuaugggacgucccgucccccgcagcaacacaaaaagcaaccuugucagaagguguuuaccgaauuaugcagagaggauuauuugguaagacacaagugggagucgguauucacauggaaggcguauuucauacaauguggcauguaacuagagguucaguuauaugucaugaaacuggccgauuagaaccuaguugggcugacgucagaaaugacaugauuaguuacgguggggguuggagauuaggagacaagugggauaaggaagaagaugugcaaguauuagcuauagaacccgguaagaacccaaagcauguacaaacaaaaccuggauuauuuaaaacuuuaacuggugaaauaggagcuguuacacuggauuucaagcccggaacuagcggcaguccaauaauaaacaagaaaggcaagguaauuggccuauacgguaacggcguaguaacaaaaucaggagauuaugugagugcuauaacucaagcggaacgcaucggugagccagauuaugaggucgacgaagauauauuccgcaagaaacgcuuaacgauaauggauuuacacccaggagcagggaagacuaaaagaaucuuaccaucuauuguuagggaagcccuuaaacggcgacuaagaacacuaauauuagcuccaacacgaguaguagcagcagagauggaggaggcauuacggggcuugccaauaagauaucaaaccccagcaguaaaaucugaacauacugguagagaaaucguggauuuaaugugucaugcaacauucacuacacguuuguuaagcucaacaaggguaccuaacuacaaccuaauaguaauggaugaagcacauuuuacagacccuuguaguguugcugccagaggguacauaagcacgaggguagaaaugggagaggccgcggcgauuuuuaugacagcgacaccgcccggaaguaucgauccauuuccacaaucuaacucuccuauagaagacauagaaagggagauaccggaaagaucguggaauacuggguuugauuggaucaccgacuaccagggaaaaacggucugguuuguaccgagcauuaaggccggaaacgacaucgcuaacugccuuaggaaaucgggaaaaagaguaauucaauugagccggaaaacguuugauacugaauaccccaagacaaaauuaacagauugggauuucguagugacgaccgauaucagcgaaaugggagcgaauuuuagagcuggacgagucauagauccgcgaagaugcuuaaagccuguuauauugacagacggaccagagcgcguaauacuggcugguccaauaccggucacgccagcaucggcggcccagcguagaggaagaaucgguagaaaucccgcgcaagaagacgaucaauauguuuucagcggcgacccacugaaaaaugaugaagaucaugcacacuggacagaagccaaaauguuauuagauaacaucuauaccccagaggguauuauaccuacacuuuuugggccagagagagagaaaacgcaagccaucgacggagaguuccggcuuaggggugaacagcgaaaaacauuuguagagcucaugagacgaggcgauuuaccaguuuggcugucguauaaagucgcguccgcuggcaucagcuacaaagaucgagagugguguuuuacaggugaaaggaacaaucaaauauuagaagaaaacauggaaguggaaauauggacacgggaaggugagaaaaagaagcuaaggccaaaauggcuugaugcuaggguauaugcagacccuauggcguuaaaagacuuuaaagaauuugcauccggaagaaaaaguauaaccuuagacauucugaccgaaauugcaacacuuccaacauacuugucgaguaaagcgaaauuggcauuagauaacauagucaugcugcacacuacagaaaaaggagguagagcauaccaacacgcauuaaacgaacuaccagaaagucuggaaacacucaugcuuguggcccuccugggagcaaugacagcuggcauuuuucuguucuuuaugcaaggcaaggguauagggaaacuuaguaugggauuaaucgcaauagcaguagcaucaggacuacuuuggguugcagagauacaaccucaauggaucgcagccucgauaauauuagaguucuuucucaugguuuuacuuauuccugaaccugaaaaacagagaacuccgcaagacaaucaacugaucuauguaauacucacuauuuugacaauaauuggcuugauagcagcaaaugaaaugggacuuauugagaaaacgaagacugacuucggguuuuaucagguuaaacccgaaacaaccauuuuagaugucgaucucaggccugcuucagccuggacauuauaugcuguugccacgaccauauugacaccuauguugagacauacgauugaaaauacuucagcaaaccucaguuuagcugcgauagccaaccaagccgcgguucuaaugggcuuaggcaaaggauggccucuccaucgaauggauuugggugugccccuccuggcuauggguuguuauucacaagucaacccuacaacuuugacggcaucucuaguaaugcuucucguucacuacgcuaucaucggcccaggucuucaagccaaggcaacgcgagaagcgcaaaagagaacugcagccgguauaaugaaaaauccaaccguagaugguauaacugucauugaucuagaaccaauaucauacgaccccaaauucgaaaaacaacuaggacaagugaugcuacucguguuauguguagggcaacuacugcuaaugcgaacgacgugggcccugugugaaguauuaacucuagccaccggaccagugaugacauuaugggaaggaaaccccggccgcuuuuggaacacaaccauugcaguauccacagcgaauauauuuaggggaaguuauuuggcuggugcaggccucgcuuucucauugaucaaaaaugcucaaacacccagacgaggcacggguaccacaggcgaaacacugggagaaaaauggaaacgacagcuaaacucccuugauagaaaggaauuugaagaguauaaacguucaggaauacuugaaguagaccguacugaggcgaaauccgcacucagagacggaacaaaaauaaaauacgcugugagcagggguucaaguaaaauacgauggauaguagagagaggaaugauuaaaccaaaaggaaagguaguagaucugggauguggaagaggcggauggucauauuauauggcaacacuaaagaaugucacggagguaaaaggauauacgaaaggcgguccaggucaugaggaacccauaccaauggcaacauaugguuggaacuuaguaaaacuacauucuggcguagacguauuuuacaaaccaacagaacagguugauacgcuauuaugugacaucggagaaucuucaaguaacccgacuaucgaagaagggaggacucuucgagugcuaaaaaugguagagccauggcuuaguucuaagcccgaauuuuguauuaagguuuuaaauccguauaugccuacggugaucgaggaauuagaaaaacuucaaagaagacacgguggcagcuugguacgcugcccguugagccgaaacucaacgcaugaaauguauuggguaaguggugcuagcggaaacaucgucucuucugucaacacaaucaguaaaauguuauugaaucgauuuacaacucgccauagaaaaccaacauacgaaaaagacgucgauuuaggagcugggacaagaagcguaagcacagaaacugaaaagccagauaugaccgucauaggaagaaggcuacagcgcuuaagagaagaacauaaagaaacuuggcacuacgaucaagaaaauccauacagaacuugggcauaucauggaucuuaugaagcaccaucgacaggaucagccucaagcauggucaauggcgucguuaaacuauugacaaaaccaugggacguuauaccgauggucacacaauuagcuaugacugacacuacucccuucggacaacaaagaguuuuuaaagaaaaaguggacacuagaacaccgcagccgaaacccggcacaagaaugauaaugacgacaacugccaauuggcuaugggcacuacuaggcaaaaagaaaagcccacggcuauguacacgugaggaauuuaucucgaaagugcguucaaacgcagcuaucggagcgguuuuucaggaagaacaaggauggaccagcgcgucagaggcuguaaacgauagucgauuuugggagcuggucgauaaagaaagagcacuacaccaagaagguaaaugugaaucaugcguauauaauaugauggguaaaagggagaagaaauuaggugaguucggaagggcuaaaggaucgcgugcuauaugguauaugugguuaggagcgcgauuucuagaauuugaagcguuaggauuucuaaaugaagaucauugguuuaguagagaaaacucaugguccggaguggaaggagaaggccuacauaggcuaggauacauacuggaagacauugauaagaaggauggugaucuuauauaugcugaugauacagccggaugggauacaaggauaaccgaagaugaccugcuaaaugaggaauugauaacagagcaaauggcgccacaucacaaaacacucgcaaaggcgauauuuaaacuaacguaucaaaauaaagucguaaaaguguuacguccaacgccuaaaggggcugugauggacauaaucucacgaaaagaccaacguggaucgggacagguuggcacuuacgguuuaaacacauuuacaaauauggaaguacaguugauuaggcaaauggaagcggaaggaguaauaacucaagaugacaugcaaaauccaaaagggcuaaaggaacgagucgaaaaaugguuaaaagaaugugggguagacagacuaaaaaggauggcgauaagcggcgaugauugcguugucaaaccacuugaugaaagauuuucaacgagucuacuauuucucaacgauaugggcaaaguuagaaaagauauaccgcagugggaaccuucaaaaggauggaaaaauuggcaagaaguaccauucugcagccaccacuuccauaagauauuuaugaaggacggucguucucuuguaguuccuugcagaaaccaggacgagcuuauuggucgagcuagaauaagccaaggcgcagguuggaguuuacgggaaacugcuuguuuaggaaaggcuuacgcucaaauguggucacucauguacuuucaccgucgggacuuaagacuagcaagcauggcuaucuguucugcaguaccaacggaaugguucccuacuagcaggacaaccuggucaauacacgcacaccaccaauggaugacaacggaggauaugcucaagguauggaaucgaguauggauugaagauaacccaaauaugacugauaaaacgccuguacacagcugggaggacauccccuauuuaggaaaaagagaggauuuauggugcggaaguuugauagguuugaguaguagagcuacaugggccaaaaauauucauacagcuauuacucaaguaaggaauuugauaggaaaagaagaauacguugauuauaugccugcuaugaagcgguauucugcuccauucgaaucugaaggcguacuauaa

SEQ ID NO: 23655 - RNA, 9867 nt, Artificial Sequence
  derived and/or modified CDS sequence (opt6) from DENV-4__JF262783__SS-prME
ucaacaguaacccuucuuugcuugauacccacgguaauggcuuuucacuuaagcacucgagacggcgagccuuugaugauuguugcuaaacacgaaagaggaaggcccuuacuauuuaaaacaacagaaggcauuaacaaaugcacuuuaauagcaauggauuuaggagaaaugugugaagacacugucauguacaaauguccccuauuaguaaauacugagccugaagacauagauugcuggugcaacuugacuucgacuugggugauguacggcacauguacccaaagcggugaacgacggagggaaaaacgauccguagcgcuaacaccucacucugguaugggccuggagacacgagcagaaacguggaugucgagcgaaggagcguggaaacaugcgcaaaggguggaaagcuggauacuucguaacccagguuucgcacugcuggcgggauuuauggcauacaugauaggacaaacugguauacaaagaacaguauuuuucguguuaaugaugcuaguugcaccauccuauggaaugcgcuguguugguguaggaaauagagauuuugucgaaggugucagugguggagcgugggucgaccugguauuagaacacggcggauguguaacaacuauggcccaggguaaacccacauuagauuucgagcuuauuaaaaccacagcaaaagaaguaacacuacuaagaacauacugcauagaggcgucuauuagcaacauuacaacggcaaccagaugcccuacccaaggugaaccuuauuuaaaagaagaacaagaccaacaauauaucugcagaagagaugucguugacagaggcuggggaaauggcuguggacuauuuggaaaaggugggguuguaacaugcgccaaauuuuuauguaguggaaaaauaacaggaaauuuaguacagaucgaaaaucuagaauacacuguaguaguuacgguucauaacggugauacgcacguagucggaaaagauaccucaaaccaugguguaaccgccacgauaaccccacgcucaccaucagucgaaguaaaacuaccagauuacggagaacugacacuggacugugaaccucggucaggcaucgauuuuaacgagaugauuuugaugaaaaugaagaagaaaaccugguuaguccauaaacagugguuucuugauuuacccuuacccuggacugccggagcagauacuagcgaaguccaauggaauuacaaagagcguaugguaacuuuuaaaguuccccaugcaaaaaggcaggacguaaccguguuaggcucucaagaaggcgcuaugcauagugcacuaacaggagcuaccgaaguagauucaggagacgguaaccacauguucgccggucaccuaaagugcaaggucagaauggaaaagcuacgaauaaaaggcaugucauauacaauguguagcgggaaguuuaguauagauaaagaaauggcugaaacacaacacgguacgacgguuguuaaggucaaguaugaaggagcuggagccccguguaaaguacccauagaaauaagagaugucaauaaagaaaaagucguuggucgcauuauaaguucaacaccuuucgccgaaaacacuaacuccguaacuaauauagaauuggaaccuccauuuggagacucuuauauuguuauugguguuggggauagcgcgcucacccuccauugguucagaaagggaaguaguauagguaagauguuugaaagcacauacagaggagcaaagaggauggcaauuuuaggagagacugcuugggacuucggaucagucggaggacuuuuuacaucuuuaggaaaagcaguccaccagguuuucggcucaguuuacacuacaauguucggagguguaaguuggaugguuaggauccugauuggacucuuaguccuuuggaucgguacgaacucaagaaauacaaguauggcaaugacauguauugcaauagguggcauaacacuuuuccucggcuucacuguacacgccgacauggggugcgcagucuccuggucgggaaaagaacuaaaaugcggcagcggaaucuucguuauagauaacguccauacauggacagaacaauauaaauuucagccugaaucuccugcacgcuuagcaucagcgauacucaacgcccauaaagacggaguuugcgguaucaggaguacaacuaggcuugaaaauguaauguggaaacagauaaccaaugaguuaaacuaugucuuaugggaaggaggacacgaucucacaguagucgcgggugaugugaaggggguauugacaaaaggaaaaagagcacuuacaccucccguuaaugauuuaaaauacuccuggaaaacauggggaaaggcuaaaauuuuuacaccugaagcuagaaauucuaccuuuuuaauagacggccccgacacuucugaaugcccaaaugaacgaagggcauggaauuuucuagagguagaagauuauggguuuggaauguuugcaacuaacauauggaugaaauucagagaaggcucaucagaaguuugcgaucacagauuaaugucagcggcaauuaaagaucagaaagcuguucaugcagauauggguuacuggauagaaaguaguaaaaaccaaacauggcaaaucgaaaaggcuuccuuaaucgaaguuaaaacgugccuauggccuaaaacccacacucuauggucaaaugaaguccuggagagccagaugcuuauucccaaggcguacgcaggaccuuuuagccaacauaacuaucgacaaggguacgcuacacaaacuauagggccauggcacuuagggaagcuagagauagauuucggcgaaugcccugggacuacaguaacaauccaagaggauuguaaccaucgaggcccaucuuuacgcacuacaaccgcaucaggcaaguugguuacccaauggugcugucgaaguugcaccaugccacccuuaagguuuuugggagaagacgguugcugguacggaauggaaauuaggccgcuauccgaaaaagaagaaaauauggugaaaucucaagucucggcuggacagggcacgagugaaacauuuucaaugggauugcuuugcuuaacuuuauuugucgaagaauguuuaagaagacggguaacuaggaaacacaugaucuuaguggucgucacaacccugugugcuauaauacuuggcgggcuaaccuggauggacuuacuacgagcccuaaucaugcucggggauaccaugucaggaagaaugggagggcaaauucacuuaaccauaauggcaguauucaaaaugucgccaggauacguauuggguguauuccuucgcaaacugaccuccagagaaacggcucuaauagugauugguauggcaaugacuacggugcucuccauaccccaugaucugauggaauuuauagaugggauaucacuuggccucauccuucuaaagaugguagcacauuuugauaacacacaaguaggcacuuuggcacuaucucuuacauucaucagguccacuaugccuuuaguaauggcauggcgaacaauaauggcgguacucuucguaguuacauuaaucccgcuuugccggacaucgugucuucaaaaacagagccacugggucgaaauuaccgcuuugauucuaggugcccaagcucuaccaguuuauuuaaugacccucaugaaaggugcaucaaagcguagcuggccgcuaaacgagggcauaauggcuguuggccuaguaucauuguuagggucagcacuucugaaaaaugacguaccacucgcagguccaauggucgccgggggcuuauuacuagccgccuacgucaugagcggaucuucagcagaucuuucguuagaaaaagccgcaaauguacagugggacgagauggcugauaucacggguaguagccccauuauagaaguaaaacaagaugaggaugguagcuuuucuauucgugacguagaagaaacaaacaugauuacacuauuaguuaaacuugccuuaauuacaguuagcggauuguauccgcuugcuauuccaguuacgauggcccuuugguauauguggcaagugaagacacagaggucaggggcacuuugggaugucccuucaccggcugcugcacaaaaagcaacuuuaaccgaaggcguguaucguaucaugcaaagaggauuauucggcaaaacucaagugggcgugggaauccacauggaaggcguuuuccacacaauguggcacguuacaagggggaguguaauaugccaugagacuggcagguuggaacccuccugggcagauguacguaacgacaugaucucauacggaggugguuggcguuuaggagauaaaugggacaaagaagaagauguacaaguacuagccauugaacccgguaaaaauccuaaacaugugcaaacaaaaccaggccuauucaaaacacuaaccggugaaauaggugccgucacauuggauuuuaaaccaggaacaucuggaucccccauaauuaacaagaagggcagagugauuggcuuauacggaaacggcauagucacuaagucgggugacuauguuucagcuaucacacaagcggagaggaucggugagccagauuacgaaguggaugaggacauauucaggaaaaagcgauuaacggugauggacuuacacccgggugcaggaaagacuaaaaggaucuuaccaucaaucguuagagaggcguuaaaacggcgguuaaggacacucauacucgcaccgacacgagugguagcagcagagauggaagaagcguuaagggguuugccaaucagauaccaaacgccugccgugaaaucugagcauacaggccgagaaauuguggaccuuaugugucacgcgacauucacuaccagauuguuaagcuccaccagaguaccaaauuauaaccuuauugugauggaugaagcucauuucacugaucccuccuccgucgcagcaagaggauauauaaguacgagaguugaaaugggagaggcugcugcuauauuuaugacagcgaccccuccuggggcaacugaccccuucccacaauccaauucgccaauagaagacauugagagagaaaucccggaacgaucguggaauacaggauuugacuggauuacagacuaucaaggaaaaaccgugugguuuguuccgucgaucaaggcuggaaacgauaucgcgaauugucuacggaaaaguggcaagaaaguaauacaauugucaagaaaaaccuuugacacugaguacccuaaaacaaaacuaaccgauugggauuuugucgucacuacagacaucucugagaugggugccaauuuuagggccaggcggguuaucgacccaagaaggugucuaaaaccagugauuuugacugacggaccggaacgaguaauacuggcuggaccaauaccgguuacaccagcaucagcagcucaaagacggggucgcauuggcaggaaucccgcgcaagaagacgaucaauaugucuucucaggagauccucuuaaaaaugaugaagaccacgcgcacuggaccgaggcaaagaugcuacuugauaauauuuacacccccgagggaauaauaccuacuuuauucgguccugaacgugaaaagauacaagcuauagauggugaauuuagauuacgaggugaacaaaggaaaacauucguagaauuaaugcguagaggugauuugccaguuugguuaucuuauaaaguggcaagcgcaggaauaucauacaaagauagagagugguguuuuacaggugagaggaacaaccaaauucuugaagagaauauggaaguagaaauauggacgagagaaggagaaaagaagaaacuucgaccaaaauggcuagaugcccgugucuaugccgauccgauggcguuaaaagauuucaaagaauuugcaucuggacggaagucaauuacucuagacauuuuaacggaaauugcgucucuccccacuuaucucucuaguagggcaaagcuggcccuggacaacaucgugaugcuucauacaaccgaacgaggaggucgcgcauaucaacacgcauugaacgaauuaccagagagucuugagaccuuaaugcuaguugcacuucuuggagcgaugacggcaggaauauuuuuauucuuuaugcagggaaagggaauugggaagcuaaguaugggcuuaauggcaauagcaguugcgucuggacugcuaugggucgcagaaauacaaccacaauggauagccgccucaauaauccucgaauuuuucuuaauggcacuauuaauuccagaaccagaaaaacaaagaacaccccaggauaaucaauuaauauacgugauacucacuauccuuacgauaauaggauugauagcugcaaacgaaaugggauugauugagaaaacgaaaacagauuuuggcuucuaucaaguaaaaacggagacaacaauuuuagauguagaccuaagaccggcuagugcguggacauuguaugcaguagcgaccacuauacuaacucccauguugcggcauacuauagaaaauaccagcgcaaacuuaaguuuagcugcuauagcuaaucaagcagccgucuuaaugggauuagggaaaggauggccacuccaucgaauggacuuaggaguuccacucuuagcgaugggcugcuacucacagguuaauccuacuacauuaacugcaucacucguaaugcucucaguccauuaugcuauaaucggcccuggacuucaagcuaaagcaacacgugaagcgcaaaaacguacugcggcaggaaucaugaagaauccaacgguugauggaauaaccguuauagacuuagaacccauuaguuaugauccgaaauuugaaaaacaauuaggacaaguaauguuacuugcccuuugugcaggccaacuccugcuuaugcggacaacaugggcuuuuugcgaaguuuugacacuugcaacuggaccuauacuuacacuuugggaaggaaauccaggaagauucuggaacacaacaaucgcaguaucaacagcuaacauauuucgaggaaguuaucucgccggugcaggucuggccuucagucugauuaaaaaugcacaaacaccccgacguggcaccggaacuaccggagaaacucucggggaaaaauggaaaagacaguuaaauagucuggauaggaaagaauuugaagaauauaaaagaagcggaauuuuagagguagacagaaccgaggccaaguccgcacuaaaggauggaucaaaaauaaagcacgcaguauccagggggucaucaaaaaucagguggauuguggagagggggaugguaaagccuaaggguaaggugguagacuugggaugugggcgagguggauggaguuacuauauggcaacacucaaaaacgugacagaagugaaggguuacacaaaggguggaccaggucaugaggaaccaauaccaauggccacauauggauggaaccugguaaaacuucacaguggaguagacgucuucuacaagccuacggaacaaguagauacgcuucuaugugauauuggugaaucgaguagcaauccaacaauagaagaaggucgcaccuugcggguucuaaaaaugguagagccauggcucaguucuaaaccagaauuuugcauaaagguacucaaucccuauaugccaacaguuaucgaagaauuagaaaaguugcaacggaagcacggagguagcuuagucagaugcccucuaucgcgaaacucgacacacgaaauguauuggguuucaggagccucuggcaauauagucagcaguguaaauaccacaaguaagauguuauuaaaucgguuuacuacaaggcaucguaaaccaacauacgagaaagacgucaauuugggagcaggaacccggucaguaagcacagaaacagagaaaccagacaugacaauaauugguagaaggcugcaaagacuacgagaagaacauaaggaaacauggcauuacgaucaagaaaauccuuauaggacuugggcuuaucauggaagcuaugaagccccaucaacaggaucggccaguucgaugguuaacggggugguuaaauuauugaccaaaccaugggauguaaucccaauggucacccaacuggcaaugacagacacuacgccauucggucagcaaagaguauuuaaagagaaagucgauaccagaacaccacagcccaaaccuggaacacggaugguaaugacgacaaccgcaaauuggcuaugggcacuucugggaaagaaaaaguccccacgauuaugcacgcgagaagaauuuauauccaaaguucgcucgaaugccgcaaucggagcgguguuccaagaagaacaagguuggaccagcgccucagaagcuguuaacgauucacgauucugggaacuuguugacaaagaacgggccuuacaucaagaagguaagugcgagaguugcguauauaauaugauggguaaacgagagaagaaauuaggugaauuugggagagcuaaggggaguagagcuaucugguauauguggcuaggagcaagguuucuugaauuugaagccuugggauuucuuaaugaggaccauugguuuggccgggagaacucauggaguggaguggaaggggaaggauuacacagacuaggcuacauccuugaagacauugacaagaaagauggagauuuaauuuacgcagaugacacagcagggugggacacuaggauaacugaggaugaucuguuaaaugaggagcuaauaacugaacaaauggcaccccaccaucggaucuuagcaaaagccauuuuuaaacuaacauaccaaaauaaaguaguaaaaguacuaagaccgacucccaagggggccguuauggacauaaucaguagaaaagaucaacgcggcuccggacagguggguaccuaugguuuaaauacauuuaccaauauggagguacaguuaauccgccaaauggaagcagagggagucauuacacaagaugauaugcaaaacccaaagggccuaaaggaaagaguagaaaaaugguuaaaagaauguggaguggauaggcuuaaaagaauggcaauaagcggcgacgauugugucgugaaaccucuggacgaacguuuuagcacaucucuucuauuucuaaaugauauggguaaagugagaaaagauaucccccaaugggagcccuccaagggauggaaaaauuggcaagagguacccuucuguucacaucauuuucacaaaauauucaugaaagauggaagaagucucgucguaccgugccguaaccaagacgaauuaauuggaagggcaagaaucagucaaggagcugguuggucucuucgagaaacagcuugccuagguaaagcauaugcccaaauguggagcuuaauguauuuccaucgccgugacuugagauuagcaagcauggcgauuuguagugcaguuccaaccgaaugguuccccacaaguaggacgacauggucaauacaugcacaucaucaauggaugaccacagaagauaugcuaaagguauggaaucgaguuuggauagaagauaauccaaauaugacagauaaaaccccagugcacucuugggaggacauacccuacuuagguaaacgggaagaccuauggugcggaagccuaauaggacuuucuucaagagcaaccugggccaaaaauauacacacagcaauaacccaaguacgaaaucugauaggcaaagaggaguauguugauuauaugccagucaugaaacgcuacagcgcaccauuugagucggaaggaguguuguaa

SEQ ID NO: 23656 - RNA, 9867 nt, Artificial Sequence
  derived and/or modified CDS sequence (opt6) from DENV-4__KU513441__SS-prME
ucaacaauaacuuuguuguguuuaauaccuacagugauggcuuuucaccucagcacaagggacggugaaccucucaugauaguagcuaaacacgaacgagggaggccuuuacuauuuaaaacaaccgaagguauaaacaaauguacguuaauagcaauggaucuaggagaaaugugcgaggauacaguuacuuauaaauguccacuuuuagucaauaccgaaccagaggauauagauugcuggugcaaucuuacgucgaccugggucauguaugguacauguacgcaaagcggagaacgaagacgugagaaaagaucggucgcacuuacgccacauagcggaauggguuuagaaacaagagcagagacauggaugaguagugaaggagcauggaaacacgcacaacgagucgaaagcuggauuuuacgaaacccuggauuugcucuacuagcgggguuuauggcuuauaugauaggacaaacagguauacagagaaccguuuucuucguacuaaugaugcuuguagcaccuaguuacggaaugagguguguaggcguuggaaaucgcgauuucguagagggaguaagcggaggagcuuggguagauuugguacuagaacacggaggaugcguuaccacgauggcacaggggaaacccacuuuagacuucgaacuuacuaaaaccacugcuaaagaaguugccuuauuacguaccuacuguauagaagcccuuauuuccaauaucacaacggcaacacguuguccgacccaaggagagccuuaccucaaagaagaacaagaucagcaauacaucugccggagggauguaguugauagggguuggggcaacggguguggacuauuuggaaaaggaggaguagucacuugcgccaaauuuagcugcucaggcaaaauaacaggcaacuugguucagaucgaaaaucucgaauacaccgucguuguaacaguccacaauggcgauacccaugcagucgggaaugacacuucaaaucauggcguuacagcgaccaucacaccaagaucaccgaguguagaaguuaaauugccagacuauggcgaacuuacacuagauugugaacccagaucaggaaucgacuucaacgaaaugauacucaugaaaaugaaaaagaaaaccugguuaguacacaaacagugguuuuuagaucuaccccuaccuuggacgacgggugcagauacaucggaaguccauuggaauuauaaagagcgaaugguaacguucaaagucccucacgcaaaaaggcaagaugugacaguauuggggagccaagaaggugcuaugcacucagcguuagcuggggcuacagaaguggacucaggggaugggaaccauauguucgcuggccaccuuaaauguaagguuagaauggagaaacuaagaaucaaggggaugagcuauacgauguguucuggcaaauuuucaauagacaaagaaauggcugaaacgcaacauggaacaacuguaguuaaaguaaaauacgaaggggcuggagcgccaugcaaaguucccauagaaauuagagacguuaauaaagaaagggucguugguagaguuauuuccgcaacaccacuugcugagaauacaaauucugucacaaacauagaacucgagccgccguucggagauagcuauauagugauugggguagguaauucagccuuaacacugcauugguuuagaaaaggaucgucaauaggaaaaauguucgagucaacuuaucgaggagcgaaaagaauggcaauacugggcgaaacagcaugggacuuuggcucaguaggaggauuauuuaccagucuugguaaagcuguccaucaaguuuucggauccgucuauacaaccauguucggcggagucucauggaugauaagaauacugauugguuuucuaguauuauggauaggaaccaacagcagaaauacaagcauggcuaugacguguaucgcuguagggggaauuacgcuauuuuuggguuuuacagugcaagcugacaugggauguguugugucguggucuggacgugaacucaaauguggaaguggcauauuuguagucgauaacguacacacauggaccgagcaauacaaauuccaaccagagucaccggcccgucuagcaucggccauccucaacgcccauaaagacgguguuugcggaauaaggucaacuaccagguuggagaauguaauguggaaacaaaucacgaaugaacugaacuauguccuuugggaagguggucaugaucuaaccguaguagcuggcgauguuaaaggaguauuaacuaaggggaagcgcgcacuaacaccaccagcgagugaucuaaaauauucauggaaaacaugggggaaagcgaagaucuucacaccagaggcaagaaauucuacauuuuuaauugacggaccagauacaucagaauguccuaaugagcgucgugcauggaauagcuuugagguggaggacuaugguuuuggcauguucacaacgaauauuuggaugaaauuuagagaagguuccucagagguaugugaucaccggcuuaugagugcugcgauuaaagaccaaaaagcgguucaugcggauaugggauacuggauugaaucuucuaagaaucaaacauggcaaauugaaagagcaucuuugaucgagguaaaaacauguuuguggccgaaaacgcacacgcuuuggucaaauggaguucuggaaagucagauguuaauaccuaaaaguuacgccggcccauucagucagcacaacuacagacaagguuaugcuacgcagaccguagggccauggcaucugggaaaacuagagaucgacuuuggugaaugcccagggacuacaguuacaauucaggaaaacugugaucaccgcgguccaaguuuaaggacuacaaccgcaagcggaaaguuggugacccaguggugcugucguucuuguaccaugcccccacugcguuuucuaggcgaagaugguugcugguaugguauggaaaucagaccccuuuccgaaaaagaggaaaauaugguaaagagucaagugacugccggacaagguacaucagaaacuuucucuaugggauuacuuugccuaacgcuauuuguagaagaaugccuucgacgacgcguuacaagaaagcacaugauauuagcaguaguaauaacacucugugcuauaauauugggugguuuaacuuggauggauuuauugagagcgcucauuauguuaggugauacuaugucugguagaauugggggucaaacccaccuggcaauaauagccgucuucaagaugucaccaggauauguacuaggcguauuccuucguaagcugacaucacgagaaacagcacuaaugguaauuggaauggcaaugacuacaacgcuuagcauuccacacgaucucauggaacuuauagauggaauaaguuuaggauuaauacuccuaaagauagugacgcaguuugauaauacccagguagguacccuugcauuauccuuaacauuuauucgaucaacaaugucgcuaguaauggcuuggagaacaaucauggcagugcucuuuguaguuacacucauuccucuauguagaacaaguugucuacagaaacaaucucauugggucgagauuacagcacugauucuaggugcucaagcucucccaguguauuuaaugacucuaaugaagggugcuucaagaagaucguggccacugaaugaaggaaucauggcuguaggguuagugucguugcuaggaagugcgcuauugaaaaaugauguuccuuuggcaggaccaaugguagccgguggcuuguuguuagccgcuuaugugauguccgguucaucggcugaucuaucuuuagaaaaagccgcaaauguacaaugggaugagauggcggacauaaccggaaguaguccaaucauugagguaaaacaagaugaagauggcucuuucaguaucagagacguugaagaaaccaauaugauaacauugcuuguaaagcuagccuuaauaacaguuucuggccuauacccacucgcaauaccaauaacaaugacauugugguacauguggcaagugaaaacccagcguucuggugcacuaugggaugucccuucgcccgcagcaacucagaaggcagcuuuaagugaaggaguauaucgaaucaugcaacgcggucuguucggaaaaacacaaguagguguuggaauccacauggaagguguuuuucauacgauguggcacguaacgcgaggcucuguuauaugucaugaaacggguagacuagaaccuucuugggcagauguucgaaaugauaugauaucuuacggagggggauggagacuaggcgauaagugggacaaagaagaagauguacaaguguuagccauugaaccugguaaaaacccaaagcacguccaaacuaaacccggccuauucaaaacucucacuggugaaauaggggcuguuacuuuagauuucaaaccuggcacaagcggaagccccaucauuaaccgaaaagguaaaguaaucgguuuguauggaaacggugugguaacuaagagcggugacuauguaagugcuauuacgcaagccgaaagaauaggagaacccgauuaugaaguugaugaagacaucuuucgaaagaaaagauuaacaauaauggaucuucaucccggagcgggaaagaccaagagaauauuaccaucgauugugcgagaagcacuuaagagaagauugcggacccuaauucuugcgcccacacgagugguggcugccgagauggaagaagccuuaagaggccuaccuauucguuaucaaacuccagcuguaaaaucagagcacacagguagagaaauaguagaucuaaugugccacgcaacuuuuacaacacgccuacugucaucaacaagaguaccuaacuauaacuuaaucguaauggaugaggcccacuuuacagacccuucgucaguugcagcgcguggauauauaaguacuaggguagaaaugggggaagccgccgcaaucuuuaugacagcaacgccuccaggagcgacagacccauucccucaaagcaauagcccaaucgaagacauugagagagagauuccggagagauccuggaauacagguuuugacuggauaacggacuaccaaggcaaaacagugugguucguuccuaguauuaaagcaggaaaugacaucgcuaauuguuuaaggaaaagcggcaagaaagucauacaacuaucccgcaagacguucgauacugaauauccgaaaacaaaguuaaccgauugggacuucguuguaacaacagauaucuccgaaaugggugccaauuucagagcaggacgaguaauagauccucgcagaugcuuaaaaccgguuauacuuacagauggaccggaacggguuauuuuagcagggccuauucccguuacuccagcuagugcagcacaaagaaggggucgaauaggaaggaaccccgcccaagaagacgaucaauacguauuuucgggagacccucuaaagaaugaugaagaucacgcacacuggacggaagcuaaaauguugcuggacaauauuuauacgccugaaggcauaauaccaacauuauucggaccagaaagagagaaaacgcaggcaauagauggugaauuuagacuaagaggcgaacagagaaaaacguucguugaauugaugcgacguggcgacuuaccaguguggcucaguuacaaaguagcaagugccggaaucucauauaaggauagagaauggugcuuuacuggcgaacgaaauaaccaaauacuagaagagaacauggaaguugagauauggacuagagagggcgagaagaagaaauuaagacccaaaugguuagaugcacgaguauaugcagacccgauggcacuaaaagauuuuaaggaauuugcuagcgggagaaagucgauaacauuagauauauuaacugaaauagccagcuugccaacuuaccucucaaguagggccaaacuagcccuagacaacauaguuaugcuacauaccaccgaaagaggaggccgagcuuaccagcacgccuuaaaugaauugccggaaucucuugaaaccuuaaugcuuguugcauuacuuggugcaaugacagcagggauuuuccucuuuuucaugcaaggaaagggcauagggaaacucucaauggggcucauaacaauagcaguugcguccggauuauuguggguugcagaaauccaaccucaauggauugccgcaaguaucauccuugaguucuuuuuaaugguacuguuaauuccagaaccugaaaaacaaagaacaccgcaagauaaucagcuuauauauguuauucuaacaauacuaaccaucauagguuuaauugcggcaaacgaaaugggguuaaucgagaaaacuaaaacagacuuuggauucuaccagguuaaaacugaaacuacuauccuagauguagaccugagaccagcaucagcauggacauuauaugcaguagcuacuacaauacuuacucccaugcuuagacauacaaucgaaaauaccagugcaaaucuuucccuggcagcuauagcaaaccaagcagcagugcucaugggguuagggaaaggauggccuuuacauagaauggauuuggguguuccccuauuagcaauggguuguuauucacagguaaauccuacaacucuaacagcuaguuuagucauguuauuaguccacuacgcaauuauuggaccaggacuacaagcgaaagccacacgggaagcacaaaaacggaccgcagcugggauuaugaaaaaucccacuguagaugguaucacaguuaucgaccuugaaccuauaucauaugauccaaaauuugaaaaacaacugggacagguaauguuacucguguuaugcgcaggccaacuauuauuaaugagaacaaccugggcauucugugaaguguuaacacuagccacaggaccgauccuaacacuuugggaggguaauccgggaagauucuggaauacuacgaucgcaguuucgacagcaaauauuuuucguggcucauauuuagcgggagcagguuuagcguucagcuugaucaaaaacgcccaaacaccgaggcggggaacgggaacagcaggagaaacucuaggagaaaaauggaaaagacaauuaaauagucucgauagaaaagaauuugaagaauauaaaagaucagguauauuggaggucgacagaacugaggccaaaucagcgcugaaagacggaaguaaaauuaagcacgcggucagccgaggaucgucaaaaauacgguggauagucgaacgaggaauggugaaaccgaaagggaaaguuguugaucuagguuguggaagaggagguuggagcuauuauauggcaacauuaaagaacguaacggaaguaaaaggauauacuaaagggggcccggggcaugaagaacccauuccuauggcaacauaugguuggaauuuaguaaaacugcacucagguguugacgucuuuuauaaaccaaccgaacaaguggauacacuacucugugacauuggcgagaguucuucuaaucccacaauagaagaaggaagaacucugcgagugcucaaaaugguagaaccuugguuauccagcaaaccagaguucuguauaaaagugcuuaauccauacaugcccaccgucauugaagaauuagaaaaguuacaacgcaagcauggugggaacuugguucgauguccucuuucaagaaauucuacucaugaaauguauuggguaucuggggcaucgggaaauauuguaaguucagugaauacgacaucuaaaaugcuacuaaauagauucacaacuagacaucgcaaaccgacauaugaaaaggacguagaucucggcgcagguacucgaagcguguccaccgaaaucgaaaaacccgauaugacuauaauaggacgccgucuucagagauugcaagaagaacauaaagagacuuggcacuaugaccaggagaacccuuaucgcacaugggcuuaucacgguucauaugaagcccccucaacuggcuccgcuagcuccauggugaacgggguuguaaaguuacugacgaaaccgugggacgugauaccuauggucacccaacuagcaaugaccgauaccacaccauuuggacaacaaagaguauuuaaggagaaaguagauaccagaacaccccaaccaaagccagguacaagaaugguaaugacaacuacugcaaacugguuaugggcauuguugggaaagaaaaagaacccaagacuauguacaagagaagaguucauaucgaaagugaggucuaaugcugcuaucggggccguguuucaagaggaacaagguuggacgagugcuucagaagcgguaaaugacucacgauuuugggagcuaguugacaaagaaagggcacuccaucaggaaggaaagugugaauccuguguuuauaacaugauggggaaacgagagaagaaauuaggagaguucggacgugcaaaaggaagucgagccauaugguauaugugguuaggagcaagguuucuugaguuugaggcacucggcuuccuuaaugaggaccauugguuugggagagaaaacaguuggagugguguagaaggagaaggacuucaccgacuaggcuauauauuggaagaaaucgauaagaaagauggagaccuuauguaugcagacgacaccgcaggcugggacacacgcauaaccgaggaugauuuacaaaaugaggaauugauuacagaacaaauggcuccucaccacaaaauauuagcaaaagccaucuucaaauugacguaucaaaacaaagugguaaaaguuuuaagaccuacaccaagaggagccguuauggauauuauuagcagaaaagaucaacgggguucagggcaagucgguaccuauggauuaaacacauucacaaacauggaggugcaauuaauucgacaaauggaagcugagggaguaaucacucaagaugacaugcagaacccuaaaggacucaaggaacggguugagaaaugguuaagggaguguggaguugauagauuaaaacgcauggccauaucuggcgaugauuguguuguuaaaccucuagaugaaagauuugguacaucauuacuguuccuuaacgauaugggaaagguaagaaaagauauaccccaaugggaaccaaguaaaggcuggaaaaauuggcaagaagugcccuucuguucacaucacuuucauaaaauauuuaugaaagauggccguagcuuagucguuccgugcagaaaccaagaugaacuaauagggcgggcucgcauaucgcaaggagcuggauggucacucagagaaacugccugucuggguaaggcuuaugcacagaugugguccuuaauguacuuccauagaagagauuugcgacuagcgaguauggcaauauguuccgcaguuccaacagaaugguuuccaacaucucggacaacauggaguauacaugcccaccaucaguggaugacaacagaagauauguugaaaguauggaaucgaguuuggauagaagauaacccgaauaugaucgacaagacaccgguacauagcugggaagacauaccuuaucucgguaagcgugaagacuuauggugcggaucauuaauaggauugagcagcagagcuacaugggcuaaaaauauucacaccgcaauuacccaagugagaaaucuuauaggaaaggaagaauacguagauuauauguccgugaugaaaagguauucugcuccuucagaaucagaaggcgugcuauaa

SEQ ID NO: 23657 - RNA, 9867 nt, Artificial Sequence
  derived and/or modified CDS sequence (opt6) from DENV-4__KC762694__SS-prME
aguacuaugacacuucuaugccuaauuccaacugucauggcuuuucaccucucuacuagagauggagaaccuuugaugauaguggcgaagcaugaaagaggucgaccccuuuuauuuaaaacaacggaagguauaaauaaauguacuuuaaucgcaauggaccuuggagaaaugugugaagauacggucacauacaaaugcccauugcugguaaacacugaaccugaagauauagauugcuggugcaaucuuacuucaacauggguuauguaugggacaugcacgcaaagcggugagaggcgacgugaaaaacgaagcguugcucucaccccacauaguggaaugggacucgaaacgcgagcagaaacuuggaugucgagugaaggugccuggaagcacgcgcagcgaguggaauccuggauucuacguaauccuggauuugcucuuuuggcugguuuuauggcguacaugauuggucagacuggaauacaaagaacagucuucuuuguuuugaugaugcuaguagccccaaguuaugguaugcgcugugugggagugggaaacagagauuucguagaaggcguaagugggggagcuugggucgaccuagucuuagaacacggugggugcgucacaacaauggcgcaaggcaagcccacgcuggauuuugagcugacaaaaacaacagcuaaagagguagcgcuacuuagaacguacugcauagaagccuccauaaguaauaucacgacagcgacuagaugcccaacacaaggugagccuuauuuaaaagaagagcaggaucaacaauauauuugcaggagagauguuguagauagaggcuggggaaacggaugcggguuguuugguaaagggggaguuguuaccugugcaaaguuucuuugcucagguaaaauaaccggaaaucuuguucaaaucgaaaaucuagaauauacgguaguugugacgguacauaauggggacacucaugcaguagggaacgauacaucaaaucacggcguaacugcgacuauaacaccaagaagcccauccguagagguaaagcugcccgauuacggugaacuaacuuuggacugcgaaccgagaagugggaucgacuucaaugagaugauucuaaugaaaaugaaaaaaaaaacauggcuugugcauaaacagugguuuuuagacuuaccauuacccuggacggcgggggcagacacaucggaaguccacuggaacuauaaagaacgaaugguuacguuuaaaguaccccaugcaaaacgccaagacgucacuguauuaggaucucaagaaggugcuaugcacuccgcgcuggcuggugcgacagaaguagacucuggugaugguaaccauauguucgcaggacaucuaaaauguaagguaagaauggaaaaacuacgaaucaaaggaaugagcuacacaaugugcucagguaaauucagcaucgauaaggaaauggcggagacccaacaugguacuacugugguuaaagugaaauacgaaggggcaggagcuccauguaagguaccuauagaaauaagggacguuaacaaagaaaaaguaguuggaagaauaauaucaucaacacccuuugccgaaaacaccaauucuguaacaaauauagaacucgaaccaccguucggagauucauauaucguuauaggaguaggagacucagcauugacuuugcauugguuccgaaaaggcucuucgaucggaaaaauguucgaaucuaccuaccgaggagcuaaacgcauggcaauauugggagaaacugcaugggauuuugguucuguuggaggacucuucacaagccuuggaaaggccguacaucagguauuugguagcguguacacuacgauguucggaggugugucauggaugauaagaaucuuaauaggguucuugguauuauggauaggaacaaacucucgaaauacaucgauggcaaugaccugcauugcugugggagguaucacuuuauucuugggauucacaguacaggcggacauggguuguguuguuucauggaaugggaaagaguuaaaauguggcucuggaauauucgucguggacaacguccacacuuggacugaacaauacaaauuccagccggaaucaccagcacgguuagcguccgcgauacucaaugcgcacaaagauggagugugugggauaagaaguacaucccguuuagagaauguuauguggaaacagauaacgaacgaauuaaacuacguuuuaugggaaggcggccacgacuuaacaguagucgcgggcgauguaaaaggugucuuaacaaaaggaaagcgggcacuaaccccaccaguuaacgauuuaaaauauagcuggaagaccuggggaaaggcuaaaauauucacuccggaagcucgcaauaguacuuuccuuauagauggaccagacacaagcgaauguccuaacgaacgacgggccuggaacuuuuucgaaguagaagauuaugguuucggaauguucaccacuaauauuuggaugaaauuucgugaaggcucuagcgaaguuugcgaccaucggcucaugagugccgcgauuaaagaccaaaaagcuguucaugcggauaugggcuauuggauagaaucaagcaaaaaccaaacuuggcaaauugaaaaagcuucccuaauagaaguaaaaacaugcuuauggcccaaaacucauacacuauggucuaauggaguccuagaaucucaaauguugaucccccgauccuacgccggcccguuuagucaacauaacuaucggcagggcuaugcaacacagacugcaggaccauggcaucuaggaaaauuagagauagacuucggggaguguccuggaacgacggucacgauacaagaagauugugaucauagagggccuucgcuaagaacaacaacagcaucugguaaacucgugacacaaugguguugcaggucauguacaaugccuccacuaagauuucuaggugaggacggguguugguacggaauggaaauucgaccacuaucagaaaaggaagaaaauaugguuaaaagccaaguuacugcgggacaagguacaucagaaacauuuaguaugggucuguugugccuuacauuauuuguagaagaaugucuacguaggcgaguaacaagaaaacacaugauucuaguagucguaauaacauuuugugccauuaucuugggcgguuuaacauggauggauuuauuacgugcauugauaaugcuaggggacacuauguccggaagaaucggaggccaaauucaucuagcaauuauggcagucuuuaaaaugucaccaggauauguccuaggcguauuccugcguaaacuuacuucacgcgaaacagcgcuuauggugauuggaauggcaaugacaacggucuuuucaauaccacaugaccugauggaacuaauagauggcauaaguuugggacuaauccuguuaaagauagugacacauuuugacaacacacaagucgggacuuuggcucucagucugacauuuauacguuccacaacaccucuaguaauggccuggcgcacaauuauggcaguauucuuuguaguuacucuuaucccuuuaugccgaaccucuugccuacagaaacaaucacauuggguagaaauaacagcacuuauucuaggggcacaagcacuaccaguuuaccuaaugacucuuaugaaaggggcaagucgucgauccuggccacugaaugaaggaauaauggcagugggauuaguaagucuauuagguucagcgcuacuaaaaaaugaugucccuuuggcuggcccaaugguugcaggugguuuacuccuggcagccuauguaaugaguggauccagcgcugaucuaucucuggaaaaagcagccaauguccaaugggaugaaauggcagauauuacuggaucuucgccaauaaucgaaguaaagcaagacgaagaugguucuuuuaguauucgggacguugaagaaacaaauaugauaacacuauuaguaaagcucgcauuaauaacaguuagcggcuuauacccguuggccaucccuguaacgauggcacuuugguacguuuggcaaguaaaaacgcaaagaucuggagcacucugggauguuccuucgccggcagcaacacaaaaagcuacacucagugagggugucuaccgcauuaugcaacguggccuguucggaaaaacgcagguugguguaggcauccauauggaaggaguguuccauacgauguggcaugugacacgaggcagcgucaucugccaugaaaccggaaggcuagaacccagcugggccgacguuagaaacgauaugauuucauacggaggcgguuggcgacuaggagauaaaugggauaaagaagaggauguacaaguacuugccauugaaccuggcaaaaauccaaagcaugugcaaacuaaaccaggacuauucaaaacacuuacaggugagauaggcgcagucacacuugauuuuaaaccuggaacaaguggaucgccaauuauaaacaaaaagggaaaagucauugguuuguauggcaaugggguaguaacuaaaagcggcgauuaugucucagcaauaacccaagcggagaggauaggcgaaccagauuacgaaguggaugaggauauuuuuagaaaaaaacgguuaacaauaauggaucuacauccaggagcaggcaaaacaaaacgaauacuuccaagcauugugagagaagcuuuaaaacgacgucugcgaacgcuuauucuugcuccgacgagggucguugcagcugagauggaggaagccuuaagaggacugccgauucguuaccaaacgccggcuguaaaaucagaacacacugggagggaaauugucgaucucaugugucacgcaacuuucacaacaagauuguuaucuucuacaagagucccaaacuauaacuuaauaguaauggaugaagcacauuucacugacccuuguuccguagcggccagaggauacauuucuacucgaguggaaaugggugaagcagcagcuauauuuaugacagcaacgccgccgggaucaauagacccuuucccacaaucaaacucacccauagaagacaucgaaagagaaauaccagaaagaagcuggaauacggguuuugauuggauaaccgauuaccaaggaaaaacugugugguucguaccauccauaaaggcagguaaugacauugcuaacugcuugaggaagucugggaaacgaguaauccagcucaguagaaaaacuuucgacacagaguauccgaagacaaaacugaccgauugggacuucguaguaacgaccgacauaagcgagaugggagcgaauuuucgagcuggcagaguaaucgacccccgccgguguuugaaaccuguaauauuaacggauggaccagagagaguuauacuggcuggcccgauccccguaacaccggcauccgcugcacaaagaagaggucguauagggagaaauccagcccaagaagacgaucaauauguauucucaggugauccacuaaaaaacgacgaagaucacgcacauuggacggaagcuaaaauguuacucgauaauaucuauaccccagaaggcaucauccccacacucuucgggcccgagagagaaaagacacaagcaauugauggagaauucagguugcgaggagaacaaagaaagacuuuuguagaauuaaugcguaggggcgacuuaccgguaugguuaaguuacaaggucgcaagcgccggaauauccuacaaagauagggagugguguuuuacaggagagagaaauaaucaaauacuugaagaaaauauggaaguggagaucuggacacgagagggugaaaagaaaaaauuaagacccaaauggcucgaugcuaggguauaugcggauccaauggcacucaaagacuucaaagaguuugcuaguggucggaaaucuauaacacuugacauuuuaaccgaaauugcgacuuugccgacauaccuuucuuccaaggcuaaauuagcuuuagacaauauugugaugcugcauacaacagaaaaaggcggcagagcauaccaacaugcuuuaaacgaguuaccggaaucucuagaaacuuugauguugguagcgcugcuaggcgccaugaccgcuggcaucuuucuauuuuuuaugcagggcaaaggaauugguaaacuaagcaugggguugaucgcaauugcaguagcuaguggacuacucuggguagcagagauccaaccccaauggaucgcagccuccauaauuuuagaauucuuccuuaugguauuacuaauucccgaaccagaaaaacaaaggacaccucaagauaaucaauuaauauacgucauuuugacgauucugacaauaauuggauugauagcugccaacgaaaugggucugauagaaaaaacaaagacugacuuuggauucuaucaagugaagaccgaaacaaccauacuugauguagaucuaagacccgcaucugcuuggacgcuauacgcugucgcgacuacaauauuaacuccaauguuaaggcauacuauugaaaauaccagcgcaaaucuuagucuggcugccaucgcaaaucaagcugcaguacuuaugggacuaggaaagggcuggccucuccauagaauggacuuggguguuccguugcuagcaauggguugcuacagucaaguaaauccaaccacacuaacagcuucuuuaguaauguuauuaguucacuaugcaauuauugggccgggauuacaagcaaaagcuacccgagaagcccaaaaacgaacggccgcaggaauuaugaaaaaucccacaguagauggaauaacagucauagaucuggaacccaucaguuaugacccaaaguucgaaaaacaauuaggccaaguaauguuacugguuuuauguguuggccaguuacuacucaugaggacuacgugggcacuuugcgaaguacuaacacuagcaacgggacccguuaugacuuuaugggaaggaaauccaggacgauucuggaauacuaccauagcugucagcacagccaauauauuucgcggaagcuauuuggcuggugcagguuuagcauuuucguuaauaaaaaacgcccaaacaccgaggagaggaacuggaaccaccggugagacccuaggugaaaaauggaaaaggcaacuaaauucguuagauaggaaagaauuugaggaguacaagcguucgggaauccuggaaguugaucgaacugaagcaaaaucggcucuaagagacggcucgaaaauaaaauacgcugugagucguggaaguucaaaaauaagauggauaguagaaaggggaaugauuaagccuaaaggcaaaguaguugaucuagguuguggcagaggagguugguccuauuauauggcuacacuaaaaaacgugacugaaguuaaaggcuacacuaaagggggaccuggacacgaagaacccaucccuauggcgaccuacggguggaaucuagugaaguuacauagcggaguggauguguuuuacaagccuacagaacaaguagauacauuauugugcgacauuggggaaaguagcucuaacccgacgauugaagaagggaggacgcuaagaguauuaaaaaugguagagccguggcuaucuucgaaaccagaauuuuguauaaagguuuugaacccuuacaugcccacaguaauugaagaacuagaaaagcuucaaaggagacacggagggaguuuaguuaggugcccucuaagcagaaacagcacacaugaaauguacuggguaaguggagcaucggggaauauuguaucaucaguaaacaccauaagcaaaaugcuauuaaaccgauucacuacacgccacagaaagccaacuuacgaaaaagacguggaucuaggugcggggacacgcucugugagcacugagaccgaaaaacccgauaugacgaucaucgggcguagacuacaaagauuaagggaagaacauaaagaaacauggcacuacgaucaagagaauccguaucgaaccugggccuaccauggaucuuaugaggcuccaucaacaggaucugcauccuccaugguuaacggaguuguaaagcuucucaccaagccgugggauguuauacccauggucacacaacuugcgaugaccgauacgacgccauucggccaacagcgugucuucaaggaaaaaguugacacaaggaccccucaaccuaaaccggggacuagaaugauuaugacuacaacugcaaauuggcuaugggcuuugcuaggaaagaaaaaaucuccacgacuauguacacgugaagaguuuauuagcaaaguucggucgaacgcugcuauaggcgcuguuuuccaggaagaacaaggguggacgagugccuccgaagcaguaaaugauucgagauuuugggaacuaguugauaaagaaagggccuugcaucaagaagguaaaugugagucaugcguuuacaacaugauggguaaaagggaaaaaaaauuaggagaauucggaagagcaaaagggaguagagcaauuugguacauguggcuuggagcgagauuuuuagaauuugaagcgcuaggcuuucuuaaugaagaccauugguuuagucgagaaaacagcuggagugggguugaaggagaaggguugcaucgucuagguuacauauuagaagacaucgauaaaaaagauggggaccuuauauacgcugaugauaccgcaggcugggauacaagaaucacugaagaugacuuauugaaugaagaacugauaacagaacaaauggcuccucaccauaaaacacuggccaaagcuauauuuaaacucacuuaucagaauaaaguugucaagguccuucgaccaacuccaaagggagccgugauggauauaauuucaagaaaagaucaaagaggauccgggcaggucggaacauacggauuaaacaccuucacaaauauggaagugcaguugauccgucaaauggaagcagagggagucauaacacaggaugauaugcaaaauccaaagggacuuaaagaacguguagaaaaauggcuuaaggaauguggcguagaucgacuuaaaagaauggccauaucaggggacgauuguguuguuaaaccacucgaugagcgauucaguacaagucuucuuuuucucaacgacaugggcaaggugagaaaagacauuccucagugggaaccaucaaaagguuggaaaaauuggcaagagguuccuuucuguucacaccauuuucauaaaauuuuuaugaaagauggccguucucuagugguacccuguagaaaucaagaugaauugauuggacgggcacgaauaucccagggcgcuggcuggagucuaagggaaacugccuguuuagguaaggcuuacgcgcagauguggagcuugauguauuuccaucgaagagaccugcgucuagccucuauggcaauauguucugccgucccaacggagugguuuccuacauccagaacaacguggagcauacacgcacaucaucaauggaugacgacagaagauauguuaaaaguauggaacaggguauggaucgaagauaaucccaauaugacugacaaaacuccuguacacuccugggaagauauuccauacuuagggaagagggaggauuuauggugugguucacugaucgggcuuucgagucgagcgacaugggcuaaaaauauacauacugccaucacucaggucagaaaucucauaggcaaggaagaguauguugacuacaugccagcaaugaaaagauauagugcuccauuugaaucagaaggcguguuauaa

SEQ ID NO: 23658 - RNA, 9867 nt, Artificial Sequence
  derived and/or modified CDS sequence (opt6) from DENV-4__KC762695__SS-prME
ucuaccaugacucugcuaugcuuaauaccaaccgccauggcauuccacuugucuacaagggauggcgaacccuugaugauaguugcuaaacaugaaagggggagaccuuuauuauuuaaaacaaccgaagggauuaacaaauguacauuaauugcgauggaucuaggggaaaugugcgaagauaccgugacauacaaaugcccuuuauugguaaacaccgaaccagaggacauugacuccuggugcaauuuaacaucaaccuggguaauguacgguacauguacacaaaguggggaaagaagacgagagaaaagauccguugcauuaacuccccauagugggaugggauuggagacccgagcagagacuuggaugucaucagaaggcgcauggaaacaugcacagagaguugaguccuggauauuaaggaauccgggguucgcacuucuggcaggcuucauggcauauaugauuggucagacaggcauacaacgaaccguauucuuuguguuaaugaugcuaguggcacccaguuaugggaugagauguguaggaguaggaaaccgcgauuucguagaaggcguuucagggggcgcuuggguggaucuuguguuggaacauggcggcugcguuacgacuauggcucaaggaaaaccaacucucgacuuugaacucacaaaaacuacggcuaaggaagucgcuuuguuacgaacuuauugcauagaggcuucaauuucaaauauaacuacugcuacuagguguccaacccaaggagaaccauauuuaaaagaagaacaggaccaacaauacauuuguagaagagauguaguugaccgaggcuggggaaacggcuguggccuuuuuggaaaagguggaguugugaccugugccaaauuucugugcagugggaaaaucacugguaacuuagugcagauagagaaccuagaauacacggucgucguaacaguacacaacggagacacgcaugcagucggaaaugauaccuccaaccaugguguuacugcaacgauaacuccuagaaguccuucgguugaaguuaaguuaccggauuauggagaauuaacacuggauugugagccgaggagcgggauagauuuuaaugaaaugauucuaaugaaaaugaagaagaaaacauggcuaguacacaaacaaugguucuuagaucuaccgcuccccuggacggcaggagcugauacaucagaaguacacuggaauuauaaggaaaggaugguaacuuuuaaaguaccacacgcaaaaagacaagacgucacaguacuaggaagucaagaaggugcuaugcacucagcuuuagcaggggcuacagaaguugacucugggaacggaaaucacauguucgccggacauuugaaauguaagguaagaauggagaagcuccgaauaaaaggaaugucauauaccauguguuccgguaaguuuucuauugauaaggagauggcagaaacacaacacgguaccacuguuguaaaggucaaauacgaaggagccggagcucccuguaaaguuccuauugaaauaagagacguuaauaaggaaaaggugguuggcagaauaauaucaucaaccccuuuugccgagaauaccaacucuguaacgaauauugaacuagaaccaccauucggcgacucauacauuguuauugggguaggggacagugcccuaacucuucacugguuuagaaaagguucaaguauugguaaaauguuugagaguaccuacagaggugcaaaaagaauggcaauauugggcgaaacagcuugggauuuugguagcgucggagggcuauuuacaaguuuaggaaaggcuauucaucaaguauucggcucaguauauacaaccauguucggaggcguaaguuggaugauccgaauccuaauuggacucuuaguccuuuggauugguaccaacucaaggaacacuucuauggcuaugacuugcauugcaguuggugggauaacgcuguuuuuagguuucaccguccaagcagauaugggaugcguugucucguggaacggaaaagagcuaaagugcgggagugggauauuuguagucgacaacgugcauacuuggacugaacaauauaaauuucagccugaaucaccagcaagauuagcaucagcuauuuuaaacgcacauaaagauggagucuguggaauaagaaguacgacacgacuggaaaaugugauguggaaacaaauaacgaaugaauuaaauuaugugcugugggaaggaggacaugaccuaacaguaguagccggagacgucaagggagugcuaacuaaaggcaaaagagcuuugacuccuccaguaaaugaucugaaauacaguuggaaaacaugggggaaagcgaaaauauuuaccccagaagccaggaacaguaccuuuuuaauagauggaccugacacaucugagugcccaaaugaaaggagagcauggaacuuucuugaagucgaagauuacggauucggcauguucagcaccaauauauggaugaaauucagggaagguucaagugaaguaugugaccaucgcuuaaugucagcagcaauaaaagaccaaaaagcaguucaugccgacaugggguacuggauagagagcuccaagaaucaaacuuggcaaaucgaaaaagcuagcuuaaucgaaguuaaaacaugccuauggcccaagacgcacacgcuauggucaaacggagucuuagaaagccaaaugcuuauuccucgcuccuaugcaggaccauucagccagcacaacuacagacagggcuaugcaacacagauagcagggccuuggcacuugggcaaacuggaaauagauuuuggugaauguccggggacaacaguaacaauacaagaagauugugaccaccgagguccuagucucaggacaacaacagcaagcggaaagcuaguaacccaguggugcuguagaagcuguacgaugccaccuuuaagguuuuugggcgaggauggaugcugguauggcauggaaauccguccguuaucagagaaagaagaaaacaugguuaaaagucaaguuacugcaggccaaggcacaagugaaacguuuagcaugggccuauuaugcuuaacuuuauuuguagaagagugccuaaggagaagaguaacccguaaacauaugauacucguugugaccauuacauuuugugcaauaauuuuaggaggauuaacuuggauggauuuauuaagggcuuugauaaugcuaggugacacuauguccgguagaauagguggacaaauacaccuagcuauuauggcuguguuuaaaaugucaccgggcuauguccuaggggucuuccuuagaaaauuaacaagccgcgaaacagcccugaugguuaucgguauggcaaugacaacuguauuuagcauaccacaugaccuaauggagcuuauugaugguauaagccuggguuugauuuuguuaaagaucgucacccauuuugacgacacucaaguaggaacucuugcguuaagucuuacuuuuaucaggucaaccacgccguuggugauggcuuggaggacuauaauggcagucuucuuuguaguaacauuaauaccauuguguaggacauccugcuugcaaaaacaaucgcauuggguagaaauaacugcguuaauucuuggcgcgcaagcacugccaguguaucuuaugacuuuaaugaagggagcuucaagacgaucauggccacucaacgaagguauuauggcuguaggcuuagugucacuauuagguagugccuuauugaagaaugacguaccucuagcaggacccaugguagccggcggauuacuuuuagcagcuuacguuaugagcggcucgagugcugaccuuucccuagaaaaagcugcuaacguucaaugggacgaaauggcugacauuacugguucuucaccaaucauagaaguuaaacaagacgaagacggaucguucucuauacgagacguagaagaaacaaacaugauuacacuucucguaaaacuugcuuugauaacggugucaggacuuuaucccuuagcaauuccggugacaauggcguuaugguauauauggcaaguaaaaacacaacgaucaggugcucucugggauguaccaucgccuguggcaacucaaaaagcuacauuaagugaagggguuuaucguauuaugcagagaggauuauuuggaaaaacacaaguagggguuggcauacauauggagggaguuuuccacaccauguggcauguuacgaggggaagcgugaucugucaugagacaggucgacuugaaccgucaugggccgauguacguaaugauaugauauccuacggcggagguuggcgacucggggauaaaugggauaaagaggaagaugugcaaguucuagcaauagagccaggcaaaaauccuaaacacguacaaacuaagccuggucucuucaaaacucuuacaggagaaauuggcgcaguuacauuagacuuuaaaccaggcaccucagggucuccaauaaucaauaagaaaggaaagguaaucggguuauauggaaacggcgucguaacuaagucaggugauuaugucucagcaauaacucaagcagagaggauaggagaaccugacuacgaggucgaugaagacauauucaggaagaaaaggcuuacaaucauggauuuacauccuggagcugggaaaacuaaacggauuuuacccaguauagugcgggaagcccuaaaacgaagauuaagaacauuaauccucgccccuacuagaguuguagcugccgaaauggaagaagcauuaaggggucuuccaauaagauaccaaacuccagcagugaaaagugaacacacagggcgcgagaucguggauuugaugugucacgcaacuuucacgacaagacucuugucgucuacacgaguaccaaacuacaauuugauugucauggacgaagcacacuuuacagaucccuguucaguagcagcacggggauacauaucaacaagaguagaaaugggagaggccgccgcaauauucaugacugcuaccccaccgggaucuacggauccauucccccaaucaaauucaccgaucgaagacauugaaagagagaucccagaaagaaguuggaacacgggauuugauuggauaacagauuaucaagguaagacaguuugguuuguacccaguauaaaggcgggaaaugauauagcaaacugcuuacgaaaaaguggaaagaggguaauacaacuaucgagaaagacguuugauaccgaguaucccaaaaccaaacuaacagacugggacuuuguaguaacgaccgacauauccgaaaugggugcgaauuuuagagcgggaagaguaaucgauccaaggagaugcuuaaaaccgguaauucuuacugauggaccugaacgcguaaucuuagccgguccgauuccugucaccccagcaagugcugcacaacgccggggcagaauagguaggaauccagcccaagaagacgaucaguaugucuuuucaggugacccgcugaaaaaugacgaagaucacgcucacuggacugaggccaagaugcuacuagacaacauauauaccccugagggaauaauuccgaccuuauuuggcccagagagggagaaaacucaggcaauagauggagaauuuaggcuaagaggggaacaaaggaagacauucguugaauuaaugcguaggggugauuuaccugucuggcuaucauauaaagucgcaucugcuggaauuuccuauaaagacagagaauggugcuucacuggagaaagaaacaaucagauucuagaggagaacauggaaguggagauauggacaagggaaggagagaagaagaagcuacgaccaaaaugguuagacgcaagaguguacgccgacccuauggccuugaaggauuucaaagaguucgcgucaggucgaaaaucaauuacuuuggacauacuaaccgagauagcuacacuacccaccuacuugaguucuaaagcaaaauuagcgcuugauaauauaguaauguuacauacuacugaaaaagguggaagggcauaucaacacgcuuugaaugagcuaccagaaucauuagagacauuaaugcucguagcacuacuaggggcaaugacagccgggauauuucuauuuuucaugcaggggaaagguauugguaaacuaagcauuggccuuauagcuauagcagucgcuucagggcuauuauggguugcugaaauacaaccucaauggaucgcugcuucaauuauuuuagaguucuucuugaugguucuccuaaucccugagccagaaaaacaaagaacaccccaggauaaccaauuaauauacguaauccuuacaauucuaacaauaauaggucucaucgcagcuaaugaaaugggacuuauugagaaaaccaaaacagacuuuggguuuuaccagguaaaaacugaaacuacuauccuagacgucgaccucagacccgcuucagcauggacuuuguaugcagucgcaacuacuauauugacacccauguuacgccauacaauagaaaacacaucggccaacuuaucccucgcugcaauagcaaaucaagcugcaguuuugauggguuuaggaaaagguuggccacuacacagaauggaucuagggguacccuuacuagccaugggauguuauagccaaguaaauccaacuaccuugaccgcgagucuuguuaugcuguuaguucacuaugcaauaauugguccaggucuacaagccaaagcaacacgugaagcccagaaacgcacugcagcuggcauuaugaaaaauccuacuguugauggaaucacaguaauugaucucgaacccauuucuuaugauccgaaauuugaaaaacaacuagggcaaguaaugcucuuaguccuaugugugggucaauuacuuuugaugagaacaaccugggcacuaugcgaaguacugacucuggcaacaggacccaucaugacuuuaugggagggaaauccugggagguucuggaacacgaccauugcgguuaguaccgcuaacaucuucaggggaagcuauuuagcaggggccgguuuagccuuuaguuuaaucaaaaacgcacaaaccccacgacgcgggacaggaaccaccggagaaacauugggagaaaaauggaagcgacaacugaauagcuuagaucgcaaagaguucgaggaauauaagaggaguggcauauuggaaguugacaggacugaagcgaagucagcauuaagagauggcucaaaaauaaaacaugcuguuaguagaggaucaucaaaaauaagguggauaguggaaagaggcaugaucaaacccaagggaaagguaguugaucuaggcugcggccgagguggguggaguuacuauauggcaacuuuaaagaacguuaccgagguaaaaggauacacgaaagguggaccgggccaugaagaaccaauaccaauggcuacguauggauggaaccugguuaaauuacacaguggaguugauguauucuauaaacccacagaacaaguugacaccuuacugugugauaucggagagucaucaucaaauccaacaauagaagaaggaagaacacuucgaguauuaaaaaugguugagccaugguugucgucgaagccagaauuuugcauuaaaguuuuaaauccuuauaugcccacagugauugaagaacuagaaaaacuacagcgucgacauggagggagccuaguaagauguccucuaucgcgaaacagcacccaugaaauguacuggguaucaggugcuagcgggaacaucgugagcucagucaacacaauuucgaaaauguugcuuaaucguuuuacaacacgacaucgaaaaccaacauacgagaaggacguagaccuaggagcuggaacgcgaagcguguccacagaaacugagaaaccugauaugacaauuauaggaaggcgucuacaaaggcugcgagaagaacauaaagagacauggcauuaugaucaggaaaacccauacagaacaugggcauaucaugguagcuacgaagcaccgucuacgggaagugcaagcaguauggucaacgguguaguaaaacuucuuacaaaaccaugggauguaauaccaauggugacacaauuagcuaugaccgauaccacuccguucggacaacaacgaguguucaaagaaaagguggauacuaggacaccacagccaaaacccgguacgagaaugauaaugaccaccacugcaaauugguugugggcgcugcucggaaagaagaaaucaccaagacuuugcacgagggaagaauuuaucuccaaggugcgaucuaaugcugccauaggcgcaguauuccaagaggaacaaggcuggacaagcgccagcgaagcaguaaacgauucuagauuuugggagcuaguugacaaagaacgcgcucuccaccaagaaggaaaaugugaaaguugcguuuauaauaugauggguaaacgagaaaagaaacuuggcgaauuuggacgugcgaaaggcagcagagcuauuugguauaugugguugggagcaagguuccuagaguucgaggcacuuggauuucuuaaugaagaccauugguucucccgagagaacaguuggucaggcguugaaggcgaggggcuucaucggcucggauacauacuagaagauauugauaaaaaggacggggaucuuaucuaugcugaugauacagcuggaugggauaccagaauaacugaagaugaccuauuaaaugaagaacuaauuacggaacaaauggcaccccaccauaaaacuuuggcgaaggccauauucaaacuuacguaucaaaacaagguggucaaagugcuuagaccuacuccuaagggagcagugauggauauaauaagucguaaggaucaacgaggaagugggcaaguuggaaccuauggacuaaauaccuuuacgaauauggaaguacaauuaauacgccagauggaggcggaaggagucauaacacaagaugacaugcaaaaccccaaaggcuuagaagaacguguagaaaaguggcucaaagaaugcggaguugaccgacuuaaacgaauggcgauauccggagacgacugcguaguaaaaccucuagaugaaagauuuucuacgagccuauuauuucuaaaugacaugggaaagguacgaaaagacauuccucaaugggaacccucgaaaggauggaaaaacuggcaagagguuccauuuugcucucaucauuuccauaaaaucuuuaugaaagauggacguucacuuguuguuccuugcaggaaucaggaugaacuaaucggucgcgcaagaauuagucaaggggcugguuggucucuuagggaaacagcauguuuagguaaagcauaugcucaaauguggagccuaauguauuuccaucguagggaucucagacuagcaaguauggcaauauguagugcagucccaacugagugguuuccgaucagucggacuacaugguccauccaugcccaccaccaguggaugacuacugaagauaugcucaagguauggaacagaguauggauagaagauaauccgaacaugacagauaaaacgccaauacacaguugggaggacauccccuauuuaggaaaaagggaagauuuguggugcggauccuuaauugggcuaaguucacgcgccacaugggcuaaaaauauacacacugcaauaucucagguaaggaaucuaauagggaaggaagaguacguugauuacaugccuguaaugaaacguuacucagcuccaagcgaauccgaagguguauuauag

SEQ ID NO: 23659 - RNA, 9867 nt, Artificial Sequence
  derived and/or modified CDS sequence (opt6) from DENV-4__KC762696__SS-prME
uccacuaugacgcuccuuugcuuaauuccuacuguaauggcauuccacuuaaguacaagagauggugaaccucugaugauaguggcgaaacaugaaagaggaaggccucuauuauuuaaaaccacagaaggaauaaauaaaugcacccuuauagcgauggaucuaggugaaaugugugaagacacggugacauacaaauguccccuuuuaguuaacaccgaacccgaagauauagacuguugguguaaccuaacaucgacauggguaauguacggaaccugcacgcaaagcggugaaagacgucgagagaaaaggucaguagcgcugacgccacacagcggaaugggacucgaaacgagagcggaaacuuggaugucaagugaaggcgcguggaaacaugcgcagagaguagagaguuggauacuacgaaacccaggauuugcucuguuagcgggauuuauggcauacaugauaggccagacagguauacagaggacagucuucuuuguccuaaugauguuaguagcuccgucauaugguaugcgaugcguaggaguuggaaauagagauuuuguugaaggggucucaggcggagcauggguagacuuaguuuuagaacauggcgguugcguaaccacaauggcacaaggaaaaccgacuuuagauuuugagcucacaaaaacaaccgcaaaggaaguagcucuauugcgaacguauugcauagaagcaucaauaucaaauauuaccacugcuacuagaugcccaacccaaggggaacccuauuuaaaagaagaacaagaccagcaauauauaugccgcagggauguggucgauagaggguggggcaacgggugcgguuuauucgggaaagguggggucgucacaugugcgaaauuucuuuguagugguaaaaucacugggaauuuaguccagauugaaaauuuggaauacaccgucguaguaacaguucauaacggugauacacacgcgguugguaaugauacaucgaaucacggaguuacugccacaauaacaccacgcucgccuucuguagaaguaaaauuaccugacuauggugaacuaacauuagacugugagccccguagcgggauugauuucaaugaaaugaucuuaaugaagaugaagaagaaaacaugguuaguccauaaacagugguucuuagaucuaccauuaccuuggaccgccggagccgauacaucagaaguccauuggaauuauaaagagagaauggugacauucaaaguuccacaugcaaaacggcaagauguaacaguucucggaucucaagagggcgccaugcacagugcuuuggccggugcaaccgaaguagacaguggagacggaaaucacauguucgcaggacauuuaaaaugcaaaguaagaauggaaaaacugcguauaaaaggaaugucuuacaccauguguucuggaaaauucagcauagacaaagagauggcugaaacgcaacacggaaccaccguaguaaaaguuaaauacgagggugccggcgcaccgugcaagguaccuauagaaauaagggauguaaauaaggagaaaguuguaggcagaauuaucucaucaacgccuuuugcugaaaacaccaauagcguuacaaauaucgaacuagaaccaccuuuuggcgauucauacauaguaauaggugucggggacucagcuuugacauugcacugguucagaaaaggaaguucaauuggaaaaauguuugaaucuacauauagaggagcuaaacggauggcaauacuaggcgaaaccgcuugggauuuuggaaguguagggggucuuuuuacuucucuuggaaaagcggugcaucaaguauucggaucgguuuauaccacaauguucggugguguaucuuggaugauuagaauauuaauaggauuucuaguuuuguggauuggaaccaauaguaggaacacaaguauggcaaugaccugcauagcaguagggggaauaacauuauuccuaggauuuacuguacaagcagacaugggauguguuguaaguuggaacggcaaggaacuaaagugcggcucugguaucuuugucgucgacaauguacauacuuggacagaacaguauaaauuccaaccagaaagcccagcucgccuugcaucggcaaucuugaaugcccauaaagacggugucuguggcauucguucaacuacacgacuagagaaugugauguggaaacaaaucacgaaugaauugaauuacguuuuaugggaaggaggacacgaucuuacugucguugcgggagacgugaagggagugcuuacuaaaggcaaaagagcuuuaacuccaccgguuaaugauuuaaaauacuccuggaagacguggggaaaagccaaaauauuuacccccgaagccaggaauaguacauucuugauugacgguccugacaccucagaaugcccuaaugagagacgagcauggaauuucuuugagguugaagacuacgguuuuggcauguuuaccacgaauaucuggaugaaauuucgugaaggaagcucugaaguaugugaucacagguugaugucagcagcuaucaaggaucagaaagcaguacacgcagauauggguuacuggauagaaucauccaaaaaucagacauggcaaauagaaaaagcgucacuuauagaagugaaaacuugccucuggccaaaaacgcacaccuuguggucuaacggagucuuagagucacaaaugcuaauaccgcggucauaugcaggcccguuuucccaacauaauuaucggcagggauacgccacucaaaccgcgggacccuggcacuuaggaaaguuagaaauugacuucggcgaaugcccggggacaacagucaccauacaagaagacugugaccauagagggccaagucuaagaacaacuacagcaagcgggaaauuaguuacucaauggugcuguagaucauguacaaugccuccuuuaagguuuuuaggugaagaugguuguugguacggaauggaaauaaggccauuaucggaaaaagaggaaaauaugguaaagagucaaguaaccgcuggacaaggcacgagugaaaccuuuaguauggggcuucuaugccucacucucuucgucgaagagugucuccgccgacgcguaacacggaagcacaugauccuaguaguugucauuacuuucugugccauaauuuuagguggccucacauggauggacuuguuacgugcacugauaaugcuaggggauaccaugucaggacguauagggggccaaauccaucuagcaauaauggcaguuuucaaaaugucaccaggauauguacucgguguguuccucagaaaacuaacaucucgagaaacugcucuaauggucauuggaauggcuaugacgacgguguuuucuauuccacacgacuugauggaauuaaucgauggaauuucccuagguuuaaucaucuuaaaaauaguaacccacuuugacaacacgcaagucggcacauuagcucuaagccucacguuuauccgcaguacgacgcccuuagucauggcguggcgcacuauuauggcaguauucuuuguaguuacauuaauaccacuauguagaacuucuuguuuacagaaacaaucucacuggguagaaauuacggcauuaauucuuggugcgcaggcacugccgguuuacuuaaugaccuuaaugaagggagcuaguaggaggucguggccguuaaacgaagggauaauggcuguuggucuaguaucuuuacucgguucugcguugcuaaagaacgauguuccacuagcuggaccaaugguagcgggaggauuauugcuugccgcauauguaaugaguggauccagugccgaccucagucuagagaaagcagcaaauguacagugggaugagauggcggauauaacaggcucuaguccuaucauagaagucaagcaagacgaggaugguaguuuuucaauacgugacguagaggagacaaacaugauaacgcuucuaguuaaauuggcucuuauaacgguaucaggacuauauccauuggccaucccaguuacuauggcacucugguauguauggcagguuaaaacacaacgaucaggcgcgcuuugggacguaccaaguccagcugcaacgcagaaagccaccuugagcgaaggaguauacagaaucaugcagcgaggauuauucggaaaaacucaaguagguguaggaauacauauggagggaguauuucauacuauguggcacguuacgcgaggcucaguaauuugccacgaaacaggaagacuagaacccagcugggcagacguucgcaaugacaugauuucuuacgggggugguuggagauugggagacaaaugggauaaagaagaagauguacaaguacucgcaauagaaccaggcaagaacccaaaacacguacagacaaaacccgguuuauucaaaacucuaacaggggaaauaggugcaguaacacuagauuucaaaccaggcacaucgggaucaccgauaauaaauaaaaagggaaaggucauagggcuauaugguaaugggguggucacuaagagcggugacuaugucucugcaauaacucaggcugagcgaauuggcgagcccgauuacgaaguagaugaagacaucuuucgaaagaagagacuaacgauuauggauuugcauccaggggcaggaaagacgaaacgaauauuaccaagcauagugcgagaagcguugaaaagacgucuucgcacuuuaauucuugcacccacgagaguugucgcggcugaaauggaggaagcguuaagaggguuaccaauaagauaucaaacgccggcaguuaaauccgaacacacagggcgagaaauaguagaccuaaugugucaugcaacguucaccacaaggcuauuaucaaguacuagggugccuaauuauaaucucaucguaauggaugaagcucauuuuacugauccuuguaguguggcagcucggggcuacauuucgaccagagucgaaaugggcgaagcagcagcaaucuucaugaccgcaacaccaccaggcagcauagauccauuuccacaaucaaauucuccgauagaggauauagagagagaaauaccagaacggucuuggaauacugguuuugacuggauaacagacuaccagggaaagacagucugguuuguaccgucaaucaaggcaggaaacgacauugcuaauugucuccgaaaaagcgggaagcggguuauacaacuaaguaggaagacuuucgauaccgaauacccuaaaacaaaacuaacggauugggacuucguagucacaacugacauaucagagaugggagcaaacuuccgagcagggagaguuauagacccgcgaagaugcuugaaaccuguuauucugacagacgguccagaaaggguaauccuugcgggaccaaucccugugacuccugcuucagcggcgcaaagaagggguagaaucgguagaaauccagcgcaagaagaugaccaauacguauuuucuggagauccacuaaagaaugacgaagaucaugcacauuggaccgaagccaaaaugcuuuuagacaacaucuauacgccggaagguauaauaccuacuuuguuugguccugaaagagagaaaacucaagccaucgauggagaauuucgccuacgaggggaacaaaggaaaaccuucguagaauuaaugcgacgaggcgaccugccuguguggcuuucuuauaaaguggcuuccgccggaauaaguuauaaagauagggaauggugcuucacgggagagagaaacaaucagauauuagaagaaaacauggaaguagagaucuggacgagagagggagagaaaaagaaacuucgacccaagugguuggaugcucguguauacgcagaucccauggcgcuaaaagauuuuaaagaguucgcaagugguagaaaaaguaucacuuuagauauccugacagaaaucgcuacucuuccaaccuaccuaucaucgaaagcuaaauuagcccuagauaauauaguaauguuacacaccacagaaaagggaggacgagccuaccaacacgcccuuaacgaacuaccugagagcuuagagacucugauguuagucgcccuguugggugcaaugaccgcaggcauauuuuuguucuuuaugcaaggaaaagguauaggaaaacugucgauggggcucauugcaauagcggucgcauccggccuacuuugggucgcugaaauacaaccccaauggauagcagcaagcauuauucuagaauuuuucuugaugguacuuuuaauucccgaacccgagaaacaaaggacgccacaggauaaccaguugauauacguaauacuuacuauucugacaauaauaggacuuauagcagcgaacgaaaugggcuuaaucgagaaaacgaagaccgauuucggauuuuaccaagucaaaacugaaacaacaauauuagauguagaccuaagacccgccagugcauggaccuuguaugcuguggcaacaaccauauuaacacccaugcuucggcauacaauagagaacacgagcgcuaauuuaucauuagcggccauagcaaaucaggccgcaguguuaaugggacugggaaaagguuggccauuacaccgcauggaccuuggagucccucucuuagccauggggugcuacagucaagugaauccuacuacccuaacggcaucgcuaguaauguuauuagugcacuaugccauaauugggccuggauuacaagcaaaggcgacucgugaagcacagaaacguacagcagcaggaaucaugaaaaauccuacaguagaugguauaacgguuauugaucucgagccaaucucauaugacccaaaguuugaaaaacaguuaggccaaguaauguuacuuguucuuuguguuggucaacuccuucuuaugcggacaacgugggcauuaugugagguuuuaacccuugcuacaggcccggucaugacauuaugggaaggaaauccggguagauuuuggaacacgacaaucgcugucaguacggcaaacauauucagagguagcuacuuagcgggagccggacucgcguuuucguuaaucaaaaaugcacaaacaccgagaagaggaacaggcacgacaggagaaacuuuaggagaaaaauggaaacgacaauuaaauuccuuagaucgaaaagaauuugaggaguacaaaagaaguggcauccuagaaguagaucggacagaagccaaaucugcguugcgagacgggucuaaaauaaaauaugccguuucuagaggcuccucuaagauaagauggauaguagagagaggcaugaucaaacccaaaggcaaaguaguggauuuggggugcggaaggggcggguggucuuacuacauggcuacucuuaaaaauguuacggaaguaaaaggauauacgaaagggggcccuggacaugaagaacccauuccaauggcuacauacggguggaauuuagucaaacuccauuccgggguugauguauucuauaagccaacagaacagguagauacacuacucugugacauaggagaaucaaguucaaauccuaccauagaagaaggcagaacacuuagagucuuaaaaaugguagaaccauggcuaagcuccaagccggaguucuguauuaaaguacuaaauccuuauaugccgacaguaauagaagaacuagaaaaacuucaacgaagacauggcggaucguuagugcgaugcccuuuaucucgaaauucaacucaugaaauguauuggguaucuggagcaaguggaaauauaguaucgucaguuaacacaauaagcaaaaugcugcuaaauagguucacgacaaggcauagaaaacccacauacgaaaaagacguagaucuaggcgcgggcacaaggucaguuagcacggaaacagaaaagccagauaugacaauuaucggcagacguuuacaacgccuuagagaagaacauaaagaaacuuggcauuacgaccaagaaaacccauacagaacuugggcauaucaugggucauaugaagcaccgaguacagguagcgccagcaguauggucaaugguguaguaaaacuuuuaacaaaaccaugggauguaauaccuaugguaacacaauuagcaaugacugauacaacaccuuucggacaacagagaguauucaaagagaagguggacacaagaaccccacaaccgaaaccugguacgagaaugauuaugaccacaaccgcaaauuggcugugggcacuauuaggcaagaagaaaucaccgcguuuaugcaccagggaagaauuuauuagcaaaguacguaguaaugcggcaaucggagcuguuuuucaagaagaacaaggcuggacaucagcgagcgaagcuguaaacgauucgagauucugggagcuaguagacaaagaacgugcuuuacaccaggaggguaagugcgaaucauguguuuauaacaugaugggaaaaagggaaaagaaauuaggagaauuuggaagggcgaaagggagucgugcuauaugguacauguggcuaggugcaagguuucuggaauuugaagcacuaggcuucuuaaaugaagaccacugguuuucacgcgaaaauucauggucgggaguugaaggcgaaggacuccaccgauugggauacauucuagaagacauagacaaaaaggacggugaccucauauaugcugaugauacagcagguugggauacacgaaucacugaagacgaccuguuaaaugaagaauuaauaacggaacaaauggcuccacaucauaagacacuagcuaaggccauauuuaagcugaccuaccaaaauaagguaguuaagguacuaagaccaacuccuaagggggcagucauggauauaaucucaagaaaagaccagagaggaagcggucaggucggcaccuaugguuuaaacacauuuaccaacauggagguccaacuuauaaggcagauggaagcugaagguguuauaacucaggaugacaugcaaaauccgaaaggucuuaaagaacguguagaaaaauggcuaaaagagugugguguagaccgacuaaaaagaauggccauuaguggugacgauuguguuguuaaaccauuagacgagcguuuuucgacaucuuuacuuuuucuuaaugauaugggaaagguaagaaaagauaucccgcagugggagcccucgaaagguuggaaaaauuggcaagaaguaccuuucugcucacaccauuuucacaagaucuucaugaaagaugguagaagucucgugguaccuugccgaaauccagaugagcuaauugguagggcacgcauuucucaaggugccggcuggagcuugagagaaacagccugccuugggaaggcuuacgcucaaauguggucacucauguauuuucacagaagggacuuaagauuagcaucaauggcgauuugcucagccguaccaacagaaugguuuccuacuucacgcacaaccuggucgauucacgcacaccaccaauggaugacaaccgaggauaugcuaaagguauggaacagaguuuggaucgaagacaauccgaacaugacagauaagacuccagugcauucaugggaagauauaccauacuuggggaaacgagaagauuuauggugcgggagccuaauuggucuaaguaguagagcgacgugggcgaaaaacauacacacagcaauuacucaagugagaaauuuaauagggaaagaagaauauguagauuauaugccagcuaugaagagguacagcgcaccuuucgagagcgagggaguuuuauag

SEQ ID NO: 23660 - RNA, 9867 nt, Artificial Sequence
  derived and/or modified CDS sequence (opt6) from DENV-4__KC762697__SS-prME
agcacuaugacauuacuauguuuaauuccuacagccauggcauuucaccucucaacacgggauggugaaccauuaaugauagucgccaaacacgaacgcggacggccauuacuauucaaaacuacagagggaauuaacaaaugcacauugauagcgauggaccucggagaaaugugugaagauacaguaacguauaaaugcccccuccuaguuaacacugaaccugaagauauagauuguuggugcaauuuaaccaguacguggguaauguaugggaccugcacucaaucgggugagcgcagaagagaaaaacggucaguggcucucacgccucauucaggaaugggauuagaaacccgcgcagaaacguggaugucuucugagggagcguggaaacacgcacagaggguugaaucuuggauauuacgaaauccugguuuugcauuauuagcuggcuuuauggcauauaugauugggcagacagggauucaacgaacaguauucuuuguucuaaugaugcuugucgcucccucauauggaaugcgcugcguagggguaggaaaucgggauuuugucgaaggagugagugguggagcauggguagaucucgucuuggagcaugguggcuguguuacaacaauggcccaaggcaaaccgacuuuagauuuugaauuaacaaaaacuacggcuaaagagguugcacuacugagaacauauuguauugaggccucaauaucaaauaucaccacagcuacgaggugccccacacaaggugaacccuauuuaaaagaagaacaagaucaacaguacauaugccgacgugauguuguugauagggguuggggaaauggcuguggacuguucggcaaaggugguguagugacaugcgcaaaauuucuauguagcgggaaaauaacuggaaaucucguacagaucgaaaaucuagaguauacagugguaguaacuguucauaauggcgauacccaugcaguaggaaaugacaccaguaaucauggcguaacugcaacgauaacccccagaucucccucaguggagguuaaacugcccgauuacggggaacuaacacuagacugugaaccgaggucuggaauugacuucaaugaaaugauucuuaugaagaugaagaaaaagacaugguugguucauaagcagugguuuuuagaucuaccccuuccauggacggcaggagcugauacaagugagguucauuggaacuacaaagaaaggaugguaacuuuuaaagugccgcaugcaaaacgccaagaugucacgguauugggaucccaagaaggggcaaugcacagcgcacuagccggugcgacagaaguagauucuggggaugggaaucacauguuugccggccauuuaaaauguaaaguacguauggagaaacugaggauaaaagguaugucuuacacgauguguagcgguaaauucucaauagacaaggaaauggcggagacccaacauggaacgacugucgugaaaguaaaauacgagggagcgggugcgccuuguaaaguaccgauugaaauacgugauguuaauaaggaaaagguaguagggagaauaauuucaucaacuccguuugcagaaaauacuaacucugugaccaauaucgagcuagagccacccuuuggugauucuuauaucguaauaggaguuggagauucggcauuaacucugcacugguucaggaaagguagcuccauaggaaaaauguucgaaagcacguaucgaggagcaaaaaggauggcuauucuuggcgaaacggcaugggacuucgguuccguuggugggcuguuuacuuccuuggggaaagcaguacaucaaguuuucgggucgguauacacaacuauguucgguggaguuuccuggaugauaaggauucucauuggccuccuagucuuauggauugggacgaacucucguaauacuagcauggccaugacuugcauugcugucggaggcauaacauuauuucuaggauucacaguccaagcagauaugggcugcguggucagcuggaauggaaaagaauugaaaugcggaucgggaauuuuuguggucgauaacguccauacauggacugaacaauauaaauuccaaccggagagcccugcaagacuugcuagugcuauauugaaugcucacaaagauggugucuguggaaucaggaguaccacccgacucgagaauguaauguggaagcaaauaaccaaugaacuaaacuauguauuaugggaggguggccacgauuuaacuguagucgcaggggauguuaaagguguacugacuaaagggaaacguguucuuaccccaccaguuaaugaucuaaaguauagcuggaaaaccugggguaaggcaaaaauuuucaccccugaagcaagaaauucuacauuucucauugauggcccugacaccagugaaugccccaaugaacgcagggcauggaauuucuucgaagucgaagacuauggauuugguauguucucgacaaacaucuggaugaaauuuagggaaggaagcagugaaguaugugaccacagauuaaugagugcagccauaaaggaucaaaaagcugugcacgcggauaugggcuauuggauagaaaguucuaaaaaccaaaccuggcaaaucgaaaaagcaucucuaauugaagucaagaccugcuuguggccuaaaacucauacgcuauggucaaaugguguucuagaaagccaaauguuaauuccuagaagcuacgcgggcccuuuuucgcagcauaacuauaggcaaggauacgcuacccagauagccgguccguggcaccuuggaaaauuagaaauagauuuuggagaaugcccaggaacuaccguuaccauucaagaagauugugaccacagagggccaucgcuaagaaccacgaccgcaagcgguaaguuaguaacacaauggugcugcaggucuugcacuaugccaccacugagauuccuaggagaagaugguugcugguauggaauggaaaucagaccacugucugaaaaagaagagaauaugguaaaaucgcagguaacugcgggacaggggacgucugaaacauuuucuaugggucuacuaugucucacucuuuuuguagaagaguguuuaagacgacgcgucacuaggaaacacaugauacucgucguagcuaucacuuuuugcgcuauaauucuaggaggacuaacauggauggauuuacuuagagcacugauaauguuaggagauacgaugagcggacggauaggcggccaaauacauuuagcaauaauggcuguuuucaaaauguccccugguuauguacucggugucuucuuaagaaaguuaaccaguagagaaacagcucuuaugguaauaggcauggccaugacgacaguguuuucaaucccacaugaccucauggaauuaauugauggaauuucguuaggccuaauucuucuaaaaauagugacucauuuugacgauacacaagucgguacguuagcucuaucccugacguucauucguagcacgacaccccuugugauggcauggcgaacuauuauggccguuuucuucaugguuacucucauaccgcuauguaggacguccugccuacaaaaacaaagucauuggguagaaauaacagcuuugauacuuggcgcgcaagcacugcccguauacuuaaugacauugaugaaaggagcaaguagacguagcuggccacuaaaugaggguauuauggccguuggccuagugagcuuguuggggucagcacuuuugaaaaacgacguuccauuagcuggacccaugguagcgggcggucuauuauuagcagccuaugucaugucugguagcagugcugaucugucauuagaaaaagcggcaaauguccagugggacgaaauggcagauauaacuggcaguaguccaauuauagaaguaaaacaagacgaagacgguaguuucaguauaagggauguugaagagacuaacaugaucacucucuuagugaaacuugcucuaauaacagucaguggauuguauccccuagcaauacccguaacaauggcauuaugguauauuuggcagguaaaaacacaaagaucaggugcucuuugggauguucccucacccgcagcaacacaaaaagcaacauugucagaagguguauaccgaauaaugcaaagagggcuuuucggcaaaacacagguuggugugggcauacacauggaagguguuuuucacacuauguggcauguuacaagaggaucggugauaugccaugagacaggccgucuugaaccaucaugggccgaugugaggaaugacaugaucaguuacggaggggguuggagauuaggagacaaaugggauaaagaggaggauguucaaguacuagccauagaaccaggaaagaauccuaaacauguucaaacaaaaccugggcuuuucaaaacacugacuggagaaauuggggcugucacucuggacuucaagccuggcacaagugguucaccgaucauaaauaagaaagggaaagucauuggcuuauauggcaauggaguggugacaaagagcggggauuauguaagugcaauuacucaagccgaaagaauuggagaaccggacuaugaaguagacgaagacaucuuuaggaagaaaagacuuaccauuauggaucuccauccgggagcgggaaagacuaagaggauccuuccuagcauugucagagaagcauuaaagaggcgauuaaggacguuaauccuagcacccacucgaguaguagcagcugagauggaagaggcauugcgagggcucccaauccgauaccaaacgccugcggugaaggcagaacauaccggacgugaaauagucgaucuaaugugucacgcuacauuuacuaccagacuacuaucgucuacaaggguuccuaacuacaauuuaauuguaauggaugaagcgcacuucacugacccauguucaguagcagcacguggcuacauaaguacgcgcguggagaugggagaagcggcugcaauuuucaugaccgcgacaccuccuggaaguacugauccuuuuccgcaaagcaauaguccaauagaagauauugagagggagauaccagaaagaucauggaacacaggguuugauuggaucaccgauuaucaaggcaaaacuguaugguuugugccaucuauuaaagcaggaaacgacauugcuaacugccuuaggaaaucgggcaagagaguuauacaacuaaguagaaagacauuugauacugaauacccuaaaacgaaacuaacagauugggauuuugugguaacaacggacauaagugaaaugggggcgaacuuccgagcugggagaguuauugauccaagaagauguuugaagccggugauacuaacagaugguccagagagggucauccucgcaggaccaaucccugucaccccugcaucagcugcacagagaagaggaagaaucggucgaaaccccgcacaagaagacgaucaguacguauuuagcggagacccguuaaagaaugaugaggaucaugcucauuggacagaggcaaagaugcuucuugauaacauauauacaccggaaggcauuauaccaacgcuguuuggaccagaacgggagaaaacccaagcaauugacggugaauuucgauuaagaggggaacaaaggaaaacauucguagaauugaugcgccgcggggauuuaccagugugguuaagcuacaaaguugcaucggcaggaauuucguauaaagauagagaaugguguuucacaggagaaagaaacaaucaaauacuugaagaaaauauggagguagagauuuggacacgagagggcgagaaaaagaaacuaaggccaaaaugguuggaugccagggucuacgcugauccaauggcacugaaggauuuuaaagaguucgcgagcggcagaaaaucuauaacacuggacauacuaacagaaauugccacuuuaccaacauaccuuagcaguaaagccaagcuagcauuggauaauauaguuauguuacauacaacugaaaaaggcgguagggcguaucaacacgcuuuaaaugaguugccagaaucacuugaaacccucauguuagucgcgcuacuaggcgcgaugacggcuggcauuuuucucuucuuuaugcagggaaaagggauagggaaauuaucuaugggauuaauagcaauagcaguugcaucaggacuauuaugggucgcagaaauucaaccucaguggauugcagcaucuaucauucucgaguucuuuuuaaugguacuacuuaucccagaaccugaaaaacaaagaacaccacaggauaaucagcuaaucuauguuauacuuacaauacuaacaauaaucggauuaauagcugcuaaugaaaugggucuuauagagaaaacuaagacagauuucggauuuuaucaagcuaaaacggaaaccacuauuuuagaugucgauuuaaggcccgcgucggcguggaccuuauacgcagucgcuacaacaauauuaacacccauguugaggcauacuauugaaaauacuucugcuaauuuaucuuuagccgcaauugcgaaucaagccgcuguccugaugggacuagguaaaggauggccguuacaucgaauggaccuuggaguaccgcuucuagcaauggggugcuauucacaaguaaauccaacaaccuuaacggcuagccugguuauguugcugguacauuaugcaauaauagggccagguuugcaagcaaaagccacucgugaagcccagaaaagaacggcagcagggauaaugaagaauccuaccguggauggcauaacugugauugaccuagaaccaaucucguacgauccaaaauuugaaaaacaauuaggacaagugaugcuauuaguauuaugcguaggccaauuacuucuuaugagaacaacuugggcgcuaugcgaaguccucacguuggcaaccggaccaauaaugacacuaugggaagggaauccaggucgauucuggaauacaacuauugcaguaagcacagcaaauaucuucagggguucguauuuagccggagccggccuagcauuuucucuuauuaagaacgcgcaaacaccucgucgaggcacgggcaccacaggagaaacgcucggagaaaaauggaagagacagcuaaacagccuagauagaaaagaauuugaagaguauaaaagaagcgguauucuggaagucgaucgaacugaagcaaaguccgcauuaagagacggauccaagauaaaauaugccgucucucgggguagcagcaaaauacgauggauagucgagagagguauggugaaaccgaaagguaaaguaguugaccugggauguggacgagguggauggaguuauuauauggcaacacucaaaaacgugaccgaagucaaaggcuauacuaagggaggacccggccaugaagaaccgauaccaauggcuacuuauggauggaaucuaguaaagcuccauagcggagucgauguguuuuauaaaccgacggaacagguugauacuuugcugugugacaucggugaaucaucaucgaauccaacaaucgaggaaggaagaacuuuacgaguguuaaaaaugguggagccuuggcuaaguaguaaacccgaauuuugcauaaaaguucugaacccauauaugccaacggugauugaggaacuagaaaaauugcagagacgucacggugguagcuuaguacguuguccgcucucgagaaauaguacccaugagauguauuggguaagcggggcguccgguaauauuguaaguaguguuaauacgauaucaaaaaugcuacuaaacagauuuacuacacgucacaggaaaccaacauacgaaaaagauguggacuuaggugcggggacuagaaguguaagcacugaaacugaaaagccagacaugacuauaaucggaaggagauuacaaaggcuaagagaggaacacaaagaaacauggcauuacgaucaggaaaacccauacagaacaugggcauaccacgguuccuaugaagcaccgaguacaggaucugccucuuccaugguuaacgggguagugaaacuguuaacaaaaccgugggacguaauccccaugguaacccaacuugccaugacagacacaaccccauucggccaacaaagagucuucaaggagaaagucgacacaaggacaccacaaccaaagccuggaacgagaaugauaaugaccacaacagcuaacuggcucugggcgcucuuagggaagaagaaaucaccaaggcuaugcacuagagaagaauuuauuucgaaaguucggucaaaugccgccauaggagcuguauuucaggaagaacaagguuggacaucggcgucagaggcagucaacgacucaagauucugggaguuaguagacaaggaacgagcccugcaccaagaggggaaaugugaaucuuguguguacaacaugauggggaagagggagaagaaacucggagaguuuggcagagcgaaaggcucacgugcaauuugguacaugugguuaggagcacgguucuuggaauuugaagcucuuggauuuuugaaugaagaccauugguuuaguagggaaaacagcuggucagguguagagggagaagguuuacacagacuggguuauauauuagaagauauagauaagaaggacggggauuuaauauaugccgacgauacggcagggugggauacacggauuacggaagaugacuuacugaacgaagaacucauuacagaacaaauggcaccucaucauaagacgcuugcaaaagcaauuuuuaaacuaaccuaccaaaauaagguuguaaaaguccuuaggccaacaccaaagggagcugucauggacauuauaucuagaaaggaucagaggggaucaggacaaguagggacauauggccuaaacaccuucacuaacauggaaguacaacugauaaggcaaauggaagcugaaggcgugaucacucaggacgacaugcaaaacccuaaaggacuagaagaaagagucgagaaauggcuuaaagagugugguguugauaggcucaagagaauggcaauaaguggcgaugauuguguuguaaaacccuuagacgaaagauucucuacaaguuuguuguucuuaaacgacaugggcaagguacgaaaagacauaccgcaaugggaacccucaaaagguuggaaaaauuggcaggaaguaccauuuuguagccaucacuuccacaaaauauuuaugaaagacggaagaucguuggucgucccaugucggaaucaagaugaauugauaggucgagcaagaauaucacagggugcaggcuggagccuaagagaaaccgcaugccuugguaaggcuuaugcucaaauguggucacuuauguacuuccacagacgggauuuaagguuagcaaguauggcuauaugcucagcagugccaaccgagugguucccaacgaguagaacuacuuggucaauucaugcccaucaccaauggaugacaacugaggauauguuaaaagucuggaacagaguauggaucgaagacaauccuaacaugacggauaaaacaccaauacacagcugggaggacauuccauaucucgguaaacgggaggacuuauggugcgguucauugauuggacugaguucuagagccacaugggccaaaaacauacauaccgcaauaacucaaguaagaaaucuaauuggaaaagaggaauacgucgacuacaugccaguaaugaaacguuauuccgcaccuucagaaucggaagguguccuuuga

SEQ ID NO: 23661 - RNA, 9867 nt, Artificial Sequence
  derived and/or modified CDS sequence (opt6) from DENV-4__KC762698__SS-prME
agcacuaugacucuucugugucuaauaccaacaguuauggcauuucauuuaaguacgcgagacggggaaccauuaaugauugucgcuaaacacgaaaggggucggccccuacuuuuuaaaaccaccgaaggaaucaauaaaugcacgcuuauagcgauggacuuaggggaaaugugugaagacacugugacuuacaaauguccucuguugguaaacacagaaccugaagauauaguaugcuggugcaacuuaacaaguacauggguaauguauggaacuugcacucaaucgggagaaagacgccgugaaaaacgcucgguugcauuaacaccucauagcggaaugggucuggaaacgagagcagaaacauggaugucuucugaaggagcauggaaacacgcgcagcgagucgagucguggauauuacguaauccagguuuugcgcuguuagcaggauuuauggcuuauaugauaggacaaacugggauucagagaacagucuucuuugugcuuaugaugcuaguggcaccgucuuacggaaugagaugcgucggaguugggaacagagauuucguugaaggaguaucaggaggcgcauggguugaccuaguucucgaacauggaggcugugucacgacuauggcacagggcaaaccaaccuuagauuuugaacuaacaaaaaccacagcaaaagaaguugcuuuguuaagaacuuacuguauugaagccucgauaaguaauauuacaaccgcgacgcgaugcccaacacagggagaaccauaucuuaaagaagaacaggaucaacaguauauaugccguagagacgugguugauagaggcuggggcaauggauguggguuauucggaaaaggaggaguaguuacgugcgcuaaauuucuauguagcgggaaaaucacgggaaaucuuguacaaauagaaaaccuagaauauacuguagucgucacaguacacaacggagacacccaugcuguugggaacgauacaucaaaucacggggugacagcuaccauaacaccaagaaguccaucgguagaggugaaacucccagauuauggugaauuaacccuagauugugagccacgaucgggaauugacuucaacgaaaugauauuaaugaaaaugaagaagaaaacuugguuaguacauaaacaaugguuucucgauuuaccauuaccuuggaccgcuggagcugauaccucugagguccauuggaacuauaaagaaagaaugguuacauucaaagucccccacgcuaaacgacaagauguuacaguucucggaucucaagagggugcgaugcacagcgcacuugccggagcaacugaggucgauucaggagacggaaaucauauguuugcuggacauuugaaguguaaaguuagaauggagaaauuaagaauaaaaggaaugucauacacaaugugcucagggaaauucaguauugauaaagagauggcagaaacgcaacauggaacaacaguagucaaagugaaauaugaaggugcaggagcaccaugcaagguuccaauugaaauuagggauguaaauaaagaaaaagugguuggaagaauuaucaguagcacaccauucgcugagaauaccaauucuguaacuaauauugaacuagaaccgccuuuuggggauucauacauuguuauaggugccggagacucagcuuuaacucuucauugguucaggaaagguagcuccaucggaaaaauguuugaaagcacuuaucgaggugcaaaacgcauggcaauuuuaggggaaacagcaugggacuuuggaaguguagguggucuauucacaucacuagguaaagcaguucaccaaguauuuggaaguguguacacaacaauguuuggagguguuucuuggaugauucgcauauuaauaggguuuuuaguguuauggauaggaaccaauucacgaaacacaaguauggcuaugacaugcauagccguuggcggaauaacacuuuuccuaggauuuacaguccaagcugacauggguuguguugucucguggaacggaaaggaauuaaagugcgguucuggcauauuuguuguugauaacgugcauacauggacagagcaauauaaauuucagccggagaguccagcaaggcuugcaucagcuauuuugaaugcucauaaagacggcgucugcgggauaaggucaacaacucgauuggagaauguaauguggaagcagauuaccaaugaauuaaauuacguucuaugggaagggggacacgaucuaacuguggucgccggagacguaaaaggaguuuuaacuaaggguaaaagggccuuaacacccccaguuaacgaucuaaaauauucuuggaaaacgugggguaaagcaaaaauuuucacaccugaagcacggaauaguacuuuucuaaucgauggaccggauacaucagaauguccuaacgagagacgagcguggaacuucuuugaaguggaagauuaugguuucggcauguuuaccacuaacaucuggaugaaauuuagggaaggaaguagugaagugugugaucauaggcuaaugucggcagcuauaaaagaucaaaaagcaguucaugcggauaugggcuauuggauugaaaguucuaagaaucaaacauggcaaauugaaaaagcaucgcuaauagaaguuaaaacuugcuuauggccaaaaacacauacccuuuggucuaauggagugcuugaaucgcagaugcuaauaccuagaucauacgcagguccauuuucacaacacaauuacagacaaggauaugcaacacagacagcgggcccuuggcaccuaggaaaacucgaaauagauuuuggggaaugucccggaacgacgguaacaauacaagaagacugugaucauagaggaccaucacuacgaacuacgacggcgucugguaaauuagugacucaaugguguugccgaagcugcacgaugcccccuuugagguuucucggugaagaugggugcugguacgggauggaaauacgaccucugucggaaaaagaagaaaauaugguaaaaucacaagugacugcagggcaggggacaucugagaccuuuaguaugggacuauuaugccuuacauuguucguagaagagugccuuaggcgucgaguuacaaggaagcauaugauccucguaguagugauuacuuuuugugcaauuauacuuggaggucuaacauggauggaucuauuaagggcauugauuauguugggcgacacaaugucggguagaaucggagggcagauacauuuggccaucauggccgucuucaaaaugucgccuggauacguuuuaggaguauucuuacgcaaauugacgucacgagaaacugcucugaugguuaucggcauggccaugacuacaguauuuaguauaccccaugaucuaauggaacuaauugaugguaucaguuuagggcuaauucuacuaaagauaguaacgcacuucgauaacacacaggucgguacauuggcacucucacucacguuuauccggaguacuacuccguugguaauggcuuggcggacuauuauggcaguauucuuuguagugacccuuaucccucuauguagaacuagcugucuucaaaaacaaucacauuggguagagaucacagcccucauacuaggugcacaagccuuaccuguguauuugaugacacucaugaaaggagcaaguagaagaucauggcccuuaaaugaagggaucauggcagucggauuagucucacuacugggaagcgcauuacugaaaaaugauguaccacuagcaggccccaugguggccgguggauuauuauuagcagccuacguaauguccggaagcucagcugauuugucuuuggaaaaagcugcuaauguccagugggaugagauggcugauauaacaggaaguucaccuaucaucgagguaaaacaagaugaagauggaaguuucagcauaagagacguagaagaaacaaacaugaucacccucuuaguuaaacuggcucucauuacgguaucaggacuauacccccucgcuauacccguuacaauggcauugugguacguguggcaaguaaagacacaaagaucaggcgcucuaugggauguaccgaguccagcugcaacucagaaagcaacacucagugaagguguuuauaggaucaugcaacgagggcuauuuggaaagacucaagugggcguaggcauccauauggaagguguuuuccauacaauguggcacguaacaagagguagcguuauaugucaugagaccggaaggcuugaaccuucaugggcggacguacgcaacgauaugauauccuauggaggagguuggcgauuaggagauaaaugggacaaagaagaagaugugcaaguacucgcaaucgagcccgggaagaacccaaaacaugugcaaacgaaaccagguuuauucaaaacgcuaacgggcgagauaggagcugugacccuagauuuuaaaccugggaccagcggaagucccauaauuaauaaaaaggguaagguaaucggcuuauacggaaauggcgucguuaccaaaaguggagauuaugucagugcaaucacacaagcagagagaauaggugagccagacuaugagguagaugaagacauuuucagaaagaaacgcuuaaccauaauggacuuacauccuggagcagguaagacgaaacguauauuaccaucgauaguaagggaggcauuaaaacguagguuaagaacccuuauauuagcucccacccgggucgucgcugcggaaauggaggaagcgcuucgcgguuuacccauacgauaucagaccccagcugucaagucagaacacacagggcgcgaaauaguugacuuaaugugccacgcaacauucaccacacgucuucuaaguaguaccagaguaccuaacuauaaccuaauuguaauggacgaagcacauuuuaccgauccauguuccgucgcagcaagaggauauauaaguacccggguagaaaugggggaggcugcugcuaucuuuaugacggcuacaccuccaggaaguauagaucccuucccccaauccaauucacccauagaagauauagagagggagauaccugaaaggaguuggaacacaggauuugauuggauaacugauuaucaaggaaaaacgguaugguuuguaccgucuauaaaagcuggaaacgauauugcaaauugcuuacggaaaucgggaaagaaagucauacaacuaucucgaaaaacguuugacacagaguaucccaaaacaaaauugacugauugggauuuuguggucacaacagacauaucugaaaugggugcgaauuucagagcgggacguguaauugacccaagacgcugcuuaaaaccugucaucuuaacagacgguccagaacguguuauccuugcaggaccgauaccgguaacaccggcaucagcugcacaaaggagggggaggauaggacgaaacccagcgcaggaggacgaucaauacguauuuucgggugacccacuuaaaaaugaugaagaucacgcucauuggacugaagcuaaaauguuguuagacaauaucuacacuccagagggaauaauaccaacauuauucgguccagaacgagaaaagacgcaagcgaucgacggugaauuuagacuuaggggugagcaaaggaaaaccuucguagaacuaaugaggcgaggagaccugccgguuuggcuaaguuauaaaguggcauccgcagggauauccuauaaggauagagaaugguguuuuacaggugaacgaaauaaucagauccuagaagaaaacauggagguagaaauuuggacucgugaaggagagaagaagaaacuccgaccuaaaugguuggaugccagaguguaugcagauccaauggcauuaaaagauuuuaaagaauuugcuaguggaagaaaaucuauuacauuggauauccuuaccgaaauugcaacauuaccaacuuaucuaucuucuaaagcuaaacuugcucuugauaauaucguaaugcuacauacuacagagaagggcggcagagcuuaccaacacgcacuuaacgaauuacccgaaagucucgaaacauuaauguuagucgcccucuuaggugcaaugacggcaggaauauucuuguucuuuaugcagggaaagggcaucggaaaacuuucaaugggccuaauagccauagcuguagccaguggucuacuauggguagcggagauucagccgcaguggauugcagccucaauaauauuagaauuuuucuuaaugguauuauugauucccgagccugagaaacaacguacaccucaagauaaucaguuaauauacguaauccucacgaucuugacgaucauaggcuuaauagccgcaaaugagauggguuugauagagaaaacuaagacagacuucggauuuuaccaggucaagacugaaaacacuauccuagacguugaucuaaggccagcaucagccuggaccuuguaugcugucgcaacaacuauacuuacacccauguuaaggcauacuauugaaaacacaucggcaaacuuaaguuuagcugcaauagcgaaucaagccgccguacuuaugggauuaggcaaaggguggccacuucauagaauggaccuugguguaccucugcuggcuaugggguguuacucacagguaaacccuacgacauugacugcuucccuaguaauguuacuuguucacuacgccauaauagguccuggucuacaagccaaagcaacaagagaggcacaaaaacgaaccgccgccggaauaaugaagaaccccacaguggacggaauaacaguaauugaucuagaaccaauuuccuaugacccuaaguucgaaaaacaacucgggcaagucaugcuauugguucuguguguaggacaguuacuccuaaugagaacaaccugggcccuuugcgaaguacuaacacuagcuacugguccuguaaugacauuaugggaagguaacccuggccgauuuuggaauacaacuauagcuguuaguacagcaaacauauucagaggcagcuaucuagcaggagcuggccuagcuuuuagccugauaaagaaugcccagacaccaagaagagguacuggaacaacuggggaaacauuaggagaaaaauggaagcgacaacugaauagccuagacagaaaagaauuugaagaauauaaacgcuccgggauacuugagguagauagaacggaagcgaaaagugcccuaagagauggaucaaaaauaaaauacgcaguuaguaggggguccaguaagauaagauggauaguagaacgaggaaugaucaaaccaaaagguaaaguaguagacuuaggaugcgggcguggcggauggucauauuacauggcuacgcuuaagaauguaacagaaguuaaaggauauacaaaagguggucccggucacgaagaacccauacccauggcgacguauggauggaaucugguaaaacugcacucaggaguagauguauuuuacaagccuacggagcaaguagauacuuuacugugcgacauaggagagucgucauccaaccccacaauagaagaggggagaacauuaagaguuuuaaaaaugguagaacccugguuaucuucuaaacccgaguucugcauaaaagugcugaacccguauaugcccacagucaucgaagaauuggagaaauugcaaaggcgucauggagggucauuagugagguguccucuaagccguaauuccacacaugaaauguauuggguaucgggggcauccggcaacauaguuucuucaguuaauacaauuaguaaaauguuauuaaaccgauuuacaacaagacaucgaaagccaacguaugaaaaggacguagaucuaggggccgguaccaggucaguuaguacggagaucgaaaaaccggacaugacuauuauagguagaagacuacagagacuccgcgaagaacauaaagagacguggcauuaugaccacgagaacccuuacagaacaugggccuaccauggcucuuaugaagcccccagcaccggauccgcuaguagcaugguaaacgggauuguaaaacuccugacuaaaccuugggaugucauaccaauggucacgcaacuggccaugacagacacaacacccuuuggacaacaaagaguauucaaagagaaaguugauacucgcacgccgcaacccaaaccuggcacaagaaugauaaugacaaccacagcaaauugguugugggcacuuuuggggaagaagaaaaguccgcggcuuugcacaagggaagaauuuauuucaaaagucaggaguaacgcugcaauaggagcgguuuuccaagaagaacagggauggacuucagcaagcgaagcgguaaacgauagccgguuuugggagcuaguugauaaggaacgagcccuacaucaagaggggaagugugaaucuuguguguacaauaugauggggaagagagagaagaagcugggugaauuuggacgugcaaagggaucaagagcgauaugguauaugugguugggagcucgauuuuuagaauuugaagccuuaggauuucuaaacgaagaucauugguuuucaagagaaaacagcuggagcgggguagaaggagagggauuacauaggcucgguuacauuuuggaagacaucgacaagaaagauggcgauuuaauuuaugcggaugauacagcugguugggauacgaggauuacagaagacgaucuauugaacgaggaacuaauaacagaacaaauggcaccucaucauaaaacauuagcuaaagcuauuuuuaaacucacguaccaaaacaaaguagucaaaguccugagaccaacaccaaaaggggcaguaauggauauaauauccagaaaagaucagagaggcucaggccaaguggguacauauggucuaaacacauuuacuaauauggaaguucaacucauaagacagauggaagcagaaggaguaauaacacaggacgauaugcaaaacccgaaagguuuaaaagagaggguggaaaaguggcugaaagaaugcgguguggaccgguuggaaaggauggcgauaucgggagacgacuguguaguaaaaccucuagaugaaagauuuaguacaucuuuacucuucuugaacgauaugggcaagguucgcaaggacaucccccaaugggaaccaaguaaagguuggaaaaauuggcaagaagugccauuuugcucucaucauuuccacaaaauuuuuaugaaagacggcagaucauuaguaguaccuugcaggaaucaagacgaauuaauaggcagggcaagaaucucacaaggagccgguuggagcuuaagagagacugcaugccuagggaaggcuuaugcucaaaugugguuacucauguacuuccauagaagagaucuaagauuggcgaguauggccauuuguagugcagugcccacagaaugguucccuacaucgcggacaacaugguccauacaugcacaccaucaauggaugacaacugaagauauguugaagguauggaacaggguauggaucgaagacaaccccaauaugacggacaagacuccgguccacucuugggaagacauaccauaucuaggaaaaagagaggaccuuuggugugggaguuugauaggccugucgagcagggccacuugggcaaagaauauacauacugccauuacucaaguacguaaucuaauuggaaaggaagaauauguggauuauaugccugcuaugaaacgcuacucugcgccauuugaaucugagggcguacuauga

SEQ ID NO: 23662 - RNA, 9867 nt, Artificial Sequence
  derived and/or modified CDS sequence (opt6) from DENV-4__KC762699__SS-prME
ucgacaaugacccuucuaugucuuauaccaacugugauggccuuucaccuuucgacaagagacggggaaccacuaaugauuguagcuaaacaugagagagguagaccgcuacuuuuuaaaacaacagagggcaucaacaaaugcacucuuauagcgauggacuuaggugagaugugugaagauaccguuaccuauaaauguccucuuuuaguuaacacugaaccugaagauauugacuguugguguaaucucacaucaacuuggguaauguacggaacauguacgcagucaggagagaggagaagagagaaaagaucgguggcuuuaacuccccauuccgguaugggucuagaaacgagggcagagacauggaugaguagugaaggagcuuggaaacacgcccagcggguugaaagcuggauucuaagaaauccggguuuugcacuccuggcaggcuuuauggcauacaugauuggacagacuggaauccagaggacagucuucuucguucuuaugauguuagucgccccauccuauggaaugcgcugcguaggaguaggaaauagggauuucguagaaggagugucaggaggugccuggguagaucucguccuagagcacggaggaugugugacaacgauggcucaggguaaaccaacuuuagacuuugaacugaccaaaacaacagccaaagaagucgcuuuacugcgaacuuacuguauugaagcuaguauuucgaacauuaccacugcuacucgauguccaacucaaggugaacccuaucucaaagaagaacaggaccaacaauacauuuguaggagggacguaguagaucgcgggugggguaacgggugcggcuuauucgggaaagguggagugguaacaugcgccaaauuucugugcaguggaaaaauuacagggaacuuaguccaaauugaaaaucuagaauauacaguaguagucacuguacauaauggcgauacccaugcaguaggcaaugauacuucaaaucauggagucacagcaacuauaacaccacgaaguccaucaguugaagucaaauuaccagauuauggggaacuaacauuagauugcgaaccccgaucaggaauugauuucaacgaaaugauucuaaugaaaaugaaaaaaaaaacguggcuuguccauaaacagugguuuuuagaucucccuuugccuuggacggcgggagcugauacuagugaagugcacuggaauuauaaagaacgcauggugacauuuaagguuccacacgcgaaacgacaggauguuaccguguuaggaucucaagagggagcaaugcauucagccuuggcuggagcgacagaaguagauaguggcgaugguaaucauauguuugcuggacauuuaaaauguaaaguaagaauggaaaaauugagaaucaaggguaugaguuauacuauguguucagggaaauuuucgauugauaaggaaauggcugaaacccaacaugggacaacaguaguuaaaguuaaauacgaaggagcuggugcgccauguaaaguacccaucgagauaagagacguaaauaaggaaaagguggucggacguauuaucucuucaacgccguuugcugagaacaccaauucuguuacaaauauagaauuggaacccccauuuggagauucauauauaguaauaggggucggggacucugcacucacacugcauugguuuaggaaaggaagcucuauaggaaaaauguucgaaucuacguauaggggagccaagcgaauggcgaucuugggggagacggcaugggauuuugguaguguugguggucuauucacuaguuuaggcaaagcuguacaucaaguauuuggaaguguauauacaacuauguucggcggaguaucauggaugauucgcauuuuaauugguuuuuuaguauuauggauagggacuaauagcaggaauacaucgauggccaugacgugcaucgcaguugguggaauaacguuauuuuuaggguuuacaguucaggcugacaugggauguguaguauccuggaauggaaaggaauugaaauguggaucaggcauauuuguagucgauaauguacacaccuggacugagcaguacaaauuucaaccagaaagcccggcuagauuggcaucagcuauacucaaugcacauaaagauggaguaugugguauaagauccaccacgcgauuagaaaacguaauguggaaacaaauaacuaaugaauugaacuaugucuugugggaggggggacacgaccuaacaguuguugcuggugacguuaaaggagucuugacuaagggaaaacgcgcgcucacuccaccuguuaacgaccuuaaguauagcuggaaaacaugggggaaagcuaaaauuuuuacaccugaagcgagaaacaguacauuuuuaauugacgggccagauacaucagaaugcccuaacgaacgucgagccuggaauuucuucgaagucgaagauuacggauuuggaauguucacaacuaacaucuggaugaaauuccgggaagguagcucugaggugugugaucaccgcuuaaugucggcggcaaucaaagaccaaaaagcaguacacgcugauaugggauauuggauagaaagcucaaaaaaucaaacauggcaaaucgaaaaagcaagucuuauugaagucaaaacgugucuguggccuaaaacacacacacuauggucaaauggcguacuagaaucucaaauguuaauuccgcgaucguaugcaggaccuuucagccaacacaauuaucggcagggauacgcuacacaaacugccggucccuggcaucugggaaaacucgaaauagauuuuggugaguguccgggaacuacaguaacuauucaagaagauugugaucaucguggaccgagccuaaggacaacuacagcaucgggcaaguugguaacccaguggugcugcagaucuuguacaaugcccccgcuccguuuuuugggugaagacggguguugguauggcauggaaauaagaccuuuguccgagaaggaagaaaacaugguuaagagucaaguaaccgcgggccaagguacuuccgaaacuuucuccaugggauugcuaugccuuacauuguuuguagaagaaugucuacguagaagaguuaccagaaaacauaugauauuaguagugguuauaacguucugugccauuauccucgguggacuuacuuggauggacuuauugagggcucucaucaugcuuggggacacaaugucggggagaauaggaggacaaauucauuuagccaucauggcaguuuuuaaaaugucaccaggcuacgucuuaggcguguuuuugaggaaguuaacaucuagagaaacagcuuuaaugguuauugggauggccaugacaacaguauuuucaauaccucaugaauuaauggagcuaauagauggaauaagcuuaggacugauucugcuaaagaucguaacacauuuugacaauacucaagucgggacacuggcacuaagucuaacauucauucgauccacaaccccacugguaauggcguggcgaacaauaauggccguauucuucguagucacccuaauccccuuaugucguaccucauguuugcagaaacaaagccauuggguggaaauuacagcacugauucuuggagcccaagcgcuacccguguaccuaaugacauuaaugaaaggagcaagcagaagaucguggccauugaacgaaggaaucauggcagucggucucgucucgcuauuggguucugcacuuuuaaaaaaugauguaccgcuagcugguccuauggucgcuggaggacuauuauuagcggccuauguaaugucuggaagcuccgcggaccuaagucuagaaaaagcggccaaugugcagugggaugaaauggcagauauaacgggcucaucucccauaauagaggucaagcaagaugaagacgguucuuuuucaauaagggacguagaagaaacaaauaugaucacuuuauuaguuaaacuagcccucauaacuguaucgggacuauauccacuagcgauaccuguuacuauggcauugugguauguuuggcaagugaagacacaacggaguggagcuuuaugggacgugccaagcccagcugcuacacagaaagcuacuuuaucugaaggaguauaccguauaaugcaaagggguuuguuuggcaagacacaaguaggcgucggaauucacauggaagggguguuccacacaauguggcauguaacgcgaggaaguguuauaugucaugaaacaggaagacucgagccuucaugggcggacguucgcaacgauaugauuagcuaugguggaggauggaggcuaggagauaagugggacaaggaagaggaugugcaaguccuugcaaucgaaccagggaaaaauccuaaacauguccagacaaagccagguuuguuuaagacauuaacaggugaaauuggggcaguaacgcucgauuuuaaacccgguaccuccggaucuccuauuauaaauaaaaagggaaaagucauagggcuauauggaaauggaguuguaaccaaaucaggagacuacguuucggcaauaacacaagcagagcggauaggagaaccugacuaugaaguugaugaagauaucuuucgaaagaaacggcuuacaaucauggaccugcacccgggugcagguaaaacaaaacguauucuuccaucaauuguacgugaagcgcugaaacgacgacuacgcacauuaauuuuggcuccaacucgaguugucgcugcggaaauggaagaggcauuaagaggacuacccauacguuaucaaacuccagcgguuaaaagugagcauacaggccgagaaauagucgaucuuaugugucacgcuacguuuaccacccgcuuguuaucaaguacucgggugcccaacuauaaucuuauagugauggacgaagcgcauuuuacagaucccugcucuguggcugcaagaggauauauaucgacacgagucgaaaugggcgaagccgcagcaauuuuuaugacagccacccccccaggcagcaucgauccguuuccucagucgaauucgcccauugaagauauagagagagaaaucccagaacguagcuggaauacaggguuugauuggauaacagauuaccagggaaaaacggucugguucgugccauccauuaaagcagggaacgacauagcuaauugucucagaaagucagguaaaaggguuauacaauuaucacgaaaaacuuucgauacagaauacccaaagacaaaacuaacagauugggacuucguuguaaccacggacauuagcgagaugggagcuaauuuuagagcgggucgagucauugauccgaggcgaugcuuaaaaccugugauucuaaccgacggaccugaaagagugauauuagccggaccuaucccaguaaccccggccagugcggcacaaagacguggccguaucgguagaaauccagcgcaggaagacgaccaauacguauuuucaggggauccuuuaaaaaacgaugaagaccaugcgcauuggacggaggcaaaaauguuauuagauaacauuuauacccccgagggcauaauaccaacauuguuugguccugaacgagaaaagacacaggcaauagacggggaauuccgccuuaggggagagcagcgcaaaacguuuguagaacugaugagacgaggagacuuaccugucuggcuaucauacaaaguggcuuccgcaggaauuucuuauaaagaccgcgaaugguguuuuacaggagagcgcaauaaccaaaucuuggaggagaauauggaaguagaaauuuggaccagagaaggagagaagaagaaacuaaggcccaaauggcuagacgcuaggguauaugcagauccaauggcucuuaaagacuucaaggaauuugcaagcgguaggaaaucgauuacauuagauauacuaacugaaauagccacucuuccaaccuaucuuagcucaaaagcaaaacuagccuuagacaauauagucauguuacacacaacggaaaagggaggaagagcguaccaacaugcucuaaacgaacugccugagucacuggaaaccuuaauguuaguagcguuacuaggagcaaugacagcagggauauuucuauucuuuaugcaaggcaaaggaauaggaaagcugagcaugggucuuaucgcaauugcaguagcaaguggauuacuuuggguagcggaaauacaaccgcaguggauugcagcaucgauaauuuuagaauucuucuuaauggugcucuuaauaccagaaccggaaaaacagagaacuccacaggauaaucagcuaauauacguuauauuaacaauauugaccauaauaggacuuauagcggcgaaugaaaugggucucauagaaaagaccaaaacggauuucggauuuuaccaagucaaaacggaaacuacaauacucgauguagacuuacgaccugccucugcauggacauuguaugcaguugcuacaaccauccuaacuccaaugcugagacauacuauagaaaauacuucugcaaaucucagccuggcagcuauagcaaaccaagccgcggugcucaugggccuagguaaggguuggccauuacaucggauggacuuaggaguaccauuacuagcgauggguugcuauucucaaguuaacccaacaacacuuacugcaucuuuaguaaugcuauuaguucauuaugcuauaauaggccccgggcuucaggcuaaagcaacaagagaggcacagaaacguacagcagcagguauaaugaaaaauccaacuguagacggcauaacugucauugacuuggaacccauuucauaugauccaaaauucgaaaaacagcucggacaaguuauguuguuggucuuaugcgucggacaacuguuauuaaugaggacaacaugggcacuaugugaaguuuuaacgcucgcgacgggacccguaaugacacuaugggaggggaaucccgggagauucuggaauacaacuauugcgguaagcaccgcaaacaucuuccgaggaaguuaccuagcgggagcgggguuggcuuucaguuuaaucaaaaacgcgcagacaccgagaagaggcacgggaacaacaggugaaacucuaggggagaaauggaaacgacaguuaaauucauuagaucguaaagaauuugaagaauacaaacguucagguauucuugaaguggaccggacggaagcuaaaucagcgcuaagagauggaucuaaaauaaaguacgcgguaaguagaggaaguaguaagauaagguggauaguugagaggggcaugauuaaacccaaagggaaaguagucgaucuuggguguggaagaggugguuggucuuauuauauggcgacuuuaaaaaacgugacugaaguaaaagguuacacaaaagguggcccuggacaugaagagccaaucccaauggcaaccuaugguuggaacuuaguuaaacuacauucuggagucgaugucuucuacaagccaacagagcaagucgauacauuacucugcgacauaggagaaaguuccaguaaucccaccaucgaagaagguagaacauuacgagugcuaaagaugguugaacccuggcuuucaucaaagcccgaguuuuguauaaaaguuuuaaacccuuacaugccuacaguuaucgaagaguuggaaaagcuucaacgcaggcacgggggcagucuaguucgcuguccacuaucgcgcaauucaacccacgaaauguacuggguaagcggcgccucugguaauaucgugagcuccguaaacacaauuagcaaaauguugcuuaauagauucacuacaagacauaggaaacccacguaugagaaagacguggaccuuggagcagguacacguucgguuucuacugaaacggaaaaaccugacaugacuauaauuggucgaaggcugcagagguuacgcgaagaacacaaagagacuuggcauuacgaucaggagaauccauacagaacuugggcuuaccauggcucuuacgaagcucccuccacagggagcgcgaguucaaugguaaauggcguaguaaagcuucucacgaaacccugggaugucauuccaaugguaacucaacuagcaaugaccgacacuacaccauucgggcagcaacgaguauucaaagaaaagguagacacccguacuccgcaacccaaaccaggaacuagaaugaucaugacaacgacggcaaacuggcuaugggcucuucucgggaaaaaaaaaagccccaggcuuuguacgagagaagaauuuauaucaaaaguacgcaguaaugcagccauuggggcaguguuucaagaggaacagggauggacuagugcgucagaagcuguaaacgauucacgauuuugggaauuaguagacaaggaaagagcauugcaucaagaaggaaaaugugaaaguugcguuuacaacaugauggguaaaagagaaaaaaagcugggagaauucggaagagccaaagggucaagggcaauaugguacauguggcugggagcucgguuuuuggaauuugaagcguuaggcuucuuaaaugaagaccacugguucucacgugaaaauucuuggucuggaguagaaggagagggacuacaucgauugggcuacauacuugaagauauugauaaaaaagauggagaccucauauaugcugacgacacagcggggugggauacaaggauaacagaggaugauuuacugaaugaagaauuaaucacugaacaaauggcuccacaucauaaaacguuagcaaaagcaauauuuaaacuaacguaccaaaacaaagucguuaaaguauuaaggccgacucccaaaggcgcgguaauggauauuauaucucggaaggaccaaagagguucaggccaaguagggaccuauggauuaaauacuuuuaccaacauggaaguacaacugauucgacaaauggaagcugagggaguuaucacgcaagaugauaugcaaaauccaaaggggcuuaaagagcgaguagaaaaauggcuuaaagaguguggcguagauaggcuaaagagaauggcaauaucaggugacgacuguguagugaagccuuuagacgaaagauuuucaacuagccuccucuuccuaaacgacaugggcaaagucagaaaggacauaccacagugggaaccuucuaaaggauggaaaaacuggcaagaaguaccuuuuuguucucaucauuuucauaagauuuucaugaaagacggacgcucacuaguuguuccuuguagaaaccaagaugaacuuauaggucgagcccguaucucucaaggggcaggauggaguuuacgggagaccgccuguuugggaaaagcauaugcgcaaauguggaguuuaauguauuuccauaggcgagaucuuagacuagcauccauggcaauauguagcgccguacccacggagugguucccuacuucacguacuacauggucuauacaugcacaucaucaauggaugacaacagaggauauguuaaaaguauggaacagaguuuggaucgaagauaauccgaauaugaccgauaaaacaccggugcauucaugggaagauauaccuuaccugggaaaaagagaggaccuuugguguggaucauugauaggccuaucaucacgugcuaccugggcuaagaacauccauacggccauuacacaagugcgcaaccuaauaggaaaagaagaauaugucgauuauaugccugcaaugaaacgguacucagcuccauuugaaagugagggaguguuauga

SEQ ID NO: 23663 - RNA, 9867 nt, Artificial Sequence
  derived and/or modified CDS sequence (opt6) from DENV-4__JQ915085__SS-prME
aguacaaugacucuauuaugccuuauuccuacaguaauggcuuuucaucuaagcacuagagauggggaaccauugaugauuguggcgaaacacgaacgaggaagaccauuacuauuuaaaacaacagaaggaauaaacaaaugcacauuaauagcaauggaccuuggcgaaaugugugaagauacaguaacuuacaaauguccacuauuaguuaauacagaaccggaagauauagacuguugguguaacuuaacuagcacguggguuauguauggcacguguacacaaaguggagaaaggcgcagagagaaaagaucuguagcccuaacaccucacagcgguaugggauuggaaacacgagcagaaacuuggaugaguucagaaggagcauggaaacaugcacaacgaguagaaaguuggauacuucgaaauccuggauucgcacuguuggcggguuuuauggcauacaugauugggcaaacugguauucaacggaccgucuucuuuguucuaaugauguugguagcaccguccuaugguaugcgguguguaggaguugguaaucgggacuucguagagggaguaucagguggggcgugggucgaucucguguuagaacacggaggauguguaaccacgauggcccaggguaaaccuacacuugauuuugaacuaacuaaaacuacagccaaagaaguagcacuguuaagaacauauuguauagaagcaucuauauccaauauaacuaccgcaacucgcuguccaacacaaggagagcccuauuugaaagaagaacaggaccaacaauauauuugccgacgcgauguagucgauaggggauggggcaacgguugcggccucuuuggaaaaggagggguuguuacuugcgcuaaauuucuaugcaguggaaaaauaacgggaaacuuaguccaaauugaaaauuuagaauauaccguuguuguaacaguucauaacggugauacacaugccguaggaaaugacaccucaaaucacggcgucacagcaacgauaacaccacgcucaccgucaguagaaguaaaauuaccugauuacggggaauuaacauuagacugcgagccgcgaagcggaauugauuuuaaugaaaugauauuaaugaaaaugaagaagaaaacaugguugguacauaaacaaugguuuuuggacuuaccauuaccuuggacugccggggcugauaccagugaaguucacuggaauuauaaagaaagaaugguaaccuucaaaguaccgcacgccaaaagacaggauguaacugugcuagggagucaagaaggagcaaugcauucggccuuggccggagcuacugaaguggauagcggugacggaaaucauauguucgcuggacaccuuaaaugcaaaguacguauggaaaaacuacgcauaaagggcaugucuuauacaaugugcucagguaaguucaguauagauaaggagauggcugaaacgcaacacgguacaacggucgugaaagucaaauacgagggcgcaggagcaccaugcaaaguucccauugaaauacgugacgucaacaaagaaaagguuguuggacgaauaauaaguucaacaccauuugcugaaaauacgaacagcguuacaaauauagaacuagagccaccauucggagauucguauauugucauaggugugggcgauucugcuuuaacauuacauugguucagaaaagguucgucuauagggaaaauguuugaaagcacuuauaggggugcaaagaggauggccauuuugggagaaacugccugggacuuugggucgguggguggccuauucaccucuuugggaaaagcgguccaccaaguauucggauccguuuauaccacgauguucggggguguaaguuggauuauacggauuuugauaggcuuucugguacucuggauaggcacuaauuccagaaauacuucaauggcaaugacauguauagcuguuggugguauaacacuuuuucugggauuuaccguacaagcugauaugggauguguaguaucauggaauggaaaagaauugaaauguggaucuggaauauucguugucgauaacguucacacuuggacggaacaauauaaguuucaaccagaaucuccggcaaggcuagcuucagcgauauuaaaugcacauaaagacggagucugcggaauccgauccacgacgagauuggagaauguaauguggaagcaaauaacuaaugaauuaaauuauguccuuugggaagggggccacgaucuaacgguaguugcaggggacguuaaaggugugcucaccaaaggaaaaagagcucuuacaccuccgguaaacgaccucaaauauucuuggaaaacuugggguaaggcaaaaauauuuaccccagaagcgagaaauagcacguuucugaucgauggccccgauacauccgaaugcccaaacgagcgccgcgcauggaauuucuuugaaguugaggauuacgguuuuggcauguucacuacgaauauuuggaugaaauucagagaaggaaguagugaaguaugugaucaucgccucaugucugcagcuauuaaagaccaaaaagcgguucaugccgauaugggauauuggauagagagcucgaagaaccaaacauggcaaauugaaaaagcuaguuuaaucgagguaaaaacuugcuuauggccgaagacacacacacucuggucuaaugguguuuuggaaucacaaauguuaaucccccguucuuaugccggaccauuuucacaacauaauuaccgacaaggauacgcgacccagaccgcaggucccuggcauuuaggaaaauuagaaauugacuucggagaauguccaggaacgacggucacuauucaagaagauugugaccacagaggccccucucuucguacuaccacagcgagcggaaaauuagugacacaauggugcugcaggagcuguacgaugccaccucuccgcuucuuaggcgaagacggaugcugguauggaauggaaauaaggccacuaagugaaaaagaagagaauaugguuaaaagucagguaacagccggacaaggaacgucggagacguuuucaaugggauuacuuugccuaacucuuuuuguagaggaaugccuuagacguaggguaacaagaaaacauaugauucucguaguuguaauuacuuuuugugcgaucauauuaggaggauuaacauggguagauuuacuaagagcuuuaauaaugcuuggugauacaaugaguggaagaaucgggggacaaauacauuuagcgauaauggcuguauucaaaaugucaccaggauauguucuuggcguauuccuucguaaauugacuucacgagaaacugcccucauggugauagguauggcaaugacaacaguauucucuaucccuagggauuuaauggaauuaauagauggcaucuccuugggcuugauauuauuaaagauagugacgcauuucgauaacacccaaguugggacgcucgcauugagucucaccuucaucagaagcacgacaccccuaguaauggcguggcgcacaaucauggucguauucuuuguuguuacgcuaauaccacucugucgcacaagcugcuuacagaaacaaucacauugggucgagauaacagccuugauacuuggagcacaagcauuaccgguguauuuaaugacccuaaugaagggagccuccagaagaucuuggccucucaaugaagguaucauggcaguuggucuagugaguuuguuaggaucugcacugcucaaaaaugaugucccacuagcuggaccaauggucgcuggagguuuacuccuagcagcauauguaaugagcggaagcucggcugaucuaucuuuagaaaaagccgcaaacgugcaaugggaugaaauggcagauauuacggguaguucgccaauaaucgaaguuaaacaggaugaagaugggagcuuuuccauaagagacguagaagaaacaaauaugauuacucuccucguaaaacucgcucucauaacugucucgggauuauacccguuagcgauuccgguaacaauggcacugugguauauauggcaagucaaaacacaacggaguggagcauuaugggaugugccaucgccagcggcaauacaaaaggcgacucuauccgaaggaguguacaggaucaugcaaaggggccuauuugggaagacgcagguuggugucgguauucacauggaaggaguauuucacacgauguggcacguaacacgggguucuguaaucugccaugaaaccgggagauuagaaccaagcugggcggacgucagaaacgacaugauuucauacggcggaggauggagauugggcgacaaaugggauaaagaggaggauguccagguccuugcuauagaacccggcaaaaacccuaaacacgugcaaacuaagccaggcuuauuuaaaacuuugacaggagaaauuggggcaguaacacuugauuucaaaccaggaacuagcggaucacccauuauuaauaagaaagggaaaguaauuggacucuacggcaacggagucguaacaaagagcggagacuaugugucugcaaucacccaagcagagaggaucggcgagccugacuaugaagucgaugaagauauuuuucgaaagaaacguuuaacaauuauggaucuucauccuggugccgggaaaacaaaaagaauuuuacccucgauaguaagagaggcuuuaaaacgccgguuaagaacacuaauauuagcuccaacaaggguagucgcagcagagauggaagaggcccuuaggggauuaccgauuagauaccaaacuccugcaguaaaaagugagcauacagggcgagaaaucguagaccuaaugugucacgcaacauucaccacgagguuacuaucaaguacaagaguaccgaacuauaaccugauuguuauggaugaggcucacuuuacugauccaugcucgguagcagcucguggcuacauaucuacucgcgucgagaugggcgaagcagcggcuauauuuaugacagcgacaccuccugggagcauagauccguucccacagucuaacagccccauagaagauauagaaagggaaaucccggaacgaucuuggaauacuggcuucgacuggauuacagauuaucagggaaaaacggucugguucguaccaucaaucaaagcgggaaaugauauagcaaacugucugcggaaaagugguaaaaaggugauacaauuaagccgaaaaacauucgacacagaauaccccaaaacaaaacuuacagauugggauuucgucguuacgacagacauuucagaaaugggugcaaauuucagggcaggaagaguuaucgacccuagaagaugucugaaaccuguaauauuaacggauggaccagaaagagucauucuagcaggucccauacccgugaccccagcuucggcggcacaacgaagaggucgaauugguagaaauccagcacaagaagaugaucaauauguauuuucaggagacccacucaaaaacgaugaagaucaugcacacuggacagaagcgaagauguuacuugauaacauauauacacccgaaggaauaauacccacauuauucgguccagagagagagaaaacucaagcuauugauggugaguucagacugaggggugagcaacgaaaaaccuuuguagaauuaaugcgaagaggagauuuaccuguguggcuaucguauaaaguagcuagcgcagguauuaguuauaaagacagggaaugguguuucacaggggaacggaauaaccaaauacuagaagaaaauauggaggucgaaauuuggacucgugaaggggagaagaagaaauuaagaccaaagugguuagaugccaggguguacgcggaccccauggcauuaaaggauuucaaagaauuugcaucgggacgaaagucgauaacucuggauauauuaaccgaaauagccacauuaccaacguaccugagcucaaaggcgaaauuagcacuagacaauauuguaaugcuccauacggcugaaaaaggagggcgugcguaccaacaugcguuaaaugaauuaccagaaaguuuagaaacacuuaugcuuguugcuuugcuuggcgcaaugacagcaggaauuuuucuguucuuuaugcaaggaaaagggauagguaaauuaagcaugggccuuauagcaauugcaguagcaucaggcuugcucuggguugcugaaauccaaccacaauggauagcagcaucuauaauuuuagaguucuuucuaaugguguuauugauaccagaacccgaaaagcaaaggacgccacaagauaaccaacuuauuuauguaauuuuaacaauucuaacaauaauagguuugaucgcagcaaacgaaaugggguuaaucgagaaaacgaaaacagacuucggguuuuaucaaguaaaaacggaaacaacgauauuagauguagaccuucgcccagcgagcgcguggacacuauaugcagucgcgacaaccauacuaacuccgauguugcgacauacaauagaaaacaccucagcgaaccuuagcuuagcagcuauugcgaaucaagcagccguucuaaugggauuagguaaaggcuggccccuucacagaauggaccuuggcguuccacuauuggcaaugggguguuauagccaaguuaauccgacaacucuaacagccucacuugugaugcuuuuagugcauuaugcaauuauagguccuggccuacaagcuaaagcuacaagggaagcacagaagagaacagcggccgguauaaugaagaauccaacaguugacgguaucacugugauagaccuagagccaauaucuuaugauccaaaauuugaaaaacaacucggacaaguaauguuguuaguauuaugugucggacaauuacuucuuaugagaacaacaugggcacuaugugagguccuuacauuagcaaccggaccgauaaugacacucugggaaggcaacccuggucgauuuuggaauacuacuauugcuguuucaaccgccaauauauuucgaggaucauaccuagcaggcgccggucuugcuuuuagcuuaauaaagaaugcacaaacaccacgacgggguacaggaacgacaggggagacucuuggcgaaaaauggaagagacaguugaacucauuagacagaaaggaauuugaagaauauaaacgcaguggcauacuagaaguugaucgaacugaagcuaagucugcucuacgugauggcuccaaaauuaaacaugcagugagccgaggaaguucuaaaauaagauggauagucgaaaggggaaugauaaaaccuaaggguaaaguaguagauuuaggguguggucgcggugguuggagcuauuacauggccacucuuaaaaacgugacugaaguaaaaggauauaccaaaggcggaccuggacacgaggagccuauuccaauggcgaccuacggcuggaauuuagugaaauuacacagugggguggauguguuuuacaagccuacagagcaaguagauacauuacuuugugacauuggagaguccucguccaacccaacgauagaagagggucgcacauuaaggguacuaaaaaugguagaaccauggcugaguagcaaaccugaauuuuguauaaaggugcuaaauccguauaugccuacuguaauagaagaauuagagaagcuccaacggaggcauggugguagccuugugcgguguccauuaucuaggaacucuacucaugaaauguacuggguuaguggugcauccggaaauauaguuaguagcguaaacaccauaucaaaaaugcuacuuaaucgguuuacaacacgacaccgaaaaccaacguaugagaaagauguagaucugggugcggguacacguucagucucgacagaaaccgaaaaacccgauaugacuauaaucgggcguagacuacaacgauugcgcgaagaacacaaagaaacuuggcacuaugaucaagagaaucccuacagaacaugggcauaucauggaucauacgaggcaccaagcacaggaagcgcauccucuaugguaaacggcgugguuaaacuucuuacuaaaccuugggaugucaucccaauggucacacaacuggcaaugacagauacaaccccauucggacagcaaagaguuuucaaagaaaaaguugauacgcguacaccucaaccaaaaccaggaacuaggaugaucaugacuaccacggcaaacuggcucugggcucuauuaggcaaaaagaagaguccacgucuauguacgcgugaagaauuuaucaguaagguaagaaguaacgcggcuauuggagcgguauuccaggaagaacaagguuggacaagugcgucagaagcgguuaacgacucacgguuuugggaacucguugacaaggagcgggcucugcaucaagaagggaaaugugaaucaugcguuuauaacaugauggggaaaagagagaagaaacuuggagaguucggucgcgcaaaagguagcagggcaaucugguacauguggcugggcgcgcguuuucuagaauuugaggcuuuaggauuucuaaacgaggaccacugguucagccgcgagaauaguuggaguggaguagaaggagaaggacuccacagguugggauauauauuagaagacauagacaagaaagacggggacuugauuuacgcugacgauacugcugguugggauacaagaauuacagaagacgaucuauugaacgaagaacugauuacagagcaaauggcaccacaucauaaaacauuggcaaaagcgauauuuaaacuuaccuaucaaaauaaaguagugaaaguacuaagaccaacaccuaaaggagccgugauggauauaauauccagaaaagaccagagggguuccggacaagugggaacguauggacugaauacguucaccaauauggagguucaauuaauucggcagauggaggcagaagggguaauaacgcaagaugacaugcaaaaccccaaaggccuaaaggaacgggucgaaaaauggcuaaaggagugcggagucgauaggcuaaaaagaauggcaauuucuggggacgacugugugguaaagccauuggaugagagauucagcaccagccuucuuuuucuaaaugauauggggaagguacgaaaagacauaccucaaugggaaccuucaaaaggcuggaaaaauuggcaagaggucccuuucugcucacaccacuuucacaaaauauuuaugaaagacggucgaagucugguagugccuuguagaaaucaggaugaauuaauagguagagcaagaaucucacaaggagcugguuggagucuucgagagacagcuugccuugggaaagcauacgcacaaauguggucucuuauguacuuccacagaagggauuuaagacucgcaaguauggcgauauguucagcaguuccaacugaaugguuuccaaccucucguaccaccuggucaauucaugcacaucaucaguggaugacgacagaagauauguuaaaagucuggaaccgaguuuggauagaagacaauccuaauaugacugauaagacgccaguacauucaugggaagauauucccuauuuaggaaaaagagaagaucuuugguguggaucacuaauaggacuaagcucucgagcuacaugggcuaaaaacauacauacggcaaucacccagguccgaaaccugaucggaaaagaggaguacguugauuacaugccugcuaugaaacguuauuccgcacccuuugaaucagaagguguacuuuaa

SEQ ID NO: 23664 - RNA, 9867 nt, Artificial Sequence
  derived and/or modified CDS sequence (opt6) from DENV-4__JQ915088__SS-prME
aguacgaugacuuuacuuugccuaaucccaacaguaauggcguuccaucuuucaaccagagauggagaaccacuaaugaucguagcaaagcaugaaagaggaaggccucuucuuuucaaaacaacagaaggaauaaacaagugcacauuaauugcaauggacuugggugaaaugugugaagacaccguaaccuauaaauguccacuacugguaaauaccgaaccagaagauaucgauugcugguguaauuugacaucaacuugggugauguacgguacuuguacacaaaguggggaaagaaggcgcgagaaaagaagcguagcuuuaacaccacauucugguaugggauuagaaacccgggcagaaacuuggaugucgucagaaggagccuggaaacacgcccaaaggguugagagcuggauacuacgaaacccaggauucgcucuacuugccgguuucauggcuuacaugauagggcaaacaggcauucaaagaauuguauucuuuguauuaaugaugcuuguagccccaaguuacggaaugcgauguguagguguggguaacagggauuuugucgaaggugucucagggggagcauggguggauuuaguacuugaacauggagguugcguuacgacgauggcccaggguaaaccuacauuagacuucgaacugacuaaaaccacagcgaaagaaguagcucuauugagaacauauuguaucgaggcuucuauaagcaauauaacaacggcuacaagauguccuacacaaggagagcccuauuuaaaggaagaacaagaucaacaguauauuuguaggcgagaugucguggauaggggcuggggaaacggauguggucuauuuggaaagggaggaguagucaccugugcaaaguucuugugcagcggcaaaauaacggggaauuuaguucaaauagaaaaccuugaauauacgguugugguaacgguacacaacggugacacgcaugcgguagggaacgauacgucuaaccacgggguaacagcaacuaucacgcccagaucacccucagucgaaguaaagcugccggauuauggggaacucacccuagauugugaaccaaggagugguauagacuuuaaugaaaugauauuaaugaaaaugaagaagaaaacauggcuaguacacaaacaaugguuucuagaucuaccuuuaccuuggacugcuggagcugauacgagugagguacauuggaacuauaaagaacgcaugguuacguucaaaguaccacacgccaaacgucaagaugucaccguuuuagggucucaggaaggagcgaugcauucagcguuagcuggcgcaacagaaguagauucuggagaugguaaccauauguucgcgggucauuuaaaauguaaaguacguauggaaaagcuacgaauaaaaggaaugucauauacaaugugcucaggaaaauuuucuauugauaaagaaauggcagaaacacaacacggaacaacuguuguuaagguuaaauacgaaggcgcuggcgcaccgugcaaaaucccaauagaaauaagagauguuaacaaagaaaaagugguaggucggauaauuucuuccaccccauuugcagaaaauacuaauucaguuauaaacauagaacuagagccuccauucggcgauucuuacauagucauaggggugggggauucagcgcuaacacuacauugguuccggaaagguucauccauaggaaaaauguucgagucuacauaucguggggcuaagaggauggcaauucuaggagaaaccgccugggauuucggaucgguagguggccuuuuuacaucauuagguaaagcgguucaccaggucuucgggucaguauacacuacaauguuugggggaguaaguuggaugauucgaauacuuaucggauuuuuaguucuuuggauuggaacaaacucacguaacaccucaauggcgaugacauguaucgcagugggcggaauuacgcucuuuuugggcuuuacagugcaagcugauauggggugugugguuaguuggaauggaaaagaacucaagugcgggucagguaucuucguaguugacaauguccauacauggacagaacaauauaaauuccagccugaaucuccagcacgauuagcuagugcaauauugaacgcacacaaagacggcguuuguggaauuagaaguacuacacgauuggaaaauguaauguggaaacaaauuacuaacgaauuaaauuacgucuuaugggaagguggccaugaucuuacggucguugcgggggauguuaaaggagucuuaacaaaaggcaaaagagcacuuaccccgccggugaaugaucuuaaguacuccuggaaaaccugggggaaggcaaaaauuucgacaccagaagcucguaauaguacuuuccuaaucgaugguccugacacgagugaaugcccgaacgaacgcagagccuggaacuucuuugaaguugaggauuauggauuuggaauguuuacgaccaacauuuggaugaaauucagagaaggaucuucagaaguuugugaucacagauuaaugucagcggccauuaaagaucaaaaggcuguacacgcagauaugggauauuggauagaaucaagcaaaaaccaaaccuggcagauagaaaaagccucauuaauugagguaaaaacuugcuuauggcccaaaacccauacacucuggagcaacggcguucuagaaucacaaaugcuaauaccgcgcucuuaugcuggacccuuuucgcaacauaauuaccgucagggguacgcuacacagacggcggggccauggcauuuaggcaaauuagaaauagauuuuggagaguguccaggcacaacaguaaagauacaagaagauugcgaucaucgagguccuaguuuacggacuacaacugcgaguggaaaguugguuacucaaugguguuguagaucauguacaaugccuccccuaagguuuuuaggagaagacgguugcugguaugggauggagauuaggccccuaucugagaaagaagagaauaugguuaaaucccaaguaacggcuggacaagguacaucugaaacuuucaguaugggauuauuaugcuuaacauuguuuguugaggagugucuucgcagaagaguaacaagaaaacauaugaucuuagucguaguaauaacuuuuugcgcaauaauacuuggaggucucacuuggauggaucuacuaagagcacucaucauguugggggauacgaugaguggacggauagguggccagauacacuuggcuauuaugaccguauucaaaaugucaccaggauacguuuuagguguauuccuaagaaaacuaaccaguagagaaacggcacuuauggugauaggaauggcaaugacaacagucuucucgauaccccaugauuuaauggaauuaauugacgggauaagccuaggacuaaucuuauugaaaauaguuacccauuucgacaauacucagguugguacacuugcacugucauugacauucaugagauccacaacaccccuaguaauggccuggaggaccauaauggcaguguucuuuguaaucacauuaauacccuuauguaggacaucaugccugcagaaacaaucgcauuggguagaaauaacugcacuaauucucggagcacaagcucuaccuguauacuuaaugacacuaaugaaaggcgcauccaggaggagcuggccucucaacgaaggcauuauggcaguaggccuaguuucuuuguuagguucugcccuacucaaaaaugacguaccucuggccgguccaauggucgcuggcgguuuauugcuagcagcauauguuaugucagguuccagcgcagauuugucuuuagaaaaagcggcaaauguucaaugggaugaaauggcugacauaacagguucuagccccaucauagagguaaaacaagaugaagauggaucauucucuauacgugacguagaagaaacaaacaugaucacucuccuagucaaauuggcacugauuacuguaucuggcuuauauccccuagcgauaccuguuacaauggcccuaugguacauauggcaggucaaaacacaaaggucaggggcuuugugggacgucccaucgccagcugcaacgcaaaaagcaacauugucugagggagucuaccgcaucaugcaaagaggcuuauuugggaaaacacaaguugggguaggaauacacauggagggugucuuucauacaauguggcacguaacaaggggaucagugauaugucaugagacgggcagacuagaacccucuugggcugaugugcgaaacgauaugaucucuuaugguggaggguggcgauuaggagauaaaugggacaaagaagaagauguucaaguguuggccauugagccaggcaaaaacccacgccacguucaaacaaagcccggacuuuuuaaaacccucacaggggaaauaggagccgugacauuagauuuuaaacccgguacaucgggaagcccaauaauaaacaagaaaggaaaaguaauuggauuguauggaaacgggguuguaacgaaaucaggagauuauguuagugcuauuacacaagcagagcguaucggggaaccugacuaugaaguugaugaagauauauuuagaaagaaaagauuaacaauaauggaucuacacccaggcgcaggaaaaacuaaaaggauucuuccuucgauaguacgcgaggcuuuaaaacgucgucuacguacacuaauucuagcuccuacacgaguaguagcagcugagauggaagaggcacuaagaggauuacccauuagguaucagacacccgccgugaaaagugaacacacgggacgagaaaucguugaccuaaugugucacgcuacauucaccacccgguugcugucaucgaccaggguuccgaauuauaaucugauugucauggaugaagcucauuuuacugaccccugcucuguagccgcgcgagguuacauaaguacgagaguagagaugggggaagcagcugcaauuuuuaugacggcgacucccccaggcucgauugaucccuucccucagaguaacucaccuaucgaagauauagagagggaaauaccagagcgcaguuggaacacgggauucgacuggauaacugauuaucaagguaaaacagugugguucguuccaucgauaaaagcgggcaacgacauugcaaacugccugagaaaauccgguaaacgagucauacaacuuucucguaaaaccuucgauaccgaauauccuaaaacgaaacucaccgacugggacuuuguugugaccacugauaucuccgaaaugggcgcaaauuucagggccggacgagugauagauccucgucguugucuuaaaccuguuauauuaaccgauggcccagaacgaguuauccuagcuggaccaauaccaguaaccccagcaagcgcugcacaaaggagagggagaauagguaggaauccugcucaggaagacgaucaauacguauucucgggagacccauugaaaaacgacgaggaccaugcgcauuggacagaagccaagaugcuucuagacaauauauauacaccggaaggcauuauuccuacacuuuucggaccugaacgagagaaaacccaagccauugauggugaauuuagacuaagaggugaacagagaaaaacuuuuguagaauugaugagacguggugaccuaccaguaugguuaucauauaaaguagcuagcgccgguauaucauauaaagacagagaauggugcuuuaccggggaaaggaacaaucaaauucuagaagaaaacauggaaguugaaauuuggacuagggaaggagagaaaaagaaacuacgaccaaaaugguuagaugcgcgaguuuaugcggauccgauggcauuaaaagacuuuaaagaauuugcaaguggaaggaaaucgacaacucuagacauacuaacagagauagcaacccugccaacuuaccuaucaucgaaagcaaaacuugcauuagacaauauaguaaugcuacacacuaccgagaaaggggguagagccuaccagcaugccuuaaaugaauugccagaaucgcuagaaacguuaauguuaguagcguugcugggagcaaugacugcugggauuuuucucuucuuuaugcagggaaaaggcaucgggaaacuauccauggguuuaaucgcgauggcuguggcaaguggucucuugugggucgcggaaauucaaccgcaauggauugccgccucgauaauccuugaauuuuuccuaaugguguuauuaaucccagagcccgaaaaacaaaggacgccacaagauaaucaauugauuuauguaauauugacaauucuaacgauaaucggucuaauagcggcuaacgagaugggucucaucgagaaaacuaaaacugacuuuggauuuuaucaaguaaaaacugaaacaacaauauuagaugucgauuuaagaccagcuagcgcauggacacuauaugcuguugcuaccacaauccuaacaccuauguugcgacauaccauagagaauacaagugcgaaccuuucauuagcugccauagcuaaucaagccgcuguuuuaaugggacucggaaaaggcuggccacuacauagaauggacuuaggaguaccguuacuagcaaugggauguuauucccagguuaacccuacaacgcuaacagcgagucuggugaugcucuuaauucacuaugcaauuauuggcccgggccuccaagcaaaagcuacuagggaggcacaaaagagaacagcggcagguauuaugaagaaucccacaguugacggcauaaccgugauugaucuggaaccgauuuccuaugacccuaaauuugaaaaacaacuagggcaaguaaugcuccuaguuuuaugugucggucagcuucuucucaugagaacaacaugggcccuaugcgaaguacuaacguuagcgacgggacccaucaugacguuaugggagggaaacccagguagauuuuggaauacaacaauagcaguuucaacagcuaauauauucagggguaguuauuuggcgggggcaggacuugcguuuucucuaaucaaaaacgcucaaaccccgagacgaggcacuggaaccacaggugaaacucuuggggagaaauggaaacggcaacucaauucuuuggacagaaaagaguucgaggaguauaaacgaucagggauucuagaaguagauagaacugaagccaagucggcgcuacgugacgguucuaaaauaaagcaugcaguaucucguggaucaucuaaaauccgauggauagucgaaaggggcaugauaaaaccaaaagguaaaguuguagaccuuggauguggccgagggggaugguccuacuauauggcuacacuuaagaauguaacagaagugaaaggguauacuaaaggcggaccuggacaugaagaaccaauuccaauggcuacauauggauggaaucucguaaaauugcacucuggagucgacguauuuuauaaaccaacagaacagguugauacguuguugugcgauauuggagaaagcuccucaaacccuacaauugaagagggacgaacacuaaggauacuuaagaugguagaaccuuggcuaagcucuaaaccagaauuuugcaucaaaguauuaaaucccuauaugccuacaguaauagaagaacuugaaaaauuacaacgacgucacggaggcaguuugguuagguguccgcuaucacgcaauagcacacacgaaauguacuggguuucgggagcaucugguaacauuguuaguucaguuaacacuauuucuaaaauguuauugaaccgauucaccacaagacaucgaaaaccaacuuaugaaaaagacgucgaccuaggugcugguacaagaaguguuagcacugagaccgaaaaacccgacaugacaauaaucgguagaaggcuccaacgccuacaagaggaacacaaagaaacuuggcauuaugaccaagagaacccuuacagaacaugggcguaucacggcucuuacgaagcaccuucuaccgguagugccucuucuauggucaauggcguugugaaacuuuuaacaaaaccaugggaugucauacccaugguaacucaacuugcuaugacugauaccacaccuuucggacaacaacgaguauuuaaagaaaaaguugauacacgaacaccucaaccaaaacuggggacacggaugauaaugacgacaacggcaaauugguugugggcacuacucggcaagaaaaagucucccagacuuugcacaagagaagaauuuauuucuaaggugcgcagcaacgcggcuauuggugcuguguuucaggaggaacaagguuggacaucagcaagugaggcggugaaugacucacgguuuugggaauuaguggacaaagaaagagcauugcaccaggaaggaaaaugugaaucuugcguauacaacaugauggggaaacgggagaagaaauugggggaguucgguagagcaaaaggaucaagagcgauuugguauaugugguuaggugcccgauuuuuggaguuugaagcacuagguuucuuaaaugaagaccacugguuuucgcgggaaaauucguggucaggaguagagggggaaggucuucacagacuaggauauauuuuggaagauauugacaagaaagacggagacuuaauauaugcagacgacacagccgggugggacacaaggauuaccgaagaugaucuccuuaaugaagaguuaauuacugaacaaauggcgccucaucacaaaacucuggcgaaagcuauuuuuaaacuaacguaccaaaauaagguugugaaaguauugcgaccuacaccuaagggugccgucauggauauaauuaguagaaaagaucaaaggggaagcggucaagucgguacauaugggcuuaacacauucacaaauauggaaguccaacuuauaagacagauggaagcagagggaguaaucacucaagacgauaugcagaaccccaaagggcugaaagaacgcguagagaagugguugaaggaauguggugucgauaggcuaaaacgcauggcuauuuccggagaugacugcguugugaagccacucgaugaaagauuuagcacaagccucuuguuuuugaaugauaugggcaaaguucgaaaggaugucccucaaugggagccaaguaaaggguggaaaaacuggcaagagguaccauucuguucacaucacuuucauaaaauuuuuaugaaggauggcagaucccucgugguaccaugucggaaccaagaugaacucauaggccgggcucgaauuagccaaggagcuggcuggagcuugagagaaacagcauguuuaggaaaagcauaugcccaaauguggucacucauguauuuccaccgcagggaucuucggcuggccagcauggcuauuuguagugccguaccuacugagugguuuccuacaucccggacaaccugguccauucaugcacaacaccaauggaugacuacggaagacauguugaaaguguggaacagaguuuggauagaagauaaccccaacaugacagauaaaacaccuguacauucgugggaagacauacccuaccucggaaagcgagaagaucuauggugugguucacugauaggcuuaagcucaagggcaaccugggccaaaaauauucauacagccaucacgcagguacgcaaucucauaggaaaggaagaauauguagauuacaugccaguaaugaaaagguacucuagccccagcgaauccgaaggcguucuauaa
